United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 2

SEQ ID NO: 4562 - DNA, 346 bp, Glycine max
  Peptide Sequence Number=SeqID_96247
atggtttgcaccaaccaagcggatatgaccagaaggcttcttgccggttcattggcattcgaatgccgcatcatgcactacatgattgtgcgcatcctaccccctagatcatccaaccttgcacagtctgagccctttgttaaagtcaagagatctttctctatcggtgcgaatgtggtctcctcttttggatatcacaaagagagggatggttcttgggtgaagaaggatacaccagcacaggctgtagaagatcgttctccatcaccacctccacaaagagatcattcttcatctcttatgcacaacattcttgacagattggatggactccacaccttcgttg

SEQ ID NO: 4563 - DNA, 352 bp, Glycine max
  Peptide Sequence Number=SeqID_96248
atggctacaccacctagctctcctcctcctcctcctcctcttcctactagtgcaacatcacagttgccatctaccttgaagcagacaagaaaagccacatggctaagatcattggctgaatttgatatccctgaagcatctgatttgaggacaaaaaataaaatgcttcagactttgggggagcgatggagacaattcaagtctgatttgacatcgaaatgggcacttgcagccgacaaggaaagtgtcgatgacactatatacgaaaaagacccttcgtgggaggatatgcgaaaaaaggcacaggccatccagaagcaaaatactgcccctcacatgttgtctcgtggag

SEQ ID NO: 4564 - DNA, 414 bp, Glycine max
  Peptide Sequence Number=SeqID_96249
atgtgggaggtgctaataccttcctcaaaagtaaatacaactcccgaaagtggcatcatccaaacctctgtagcctgtatcaaacaattcgctcctactcagttaaatcaaaaccagtcccagaattctgacagattaccttctcaatctgtacagaatccccaaaatgtgagtgcaattacattgaggttgggaaaacagtatcaaggacctcaactagtagcatcttcctcatctgcaaatgaacctgcccaacctcactcaactccagaaaaagatgatgacaaaaatttaaagagtaagttgcctaacaatttctatgcagtagtagcatatccctcttccattcccaccaagagcaatttccaacaagaaaatggaagaggcggagaaggagatcttggaaacatttag

SEQ ID NO: 4565 - DNA, 499 bp, Glycine max
  Peptide Sequence Number=SeqID_96250
gcggaatttgatatcccagaggcttcttacagtaggacgaaaaggaagttactacagaccgtgggggagagatggaggcagtttaaatcagacctcacgaggaaatgggcccttgcagccgatcaggatggatgtgcgcatgaaggcacagccatccagaagcagaatactgctccccaagttttgtctcgtgggggttatgattatttggagcagaagctcctggctgagaagaccaagaaaaagatgcaggaagctgcacaatcaggaagcgttgatgacgtcatcgaccctccatcctcggtcagacgccacgtgaagtggaagatggcccgcacgaagaagacaggggagatgacgactgaggccgcaaaggaaatcgctgagaagattgattcgtttgaggagcaggccacacagggatcgttcgtcccccatggacgtcaggatgttctggccgctgctattggacgtccagagcaccctggacgtgtccgtg

SEQ ID NO: 4566 - DNA, 444 bp, Glycine max
  Peptide Sequence Number=SeqID_96251
atggcgagaacgtgtcgtcctctaaaggcgaggacgtgtagtcctctgaaggtgagggcgtgtagccttacaaaggcgaaggtacatggccctttgacagcgaggacgtgtagtcctctgaaggtgaaggtacatgaccctttgaaggcgaggacgtgtagtcctctaaaggtgaaggcgaggacgtttagtcctctgaaggcgagggcgtgcagccctctgaaggcgagggcgtgcggccctctgaaggcgaggacgtgtaatcctctgaaggcgaggacgtgtagtcctctcaaggtgagggcgtgtagccctacaaaggcgagggcatgtagccctccaaaggcgaggacatgtagtcctctcaaggggaggacgtatagtcctctaaagatgagggtgtctagtcctctaaaggtgagggcatgtagccctatgaagtga

SEQ ID NO: 4567 - DNA, 204 bp, Glycine max
  Peptide Sequence Number=SeqID_96252
atggaagctttcaagaaattcaaatggtcagagcttttcacacggaggggcatcacatatcgagacgctcgaaagagaacaacggaagctctcgagaattcaaatggtcataacttttcacacggaggtcgatttcaggcgcaaaatgtatcgagacgctcgaaattgaacaacggaagctctcgggaattaaaatggtcataa

SEQ ID NO: 4568 - DNA, 279 bp, Glycine max
  Peptide Sequence Number=SeqID_96253
atgagcatcaaattccaaggaacactccaaacgagtccagcattggccaaggaaagggaagctttcagcagggaagctaagtgtgaagtatgcaattctgcacaggatggagctgcaaactgggttcccaccaatcatacttccactgttgccacagagaatctcctctcatccctgcattacaaactgattaagggacacatgtcccagacattgtctcgacatctaagaaggtctcaagacattcagggaaaaagctgcctggggaaatgtccctga

SEQ ID NO: 4569 - DNA, 246 bp, Glycine max
  Peptide Sequence Number=SeqID_96254
atgcatgagaacgaatggcacggagcgtgtttgctctttgcccctatttgggaacctataggacaatatctaggggtctctaataactactccccaacaattcataactcacacgactgttttctagaggcaagcaaaggcgaggctcacgggtgcgctttccaaaggaggaaagatgcacggagtcgccaccaacgtttatttgtggaaaacgtcggaaaaaccgaaggaaaccggtcaaaatga

SEQ ID NO: 4570 - DNA, 501 bp, Glycine max
  Peptide Sequence Number=SeqID_96255
atgggggagacacatgaaattccccaccacaatctagccaacttcgagtcttgcctcagatatgccactgaagggcaagtagttggggcctcaatttcgcccccaaccacaacccttctatggaaaaatggtgggttacacaccttcaagctttcggaaaatttggtcttcgccgatgaaaggatcaaagtgggtccggaaaaaggcaaatctgatcatcctgctttgatgattgcaaaaactggggcaaatgaagaggatgagaataacggagaaacccttgctatgattgccattcctacacggtcaaatttcccatcagcccaacaatgtcattactcagccaataacagtccctctcacccaatcatccacaaaggccatccccaatcatccacaaagcctgcccgccacacatcaggcgccaaaacaccaaccaaaaaggaattttgtagcaaaaagcctgtaggattcaccccaaatttcggtgtcatatgctaa

SEQ ID NO: 4571 - DNA, 1074 bp, Glycine max
  Peptide Sequence Number=SeqID_96256
cttgcggcgattcatggctgtgttattgatagtcagcgcggcgctctatcggcgccgcagcatcaccttgagtaccgcgcccgccagcctgccgaacggcgcgcgcagcagatcggtgaagcgccagcggctttggataaagacgcccttggcatggctcagcgcccggaatccttcgatgccgtgacaggcccccatgccgctggggccgatgccgccgaacggcagatcgtcctgggcaaagtgcagcagggtggcgttgacgctgacgttgccggaggtggtgcgtgccagcagcctgtcctgcagcgtgccgcctgggccaaagtagtacagcgccagcggggcgcgggcccggcggttgataacgtcgatcgtttcatcaaaggcggtgtaggtgcgcaccgggcagcagcggcccgaaagatctcctcttgcatgatccggctgtcgtcgggggcgccgacgatcagcgtgggggcgaggatcctgcaaacggtggtagtgcctgtcgttgatgatggcgccgtagtcatggctcgtcggcccgtcggggtaaaacgctttgaccgccgcgtcgtagagcgcaatgaagttttccacatcgtcctgatggatcagcaggaaatcgggcgcgatgcaggtttggcccgcgttcgacagcttgccgaacgccaggctgttaatggttctggcgttaaccgcgccgggcgccaccacggcggggcttttgccgcccagctcgagcgtcaagggcaccagatttttaccggccgcctgcatgacctgacggccgatcgccgtgctgccggtgaacaccaggtgatcgaacgccagctcgctgaacccggccccgacgtccggcccgccggtcaccaccgcgacctcatcggcgggaaacagcgccgccagcatcgtttcgataagctggctggtgcgcggcgtgagctccgaaggtttcagcatcacgcggttgccggcggccagggcggtggccagcgggatgaaggtcaacgaaaacggggcgacgtggcggcgttccggctgcatgaagcgtttcaggttgcgcagcag

SEQ ID NO: 4572 - DNA, 114 bp, Glycine max
  Peptide Sequence Number=SeqID_96257
atggcacctacgaggcaccttgtggacccagaaaagtccaacagggcattaggatttccaacactaatcacaagcctctgccagttttacgaagtgccggtcacccccagcaag

SEQ ID NO: 4573 - DNA, 552 bp, Glycine max
  Peptide Sequence Number=SeqID_96258
gggctttatcccgacattcgccgcgtgctggctaaactgccggccaaacggcagaacctgctgttctctgccaccttctcggacgagatcaaagcgctggcggaaaaactgctcaccaacccggaacaggtggaagtggcacgccgcaacaccgcttccgagcaggtgtcgcagcaggtgcattttgtcgataagaagcgcaaacgggaactgctgtcgctgatgattggtcgcgacaactggcagcaggtgctggtgttcacccgcaccaagcacggtgctaaccacctcgctgagcagctcaacaaagatggcatcactgccgccgcgatccatggcaataagagccagggcgcgcgtacccgtgcgctggccgacttcaaaaccggcggcattcgcgtgctggtggcaacggatattgccgcgcgcggtctggatatcgaagagctgccgcacgtggtcaactacgagctgccgaacgtggcggaagattacgtgcaccgcatcggccgtaccggtcgtgccgcggccaccggtgctgcgctgtcgctg

SEQ ID NO: 4574 - DNA, 675 bp, Glycine max
  Peptide Sequence Number=SeqID_96259
atgagatcctgggtgaggggtcagtggatcccgtttgatgcagatgctatcggccagctcctgggacatcctttagtgctggaagagggtcaggagtgcgagtatggccagaggaggaaccggtccaatgggttcgatgaggaggccatcacccagttgctatgtataccggagcaggattttgcccggactactgccgggaggcgagtgcggatcatgcgcaccaacatgaccactctgactcagatctggatgactttgctgctcagcaacatccagcccagcgatcataactccgacctccccctgccaaagtgtcagctggtgtatgccatcctgacacggatgagcattcacgtggctcagttaatcactgatgccatctatatatttgcaggtatggcgcctaccaggcaccctctggacccggataagtccaacagggccctgggatttcccgccttgatcacaggactctgccagtcgttcggagtccccgtcgcacttagtaggttcaaggaagaggtcgcatggcctggagattggcctgaggcccgggcaggagaggcacctacagaggcaccagcagaggctcccgacgaggcaaatgaggcccgcaaggacgaggagatggccgatttatttgatttcttaggaggaagcggggccacatga

SEQ ID NO: 4575 - DNA, 367 bp, Glycine max
  Peptide Sequence Number=SeqID_96260
atcacccggtcgttcatcaaagaagtactacacgcctaggcaggcgcagggtgatgcacatcaggccgcagacgcaccaccaccacctcatcaggccgatcccgctggatcactaggcatggagtgttatctacagcacttggtttgccagcaggcggccaaccaccgggggcaggggcagggtttcgctccttttgcaagccctactccagagcagtttggggctgaggtcacatgggccagagactggcccgaggcccaggcaggggaggagcccgcaggatcccccggtgaggcagaggaggcccgtatggatgaagaaatgactgacttgctcggtttcttgggaggaagcgaagccacgtga

SEQ ID NO: 4576 - DNA, 504 bp, Glycine max
  Peptide Sequence Number=SeqID_96261
atggggacaaatcaaactggcaaaaggttttatcaagtcaagattaagggcctagatatcaccagcattaaggaattggggcggttgatgggacctctccaaatgcaagctttccgtaaggcatacggaaagatcttagatttgaccatagcagagatattcacagaagccattgcatcactcgcccaatactatgaccagcccttgagatgcttcacgtttggagacttccaattagtaccgaccgttgaagaatttgaggagattctaggatgtcctcttgggggaaggaaactgtatcttttcttcgggttccttccctccttgagcaaaattgcaattgtgatcagggattcggcgagaggattgtaccgtgtgaagcaaactcgaaacggcatagtgggcctagcacgaaagtacttagaaggcaaggcgagggatatggcgaatcaagatgagtgggtcccgttcatggatgtattagcattgttagtctttggggtt

SEQ ID NO: 4577 - DNA, 165 bp, Glycine max
  Peptide Sequence Number=SeqID_96262
atgactgagtggattctcatcatcaaaaatggggagattgtggaagcaatgccttccaagattattttgatgatgccaaagaatcaagagttaagcaagttccaaagaatcaggagtaaaaaagcttcaagaatcaagtttcaaagaatcaagattcaagaataa

SEQ ID NO: 4578 - DNA, 543 bp, Glycine max
  Peptide Sequence Number=SeqID_96263
atgaacaacatgatcatgctacaacacactgaaattaaggcatcttttgagacaagtatacatgtgattgggcatgtttttaaagttaccttatacaagaggttacttgacatggtatcaaggtatgctttaaatcagattactgctgagtttgagaatgtacattatgctggaaaaaatccttctcgctgtgaatgtgtcatgagaactactcacggtccgatcttccatgtgcatgtgagctatccaaatatgttcttagtaccataccacttgacacaatccatatgttttggcagaggttttttagaccaaggattatctaagccccaagtgaccataaccgaagagatggaaaccatatccaagcgatttgaaaagcttgatgtttgtggcaaagttactctaaagagtaaactctgggaaatcgcctaccctgatctaaactctatgtgtcatcctcccgaagaggtcaacgccaaaggtgctcagaagaaatcgatgaccaaacatcaaagatcaacaaagcatgatccgtcttag

SEQ ID NO: 4579 - DNA, 467 bp, Glycine max
  Peptide Sequence Number=SeqID_96264
atgacgcagctgaagaggtcttccaatagcctgaggaagcaggtgttgatgcccagggttttccaggcagggcgtatgacacgagttctgactgcctatgctgatcatattacagtcattgtttggaatggaaaggtcaccatcaccctcgatgatgtggcatctttgcttcatctacccatcataggcacattccatagcttcgacacttttcatgtcgacaaagcggtattgatgttagtggagttacttgaatgcaacacacgtgcatgtgctgttcttggacgccttttgagaccacagttagagtggaagctacgcatgggagctactgctctagtgcatatgtacgataatttgaatgatacttataagagcggcaacagacaacttgttggatatatcacactattatggtatttttcatctattgctaaggcttttacggatgaagactatgatgaaag

SEQ ID NO: 4580 - DNA, 360 bp, Glycine max
  Peptide Sequence Number=SeqID_96265
atggatgaagtggcaaagattcggaagaggtttggtgacgagcaaagcaccctcttggaccaattcgagaggctctcctttgagactcacctcaacaaggccatgctacaaaggagcctatcagagccagggttcccaaggcaagtgtcacagccaaggcacgttagtgtgacccctacaattcccctcttgaatcatgggaagcaaaggcgttgtcgagtgtcagggttgagtaaggttctgaagaaattgcttagacctattcttgggaggaagagtagtggcggagagaggaaacatgtcccggatcctaggaatccactctcttggaaaaacttcagcagatcactaaggttctaa

SEQ ID NO: 4581 - DNA, 522 bp, Glycine max
  Peptide Sequence Number=SeqID_96266
atgccaccggtctcttgggacacggtaacaaaaagtggggtggtcgacaaaagcagggcttttgctcctacgtatcctcaatttgtgatgaggaactcagacctacgtagttcttcctactgtgagactaaaaatagtctcggtgctttcttcactaaaatgcgaacatgctttagtaaagagacaaaacttctaactgatcagagcaacatatgctttttggatgaaaaacaatgtgtctatcggggaaggagacatttcgtttctaaacgaccatttagagaaaacactgggtccaacaaaaatagaagaagatcactcaaagtgtatcaatctcacacagtgcgtggcgagaaagtcgctagcgcacaggattttgtcggcaatcaaagggattggaccactttaggtcgtggttcctttttcttgggtaaggattatgataagttgggttttggctcaaggcttgtagaacggctgctcacgatatatgtcagggtttggccagcggttcggggataa

SEQ ID NO: 4582 - DNA, 869 bp, Glycine max
  Peptide Sequence Number=SeqID_96267
tagtttgggaccaatacttggctgggataggaggcagcacaatcaactggtttcctcgatggaaggaaggaaatgagggagttctcttctcatgtggggactacccaaacgttccgttgatagggacgaggggttgtatttactacaatcccgcactttccataagacagttagggtaccccatgaggggagcaccgacgaaagagagcctctcgcctttccttgtgagagatttcggcgcgcaaagtctcaagattgtacaaagagtccacaaggcgtgggaaaacccattaaggaaagataaagaacttaggggcatccgtaatggcatcattggtggttatcatgaatggctctccaagttgaaaattatcaacgaggagaacttcgaagctccgaaagaggatgaagaagtccaagctctaaaaacagtgctaggaaaggcaagactcgccaaagaaaaattcaagttagtcgctacagacatccggaaagagtgtgccgacaacaatgagcttaagctccggagagaggaaagagaccagtcacgagtacatgacatggtcttaaaggaggagttagctacctgctcaagatccaagaggagtttggcccaacacttagaagccacggagcaaagcatgctagctataataggacagtacaaagaagagttaaaccagtctttgacccatgaacaaaaactagtagaggacttcgcacaagcatacgccgagaaggaaccaagagggagggtgattgatgcattgcatcaagaagcgaccatgtggatggataggttcgccttgaccttaaatgggagtcaagacctcccgcgactactagccaaagcaaaggccatcgctgag

SEQ ID NO: 4583 - DNA, 366 bp, Glycine max
  Peptide Sequence Number=SeqID_96268
gaacaaggataagggttacgtgggagtacgtgagctcagttggaggtgggcaacaggggatggtgggttatacgtgatttgtggatgtggaaaatcgtttcgcaccatcgcccgaccgccacctagtaccacatgtgatggagtggtacctggagatatgtcgcgggggtcaggagaccttggggacgtcaggtggggtacctgtgatgtacctgtcgcaacctacccttcagcggaagggcgacgcgtgactcgcgggatgcgtgttccacgaaaggaatacgcgcggagtcgccaccaacgtttatttgaggaaaacatcggaaaaaccggaaaagacgcgatctacgaacttttaagtgaaag

SEQ ID NO: 4584 - DNA, 1015 bp, Glycine max
  Peptide Sequence Number=SeqID_96269
aggactacacgtcctcgccatcagagggctgcacgccctcaacttcagaggaatacacgtcctcgccatcaaagggctgcacaccctcaccttcagaggactacatgtcctcgcctttagaggactgcacgtcctcctcatcagagggccgcacgccctcaccttaagaggactacacttcctcaccatcagagggcggcacaccctcacctcaagaggactacacgtccttgccatcagagggctgcacgtcctcgtcttcagagggctgcacaccctcaccttcagaggtcttcacgccctcaccttcagagggctacacgccctcgccttcagaggactacacgtcctcaccttcagagggctaaacgtcctcaccttcagagggctaaacgccctcgcctttagaggacaacacatcctcgtgttcaaagggctgctcatcctcacttccagaggactgcacgtcctcaccttcagagggctacacgtcctcgccttcagagggctgcacgccctcaccttcagagggctacgcgcccccaccttcagagggctgcacgccctctcctttagaggactagatgtccttgccttcagagggctacacgtcctcaccttcagggggctacacattatcaccttcagaggactagacgtcctcgccttcagagggctacacgccctcgcctttagaggactacacgtccttgccttcggagggctacgcgcccccctttttgagggctgcacgtgcccatctttagaggactgcatgtcctcaccttcagaggactgcacgtgctcacatttagaggactgcacgtcctcacctttagagggctacacggcctcgccttcagaggactactcgtcctcgccatcagaggactacacgtcctcgcctttagaggactgcacgtcctcgccttcagaggactacacgtcctcgcctttagaggactgcacgtcctcgtcttcagagggctgcacgccctctcctttagaggactag

SEQ ID NO: 4585 - DNA, 258 bp, Glycine max
  Peptide Sequence Number=SeqID_96270
atgaatattgaggaatccattcatgttacttttgatgaatctaatgctatcttgtcaagaaagaatatgctagatgatattgcagaatctttagaacaaattcatattcatggacaagattctaaagaaaaagggaaaggaagcaatgaagatcctctagaagaagccaaatcaaataatgaactcccaaaagaatggaaagtctcaaaagatcatcccctcgacagcattatcggtgatatctcaaaaggggggtaa

SEQ ID NO: 4586 - DNA, 1359 bp, Glycine max
  Peptide Sequence Number=SeqID_96271
atgtcttcgatttatgagaaatatgacctgaaacaggtgatcaacgcctccggccgtatgaccattctcggcgtgtcgacgccgtccgccgacgtggtggataccgtcagctacggcctcaatcactactttgagatcaaagatctggtcaacaaaaccggcgcctacatcgcgcgcctgctggaagtcgaaaacgcggtggtggtgtcctgcgcctcggccggtattgcccagtgcgtagcggcggtgatcgtcaaagataacgactggctgctggataacctgcacgccgcgccgctcagcgtgccgcacgacattgtggtgccgaaaggccataacgtgaactacggcgcgccggtgggcagcatggtggcgctgggcggcggacgcctgattgaggccggttacagcaatgagtgctcgccagaacagctggcggcggccatcacgccgaccaccgcggcgctgctgtacgtcaagtcgcatcactgtgtgcagaaaagccatctcagcgtcgaacaggcggcagtagtcgcgcgcaaacacggtattccgctgattgtcgatgcggcggccgaagaggatttgcagtgctattaccagatgggggccgacctggtgatctacagcggtgccaaagcgattgaagggccaaccagcggccttgtgattggccgcagccagtacgtcgagtgggtgaaacgccagagcaacggcattggccgcgcgatgaaagtcggcaaagagggcattctcggtctgactcaggcgattgaaaactacctgctgcagagcaaaaccagcggtgccgacatggtggcgaagatgacgccctttatcgataacctcaatacgctgaacggcgtcagcgcacgcgtggtgtgggatgccgccggtcgtgatatcgcccgcgctgagatcaaatttgatgaagcggtgacgggctggccaaccggcgagctggtgcaggcgctgaaaaacggcgacatcgccatctatttccgcggctataaagccaacgaaggcattatcgaagcggatccgcatccaggcgctgctcagcggaggaaaacgcgcatgaatctcaaccccaatttctatcagggccgtctgtgcctcaacgtgctggctggttcaaagcagaatgcgcaggcgatctggcaggcggcagaagggcatgtgctggtcggcgttttgtcgaaaaactacgcctcgaatgaggccgcgattgccgatatgcgcgagtacgcggcgctgattgataatgcgctgtcggtcgggctgggtgcgggcgacccgaatcagtcggcgatggtcagtgaaatctcggcggaactgcagccgcagcacgttaatcag

SEQ ID NO: 4587 - DNA, 923 bp, Glycine max
  Peptide Sequence Number=SeqID_96272
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccagatactcaggcaacagatagcatgatgaatagaatagtgtctcatgtctccctactaacattaaatgtaagtattctaaatgctccacttgaaagatacagaatgggccaggcgcggtggctcatgcctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4588 - DNA, 342 bp, Glycine max
  Peptide Sequence Number=SeqID_96273
atggtgaaagttggaacatattacgtgccgatcaacgtctcattttcgccaaaagttggcccagggcttcccggtatcaacagggacaccaggatttatttattctgcgaagcgatcctccgtcacagcgtaaccaccacacccgccgcggttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcaaacggcggccagtgaattgtaa

SEQ ID NO: 4589 - DNA, 555 bp, Glycine max
  Peptide Sequence Number=SeqID_96274
atggagacacttcaaaaggtccgcaaagaatgggaggtagtgcgaaagaagaacaaagaactcacgggcagtaacaatgggcccatcggtggctaccataagtggtttagagcccacatgcaaggtttggattggctcctaagtttgagaaccgctaaaagggaggaagttgaggcaccggaggaagacgaagaggtgcaggcccttagggcagaactcgagcaagcccaaacagtcaaagaaaggttcaaatcagcagctctgaagatccgaaaggagaatgccgaactgagagatacaagtatagctaccaccaagggcttggaacgagagatcaagagggctcgtagggaagaatacggctggaacaagtttcgaggggctctgtggggcggtaacaatgagcttaagctccgaagagaggaaagggaccaatcacgagtagacagtttgatcttgaaagatgagttgaaggcttgctcgaggcccaagaaaagtttgtctcagcggttatgcgagacagagaccaacatgttagccatcatcagcaagtaa

SEQ ID NO: 4590 - DNA, 240 bp, Glycine max
  Peptide Sequence Number=SeqID_96275
atgtcgatacaccatcaccatgaagtctccttcctatcactttcactggcagagacttcaagggtcctcatcgacctgggtagctccactgacatcttattgtcgcaatgtgcccttttgcgggcgagcgagggcgaggctcacgggtgtgctttccaaaggaggaaaggtgcgcggagtcaccaccaacgtttatttgtggaaaacgtcggaaaaaccgaaggaaaccggtcaaaatga

SEQ ID NO: 4591 - DNA, 93 bp, Glycine max
  Peptide Sequence Number=SeqID_96276
atggagaaaaatgaagaaacaacaatagaagagaagatgccacggaaggccaaggagaagaggagaggggaggcaccatccacaacggaataa

SEQ ID NO: 4592 - DNA, 417 bp, Glycine max
  Peptide Sequence Number=SeqID_96277
gaccgtgaatgtgctgaattgattggtcaaacagctgatgatgtgaatagggtcaagattgaagatggtgatcttgatttgaatgcttcccctcaagcacttgacaaattgttgggtcatgtgcttgcttttaaggtcaggattcaatcaagattcaaaaatgcagttgtacttaaatactcaaaagacctggatttgatcaatgttgttctggagatgttgcctgatagtgagattttatgctttatgcaacaatctctatctgtcacaactgaccatgatccggttgcggggttgcctttaacacccaaaaagcggatgtcatctgatgaagccgatgatgagttagggagctctcaaatttcgccagcccaactatcgtctaacaaattaacaagacattctcataggagctaa

SEQ ID NO: 4593 - DNA, 240 bp, Glycine max
  Peptide Sequence Number=SeqID_96278
atgtcatctattgtttgctgggatcgtgcccgcaagacacctagtggacccgaagaaggccaacagggtcttgcagttttcatcaggcaccctattaaccgagctttcatcaagaagtactgcacccctaggcaggcgcagggtgaaacaccacagcagcctggggagtgctggcagcgggcaaccgatgcaccgccaccacctctagagttcacctcagctcagcaacaaaaaggttag

SEQ ID NO: 4594 - DNA, 285 bp, Glycine max
  Peptide Sequence Number=SeqID_96279
atgactacacatgcagatctgatgcaagcttccacttccgttcccattccagtacctaacggttgtgattttcaagcattaaaaactagaatacacaatacccttaagctaatcgacaagcattttttggatgaaatttactaccggcagcctttcacatatgcaggaaaaaatcccaaaaagtttgacattccttccgaatgtaccatggatgaactgaaggatttgatcaaacaagttgcgcctcacgggattcccccttatggtattcacaaaacacaaacg

SEQ ID NO: 4595 - DNA, 219 bp, Glycine max
  Peptide Sequence Number=SeqID_96280
atggtgaaagttggaacctcttacgtgccgatcaacgtctcattttcgccaaaagttggcccagggcttcccggtgtccagtggcttctgtttctatcagctgtccctcctgttcagctactgacggggtggtgcgaaacggcaaaagcacccccggacatcagcggaggcaagtgtagcggtcacgctgcgcgtaaccaccactcccgccgcgcttaa

SEQ ID NO: 4596 - DNA, 234 bp, Glycine max
  Peptide Sequence Number=SeqID_96281
atgtgggaggatgaatttgtgcgatgtagccagtttccttctttgatccttaaggacaaggctgtagctccaagaaagggccatagtccaaagaaggtcaacttggttgctgctctggttcgtggtatgcttgttaaagatgcatcgatgcagttggaatcgacaataaaacgagcagcaaaaactgtatatcaggttaaaagagttcccatagaagagatggttttgaggtag

SEQ ID NO: 4597 - DNA, 159 bp, Glycine max
  Peptide Sequence Number=SeqID_96282
atggaggcatacacaaaagatgaggaattgctgatacatttcttccaagaaagtcttactggggtagctgttacctgggcatatgcaagagggggcatggatctttcaaagcatacgcccaaagggagagggatctggcagcccgagtggttcccttaa

SEQ ID NO: 4598 - DNA, 474 bp, Glycine max
  Peptide Sequence Number=SeqID_96283
gcagatatcctcatagctaggttcccttaccctaactatggtgttaaaacgggttcctctcggtgtggggtttcaatggagaacaacgatagtttgtggtggctaatggtggttgtgggtgatggagaaagtgcttgggatgttagaaatggctttggaagaaagaaaggagaagaaatggcgtttttcctaagctacacgaaagcaaagctgaaatgcttaaataagagatgctctcggaaacggaagcttctagcaccctccagacatcttctcaaagatcccaacggtcaaatcatggaccagtgtcttgtgaagttgcagacaaattttcgagaagatccaacggttaacgaaggctgggcagcatttttaccgaggcagctacatgtagctttctctagaagcttcattaagaggcttccttgtggcttctttgaaaagctttctcaagaggcttctttgataagatag

SEQ ID NO: 4599 - DNA, 96 bp, Glycine max
  Peptide Sequence Number=SeqID_96284
atgatgttggaatacgcgcggagtcgccaccaacgtttatttgaggaaaacgtcggaaaaaccagaaaagacgcgatctacgaactttttaagtga

SEQ ID NO: 4600 - DNA, 297 bp, Glycine max
  Peptide Sequence Number=SeqID_96285
atggggcatgtctccgactttgttgaggagactatcgcacaactactatgcataccggggcaagatttcacccagccgctgcaaggagacgagtgtggatcggatcgcgcccgcaagacacccagtggacctgaagaggttcaacagggtcttggggttctagctctgattacgggcctctatcggttctacggagtgcccgttgcccccaacaaggtcatcaggccccctattaaccaagctttcatcaagaagtattgcgcccccaggcaggcgcaaggcgaggcaccacaatag

SEQ ID NO: 4601 - DNA, 561 bp, Glycine max
  Peptide Sequence Number=SeqID_96286
atgcactacattattgttagaattttgcttccccggacttcaaatttggctcaagcctctgaggaggacttgattttgatgtgggctttccttaccggtcgtcagatcgacagggctcacttggttcggtaccaaatgcataaggcattacgggccaatgcacctctcccttaccctcaattggtcactctgtttctccgtcattttcaaattccgcttgatgatgaaccttttgttcaagtcaagcgttcctttgctataggtgctggtgcagtcacttcatttggataccataaggatcggaatggtcaatggctgaagaaagatgcacttcctccacaagatgagcatactccttctcctcctcctcagcaagatgattcagcccttatgactgaagttctttccgagttacgaggtcttcgtacttatgttggtgaacgttttgattctttggataatcgctttgccagaatggatatccgtctcacacagcttgaagaagatgtgggttatattcgtcagagcttcaatcttccaccaccacctccaccttcttag

SEQ ID NO: 4602 - DNA, 228 bp, Glycine max
  Peptide Sequence Number=SeqID_96287
atgcatgctttgttagggtcattcaacagtggaaacaggtctgattctaaggtccttgatagtacgaggctaagttgttgtactatcccaaggaatcgggtcttgattgagtttaatcttacaagaggaatctgtggacgaggcttgatcaggattaggctaggctatcatgaggaatcggggtctagcagtccaggagacaacataggaatacatgagcattgttag

SEQ ID NO: 4603 - DNA, 87 bp, Glycine max
  Peptide Sequence Number=SeqID_96288
atgcaggcgcggaagatcgtcatctccggtgaggtggctggacttcaaatccagttggggacgccagcgttcccgggcagagaataa

SEQ ID NO: 4604 - DNA, 219 bp, Glycine max
  Peptide Sequence Number=SeqID_96289
atggtagcagtaacccctgccagggttcctcaacctccattttttcgaggatacgacttgaatgcaacatgtgcatatcatggaggagttttgggacattcctttgagcactatatgaccttgaagcccattggtttgtttgctcaagcgacatgtgctcctgagtttggacttccaagaccgttcaatcagaaattactcgtgctacatatttggtga

SEQ ID NO: 4605 - DNA, 190 bp, Glycine max
  Peptide Sequence Number=SeqID_96290
tggcgtctcctctatctcttccttctccattatgctgccatttatcttccaagaagcaaaggaatccattgatgaagaagatcctaggcctacaagctccaatggagcttacattacaaagcaatccttctactgtttcttggatggatactcgggttacaatcagattgcagtagatcctcaggattaa

SEQ ID NO: 4606 - DNA, 1146 bp, Glycine max
  Peptide Sequence Number=SeqID_96291
atgaatacgctgttgtacctcgccgtagtgctgatttggggcaccacctggattgcgatcaccctgcaacaggaaggcccggtggccattcccgtctcgatcgcttaccgcttcgccatttccgccgcggtgatgttcgccgtgctgttgctaacacgccgcctgcgccgcctcgccccgcgcgatcatctgttctgcgtgctgcagggctgctgcgtgttcggcttcaacttcttctgcttctaccacgcggcggcctacatcagcagcgggctggaatcggtgatcttctcgatggcggtgctgttcaacgccctcaacagcctgctgtttttccgccagcgtcccagccccaacctgctgccggcggcgctgctgggtttgaccggcatcgtggcgctgttttggcaagatctggccgccacccgcatggcgccggagctgctcaaaggcatcggcctgagcgcgctcggcacctacggcttctcgctgggcaacatgatcagcacgcgccatcagcgccgcgggctggatatcttttccaccaacacctacgccatgacctacggcgcgctgctgatggcgctgatcgccctggcgcagggcgcatcgttccagatcgaattcagcagccgctatatcggctccctgctgtacctggcgattttcgggtcggtgatcgccttcgccgcctacttcagcctgctcggccgcatcggcgccggcgcggcggcctacagcaccctgttgttcccgctggtggcgctgaccatctcaacgatctacgaaggctatcagtggcacttcaacgccgtgctgggcctgtgcctgatcctgctgggcaacctggtgatgttcgccaagccggggctgaaatggcgacggccaggtggacgtgtttacccgtacgccgctgcagggcaaccccgtggcggtggtgctggaggccgaggggctgagcagcgcgcaaatgctggcattggcccgttggaccaaccttttcggaaaccacctttgtgcttaaaccgacgcacccggcggcggattataaggtgcgcattttcaccaccgaaaagagctgcccttcgccggccacccaacgctgggcaccgcccacgccctgctggaagccggtttgacgcctaa

SEQ ID NO: 4607 - DNA, 384 bp, Glycine max
  Peptide Sequence Number=SeqID_96292
atggtgaaagttggaacctcttacgtgccgatcaacgtctcattttcgccaaaagttggtctccatgagttccttgcgattcaacagaatcacgcatcatacggctacctgcaaaaggattcctcaagcttatcgataccgtcgacctcgagggggggcccgtccagtcgggaaacctgtcgtgccagctgcattaatgaatcggccaacgcgcgggggatgtgcggtttgcgatattgggcgctagcggagtgtatactggcttactatgttggcactgatgagggtgtcagtgaagtgcttcatgtggcaggagaaaaaaggtgcaccggtgcgtcagcagaatatgtgatacaggatatattccgcttcctcgctcactga

SEQ ID NO: 4608 - DNA, 897 bp, Glycine max
  Peptide Sequence Number=SeqID_96293
atggcatcgtcccacccgcggctactgcccccgcgccgagcgctgcacgtgctcgatgaagcactcggcaaaactcggcaggtcgcggccacgctggcggcacagcaggcggtcgcgcaaggcccacgggtcgtccagcttcagcacatgcaaacgcatcgggccggctgtagcgcgccgcgcaggcgcgcggcaccacggcgatgccggcgccggcctcgaccatgcggcacacggcctcgaaaactgccgacgtgcacgcgctggcagatgcgcttgcccaaggccgctggcgatgtcttccaggaaggtctggatggcgctgtcgggatggatgccgacgaactggtaggcatcgatcaggtcggcgaaatgggccgacttcgacgccgccagcggatggtccagcgccgtgaccacggtgagctcatcgcggaacagcggcgtcacatccaggccctcgacgtcgatgttgccggccaccagccccaggtcgccggcgcccgcgcggatcgcgatgacgatgtcgcccgagatcttctcttccagctcgacgtccacgtcgggattctcggccaggaaggtcgacagcgcgtccgccaggaaggaattggtggcggtggtgttggccagcaggcgcagccgccccttcaggccgctggcgtagggctgcaggtcggcgttcaggcattcgagctggcggaacaccgcgttggcgtgcttgagcagcacctcgccggccggggtcagcgccacgcccgtggccatgcgcaccagcagccgcgccttgaaggcctcttccatgtgcttgacgcgcgcgctggcggcgggcagcgacaggaaggtgcgttcggccgcgcgggtcagattgagcgtttcccccacgttcacgaatag

SEQ ID NO: 4609 - DNA, 328 bp, Glycine max
  Peptide Sequence Number=SeqID_96294
atggggacaaatcaaaacggaaaaagattttatcaagtcaaggttaagggtcttgatgtcaccagcctcaaggaattgggacgattgatgggacctctccaaaggcaagccttctgcaaagtgtaccaaaagattctagatttgaccgcagcggaggtatttacggaagctgttgtatccctcgtccaatactatgaccagccgttgagatgcttcacgtttggggacttccaaatggtaccgactgttgaagagtttgaggagatattaggatgccctcttgggggaagaaaaccgtaccttttctccgggtttcttccctccttga

SEQ ID NO: 4610 - DNA, 235 bp, Glycine max
  Peptide Sequence Number=SeqID_96295
atgaaaggaaaccaacaaaggggtaagtcacggtccccagtggactcgccaactgttgcaacctacccttcggcgggagggcgacgcgagactcgcgggatgcgtgttccacgaaaggaatacgcgcggagtcgccaccaacgtttattcgaggaaaacgtcgaaaaaaccggaaaagacgcgatctacgaacttttagtggaaggttcgggagttgtatttatgcacggggaag

SEQ ID NO: 4611 - DNA, 386 bp, Glycine max
  Peptide Sequence Number=SeqID_96296
acggagattggcctcgagtgcaaggcagaagggagcttgactgcagaccacccgtcgagcagggacgaaaagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggtcacggcgagacgagccgtttctaa

SEQ ID NO: 4612 - DNA, 426 bp, Glycine max
  Peptide Sequence Number=SeqID_96297
atggttgactatatgtgtaaatcttttctgcatgctatggatgttttcattagggttcatcctaaacaattcatactcatgtgtaagggtattgactctagatctttatacatcagtggttccttcatgtgtttttgtgttgtggtgcttgtgcttacatctactacagtgggtatgtatggtgatgtaagctccattggagcttgtaggcctaggatcttcttcatcaatggattcctttgcttcttggaagatgaatggcagcggaatggagaaaggaagagagagaggagacgccacttcaaggagaagatgagtctagaaaaagctcaccaccataggaggccatggataagagcttggaggaagaaggagatgaatgaggggagagggagagaagagcacgaaattttgtgctcaaaatga

SEQ ID NO: 4613 - DNA, 615 bp, Glycine max
  Peptide Sequence Number=SeqID_96298
atggcctccaactcccagcagtttagtgccagaaatgatgccatagtcattggaggagtgcatgaggtagctacaaacccatctgcatcatctgaaactaagaagcttgaaggcaaactggatgcattggtcaacttggtaacccagctggccttgaatcagaaatctgtacctgtcgcaaggacctttgcccttccatgcagcaacttggagcaattgagcagcctgaagcttatgcaaaccagcaatatacatagacctcctcaacctcagcagcaaaatcaaccacagcagagcaattatgacctctccagcaacagatacaaccctggatggaggaatcaccctaaccttagatggtccagccctcagcaacaacaacaacagcctgctccttccttccaaaatgttgctggcccaagcagaccatacattcctccaccaatccaacaacagcaacaaacccagaaacagccaacagttgaggcccctccacaaccttccctcgaagaacttgtgaggcaaatgactatgcagaacatgcagtttcagcaagagaccagagcctccattcagagcttaaccaatcagatggacaattggctacccaattga

SEQ ID NO: 4614 - DNA, 201 bp, Glycine max
  Peptide Sequence Number=SeqID_96299
atgtctcagcatatcagtgttacagttatggattcttgtaatagacaaaaaggaagtactgagtgcggctactatgtgatgcactggatgtccaccatcattttcggaacttttaggaataattgggaagcgccagagagattaaaggcattgcggatccactgggcacagttttatctccgagttagagatcaggcctag

SEQ ID NO: 4615 - DNA, 129 bp, Glycine max
  Peptide Sequence Number=SeqID_96300
atgataaataggcctagtgagtttaacatacataggaaagttgaaagtaaacctaagggaattggaaagaaggattggtgccatcaattgaagaatttgagtcaagaagcaaggggccaaccaccttaa

SEQ ID NO: 4616 - DNA, 191 bp, Glycine max
  Peptide Sequence Number=SeqID_96301
agggtacatcctttgtggtacaagtagagggtacatctacttgggttgttgttactgagaccaagaaagggtacatctcttgtagatcagttctagtggagggtacatccactaggttgttcaaagagaatagagctgccaaaacgggccagcctggcccacgtgggctggcccacaatgggttgagctaa

SEQ ID NO: 4617 - DNA, 435 bp, Glycine max
  Peptide Sequence Number=SeqID_96302
atggcgtacacctactccgcccccgaggagatccacggacttctcggctattgccatgttaggaatgaggcaactcatggagaaaaacgtggccaccgctgccgctgttcggctgccgaagcagacccaactctcctagctaccgcgcaccatcctcccccaaatacgataggacgaggaatgagcacactggggcacaacagcaaccccaatttgggatacaaccgggtggcttacccttatggattgccacctaattacacgccaccaatcatgcaagatgatgcgggtcatgtctcttcccccatccttgaaggggagcctcctcgacagcttgacgaggtccacgaagatcatcaagagtatgccaaaggggatgtcgagttctaccccccgatccctgtcgaggagccggcacccaacactttgccttag

SEQ ID NO: 4618 - DNA, 333 bp, Glycine max
  Peptide Sequence Number=SeqID_96303
atgcagtctcagcttcaatcacagatgcaatcacagggacttgcactgcctttggagcttaaggttggtccctcaactactcatgttagcacaaaggggagttgtgttgatccctcaccgaccgatccagagacgggtgactcaaacaaatgtgggctgtacatcgaagaaaatccttcccgccaggttgccctaggaagattttatgagggatcaacagttgttcacaacatccctttgttgcatggtcaggtgaagattggtgttgaggaggttaaagatgcaaaggctctcgttcctgtacccactaacgaggttcaactagtggggtag

SEQ ID NO: 4619 - DNA, 396 bp, Glycine max
  Peptide Sequence Number=SeqID_96304
atgaaaattaaaagagtagggaagaagaagacaaacacaagagatttatactggttcaacaacaacccgtgcctacatccagtccccaagcgacctgcggtccttgagatttcttttcaaccttgtaaaaatcattttacaaacaaagatccacaagggatgtgccctcccttgttctctttgaacaacctagtggatgtaccctccactagaactgatccacaagagatgtaccctctcttattctcagtcacaacaacccaagtagatgtaccctctacttgtaccacaaaggatgtaccctccaatgtgttaagacaaagttctcaggcggttagtcctttgaaactttgtgaagggggaaacaaaagaattctcaagcggttagtcctttga

SEQ ID NO: 4620 - DNA, 204 bp, Glycine max
  Peptide Sequence Number=SeqID_96305
atgtgtggaagcaatgtcttccaaggttattttgatgatgccaaagaatcaagagttaagcaaagtttcaagcaaagattcaagaatcaagtttcaagtttcaagtttcaagattcaagattcaagaatcaagatctaagaatcaatattcaagaaaaatcaagatcaagattcaagactcaagagaagactcaatcaagataa

SEQ ID NO: 4621 - DNA, 258 bp, Glycine max
  Peptide Sequence Number=SeqID_96306
atgccttcctttcgcgatttggagcagaaatggctaccaaaggttggagctttgttggagcttcaatggtggaggaagaagaagagaatggcaacctatgcaacatgtctccatttgagtggagcaaaagtgcccactttttctcttgatgtgactcatgctcagccacatgatgagaaatgccaaaatcctgcctcggtttgcatgtcgttcctctggttccaatccctcgtgtttctctacgcccgtcggggctag

SEQ ID NO: 4622 - DNA, 219 bp, Glycine max
  Peptide Sequence Number=SeqID_96307
atggggttgtgtggtggtgacaatgaggctaaagagggaggctggttgacagggtctatgaaagtgaaaaggctagagaggggaggctggttgacaggtgacaatgatgtcgtggtgggtaggtgttgtaggggaatgattctgacaaggacacgccgacaacaacatggtggaggaggtagcggcagcatggatctaagcattagagagcggatctga

SEQ ID NO: 4623 - DNA, 291 bp, Glycine max
  Peptide Sequence Number=SeqID_96308
atggtgtggattagattcctaggaattaatctagttttctatgatgaaagcagtctcttggcacttgcagccatggtaggaagtccttttaaagtggatgctaacacgttggatgtcaaacgtgggcgattttcacatgccaataaacatgttattggtaaacatgttattggtaagatgtggcttctagaccactgcagtaatgatttctccatggatgtggtgcaggactcccaaagtcccatgcaagttagtgatgaacaaattcctcctggcaagatgtcctcctag

SEQ ID NO: 4624 - DNA, 234 bp, Glycine max
  Peptide Sequence Number=SeqID_96309
atggagctacatcatggagttctatgcattataagcctattttcattcaagaagcgtgtggtcatgtttgaggaatttggattttgtccaactgggatgacttatcttatggtttggttgatgaggaagaatgtgcaaaatagagctcatgcgagaaagaagttagacaaatgtatggcgaatccaaaatggaggcttggcttccctcatgctttggtggaagtgcttccgtag

SEQ ID NO: 4625 - DNA, 1029 bp, Glycine max
  Peptide Sequence Number=SeqID_96310
atggcaaaatcagtggagaagcccttctcgattattggccttcttgctattagtggtggtgacaagaagaaaacacttccaacaagcaagcccaaaccattcaacaaaggaagaagttctaccgtcgagacccattacaaatctactcacgacctccttccacctcacaagaggaaaatggttgttaatattgaagacaatgtagaaccagttggttctagcttggtcaactttagcaacttcggtggttctcttatatggatgtctttgagccaagagattgatcatgtcatcttgtcaaaagattgggagtccattcaaaagaagggtcttgccgacttagagtctactatgtcgatcttagctggacactatttgggtgatgtcaacccactgaaactggttgaagaggaaaatgttactttgaagaaggcacaagatcaagcagacgcattgtcagaagagtttaaccaattgaaagagatcacccgacttaaagaggagtcgagtcaaggagaggtcacccaacttaaagaggagtcgagtctgggagaggaagagaacttcaagaaggccactagaggctcttttaacaatgttttgaagcaagttgagtatctccaccccaaggagactaatgatttgggaactcttgatgatgtaatggttgatgggtttatcaaaacccaaaggttcattgaagcttccgatgttgatgctggccttgaaggacctcaaatggttgatgttttgatagttgatgaggcctttgaatttatccgagattacattttcttagctttttcttctgcatttgttgtcaagatattttgtgtagctaaaagatataagctttgtcatgaattgatgcaatcctaccccccaagggtattggatagaagactccaagaggcttgggctagagctactaaagaaggccctagggttctcatgaaccttaggctaagctctagcttctttaggaatcttctcaaggaagcttctcaaggaggtgagcttagttattag

SEQ ID NO: 4626 - DNA, 315 bp, Glycine max
  Peptide Sequence Number=SeqID_96311
ggttatgatacggcgcagttcgatctgggccgctggctgattgagggccgcggtggcgaccgcgactacgaacaggggtttggctggatgcgtcttggcgcacagcgcggcatggtgatggcacaggcctggctcgcccgcctctatcgcgatggcattggcacagaaggcgatctcgtcaaagcagcggcctggtatattgttgcccagcgcgccggttttcgctcaccagacctcaacgacatgatggacggactggctgatgaccagattaaacaggccatagaaaccgccaacaatctgcgcgtccgctga

SEQ ID NO: 4627 - DNA, 675 bp, Glycine max
  Peptide Sequence Number=SeqID_96312
atggctgcaagtgacattgctattctcagagatagagcccacataccaacaaagaaaagccttctagaacttacatcacaagatgcgttgctggcacagaacaagttgcagggtgtgccatctgatgtggagctcacaattatggctgctgtatccccaatgaagaaccagctcatgaagttaattatatggggaatcagccaagacaaaatttcaatgcaagtggatattccggatttcagcatgcaagggcctagtctctatgatcgaacaatgaagctggaagagactctagctcaatttataaaggtatctatgtcaaaccataagagcatagagttcgccataaagaatttggaagtccaagtgggacagcgggcaaaacagttggcagataggccgttgtcataccctaatttcgtccggggactattgtttgatgacatgcaaccttgttttgactgcttcgagaaggcggttgcttttggaggaagcaacctggctcgcctgggcgagctgggtggcaagctcctcccctattttgctataaatagagggaggagtgaagaaggaaggggttcagccttcttggcacttcgtattcacttgaaattgattttcaaccgttcttcgtcgttcgttgttcgttcttcatcgttctttggtcttcaaccg

SEQ ID NO: 4628 - DNA, 697 bp, Glycine max
  Peptide Sequence Number=SeqID_96313
aggacaacgcaccctcgccatcagagggctgcacgccctcgccattagaggactacacgtcctcgccttcagagggctgcacgccctcgccttgcgatggttgcacgccctcaccttcagaggactgcatgtccttgccttcagagggctgcacgccctcgccttcagaggactacgcgtcctcacctttagagggcaacacgcctttacctttagaggactacacgtcctcaccttcagagggttgcacatcctcaccttcagagggcaacacgccctcgccttcaggggactacacgtcctcgccttcacaggactacacatcctcaccttcagagggctacacgccctcgccttcacaagactacacgccctcgcctttacaggactacacgtcctcaccatcagagggctacacgccctcgcctttagaggactacacgtcctcacctttagaggactacatgtcctcgccttcagaggactacacgtcctctccttcaaaggactacacgtcctcgccttgagagggttgcacgccttggccttcagagggctacacgccctcgccttcaaagggcgacacgttctcgacttcagagggctgcacgccctcgcctttagaggggtacgtgtcctcacttttagtgggctccacatccgcaccttaagagaatttaaggtcctctacccttaa

SEQ ID NO: 4629 - DNA, 414 bp, Glycine max
  Peptide Sequence Number=SeqID_96314
atgccaaggagatgtgggatactctccaacttacacatgaaggcaccactgatgaacatgaaatggaactccaatggcttaatcaaaatgaagaaaccgacaaaaagaagagaaaaatttgtcaagaaaagaagaatcgagaggagtcagaacttcaacaatggaagaaaatcacaagaagactctcaagttcttaaatgttacaaatgcaaccaacttggtcacatcaaagctaattgtccttcaaatgaagaatggcctaagaaaagtgataagaaaaggtatgatgaaagaaggaccaagaaggcctacattgcatgggatgacaatgattcatccgatggttcagaaaaggaaattaatcttctaaccaaggattatgagagtgatgagaacatttctcaagaaggttaa

SEQ ID NO: 4630 - DNA, 369 bp, Glycine max
  Peptide Sequence Number=SeqID_96315
atggccaagttcgatccagaagtagtccttgagttttatgccaatgcttggccaacagaggagggcgtgcgtgacatgaggtcctgggtgaggggtcagtggatcccgtttgatgcagatgctatcggccagctcctgggatatccgttagtgctggaagagagccaggagtgcgagtatggccagaggaggaaccggtctgatgggttcgatgaggaggccattgcccagttgcggattttgaccggggcaagattttgcccggactgctgccggaagacgggtgcggatcatgcgcaccaatatgaccaccctgactcagatatggatgactttgctgctcaacaacatcctgcccaccgatcataa

SEQ ID NO: 4631 - DNA, 348 bp, Glycine max
  Peptide Sequence Number=SeqID_96316
atgtttggaaactttacggattacacaacaacgctctttttgacttccagaatgttgcagaactttacggattgcgcaacaatgcttgttttgacttttggaatgttgcgaaactttatggattatgcaacgatgcttgtttcgagggttccgaagggagcaaacaaggttcaaggaccgaccacaaaatggcatgatcactggctggcatattctcaattagctcagttgcttcttccaaggtcttcagctttatttttccccttgcagaagcatctagtagttgcttggagaattctaagcaattgggcttggatccagaatttggctgaaccggcttggacataa

SEQ ID NO: 4632 - DNA, 162 bp, Glycine max
  Peptide Sequence Number=SeqID_96317
atgcttccttttcagttccggcatgtcatggaacatcacgaattgcctaacgatgggtgccagcattcgttattcgctctccctcgaggagattctgctgtcttcctcttcgggggaaaggatgaggattctcttcataggccaaggttcaaagtagcttaa

SEQ ID NO: 4633 - DNA, 492 bp, Glycine max
  Peptide Sequence Number=SeqID_96318
atggttatgggagatttcatcagcagactctccttccccgtggagaaaacaccgagactttttcaagtctcacaagttatcccagaactacgtaggtctgagttcctcattggaggatacgtaggagcaagagcctcgcttttgtctgaccacaccgccttttgttgccataactcaagagctggtgatacgcggagataccttacggttatccgcacccctttgctaggtcagacacagttgtgtccgatggcaagcagagaccaagtttggtcattctgcacacatgatacgcggagataccttacggttatccgcacccctttgctaggcagacacagttgtgtccgatggcaagcagagaccaagtctggtcattctgcgcacatgatacgcggagataccttacggttatccgcacccctttgccattcaggcacagttgtgtccgatggcaagcagagaccaagtttggtcattctgcacccatga

SEQ ID NO: 4634 - DNA, 744 bp, Glycine max
  Peptide Sequence Number=SeqID_96319
atgggtgacgtagaggaagtgcaagaacagatgaaagccgacatgtcagctctgaaagaccaaatggcttccatgatggaagccatgctagatatgaaaagattgatagagagtaatgcggcaacagctgccgccaccagcactgtcgttgaagcagacccgatccttccgtctacagcaaatctagcacatcaactcgccccgaatatggtgggacaaggaagagacacattggggaataccaacagctcgtgtttggggtacaaccgaagtgcttacccctatggtctaccccccaaggaagagacacattgggatccttgcttgatgcatccaggtgcatcgcatgatatggaaacatgttcagcggtggagcagttgttgcagcggatgatagaccaaggccgactcgagatcggtgacgaggacgagaaagaacaacataagccgaacgagaggaaggagaaggccaccgacactgattccacttccgccaaagtgaccaatatcaccggactaggcggcatgacccgcagcggccgcatctttgtggtgcttgacttgtcggtacgacctgtgaacgctaacagaaaagaaaaagtggtcgcagaagaggccaacgaagcaaaccccaccccggatgaggatgttccagcggggaggttcactgaaaaaggggaaggactcggcagaaaagaggtatccttggaggaggccaacgagttcctccgtataatccaatag

SEQ ID NO: 4635 - DNA, 564 bp, Glycine max
  Peptide Sequence Number=SeqID_96320
atgaggaatgccttgcgcttagatagcatgaaaaagtgcttcgataatatgaaatggcttcgaggaagctttctgcaaaaagatctaggagggacgtcgcggctgaagggaccagtgccatttgacagccatcgtttcaggagcgctgagcaccagcagcatttcgaagccatcaaaggatggttgttccaccgagagagacgcgtccagctcagggacgatgagtacgtagattttcaagaagagatagctcgccggtgttggatgtcgctggtcactcccatggctaagtttgacccagatatagtcctagagttttacgctaatgcttggcccacggaggagggcgtgcgggacatgcggtcatgggtaaggggccagtggattccttttgatgcaaacgccctcagccagttcctgggtgacctgctagtgttagaggagggccaggagtgcgagtttagtcagaggaggaaccggaccgatggatttgacgaggaggtcatcgcccagccgatatgcatacggggccaggatttttctcggaccgctgccgggaggcag

SEQ ID NO: 4636 - DNA, 597 bp, Glycine max
  Peptide Sequence Number=SeqID_96321
atgggtaaagctcgggcagcagtagaagagctgagaaggtttcttgtggctaggaaactggacaagttctacatggtccttatcttgaggagtctacactcagattttgatcatgtacgtgatcaggtcctagctggagatcaagtcccattgatggattctctcattactaggcttctccgtgtacctcatgcgttgaaggatgaaaatctcactgatgctgtggaaacattagccatggtggcacctcgtgggagagggggaggccgtaacagtagaggaggccgcaatggaagaagtggacgtcctcaatgcacatattgcaagaggatgggccacactcaagaaaattgttactctttgcatggcttccctgacaaagtggcacaggtatccaagtcagaaaaatctgagtctaagttttctgatgaggaataccaagagtatttgaagctcaagtccgagaaatccagcaatcaagcatcatcttcatcagtactatgtttctcaacagcatgtgtttctcaatcaatcggaagtcctagcccttggatacttgactcaggtgcctctgatcatatctctgtgtccatataa

SEQ ID NO: 4637 - DNA, 222 bp, Glycine max
  Peptide Sequence Number=SeqID_96322
atgggtgatcaagaggagacacaggaacagatgaaagccgacatgttggctctgaaagagcaaatggcttccatgatggaggccatgttaggaatgaggcaactcacaagatttacgttgacacgtggagatttatggcccaacaagcccgttgacacgcagagatttacgtcatcttccgcgctcacaagatctatcatactgacatttgagtcacgctga

SEQ ID NO: 4638 - DNA, 366 bp, Glycine max
  Peptide Sequence Number=SeqID_96323
atgcaaaagataccaaaaaggaggggcaaaagggtctttttacctagttttttggaccctggctcgcctgggccttcaggagacttcagcctgaaggaactagctcgcctgggcaagccagttacttcaggtgtaagtcttggctcgcttgggcgagctgccatggtcccaaatgccttttttgatataaataggcatgaatgggagctggggaaggggtgccagcattcaatagtgaaggaaattgggagaataaggaaagaagaagaaagaaaaagaaacgaggtcgaggcgctaccaaatcgcgattgtgatcaacctctacatcgttccttgtttggtgttcttcgtgctaccatcggttag

SEQ ID NO: 4639 - DNA, 270 bp, Glycine max
  Peptide Sequence Number=SeqID_96324
atgaagcttgcttctacaaagacaacgattgatacctcaaagccctacactggggcaatgaggggcactatgcatgagcctcaagcgaacgtaggggcagtacctattgcctttagaggactacacgtcctcgccttcaaagggctacacgtcctcgccttcagagggctttacatcctcgccttcagagggctacacgtccttacctttggagggctacacgttctcatctttagagggctacacgccctcaccttcaaagggatgcag

SEQ ID NO: 4640 - DNA, 402 bp, Glycine max
  Peptide Sequence Number=SeqID_96325
atggaagtcgaagctaggcgaatcaggaggtttgtgcctcagaggccctcacaccgcactattctcccgcttcacgcttcttcctcctcccacaatgtttccaacaccatttcctgctggtattgcgactacaaaatctgctcgtttaatagacctcttttccactttggtcgccgatacgccaggtttttgaaagtgtggttttcgattggggttgggtttgccctctctgctgtactcggagtcactttggtccctggtttaagtttatcgcttgctgatactgggtatgcatgtgtttctaccatcatatctgtcttcatgcatgaattgggtcatgcagttgctgccacaagacaacctttgggatgctctcatctattgcttcctcctaaagcataa

SEQ ID NO: 4641 - DNA, 150 bp, Glycine max
  Peptide Sequence Number=SeqID_96326
atggcctcctatggtgtggcgtctcctctctctcttcctttctccattccgctgccattcatcttccaagaagcaaaggaatccattgatgaagaagatcctaggcctacaagctccaatggagcttgcatcaagatagatgagagttaa

SEQ ID NO: 4642 - DNA, 312 bp, Glycine max
  Peptide Sequence Number=SeqID_96327
atgcccgcctcttgcaaagcttcaaagataaaccttcttgaggttactatgtctttcatttgcttaggcctctatagtccgcacgcccctatcgcatttaccgctgggccacgcactgctcgaatgaatgccccagagtgcctccgtgatacgcgcaggttggcgattaaggatggaaacaagtccctgtatgacatcggaatcaaggaaaactctggaagcttctttactgaagggttcctccccagattagaacttgtgccagaattgaaatcaccggtgggacaaggccttgcaggagccggggcttga

SEQ ID NO: 4643 - DNA, 768 bp, Glycine max
  Peptide Sequence Number=SeqID_96328
atgcttcctttcgactcccgacatgtcgcggaacttcatggatcgcctaacgatgggtgtcaaacacctcgaagcggtcaagcgaaggtcgcatcccaccaaacagatgatccttctgttctttcttccgagggtaaaggtagaaattcctatcctgggtcaaggtttatggctgaagggttgaggttttggctaaaaaggcttgcggaaggtaggacatggcgtatgtcagggagaaagtccaacatatcggccatgtcctcatcctcttgggcttcgtctacacctccagaggcccctgccaggccaccgtggcctcaaactactcaggagtgggccaagggaaaggactggggtcctgactttgttggtgcagttctatcctatgcaagcgatcggagatggacctcaaagacgatacctcctcttgaggcggcggtggcgcatctgcagctggttgttggtcctcctctggctactagggcacctagccctgcgcctgcgcatgcctggggtgcagtatttctcgatgaaggccctattaataggaggttgggtgaccttgctgggggtgacgggcactccgtagaattgacagaggcccgtaatcagagcaggaaaccccagggccctgttggacttctccaggtccacagggtgtctcgtcagagtttggtcgcatcgggccgtctccaaggattgaaaagccgtctccaaggattcttccgcaacttcaacgtacgacatataagaaggacagcttactaa

SEQ ID NO: 4644 - DNA, 354 bp, Glycine max
  Peptide Sequence Number=SeqID_96329
atgtcgcggaacttcacggatcgcctaacgatgggtgtcaaacacctcgaagctatcaagcgaagaacatcattcggccggtcaatatccccgccagcggaaccttttccattgcacccaatcgtctctgcccagcagagaagaatcccgcgcgtcgctgggcttaaatgtttccggatgacgagggggcagaagacgatgtcagtttcttcgcgtcaacgggctcgtttgccactggttgacgaaagggtgcagaagacgacgttagtttctgtgtgctatcagacgtggagtcttacagatagcaaaagagtgtggatgaccataatttgtctccgcgtaccaacggactaa

SEQ ID NO: 4645 - DNA, 1171 bp, Glycine max
  Peptide Sequence Number=SeqID_96330
aaggaaaggcgagggatatggcgaatcaagaggagtgggtcccgtttatggatgtattagcattgctaatctttggggttgtcctctttccaaaggtggatggtttggtggacctagccgcgattgatgctttccttgcatatcaccatagcaaagagagcccggtggtagctgtcttagcggacttatttgacacattttaccgaagaacagtcaactggtttccacgatggaaagaaggaaaggagggagttctcttctcatgtgggggctacccaaacatcccgttgataggaacgaggggttgcattaactacaatcccacactttccataagtcagttagggtaccccatgaggggagcaccgacagaagaaagcctgtctcctttccttgtgagagatttcggcgtgcaaaatttcaaggttatacagagagtccataaggcgtgggaaagcccgttaaggaaagataaagagcttaggggcattcgtaatggcatcattggtggttatcatgaatggctgaaaggggaagttgaggcaccggaggaagacgaagaggtgcaggctcttaggacagaactcgagcaagctcaaacagtcaaagaaaggttcaaatcagtggctcttaggatccgaaaggagaatgccgaactgagggatgtaaatgtagctaccaccaaggccttggaacaagagaccaagagggctcgtagggaagagcatggccggaacaagtttcgaggggctctgtggggtagtaacaacgagcttaaactccggagggaggaaagggaccaatcgcgggtagacagtttgatcttgaaggatgagttgaaggcttgctcgaggtccaagagaagtttgtctcagcgtttatgcgagacagagaccaacatgttagccatcatcagcaagtaccaagaggaactaagtctagccatgacccacgagcatagggtggtggacaagtatgcccaagtgtacgcggaaaaggaggctagaggaagggtgatcgactcgttacaccaagaggcaaccatgtggatggaccgatttgctcttaccttgaacgggagtcaagatcttccccgattgctagccaaggccaaagcaaatggcggacacctactccgcccccgaggagatccacagacttctcggctatt

SEQ ID NO: 4646 - DNA, 1407 bp, Glycine max
  Peptide Sequence Number=SeqID_96331
atggtgaaagatggaacctcttatgtggagataaacgtgtcattttcgcccaaagtggtcgcacagcttcgtcgtatcaaccgggccatcaggatttattcattggccaagcagatcgccactgcggtgttgtgggataccgccacgggccgcgcgctggtgccggccatggtgtggcaggacacgcgttatgtcgatgaactcgatcgcctggcgcccgcttggaacccgctcctgctggagcaggtgggccgcccggccggtgtgcgttcgcagtatctgtgggcggcgcgccacctgcgcgattcaccggccgtggcacaggcctggcgcgagcgccggctggcgttcggtaccgtcgacacctggctgctgtggcatatgtcggaccgccgcgaatgcgtgacgacgcccaccaatgccacctcggccggcgcctatgttttgtccgggcaccgctactacctggactggatcgacgcgctggagtttccgcgcgagctgctgccggccttgcgccaggaagccgacgatttcggccagacgcgcgaggacatcctgggccttgccgtgccgatacgggcatcggctggcgaccagcatgcgggcgcggtggggctgggctgcaaggatcgcgggcaggcgaagtgtgtgcatggcacgggcagtttcgtcgacctgatcatcggccccgaggcgcccgtcaatagtggccgctacgaaggttcgttgacgatgacggcgcggcgccaggaccaggtgtcgcaattcgcggtcgagacctttgtcgccaccaccggttcggccttgaactgggtctgcgacaagctgaagtggttcaggaacgcgcaggagatcagtgaactggccgccaccgcgcaatcggcgggcggcgtgacattcatcccggccttgaccgggttgcgcgtgccgcgcatggcggccggcgcgcgcgcctcgctcaccggcatctccatggctaccacgcaggccgaagtggcctacgcgatcctggaaggcatcgcccattcggtggccagttgcatcgaggcggacgaggaagtatcgggcgtgcaggtgtcggaactggtggtgggcggaggcctgtccagcagcgatccgttgctgcgcatccaggccgacctgctggggataccgatccgccgcatgcaggaggccgatcgcgccagcctgcgcggcgcggcgttcctggcgggggcgtcgggcctgctgtggccatcgttgcaggccgcgcgccagaccgccgccaccgatgcggtattccaacccaccctggcggccgaggcccgcgcccgccgccgcgcgctgtggcattcgcgcgtcgaatccgaactggcccacgcgggcctgtattcccaggacaagcaggaggcattgcggacatga

SEQ ID NO: 4647 - DNA, 582 bp, Glycine max
  Peptide Sequence Number=SeqID_96332
aagagctgagaaagttccttgtagctgattcattggaagaagtgaacaagaaacttgacaagttctacatggtccttattctgaggagcttacattcagactttgatcatgtccatgatcaagtacttgctggggaccaagttccatctatggattccctcatcactagacttctccgcgtgcctcattcattgaaggatgagaatcctgccgatggtgtggagacgttagacatggttgcgtctcgaggaagaggaggcagccgcaacaacaggggaggtcacagtggaaagggtggacgtcctcattgcacttattgcaagaggatgggtcacacccaagagaatttttattcgttgcatgggtttcccgacaaggtcgcacaggtctctaaattagagaaggcagagtctagattttctgatgaggagtatcaagagtatttgaagcttaaatccgagaaacccagcaaccaagctcaatcctcatctgtaccatgcttttcaacagcttgtatctctcaatccattgaaggttcaagtccttggatactcgaatcaggtgcctctgataatatttctg

SEQ ID NO: 4648 - DNA, 393 bp, Glycine max
  Peptide Sequence Number=SeqID_96333
atgggtcaggcttgtgtattcccactaaagaaacatctcatgaagttaattacatgggaaactagcctagacaaaattttaatgcaggtggattttctagatttcaacatgggcaaccttaccaatagcataatcaatggagaaatcaccatggtgtcattgactaatcataagagcacagagtcagccataaaaaatctagaggtccagaatctaaaagaagaatgcaaggctgcgatgacccgaggaaggaaggtaaccatggaggaggagaagaagatgaagaaaatggtagaggatgacaaacaacagctggtaattgagccaacacctaaaccattgcaacccttttgtgaacttataaaggaagaagaagaagaggaggatgaatag

SEQ ID NO: 4649 - DNA, 945 bp, Glycine max
  Peptide Sequence Number=SeqID_96334
ctggcggacgatctcaaaacctacggcagtgaagtgattcccaatcacgaaaacagtaaagccatcttctggaaagacggcgagccgttgaagaagggcgataggctggtgcagaagaacctcgccaaaagccttgagctgatagctgaaaacggtccggacgcgttctacaaaggggcgattgctgaccagattgctgaagagatgaagaaaaacggcgggctcatcaccaaagcggacctggccgagtacaaggcggtagagcgtgagccaattagcggaacctatcgcggctacgaagtcttctctatgccaccgccgtcctccggcgggatccacatcgtgcagatcctcaatattcttgaaaacttcgatatgcataagttcggcttcggcagcgcggatgcgatgcaggtaatggcggaggccgaaaaacgcgcctacgccgaccgctcggaatacctcggtgacccggacttcgtgaaggtgccgtggcaggcgttgaccaacaaggcatatgccaaatccattgctgatgagatcgacatcaacaaggctaaaccgtccagcgagatccgccccggcaagctggcaccgtatgaaagcaaccagaccacccacttctcggtggtggataaagacggtaacgcggtggcggtgacctatacgctcaacaccacctttggtaccgggattgtggcgggcaacagcggcattctgcttaacaacgagatggatgatttctctgccaagccgggcgtgccgaacgtctacggtctggtcggcggcgatgcgaatgcggttgggccgaagaagcgaccgctgtcatccatgtcacccactatcgtggtgaaagacggtaaaacctggctgtatcgattttgggatgaacgtcgccgaagcgaccaacgcgccgcgttttcatcaccagtggctgccggatga

SEQ ID NO: 4650 - DNA, 731 bp, Glycine max
  Peptide Sequence Number=SeqID_96335
tttggaacctcttacgtgccgatcaacgtctcattttcgccaaaagttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4651 - DNA, 228 bp, Glycine max
  Peptide Sequence Number=SeqID_96336
atgacgacaaaggtgatgaacaaaaagctcaaaagatcaaagaacaactcaagtgaatcaaagaacatctcaagtgaatcaagaacaagtcaagagttcaagaatcaagaagaactcaagactcaagaagaaagcctacaaacaaagatcaagattcaagaatcaagaatcaagactcaagatctcaagaatcaagatcaagattcaagattcaagattcaagaatga

SEQ ID NO: 4652 - DNA, 192 bp, Glycine max
  Peptide Sequence Number=SeqID_96337
atgactaaagcacgtcaaaatggggtacggaaaggaaaagagggagaagcttgccaaccagctcacccaggcgagctaggttgcttcctccagaaggcaccgccttctgggggtgtagaagcaaagcttcatgatgaatcaaagatgattcaaaggtgttttgatgataaaaatgatgataacaaaagatga

SEQ ID NO: 4653 - DNA, 330 bp, Glycine max
  Peptide Sequence Number=SeqID_96338
atgtcatcgggcccgccgcctctggatgacaggaatgaccaaatttttctctgcttgtcatcgggcccgccgcctctggatgacaaaagggtgcggataaccgtaaggtatctccgagtatcatcgggcccgccgcctctggatgactacaagggtgcggataaccgtaatggttctccgtcatcgggcccgccgcctctggatgacaaaagggtgcggataaccgataagggtcagtatgacaaagattatggggcgaccgacaaaagcaaggctcttgctcctacgtatcctccaatgaggaactcagacctacgtagttctggataa

SEQ ID NO: 4654 - DNA, 127 bp, Glycine max
  Peptide Sequence Number=SeqID_96339
atggctgatgagtttgccactttagcgtccatgttccagctgacaccgcatggagacctaccatacattgagttcaggtgtcgcggcagacccgcacattgctgtttggtggaagaagagtgggatg

SEQ ID NO: 4655 - DNA, 369 bp, Glycine max
  Peptide Sequence Number=SeqID_96340
atggcctcttcaaattctttgtttcctgaaggaaattccatccataggccacctatctttaatggtgagggttaccactattggaaaactcgtatacagattttcattgaagccatagatttaaacatttgggaagcaatagaaataggaccttacatacccaccgtagtagatgtaagtactagcaccacaacacaaaaatctagagacaagtggacagaagaagatagaagaagaatccagtttgatgctttggaacaacaagtggacatgcgtttcaacgaaatgaactcaaggatcaccaaggttgaagaagatgtcactttcatccacacatgctttgatctaccaccaccaccaccaccataa

SEQ ID NO: 4656 - DNA, 1019 bp, Glycine max
  Peptide Sequence Number=SeqID_96341
atgaattcctcctccatttatattcttgtctttgtccagctttggttgttgagcttaccatgcagagagagtgtgtgcatcccaagtgagcgtgagacacttttgaagattaagaataatctgaatgatccttcaaataggctttggtcttggaatcctaataataccaactgttgccactggtatggagtcctctgccacaacgtcacttcccatcttcttcagcttcacctcaacactacgttttctgctgctttctatcacttcgatgaggaagcttatgagaaatcccagtttggtggagagatcagtccttgtttggctgatttaaagcatttgaattacttggacttgagcggcaatgaattccttggagaaggtatgtcaattccttctttccttgggacaatgacttccttgactcacctcgacctctctggtactggattcatggggaagattccatctcagatttggaatctctccaatttggtgtatcttgacctgacgtatgccgatggaacaattccatctcagattgggaatctctccaatttggtgtatcttggccttggaggtcattctgttgtcgaacctctgtttgctgaaaatgtagaatggctatcaagtatgtggaagcttgaatatcttgatttgagtaatgcaaacctatccaaagcatttcattggctacacactctccaatctcttccttctttgacccacctatatttgtcaggatgcaaactccctgactataatgaaccatccttgctcaacttctcatctctgcaaattctcgatctttcccgtactagttattcccctgccatttcttttgtccccaagtggatattcaaattgaagatacttgtttctcttcaattatggggtaatgaaatccaaggtccgattcctggtggtattcgaaacctcacacttcttcaaaatcttgacttgtctggaaattcattctcatcttctatacctgattgcttatacggtcttcatcgtctcaa

SEQ ID NO: 4657 - DNA, 423 bp, Glycine max
  Peptide Sequence Number=SeqID_96342
atgaagcacttcactgacaccctcatcagtgccaacataaatattctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 4658 - DNA, 491 bp, Glycine max
  Peptide Sequence Number=SeqID_96343
cataaatctagctttggtgaaggagttttatgccaacctttacagctccgaaggaccttcaccaaagcaagtcaaggtcagaggccacgtggtgaagattgatgcagacagcctcaacacctttctagagacacctgtggtactagctgagggtgaaaccttacccgtatattccaaatactgcaggttgcccactgatattagagaaattgaggctgccttatgtatcctaggtcaggggtttgatttgcatgctgaaggccaccctgggaagattctcaagaaagatttaacaactcttgctcagatggacatgaatgtgggagccttcatctctagtcagattacatctatggcccagtctaactcttctagacttgggttccttgctcttatcaccgctttatggtcattcattagtggaaactggtctgactctaaagtccttgatagtgtatggttaagttgtcgtactttcacgaggaatcggg

SEQ ID NO: 4659 - DNA, 540 bp, Glycine max
  Peptide Sequence Number=SeqID_96344
atgtcacccactaggcaccctctagacccggataagtctaacagggccctggggtctccggcattgatcacgggcctatgccagtcattcggggttcccgtcacccccatcaaagtgattcgaccaccaatcacccgagccttcattgagaagtactgcacacctaggcaggcagagggtgacgcacctcagggcgcgggcgcaccgtcaccacctcatcaggtcggtcccgctggatcactaggcatggagtgttgtctaccgcacttggtttgccagcaggcggccaaccaccgcggacaggtgcagatacacgagtgtctctaccgtttcagccgcagtcaacaggggcagagttccaccccttttgtgtgccctaccccggagcagtttgcggctgaggtcgcatggccgggagactggcccgatgccaaggcaggggaggagcctgcaggatcccccggtaggatagatgagccccgcatggacgaggatatgactgacctgttcgatttcttgggagggagcggagccacatga

SEQ ID NO: 4660 - DNA, 219 bp, Glycine max
  Peptide Sequence Number=SeqID_96345
atgtcgtaccggatgtcacgacatcacgcttcagaacatgcagattatatgtgtccgtatgaacagattaaacaagtgcatgctttgttaggatcattcaacagtgaaaactggtctgattcttataacttgattggacagcggaatgaagaaggaagagagagagaggagacgtcacttcaaggagaagatgagtctagaagaagttcactaccataa

SEQ ID NO: 4661 - DNA, 786 bp, Glycine max
  Peptide Sequence Number=SeqID_96346
atggcttctagaaagagaaagagcattagtacaaggcccacatctcagtatgacacaaagagattctcttcattagatgcttggaccaaatacactgataatgttatagggagaaacattttacctgagaggaagctagaactatatcacactgagctaaatgactttaaggccgaactagagaggcgtaatttccataaatgcctcaccaatttagtcgatgggagcatagacctggctttggtgaaagagttctatgcaaatttatacagttctgaggatcatccaccaaagcagtccagagtcagaggtcatttggtgaagattgatgctgacagtcacaacacattcctggagacacctgtggtattagctgagggagagactctacccgcctactctagatactgcaggttgcctacagacttcagagagatagaggttgccttatgcatacttggtcgagggttcatcttgaactctgagggccaacctgggaagattcttaggaaggatctgactacactagctcaggtgtggagtgtcctctcatactccaacttggcccccacatcacatacctatgatttgacagtggacagagctaggctgatctttggcctagtctctcacttggatatgaacataggagtactgatctctggccagatgacctctatagcccagtctaacacctttagacttgggttccctgctctaatcaccgcattatgcagagctagaggggttgtctctgacagccttaccttcaagcgcctgagccca

SEQ ID NO: 4662 - DNA, 519 bp, Glycine max
  Peptide Sequence Number=SeqID_96347
atggctcccgaatggttttcgacagaacaacgccgcaaggcattgcatgacgaaatggaacgtcgtcgcagcggcgcagccgacgatggcgatccagcccgcaagcacgggaccgtaggcgctgtcgcactggatagcttcggacatctggctgctgctacctccacgggcggtatgactgcgaagacgccgggacgcgttggcgatagcccggtcatcggcgcgggaacctgggcggacgatcagacggttgcactttccgccacgggtcacggagaatatttcatccgctgggcggtgggccatgaaattgatgcacggatgcgctgggcagggcaatcactcgacgaagcggctggcaccgttgtccgtgaacttggcgaaatcggcggttctggtggtctggttgcggtagaccgtaaaggcaatgtcagtctgccgttcaacagtccgggcatgtatcgcgcatggtgcggtacagatggtgagattcataccggcatttatggcctggattga

SEQ ID NO: 4663 - DNA, 331 bp, Glycine max
  Peptide Sequence Number=SeqID_96348
atggtcccaaggaagcttgcctcaaagagatccaggaaggataaagcggctgaaggaaccagttccgctcccgagtatgacattcatcgttttaggagcgctgagcaccagcaacgcttcatggacatcaaaggatggtcattcctccgggagcgacgcgtccaactcagggacgacgagtataccgacttccaggaagagatagttcgccggcggtgggcatcgctggttacccccatggccaagttcgaccaagacatagtcctcgagttttatgccaatgcttggcctacagaggagggtgtgcgagatatgcgatcttgggtgaggg

SEQ ID NO: 4664 - DNA, 243 bp, Glycine max
  Peptide Sequence Number=SeqID_96349
atggctgaaagaagagaaggaaatagaccaccaaggaggactctggtcattcctcctttcagcaataaggtcatggaattaaagccagcactgcttagcctaatcagctcacatccctttgctggactagattatgaggatccatacacacatttgtctaccttcatggaactatgcattactatgggagcttttgacgaagatgccgaagctgtctacctcagagctttccattttcattag

SEQ ID NO: 4665 - DNA, 312 bp, Glycine max
  Peptide Sequence Number=SeqID_96350
atggcacctttaccgaaggggttcaagattccatatttcactaccttctctgatgaggatggaaaatcaaccatggtacatatagttcgtttcacgactcaatgtggagaagttgaggtgtcattgacatggtactctactatagctgatttgatgaacatgaaacaattggttgacaaattggtaatggatttcatagaaaggtttagaaatgatggaaaccgatgtttagtaaaattgccagagattgaatgtgcaacaatggtggttggtaacatgcgacctcaattgaaggagaaactagttgcctaa

SEQ ID NO: 4666 - DNA, 1377 bp, Glycine max
  Peptide Sequence Number=SeqID_96351
atggttgtttgtgatggagggtcaaggctaagtgtttgggtttggttaggggttggaagagtgggtggagcacttattggtggaggaggttgcataggtggaagtggcattggagtagtagtaacactgaataaatgcatttgggcttgttgtaaattaagaatgagagattcaccaaggaacaaagttgattcaattgcatctttagatgatgcttcatgtgaggttgattcagttggagcctcatccatcttagcttttggttgcataacgactatgaatagagtcgactctaccattttaaatgcttcagtagttgcatcaattgcttcaacaagcgcttcaggaagccgtcctcaaggttcttcacaaagcaagcatttacgtcatcaaagtggagctggctcctttggtgtcataccacaccgtttgattccactaggtcttagcatcatctgcgtcaagctttctgatgagtttttggccttagaacagagtttttcaaattcgggagaagtcttgggtagactctatcaagccatgccaattcatctgctgatgcggagtccaaagggatatgcagttgtcggtgcagagcccaagtgtgcacctccttggaaaatagtgcttgaggagtggaatggtcctttgagagcacaggagatagacaaggggcatccagagccactatggcatctgggggcagagcaacatattcagcaaaaagagtatggacatactcgtaccacgtccattgagggtctccagcttcttctccatgtggatccaagcactggaaacttggatgtgttgattggagaaagaggcttcttggtcgttactggtggtggactggatggatgtggactgggagttggagttgcctcattattagatgaactggagccgtcagagcatgggatcttgatgggttcctttggtgttgaggacttgcatccaactcttgttcaaaccactgaagtgttgttgtctggaaataaaagttcccttgctgatgatggagagcttggagtcttcgtccagtttttcaaagacatggaatacctggtgttcctagagaagtttgttgatgagggtggcatagtggatgtcatccactcctcccaaggtcttcatgttcatgagtatgttaatgtagattgggtgtggaagttgtgggtcattgaaataaccgtggattctgcaaagaagcaaaatgtgttgtatgttgagaccaagaccttccaacatattaatgtaaaagtagtgttcaatgtgaacagtaggttctccataaatttggatggtagcggtgtctgtgatgataatggtggtggtaagggcagtgttttcactggagttagacatggtgagtag

SEQ ID NO: 4667 - DNA, 267 bp, Glycine max
  Peptide Sequence Number=SeqID_96352
atgcagatgctatcggccagctcctgggatatccgttggtgctggaagagggccaggagtgcgagtatggccagaggaggaaccggtctgatgggttcgatgaggaggccatcgcccagttgctatgtatgccggatgtatgccggggcaggattttgcccggactgctgcagggaggcgagtgcgaattatgcgcaccaacatgaccaccctaactcatatatggatgactttgctgctcagcaacatcctgcccaccgaccataa

SEQ ID NO: 4668 - DNA, 207 bp, Glycine max
  Peptide Sequence Number=SeqID_96353
atgccggatggggacatcaggttcaccttagcaacaacgctggtagcggaaattgcaaccgcattggcttccattatcttcttcacgctcatcatggcctccatcattgtggccattttctctttcatggcctccatgccggccttcaccttctcttgcacctcctctgctttacctattactctagctctagcacaggttcggtaa

SEQ ID NO: 4669 - DNA, 450 bp, Glycine max
  Peptide Sequence Number=SeqID_96354
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaactggactgtatgcacgaaccccccgttcagtccgaccgctgcgccttatccggagttagtcttgaagtctgcaccggttaaggctaaactgaaaggacaagttttggtgactgctctcctccgagccagttacctcg

SEQ ID NO: 4670 - DNA, 237 bp, Glycine max
  Peptide Sequence Number=SeqID_96355
atgggagctggccatgcccgaagtcgttaccttaaccgcaaggagggggatgccgaaggcagggctagtgactggagtgaagtcgtaacaaggagcgccccccctgataattgcgtcgttgtgcctgggactgtgagggctctcagccacatggatagtttaatgtgctcatcggcgcctgaccctgagatgtggatcatccaaggcacattagcatggcgtacttctcctgtttga

SEQ ID NO: 4671 - DNA, 540 bp, Glycine max
  Peptide Sequence Number=SeqID_96356
atgagagaaaagaaagagaaagaaaatagtgaggcaccacagaggaataggaaaaagaagagtgatacacctgagagaaaaagtgatacacatgagagaaagagtgataattctaatgagttaattgtttatgtttttcctagtgttcaacccttattgcaggaatttaaaaatgtttttcccaaggagattactcatgggctgccaccttcaagaagctctgaacatcaagtgcaaattgcaaagaagaatgaaagctatgccaagcaaaccaacaagaataggaaggaagtggtacttgaacctagtgatgatcctagacatttgagggcaaatgttttccaagaaggagggaatgatgagaatcctaaaactactcaaatagaaggacctatgactagaagtaggaccaaaaaatcagtggataccctccaacaaatggtagcaggcatacttagcaaggcccaagtggagaaggacgaaggcccagaggcagaggcactaccaagaatatcaatttttgctgaaggcccagattaa

SEQ ID NO: 4672 - DNA, 848 bp, Glycine max
  Peptide Sequence Number=SeqID_96357
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctcgaagaaggaagagataagagggccctatggaaaatgtggtcagaaatccataatagagtccgaccacaagtggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 4673 - DNA, 468 bp, Glycine max
  Peptide Sequence Number=SeqID_96358
atggattttaaacacccacttgtggtcggactctattatggatttctgaccacattttccatagggccctcttatctcttccttcttcgagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 4674 - DNA, 129 bp, Glycine max
  Peptide Sequence Number=SeqID_96359
gcgcattctacatcggttaaatcgatcattctacatcggttatggatcgacgttgtagatgacgatgtaaaaaggggttggtgttttacgacggttataggaaacgatgtagaatggcgtgaattctaa

SEQ ID NO: 4675 - DNA, 168 bp, Glycine max
  Peptide Sequence Number=SeqID_96360
atgagtgaaataaaggaggtacaagagcgaatgaaggccgacatagaggccctgaaagagcaaatgaccacaatgatggaggccgtgatgagcatgaagaagataatggagatcaatgcggctgtgttgaggaaaaaaacccagagtttcaagaacctcatgatttga

SEQ ID NO: 4676 - DNA, 325 bp, Glycine max
  Peptide Sequence Number=SeqID_96361
ggaagatgaaggtcccacaacccaggtacctcagcaagtgaaggatgagtcatctgaggccaccatcccagagccattttttataagagaagaggcagagaagacacaggtgagacaggtagctgctgccacacctgagcgatctattaaggctacttcagagccttctgcacaaagggaggatataccctcacctcagcctgcaatagacccatccactcctcttctagagaggccagaggacttgaatacatcagtcctggctatggacacttctcctccaactactccagtattgcatctgacagatgaggaggatctttag

SEQ ID NO: 4677 - DNA, 234 bp, Glycine max
  Peptide Sequence Number=SeqID_96362
atgagaggcaccatgcatgaacctcaagcgaacctagggcagatcaaaagttctcactcggtgaaaaagaggctatgttatgaagcgctaaaagtgacagttgagcttagctcatcagttgggctaagcgtgcatccatcgataagcacaacttcagcatgcttagcgcgacaaaggaatctagcagagcatcaatatcagggccgcgcgctaagcgcgagatcagtgcgctaa

SEQ ID NO: 4678 - DNA, 480 bp, Glycine max
  Peptide Sequence Number=SeqID_96363
atgcagctactatgtataccggggcaagatttcaccagtgccgctgtagagagacgagtgcggatcgtgcgcaccaacatgaccactcttacacggatatgggtcgtgcccacaagacacccagtggacccggggaagtccaacaaggccctggggtttccagctcgggttacgggcctctgtcagtcctacagggtgttcgtccccccagcaaggtcataccatcgtgacatagggatcgtgcccgcaagacacccaatggacccggagaagtccaacagggtcttggggtttctagctctgattacggacctttgtcagttctacaaagtgcccgtcgcccccaacaaggtcattaggcccccattaaccgagctttcatcaagaagtactgcgccctcaggcaggtgcagggcgagacaccacatcagcctggggatggctgatagcgggcaacaggcacaccgccaccacctctag

SEQ ID NO: 4679 - DNA, 300 bp, Glycine max
  Peptide Sequence Number=SeqID_96364
atgttgctcaagtactactacgttgccaaaactctcattgccaacttcgcatgctttgagatgtactacataccttgggagagcaacaccagaacaaacttgctctccaagatggccagcactaaaaaaatcggacatctcaagactatcatccaggacacgctccaaactcctaccatagatagtgaagaagttatggccgaagaagaggatgaaccaaacttgatgaccccttacaagaatttcctaattcagggggtgttgccatcaaacaagaatgtagcccgaagcttgaaatga

SEQ ID NO: 4680 - DNA, 478 bp, Glycine max
  Peptide Sequence Number=SeqID_96365
tttgttgttggtggaacaacaacctccttgtcaatggttccctgacttcaatgggaattatagtgtttgtgctatatgtgagtcggcccttagacttatcgagtctcgtgcgcagggccctgaggatgactctgttggcttcctctgcatggtcgttggtctaaggatgtttgacagaggtgacaaggccatacttgcatatgaggtgtttctaggtgaacttctccacctcattggctataatttctcgcagtggtcttgcctcgatccacttggtgaagtaattgatgtcactagtaggtatttaactgctcctagggcctttggcagtggtcccaatatgtccattccttatatggcaaagtgccaatgggagctcaaactgtggagattatcaagagggcatgcatcacctttgttgcaagggattatccccttgtatggaaaccacaaattccttcatggaattctctcatga

SEQ ID NO: 4681 - DNA, 653 bp, Glycine max
  Peptide Sequence Number=SeqID_96366
attcatctttatctgctgaaaataagaagcttgagggaaaacttgatgccttggtcaacctagtaactcagcttgccataaatcagaaatctacatctgcacctgttactgttgcaagagtctgtggtctatgttcttctgctgatcaccatacagatctctgtccttctttgcaacaatctggagtcaatgagcaacctgaagcctatgttgcaaacatttataatagaccccctcagcagcaaaaccaacaacagaatcatccaaatctgagatgggcaaatcctccacaacaacagcagcaacaacagcttgtccctcctttccagaatgttgttggtccaagcaggccatatgttcctcctccaatccagcaaatgaccatccagaatatgcaatttcagcaagagacaagagcctccattcagagtctgacaaatcagatgaggcagatggctactcagttgaaccaagctcagtcccaaaattctgacaaattgccttcacaaactgtgcagaatccgaaaaatgtgagtgccatcaccttgaggtctggcaagcaaattgaagtgcctccacctgtagcagcacctgcacttgaacctgtcaagcttcattctacacccggaaaagaggatgagctagctgcataa

SEQ ID NO: 4682 - DNA, 356 bp, Glycine max
  Peptide Sequence Number=SeqID_96367
ttaggcatcattttataccttttgctcatcctgagcattccattactagtgaatttgtgtattctattattggtgattttgaacatcctgattttgagcattataattttgagcattctgattttgaacattctgagaacatggcacaacctccaccccgtgagaggaatctaagggagatggctgcacctgatttcacctacgaaagcttgtgcatccaataccctgatgaggatgtcccatatgttcttaaaactggactaatccatttgcttccaaagtttcatggccttgcagggagtggcaaaggactggcagtattaccttgctccaaagtccatcacgagctgggatga

SEQ ID NO: 4683 - DNA, 216 bp, Glycine max
  Peptide Sequence Number=SeqID_96368
atgactgttaaaaagaggctaagtcatgaagtgcaaaaagtgacagttgagctcagctcatcaattaggctaagcgcgcatccatcgctaagcgcagcttcagcgtgcttagcacgacagaagaatctggtagaccatcaatatcaaggccgcacgctaagtgtgagatcagtgcgctatgcgcagcggttgtcttcagccaggctcagtgcatga

SEQ ID NO: 4684 - DNA, 137 bp, Glycine max
  Peptide Sequence Number=SeqID_96369
atggttcatcatcaagcggaatttgaaaatgacgcagaaacaaagttatcaaatgagggtaaggaaaaggtgcattggcccgtaatgccttatgcattcggtaccgaaccaaatggcccagtcgaatctgacgaccg

SEQ ID NO: 4685 - DNA, 732 bp, Glycine max
  Peptide Sequence Number=SeqID_96370
atggagagggtccctatctgtcacattagcaagagctttgtcagtgcggggtggatgcatgaggatcaagttgttgtactgggcaaagaaacctatcaaggccagtcaaactgggtgcaatcgtgctctccgggctttaaattgaagaattggcggatcatggagcgacccgagattttcgtgtcaaatccaatatccaacaatgagtcctgtgaaagtagtgatactgaggacccggacgttgactttgagcggctaggacttccccccagatttgaggagaatggtggagcaagaagaaagagaggtgaagctgcactgagaggagacaaaggttgtgaatttaggcattggtgtaaagaaaaaggaattcaaggttggcacttgtatctcctcgaacatccgagatgggttagtgactctgttgcgagactaccaagacatcttcgcttggtcttactaggatatgtttggtttgagctaagatattatgcaacacatgctatctttgaatcccaagtgctccctggtaaagcaaaaattgaggacaatgaaacccgagatgtccctaaagataaaggaggagatgaagaagcagttcaacgttggtttcttggccgttgctcggtacccagaatgggtcgccaataccgtgccagtcccggaaaagaatgggaaggtgcaaatgttcgtggactattaggatctaaactgagccaatccaaaggataa

SEQ ID NO: 4686 - DNA, 228 bp, Glycine max
  Peptide Sequence Number=SeqID_96371
atgaagctgaaagctgcaacggttgcgatagctgcgctcgcctcaactcttacgaccggttctgcactggctgatgcgcaatttcgccaatgggtcgcgagcttccgtcctgtcgccataaaggcaggtgtttcgccttccacgttcgaccgcgcatttcgcggcgtggatgcgccggacccggtggtgctgcagaaggcgcgctatcagcctgaatttaccgagcct

SEQ ID NO: 4687 - DNA, 642 bp, Glycine max
  Peptide Sequence Number=SeqID_96372
atggatgaaggcattgccggacggctgaagatcaagttgggcgacacgctgaccatcagcggcgatacccaggcgttcagcgccaaggtcaccagcctgcgccaggtggattgggagagcctgaagccgaactttactttatcttcccgccgggcgcgctggacggccagccgcagacctggcttaccagcttccgctacgacggcgacgcctgatggacatcggcgcgatcctgaaacaggtcggcggcgtgctgcagcaggtcagccgcgcgctggaggtgatggtggtgctggtggtgctgtgcggcggcctgctgctgctggcacaggtgcaggtcggcatgcgtcagcgccgccaggagctggtggtgtaccgcacgctgggcgccggcaaacggctgctgcgccgcacgctgtggtgcgagttcgccctgctggggctggtggcgggcatcgcggcggcggtgggcgccgaggcggcgctgtggctgctgcagagccgggtgttcgacttcccgtggacgccgacgccggtgctgtggtgggcattgccgctggccagcgcgctgctgctgtcgctgtgcggcggctggctgggcgtgcgcctgctgcgcggccgggcgctgttccgcagttatga

SEQ ID NO: 4688 - DNA, 648 bp, Glycine max
  Peptide Sequence Number=SeqID_96373
atgaagctttgcttccacattcccagtttgagaaccactaaaagaaaggaagatgaggcaccagaggaagacgaagaagtgcaggcccttagggcgaaactcgggcaagcccaaacagttaaagaaaggttcaaatcagcagctctgaaaatccgaaaagagaataccaaactgagagatgtaaatgtggctaccaccaaagccttggaacgagaaaccaagagggcttgtagggaagaacacgaccggaacaagttccgaggggcccagtggggtagcaacagcgagcttaaactccgaagagaggaaatggaccaatcacgaaccaacatgttagctattatcaccaagtaccaagaagaactaaatctagccgcggcccacgagcatagagtggcagacgagtatgcccaagtgtatgcggaaaaggaggctagaggaagggtgatcgactcgctacatcaagaggcaacgatgtggatggaccgatttgcccttaccttgaacgggagtcaagagcttccccgactactagccaaggccaaggcaatggcggacacctactccgccgccgaggagatccatggacttctcggctattgtcagcatatgatagatctaatggcccatataattagaaaccgctag

SEQ ID NO: 4689 - DNA, 369 bp, Glycine max
  Peptide Sequence Number=SeqID_96374
atggtaacgacaaaacgacttcttgagtcgttgttgttatttctaacgtgtatgtcttcagtttcgactttggagggagtcgtcgtctctctttttttttttttttttcctttcattctctccctcccctcaccaacacgacacacagacacaccaaacattatatatattaacaaacaacattgtcgtaatgtcatcattctcatcctctgttcgttcgattctaccgatggccggtgcacactcccacagacaatcacagctgcaccaccaacaaccctcctcacgtctcctcttactcctcaccgtcctccccttgactctcgccaccctcgccttcgtcctccaatggcgcggcggcgtcactga

SEQ ID NO: 4690 - DNA, 171 bp, Glycine max
  Peptide Sequence Number=SeqID_96375
atggaagaattcaagaagatgataattaaggactctatatatcgatcgaagtctaaattcactgagaagatgacaacaagcaatgaggtagacgaagcacaaataaagaaagagatggatggggaaatcttatatagaaaagtgcttaaagagaaggagaagagtgagtga

SEQ ID NO: 4691 - DNA, 820 bp, Glycine max
  Peptide Sequence Number=SeqID_96376
aactggagttttggtctcgtgcggaggatttccaaatgttcccttgatggggacaaggggttgcatcagttacaatcccgttcttactataagacaacttggctaccctatgaaaggggcaccactagaggaagagctcgcacctgtcatttcacgagggttcagtgagaccaacgtggagacacttcgaaaggtccgcaaagcatgggaagtggtacaaaagaaggacaaagagctcaaaggacacaacaatgggcccattggtggctaccgtgagtggttaaaagccctcgtgcaaggtttggattggctcccaaatctgagaaccgctaaaagggaggaagttgaggcaccggaggaagacgaagaggtgcaggctcttaggatagaactcgagcaagctcaaacagtcaaagaaaggttcaaatcagtggctcttaggatccgaaaggagaatgccgaactgagggatgtaaatgtagctaccaccaaggccttggaacaagagaccaagagggctcgtagggaagagcatggtcagaacaagttccgaggggctctgtggggtagtaacaacgagcttaaactccggagggaggaaagggaccaatcgcagaccaacatgttagctatcatcaccaagtaccaagaagaactagatctagccacggcccacgagcatagggtggcggacgagtatgcccaagtgtacgcggaaaaggaggctagaggaagagtgatcgactcgttacaccaagaggcaaccatgtggatggaccgatttgcttttaccttgaacgggagtcaagaacttccctga

SEQ ID NO: 4692 - DNA, 240 bp, Glycine max
  Peptide Sequence Number=SeqID_96377
agattcaacaagtttataaggaacaaaggaaatcaaagaagaacaaatttcaatccaaagaaaaaaggagaagactctccttctgttccaaagtgctatgaatgtaatcaacctagacatctaagagttgaataccccagtttcaagaaaagaatggagaagtctgacaagaaaaatttcaaagacaagaaagcaaagaaagcttacatcacttgggaagataacgatatagattcataa

SEQ ID NO: 4693 - DNA, 225 bp, Glycine max
  Peptide Sequence Number=SeqID_96378
ttctacggagtgcccgtcgcccccaacaaggtcatcaggccccctattaatcgggctttcatcaagaagtactgtgccccccaggcaggcgcaaggcaagacaccacagcagcttggggatggccggcagtgggcaatagacttaccgccgccacctctagagcccctcagctcatctacaaagcctggagggttgcctacgacccgtggccgaccagcaggtga

SEQ ID NO: 4694 - DNA, 212 bp, Glycine max
  Peptide Sequence Number=SeqID_96379
ggatcgcacccgtaagacacccagtggacccgaagaagcccagcagggtcctggggtttctagctctgattacgggcctctgtcagttctacggagtgcccgtcgcccccaacaaggtcattaggccccccattaaccgggctttcatcaagaagtactgcacccccaggcaggcgcagggcgagacaccacagcagcctggggatggctga

SEQ ID NO: 4695 - DNA, 1506 bp, Glycine max
  Peptide Sequence Number=SeqID_96380
atcgtgggcgaaggctggcatcagcgcgctggtgaaccgcacgcggaagtgcacgcgctgcgcatggcgggtgaccacgcacgcggtgcgaccgcatatgtcacgctggaaccctgcagccatcacggtcggacgccgccgtgctgcgatgcgctgattgccgccggcgtcagccgggtggtcgcggcgatgcaggatcctaatccgcaggtggccgggcgcggcttgtatcgtttacagcaggcgggcatcgacgtgagtcacggcctgatgatgaacgaagcggaagcgcttaatcgtggttttctcaaacgcatgcgtaccggttttccgtggattcagctcaaactgggtgcctcgctcgatggccgtaccgccatggccagcggcgaaagccagtggatcacttccgcagcggcaaggcgcgatgtgcaacgtttacgtgcccgcagttcagctatccttaccaccagcgccaccgtgctggcggacaatccgtcgctgacggtgcgctgggatgaactgagcgagaccgtgcgccagcagctggatgagagccagctgcgtcagccggtgcgggtggtgatcgacagccagcagcgcgtgacgccacagcatcgtttgatcgcccagcccggcgaaacctggctgatgcgcacggaggctgatgcacaaagctggccgccgggcgtgagtcagattgaggtgccgccgcgcggtgagcagctcgatctggtggcgatgatgatgctgctcggtcagcgtcagatcaacagcgtgtgggttgaggccggtgccggtctggccggtgcgctgctgcaggccggcctggtggatgaactgatcgtttatctggcgccgaaactgctgggtaatgccgcgcgcggcctgtgtgcgctgccgggactggaaacgctggccgatgcgccagcgctgaattttagcgacgtgcgtcagcctgagcgcgttgccgaagagtatgatagaatccgcccccttctgcggggccataaaacaaacacccaaaggatatgtatgaaagttatcgaagctgctgttgccacgcctgatgccaatattgccatcgttattgcgcgttttaacaatttcatcaatgacagcctgctggacggtgcagttgacgcgctgaagcgtattggccaggtcaaagcggaaaacatcaccgtggtctgggttccgggcgcttacgagctgccgctggcggcacgcgccctggcgaaaaccggcaagcacgacgcgatcgttgcactgggcacggtgatccgtggcggtaccgcacacttcgaatacgtggcgggtgaagccagctccggcatcgctcatgtagcgatgaacagcgaaattccggtgaccttcggcgtcctgaccaccgaaaacatcgagcaggcgattgaacgcgccggcaccaaagcgggtaacaaaggcgccgaagcggccctgaccgcacttgaaatgattaacgtattgaaagccatcaaagcctga

SEQ ID NO: 4696 - DNA, 945 bp, Glycine max
  Peptide Sequence Number=SeqID_96381
atggtggccagagcgctggcgtatagccgtgaattgcgggcggcctctgccgaggtacgtctgggcgtgacctcgccgctgtcgaccgtgggcggcgatcgtcagtcgtcctccaacaatagccatatcagcgactccagcggcacggtctccgtcaatacaccgattattgactggggaaggatcagcaaccaggtggacaactctctggaaacggcaaaagcagcccgttattcaaaagagtattcccgcgaacagctggcctataacaccgtgtctgaactgatgaatatggggcgctaccagcgcagtaaggtcgtggcgaaacagtatgtcggccgcatgaaagagctggtcaccatgctgtcgcaaattactcaggcggaccgcggaagagagagtgaactggtacaggcaaaagcaaaactgatgtcggcccaggcgagtctcgataacattgagcatcagctgagcgccagcaaaatcaaactggtgcgcctgctggggatcgagcctgaattaccggaaggcataagctggcacgacacggtcattccggcctcagtggccctctccgcgctggataaaaatccgatgatgctgaacctgcagtccaaagtacgggcggcagagtatgaggcagaaagcattaaatcctcggctctgccacaggtgaactgggtcatctccaaaagcaccgccaaagacagcaacggtaacgaggccgggtggtataccggtttaaacgtcgagtgggaagcgtttagcggcggctctcagcgtgccgccgagatgtccgcgcgcgcgaaagccaatatggcgcagcagcaatatgaagtgagttacaaagatctggagtatcagatcaactatcagatccaggtccgtgactcctccttcctgcgcgccgatgattacgatcgtctgtcaggtgaaacggatcgg

SEQ ID NO: 4697 - DNA, 477 bp, Glycine max
  Peptide Sequence Number=SeqID_96382
atgccaatctccctctgcagatgtatcagttgggatcgcgcccacaagacgcccagtggacccgaagaagtccaacagggccctggggtttccagctctggttatgggcctctgtcagtcctacagggttcccgttcccccagcaaggaatcgctcccacaaagacacccagtggacccggagaagtccaacagggccctgggggacccgcaagacacccagtggacccgaagaagtccaacagggtcttggagttgccaagctctaattacgggcctctgtcagttctacggagttcctgtcacccccagcacggtcatcaggccccctactaatcgagctttcatcaagaagtactgcgtccccaggcaggcgcagggcaaaacaccacaacagcctggggatggccggcagcgggcaacagacgcaccgtcatcacctctagagttcacctcagctcatccacaaaaaggttag

SEQ ID NO: 4698 - DNA, 129 bp, Glycine max
  Peptide Sequence Number=SeqID_96383
atggaagttgggagttggaagtggaagttactggaagttggaagtggaagttactggaagttggaagttggaaatgaaagttattggaagttgaaagttgaaaatgaaggttggaagttggaaggggaa

SEQ ID NO: 4699 - DNA, 246 bp, Glycine max
  Peptide Sequence Number=SeqID_96384
atgacagtcgacgtcggccaggaaagcccatgtggagaaggacgaaggcccatgtggagaggggcaaaggcccatgtggagaaggacaaagcccccgagtggagaaggatgaaggcccaagtggagaaggatgaacgcccagaggcagagacactattaagactattaattgttgctgaaggcccaagtggagaaggacgaaggcccatgtggagaaggacaaagcccccgagtggagaaggatga

SEQ ID NO: 4700 - DNA, 594 bp, Glycine max
  Peptide Sequence Number=SeqID_96385
atgccgaagtgcccagctggtgtacgccatcctgacacggatgagcatccatgtatggcgcccactaggcaccctttggacccagataagtccaacagggccctgggattccccgcactgatcacaggactctgccagtcgttcggagtccccgttgcacctaccaaggtgattcggccgcccatcacccgggtttttattgagaagtactgtacccagagacagggtcagggtgatgctccacaggctgcaggcgcgcccccaccacctcatcaggctggccaggctggggcatttgacatggagcagtatttacggcatttggttcgccagcaggcagccaaccaccgagcacatgtacggacccatgactgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 4701 - DNA, 324 bp, Glycine max
  Peptide Sequence Number=SeqID_96386
atgatcgaaagttttcaacaacaacaacaaatgtcagttctagaattgtacgtagaaaaggatattgctggtggttctatgtttcatgctgcaaattctgttacgtcatgtggacataataatgtatctcatcatgagtcggaactgccaagaaatataaataatttacatgatgatgaagatgatgatatgatgattatcttgcgtctaactcatatgttgaagagtctttcgaagaagatgatattgttgatggaatatctgatacagacgatgaagtcaccgacatcgttgaaccagtttcaattgttcatccaactgaag

SEQ ID NO: 4702 - DNA, 348 bp, Glycine max
  Peptide Sequence Number=SeqID_96387
atggtcgtcattgtcaatgcggaagcttgtggttacgtgagcatgaactactaccaatatatagatgttgtttatacaaacgagcacatcttaaaagcttactccgcacaatggtggcctcttgggaatgaagcggctattcctccttctgatgacgcatggacacttatccctgacccaactacaattcgtgcgaaaggtcgcccaaaatcaacaaggataagaaatgagatggattgggtcgaaccatctgagcaccgaacaaaatgcagtagatgtggagccgaagggcataacaggcgtcgctgtccaatgcaatctgagcgtgggagttgttcaaatccttga

SEQ ID NO: 4703 - DNA, 336 bp, Glycine max
  Peptide Sequence Number=SeqID_96388
atggaagaagtacaagaaggactcgaatttcctcttgcacaaaggtggtctcatccaaggaccgaaacaaatattcccaccaattcattcttgtggactccttatgatacactagaaataaggccattaattaatgatgttgagggagaacagatattttttggcctcaccatcatcatcactggattgccaaatggaatcattggaatgattatattgtttatggtgaaatgggccaaggtcttttgcatgaaaattcagaatacatgcaatggtatatacgtcgaactagacgatatatatcccgtgaaagagcactatctattgaggttgtaa

SEQ ID NO: 4704 - DNA, 216 bp, Glycine max
  Peptide Sequence Number=SeqID_96389
atgagttgtacaagttcgctaagcgcaccacttcatctttctaagtgcaccgcttcagttcatccgctaagtgagaaagggagtttggactgggattcagagctttgcttgtctagggtttctagagagagaaaggtccaagttccagagagttttgagagattttgctgtgtgaagatctacagagaccagagcttgaagcaggagccagtttga

SEQ ID NO: 4705 - DNA, 249 bp, Glycine max
  Peptide Sequence Number=SeqID_96390
atgtatccaaatttacaaccatttctcccaagaaaagtggacacgttacatatggtgacaacaacaaagaggctctttgctatgcgaaggtatgggggagggatgttgtacgcagccttatccttgcatgttcaagatgatatagtccaagaaaaagatgatcttcccaaagaatggaaaacttcaagaaatcatcctcttgacaacatcatcgaagatatctccattagaagtgatctggcagcttag

SEQ ID NO: 4706 - DNA, 306 bp, Glycine max
  Peptide Sequence Number=SeqID_96391
atgactcaatcgacatcgagtgcaaagttactttcgcttgaatttgctcagagcttctgtttcaattttgagcgtctagatatattacgggactcttgcatgcctgcaggtcgactcagagctaaaaagttattgtcgtttgaattttggagagcttctgtaattcaatttgagcgtctggaattattacgggactcatcggacatccgagtcaaaagttattgtcttttgaatttgcttagagcttctgttttcaattttgagcgtctcaaattatatacaggactcaatcagacatccgagtaa

SEQ ID NO: 4707 - DNA, 107 bp, Glycine max
  Peptide Sequence Number=SeqID_96392
atgggttctccacctgcctccgctcctcctcctcctccttctacttcggacgcatcggcttcaccgtctgccgtgaagcggacacacaaagcctcacgtctacgatc

SEQ ID NO: 4708 - DNA, 267 bp, Glycine max
  Peptide Sequence Number=SeqID_96393
atgaagaaactatgttcaattattggacctggcattggccatgcggtcattcacgaagaaggcctatgctgtagacaatatattccttgtaaaacgacggccagaccaagcaggcatgcgagcaggtcgactctagaggatccccctatagaagtgatcggcgatttcactgcagcagagggtcgtgaatttttgcagaattatgcacttcccggctatggccatactacagagcttactaatgaccagtggtcagcaattttccag

SEQ ID NO: 4709 - DNA, 267 bp, Glycine max
  Peptide Sequence Number=SeqID_96394
atggctaaggattttgaaagaacacttttatgtgaggaagaaggccttgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 4710 - DNA, 216 bp, Glycine max
  Peptide Sequence Number=SeqID_96395
atgtccttcatgggtgatgaggacgacgccaaagagcaagcaaaggaggtagcagttgaagttgtcaaggccgaggacgtcatcgccatgatgctcgagggagagggagacataagggtcaacgaagccagtggcaccgttgatgaggacgaaaaggccagagggggaagtttgggtgataaaggcagaggacaacgcgtcattaggcgacaatga

SEQ ID NO: 4711 - DNA, 489 bp, Glycine max
  Peptide Sequence Number=SeqID_96396
atggatgattttagtgagcataaggatcaagagttgtttcatcacaacaatgaccaaagcgatgatgagggtgttgccgtaacaacgtcacctttgttgcaatatcaccaacctaggtgtccagtagagttgaaccttgaccacctaccacaatacattgattaccaccatttcgttcagcaacaagactatgtacaaccatcaaccgatgcactcgaggttggcatgaccatcgatgaaaaagcacaatatattcaaacagttaaagagtacaacattagaaaccatgttgactacaaaacaatatattttgaccagagaaagctaaacttcgtgtgtaaatcacatgaaaatggttgtacatggagcttagcgcatgcaattcaaagaagcataagaaatgaattatcaatagtattagaggccttggatcttcttcatcaatggagtcctttgcttcttgaagatgaatggcagtggaatggataa

SEQ ID NO: 4712 - DNA, 516 bp, Glycine max
  Peptide Sequence Number=SeqID_96397
atgattcataatttccttggcacttttgatatgttaacagaaattgcgtgccttcaccacttatccatattttatgaatttgctatctttaaatttttgcccagactttataatttttctggctccgccactgactataaccaaaagtgggacccggcaagccgacacattggcatcgatgtgaactccatcaagtccgtcaaaacggcgccgtgggggtttgccaacgggcaagtagcgcagattctcattacctataacgccgacacgagcctcttagtcgcttctttggtccacccctcacggaaaacgagttatatcctctctgagacagtgagcttgaagagcaatcttcccgaatgggtgaatgttgggttctctgccaccaccggggcgaataaaggcttcgctgaaacccatgacgtgttttcttggtcttttgcttccaagttgtcagatggtagcaccagtgatactttggatcttgcaagctttctgctcaatgaggccatctag

SEQ ID NO: 4713 - DNA, 412 bp, Glycine max
  Peptide Sequence Number=SeqID_96398
tagccaagatgaggctactacttcaccttcctctaatgaaaatgaagaagcaataggggaagaatctagggaagaaatctatccccaagaagaaggacaacctttaatggttaaggaggagtgtaaggaggtaagtgtctcctccaagagtggtcaaggggttcccgcagaccctaagagaataaaggtcattcttgattggcccactccaccaacaccactcattgagttggtgaggaacgatgctccctcatgggaagatgtccatgaaaagggtcaaatcctttccaaggtggaggggatgatgcaatcctaccccgtaagggtattggatagaagattccaagaggattgggctagagctgctaaagaaggccttggggttctcatgaatcgcagggtagatttctga

SEQ ID NO: 4714 - DNA, 271 bp, Glycine max
  Peptide Sequence Number=SeqID_96399
gtcgactctagaggatccccacgcatctgatgagttctaccctgggcagagagatggtggtgagtactggacttctgatgccgggccattagaggcctttaagaggtttggaaagaatcttgaagagattgaaaagaagcttatagagaagaacaatgatgagacattgagaaaccgctatgggccagctaaaatgccttacactttgctctatccttctagtgaggagggattgactttcagaggaattcccaacagtatctctatctaa

SEQ ID NO: 4715 - DNA, 607 bp, Glycine max
  Peptide Sequence Number=SeqID_96400
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgaaccaccccactgtggaagagaagatcctcgcgaaactaatggtagtgcttacttccattcgcggtggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 4716 - DNA, 129 bp, Glycine max
  Peptide Sequence Number=SeqID_96401
atgtatgaacatgaaatgcctctgaagaaactctccacgaagaggtctaggagagacgctgcagcggaagggtccagtgccacccccgagtttgatagtcatcgtttccggagcgtcaagcaccaatag

SEQ ID NO: 4717 - DNA, 177 bp, Glycine max
  Peptide Sequence Number=SeqID_96402
atgggtgatcagtccacaagcattaaagagttttacatcaaggctcagcagaaattcccaacaagagctttagccttccatggcaagttatcacctttcagctacaatatggggttttggaagcaaaattcagattacacagtggtggggatgtctcctccacctctaggaacctag

SEQ ID NO: 4718 - DNA, 584 bp, Glycine max
  Peptide Sequence Number=SeqID_96403
gatcatatccggcatcagtcagtaattctttcaaggcgtctaaactcatgatcaatgacctcgtgctggaaattcaagaatttagagagagccttttagatttagggatcgaggttagatcaattttggcgcctattggacaagggagttcacaggtttcagggtcatctcaattatcatcaaaagatgcgtttctgtcaaagactgaagtaaaaaatatctctcagattaatgccagttcagaggagtttgtttgtgttactgtagtgaaggacaactattcatggtgctatccggcttgtggtcaatgttataaaaaagatgacatgcaaactgtgccgttcacatgtccatgtggcaaagagaatgatcaacctgtactaaggtatcaggttgaggtgatggttaatcacaagggtgaacaaaccaaatttttgatctggtatcgtgaatgtgcacagttaattggtcagtcagcggatgaagtcaacaggctcaaaatagaagatggggatgttgatttaaatgcctctcctcaagcactagataggctattgggttgtttccttgcattcaaagtgaag

SEQ ID NO: 4719 - DNA, 375 bp, Glycine max
  Peptide Sequence Number=SeqID_96404
atggggcatcagggacatttccaggcaccgttttccccgatttcttggctcctgatgtcgagaacatcgttcggacatgtgtcctcaaacagaatcagggatagaggaaatttctctcttcttggacagaggtgcaactttgctccatctggtgtggtatctggtggtacccagttggtgcagggtgccaatcctatgctggcttgcatacttcactgcttccctgttgaaagcttccctttcttcctggccaatgaagagctggacttgcttggcggtggaaatgttggcaactttgatgctcagggaaacagctttaatgattccactgcggacttcttatccttcagttggtcttgcccagagggaagttga

SEQ ID NO: 4720 - DNA, 492 bp, Glycine max
  Peptide Sequence Number=SeqID_96405
atgggaaaaccctgggccactccaccgaatagtgtatggcctttaaacacaagagatgcagctccccaaacgccacgatacccctcggtagttagacctattctgtttccataccaaaatagccacgcagtttcgtggaggtatgcgcctccgagcgaaaggaaggaagaagccgctgacttcagctcgttgtcggccaaggtaaccaatatcacggggctgagcagcatgatccgcagcgatcacgtattcgcatcccctgacctgctgacacagcccgcaaacgctaaagggaaggcgaagatagcggaagaacaaaatggcaaagtgatccccgctctggacgaggatattccagtgaaaggtctttctgagaaaaaggatggttgtggccagaaagaagtatcactagaggaggcaagcgagttcctctgcattattcaacaaagcgagttcaaggtcattgagcagctcaacaaaaccctggcctga

SEQ ID NO: 4721 - DNA, 880 bp, Glycine max
  Peptide Sequence Number=SeqID_96406
tgctggttggggctactaccctagcgggggtctcggtctgattttgttgattttgttgatacttgcgctcacaggcagtgcctttctttccctgttcaccggatccattcaagcggttcaggcagaatatcagtgtggcccgccgcattggcaaaaggacggtttaaccgcggtagatatatcagttacgcctgatcaattgacgccagaagtatatgtgccaagccgtcaaggcagtttgcaagttgaaatgctggctgctgcacgacgacatggcgccattgccatccagattccgccacaactggaagccgtcctgcaggagattgctgcggggaatgtggtggtggtcatgcaaaacctgggctttgcctgggtaccgtcctggcactatgccgtcgtggtagggtatgacctggataaagagttggtctggttgcgttcaggcacgtttgaacgctttgagatgacattgagtgcattccagcgtacctggatgcgtagcgagcagtgggctttgtcgcactgcctccacggtaaactgcatgcggcgagcgcctgcgatgacgcatgcagggcgttggtgtatgaaaacgctgaataccatgcagtattgttaatgggcctgggtaatacggcttacgcattgaatgacttgacggtggctgaaatgaccttccggcacatgaccaaagcgcaccctcattcggcggttgcttacaataatttggcaaatgtactgctggcacagaaaaaggttgtccaggcagaggccgttgcacaacatggattggcgttggcgagtgaggatgaaaaactcaccgtccaacttaaacagactctgggtgagattcgccaagctaagaagcaaatgctgtaa

SEQ ID NO: 4722 - DNA, 483 bp, Glycine max
  Peptide Sequence Number=SeqID_96407
atgctggcttttttgttctggcatttcttgctggattatcagcgtcagaaggacgagagtaaagcctatctcgaagcggccacctatggcagtctactgcgtgcccaactggatcgcgagttgaattcgctgctgtttatttcaaacggcttgtccagttttcttaaagtttaccgcaatgaattacagcaggaaaaaatgcaggcgattctgggcgatctctggtccaatgcccaccatgtcaggaatcttgcagtggcggtgaattacaagctcacctatgtttatcctgaaaaaggtaacgagagaattattggtgtcgattatcgggacgtgccgtcgcagtggcccaaggttcaattagcgattgattcccaccgcggggtactggatggaccgattgagctgatccagggcggcaatgggatggtgtaccgcttcccgatttttgtcgatgatgagtattggggcattatgtcgaca

SEQ ID NO: 4723 - DNA, 603 bp, Glycine max
  Peptide Sequence Number=SeqID_96408
atggcatcaaagaagagaaagccacctgccacacctttccaggtccgatatgaccgatccaggttcacttctcttgaggcctgggaaaggtacactgatattatggtacctagaaagataatccctgagcgaaatgtggtaatctaccacaccaagtttgatgagttcaaggatgagctgatgagaaggaaatgggatgaggaattaaccagttttgctgaaggcaacatcgatgttgccattgtaaaggaattttacgcaaacctctacgacccggaagataagtcacctaagcaggtgtgggtcagaggtcacttgattaagtttgatgaggacatgttgaatacattcttgaagacccttgtaatcatcgaggagggggagacattattagtttactctagatttgcactcttaaggcctgatcctcaagagttggctgttaagctctgcatcctagggaggggatttgagctgaatgttgatggtcagcctttgaagattttaaggaagaacatgaccacagtcgctcagacttggagtgttctttcttgctccaacttggtccctacctcccacacttcggacatcacactggattag

SEQ ID NO: 4724 - DNA, 1212 bp, Glycine max
  Peptide Sequence Number=SeqID_96409
atgacaacacgtttcgccctgaaagccctggtactcgccgtgggtttaggcagcgccttttgcagcctcgccgccaaactcaccgtggtggaagttattaccagcccgccacgtaccgcgcttctgcaaaaaatgctcgacgaatacaagacgcagcatcctgggaccgagattgagctgatttcgctgccgtggggtcaggcatttgaaaaactgggcaccatgttacagagcggacaggtaccggatgtggtggagatgcccgatacctggcaaggcttatacgccagcaacaatatgctggaagatcttgaaccccgcctgaaaagctggcctgaaagcgcccagctgacggacaaaacgctggcaatggcgcgtgccgcgaacggcaaagccaccatggtaccgtacggtttttatctgcgagcgctgttctggaataaaaagctgtttaagcaggcaggactgagtgaaccgccaaaaacaatggacgagtttgccagcgacgcgaagcgtattagtcagtcaggtaacggtatcagcggctactgcatgcgcggcggtgtcgggggaaccaatgcgtggatgatgtttatggcggcaatgaacggttcgcctgccttctttgataaagacggcaacagtaccttaacccagccgggggcgataaagggggcacaactgctggttgatttgtaccagcaaggtggcgcgcctaaagacagcgtgaactggggctttaacgagattgtctcgggcttttattccggcaaatgcgcgatgctcgatcaggatccggacgcgctgatcgcgattaaaaatagcatggcggctgaggattttgctgtggcgcccatgccggtcggaccgtccggtaaagccttcccgaccatcggctataccggctgggcgatgttcaaacagggtaaacaaaacgatatcgcctggccgctgattaccttcctcagtaataaaaccaacaatctggcatgggcgaagtttgtcggcacgctacccatctataaaggtgcggaacaggacccgttctatcagacgccgcagtttgccggctggtttaaggagttgaacgatccaaattatgtgccgctcaccatgccgacccaccttaaaggctggggctatttcaattcggtgatcgtgaaagagagcagccaggagacgttactgagcgaaaacgacaccaaagatatg

SEQ ID NO: 4725 - DNA, 183 bp, Glycine max
  Peptide Sequence Number=SeqID_96410
atggatcgtgcaaaggaaaggattaaaagtaacttcaataatgtgaagaaaaattatgaacctatttgggaaattattgataagaggtgggagaaccaactttataggcctttgcatgcaggtgcatattatcttaatcctcaatttcattttgaagatgattttaaaaaggataatggataa

SEQ ID NO: 4726 - DNA, 899 bp, Glycine max
  Peptide Sequence Number=SeqID_96411
ggctacacgccctcaccttcagaggactacgcgtcctcgccttcagagggctacacgccctcgccttcaggggactacacgtcctcgccatcagagggctacacgtcctcgcctttagagggctacacgtcctcgccttcaggggactacacgtcgtccccttcggaggactacatgtcctcgccatcagagggctacacgtcctcgccttcagagggctacacgtcctcgccttcagaggactacgcgtcctcgccttcagagggctacacgccctcgccttcaggggactacacgtcctccccttcggaggagtacacgtcctcgccatcagagggctacacgtcctcgccttcagagggctacacgccctcaccttcagaggactacacgccctcaccttcagaggactacacgtcctcgccttccgagggctacacatcctcacctttagaggactacacaggactacacgtcctcacgttcagagggctacacgccctcgtcttcagaggactacacgccctcaccttcatagggctgcacgccctcgccttcataggactccacatctacgtcttcagagaactcaaggtcctgggccaccccctaatattggagggcgaccaactgtgcgagcacaaccagagagggaggctatcgtgcagctactatgcatacctgggcaagatttcacccagccgctgcaaggagacgagtgtggatcatgcacaccaccacaactccgatctccctttgccaaaggatcgcgcccacaagacacccagtggacccagagaagtccaacagggccttggggtttccagctctggttatgggcctctgtcagtcctaccgggtgcccatccccccagcaaggtcacgccattgtgacatag

SEQ ID NO: 4727 - DNA, 303 bp, Glycine max
  Peptide Sequence Number=SeqID_96412
tcaattgttgaatgcaatgataaactctctgatgaggagcaggtgttgttgttgttggcctcactaccaaggtccttcaaaaatttggttcaaacattgcttatgggaagatcaacttcgaatttggatgaggaagatttgaagaaattaagagatatgaacaaagatagtgccaactcccaagctaatgtagtgaaaagtgttggagatgaagatgatgtgtttttggcaataaatgatgacgttgctaaaacaaaatgggtgatgaattctgttgtctcaaagcacatttgcaaagattga

SEQ ID NO: 4728 - DNA, 375 bp, Glycine max
  Peptide Sequence Number=SeqID_96413
gattcacaagcgattctccttaaatttcagccagcccgcatcattttagactttacaccttacgcttcagggtcatacaatgctcaatggaatgccccggggctcctccatgataagcacacattgcgttcgagcaagttagcatgtgacaccggaatttggggtgagtcctacaggcttttcgctgcaaaattcatttcttggtttgtgctaaaggtggtgtttagcattggttgtgtgatccgcttcgatcctttccccgagcgaagaccaaatccgcaaagctttgaaggtgcgtaccccaccatttttcatagtaaaacactggtgccacttgagctgctagatccctccacctctggacatattccttga

SEQ ID NO: 4729 - DNA, 252 bp, Glycine max
  Peptide Sequence Number=SeqID_96414
atggaggggcggtggccttcggtggtggtgaagggccgcgacagcagcaagtgcgcggcggtcacgtggcgcttcagcagcgacgacgagttcctcacgtgcttcaacagcatcgccattttcttctgttttttgttttctgtgaaaatgagatctaatctaagcgttctgagtttgataacaaatccaacagttaaaacgcctctccaactgtgggggacactggaagtcgtctgtttactagtccattaa

SEQ ID NO: 4730 - DNA, 234 bp, Glycine max
  Peptide Sequence Number=SeqID_96415
atgggttatcattactggaaaacccgcatgcaaatcttcatagaggctatagatttaaacatctgggaagccattgaaatcggtccttacatccctacaatggtagtaggaaatgcaactatagaaaaacctagggaacaatgggatgaagaggaaagaagaaaggattggatgaatactttagagtctcaaattgtaagaatacaaaagaaatgtgagatacattgcaagtaa

SEQ ID NO: 4731 - DNA, 54 bp, Glycine max
  Peptide Sequence Number=SeqID_96416
gggattcttgaacacaagggaagggttgtccctgtgtgcgttgttaatccgtaa

SEQ ID NO: 4732 - DNA, 201 bp, Glycine max
  Peptide Sequence Number=SeqID_96417
atggattttcaaatggccaaaacatcagcatggtgtaaagaaatgtcagaggaattgtcagagacgatagttgggctggggaaatttgggagcttcctagctcatcatcaatttcatcaaatgataggcgttttttggacattaaaggaaatcctgcaactggatcatggtctgttgtcacagacagagattgctgcataa

SEQ ID NO: 4733 - DNA, 1593 bp, Glycine max
  Peptide Sequence Number=SeqID_96418
atggaatttaagaaaaggaaggctccttctacaccttcccaagtcagatatgactggtctaggttcacctctcaagaagcttgggaggggtatactgatataattgtacctaggaagctgttaccaaaacgaaatgtggtaatgtaccacatagagttcgatgagtttaaagaggaattaatgagaagacactgggacgaagagctcacaagctttgatgaaggtagcattgatgttgccattgtgaaagaattctatgcaaacttgtatgacctagaagataaattacccaagcaactgcaggtcaggggtcatctgattaaatttgatgaagatactttgaatacttttcggaagactgcaatgattgtagaagagggggagaatttatgtgcttattcgagatttgcactcctgaggcctaatcctcaggagttagctgctaagctctgtatcccagggaggggatttgagctgaattcattagaagagaatgagcatgtgattggaagtatgactgaaaatattagtcagtttgtcagattgattgtgaaggaatgcattgaccgtatcccggagagcatcatccacaggaagcctggttcaaagcagatttgtcccaaatttgggggagtaattatcaagaaaaacaagagagaaaagaaaaaggaaaaaaaaagagtagaagaaataagtcaagatgaaaaagagaaaataagggaagaagaaagaaggaaaatactaaaagagttaagaaaagaaaaacatgcctcctctagtagtcataactcttgcaatagcctaagtgaagaacttcgtgactattatgaaggaaggcataggtcatatcttagacctcactcccatgggagagaaaaggaaataaagcctcaagaggctaacattaacctcccatacttccatgggaaggacaatgtagaggctaacttagattgggaaataagggtagagcaacaacttaaaagcaagtctacttcaaaattttatggctctcactcttatccaaagaaagaccaaggtcaaggcatcttagaggcgacaccttctaagctcaaagatcataaggggaagacaatagaaaagcaaccccttaaggctagtatgcaagagaagactagctccatgaagtgctttaaatgtcttggaagaggacacattacttctcaatgccccaccatgaaaaccatgattatgaggggccaagacatttatagtagccaagatgaggttactacttcaccttcttctagtgaaagtgaagaagcaaaaggggaagaatctagtgaagaaatctacccccaagaagaaggacaacctttaatggttaaggaggagtgtaaggagacacttgttagcattgccacacctcttaggcttgagtttattcctcaagtaaaggagttgttggatgagggtttggttcgcaagagcttaaatccttgtgctttgttggtgcccaaaataggtgttgaggaaaaaattaatgagtttcaagaacctctggatttgaggtcaaatccttttcaagggggagggaatgatgcaatcctaccctccaagggcattggatag

SEQ ID NO: 4734 - DNA, 372 bp, Glycine max
  Peptide Sequence Number=SeqID_96419
atgaccataatttgtctccgcatgtcgtcaggctcaccgcctctggatgaaaaaagggcgcagaatgaccataatttgtctctacgtgccatcggacacgattgtctccgaatggcaaaaagggtcagtatgatagaagggcgtagaatgaccataatttgcctctgcgtgccatcggacacgatcaaatctggatggcaaaaggtgcataatgaccataatttgctccgcatgtcatcgggatcaccgcctctagatgacaaaaggcgcagaatgaccataatttgtctctgcgtgccatcggacacgattgtctctgaatggcaaaaaggtgtgcggaataaccataatttgtctccgcatgtcacatga

SEQ ID NO: 4735 - DNA, 324 bp, Glycine max
  Peptide Sequence Number=SeqID_96420
atggcccctcatccccaaacattgtgtagagccagatgcagcccttcgtccctacctattctccaacaaaaccaaacaaggggtcatcatgggggaggatctcagaatcggtgcacagcggaaattaagagagtagggaagaagaagaaaaacacacaagagttttatactggttcggcaacaacccgtgcctacatccagtccccaagcgacctgcggtccttgagatttcttttcaaccttgtaaattcctttacaagcaaagatccacaagggatgtaccctctacttgtaccacaaaggatgtaccctccaatgtgttaa

SEQ ID NO: 4736 - DNA, 249 bp, Glycine max
  Peptide Sequence Number=SeqID_96421
atggggctaaaggcagaaatcaatcaagtaaatattggatgcctaatctaccctgatggagttcaagaattggctctgaaaaagctttccgcaaagagatctatgagggacgccgcgactaaagggaccagtgccgcccccgagtttgatagccaccgtttcaggagcgccgagcaccagcagcgcttcgaggacatcaaaaggatggtcgttccacagagagagacgtgtctagctcagggacgatga

SEQ ID NO: 4737 - DNA, 483 bp, Glycine max
  Peptide Sequence Number=SeqID_96422
atggatgtccaaaaattgacagcaggtgcttctgtgcatgcagcagagcatgaacgccttcctcttcaagttatagtgcatgttctcttctttgattatgtcaagtcttctatcagctttcgaacacccggtaacaatagtgcatgcgaccctttatgctctccaatgaaccgagatgagggatatgagacaacaacgggagatagctgccaagccaccctcaagaatcatatcagtcatttgaggatcaaggatgaagagttacataaaaatgggaagttgagcaagaagaatagcaaaaacaacaaaactgacattcaattgttgccattgcggtcaaggagaatctttgacaagaaaacttcagagagggttggagaggagaaggttgagtacattaagtattctgatcctcagaaaggagctgttgctatgcttccaccagctaaaactcttttgcctgaaggttcttactctcaatag

SEQ ID NO: 4738 - DNA, 666 bp, Glycine max
  Peptide Sequence Number=SeqID_96423
gttctacttcggttgaaaggttcctctcggtgtggggtttcaacggagatcaacagtagtttgtggtggctaaaggtggctgtgggtaatggagaaagagcttggaacattggaaatggttttggaagaaagaaaggagaagagatggcgttttttcctaagctacttggaccacaaggctcaaaacgcacaagtgagcaatgctctcgggaacggaaatgtcgcgcacactccaaacatcttctcagagatcccaacggtgagatcgtggacaagtgttctttgaagatgcaaaccaaatttcgagaagatccaacggttaaggaaggctgggcagtgtttttaccaagacagcttcatgtagcttccttgagaagcttcattaagaggcttcctcgagaagttttctcggtgttacaacaagcatcatttggtcacgattatcaccactcaatctgcttaagggtaaccactcaattagggatacctaagcatgattgggagtattgctcaactggtaattatgatgtgacaggtccaaagacctcgggcctaacaagctctgaaccaaaccctcacttgagcgtcgaaatgccttttgtaggtaccctcccctccgcaccggatactcatgcacttgaatcctcgacaaggaacaccaagtag

SEQ ID NO: 4739 - DNA, 423 bp, Glycine max
  Peptide Sequence Number=SeqID_96424
atgaccccagatctggtaacccgcggagacaccttacggttatccgcacctcgtcattcagtgaccccaagtgtgattgatgagcagaggccaatgtggtcatctacgccctttccggagatgtcagcatcttccggtggagactttttcaagtctcacaagttatctagaactacacaaaatttggtcattccgcacccctttgccattcagacacagccgtgtccgatggcgcatagagacaaaaattggtcattctgcaccctttgtcatccagaggcggcgggcccgatgacacgcggagacaaaatttggtcattccgcacccctttgccattcagacacagccgtgtccgatggcgcgcagagacaaaaattggtcattctgcaccctttgtcatccagaggcggcgggcccgatga

SEQ ID NO: 4740 - DNA, 201 bp, Glycine max
  Peptide Sequence Number=SeqID_96425
atgaaacatagctccaaactcgaaggtggaggacacatgaacagcactaggtcgaggacacatgaacagggcttggcaataacattcatggggctccgaaaaagaaaaggagggagaatggaggattgccttgagggtccgcacttaggcagtcctgaaaacatagctctcaaactcgaaggtggaggacagatggaatag

SEQ ID NO: 4741 - DNA, 513 bp, Glycine max
  Peptide Sequence Number=SeqID_96426
agttcttcggaaacgttctatactctggtctggagacttgcttgctcactgagcaaggaagccttatccagactcttacttcgtggctcctccgttactctcatcatggcaggtggattcgctctacgggccttcttcctggcgaccgaaggagggctatccatggagaattccatgatgcctcaccctcacggagctgccgaatccacccattctgatgggtttacttatacttccgatatggttccggattcgtcaagttccgggcggagtataagttccgtggagcagcctattccagaagagaaaccatacatcgcactccttcagctagagggggagcgaaaacgggttatggaagaaattctccacatcgtggaagggcaattggaagacccggggctgccacggggtccacatgagcaagccctacgcttctgttggtttgaactggatataaatgataattccagtcttaccgatcttcaagactggaggggttcactaagaggg

SEQ ID NO: 4742 - DNA, 654 bp, Glycine max
  Peptide Sequence Number=SeqID_96427
atggatgtcaagataactgtaatattgcaccatcgaggaagattcactccacgtgccagtgatggaaaggttgaatatataggtggagaatttgacgtttgggaggatatatctgcaaattacatgaacacatttatcctatgtgatctggtgcaagcatgtaagaagttaaagagttgtacaacagatggagatatattatacttagtgaaggatgctttgaaaaatgagaatgagataaacgtttattttcatcatgaagtagatccaattccagaagaagtctcactgatgttggacttgaaatgtcatccaattccaggggccagtaatgaggatgatttagatgatgtacttgttgctggccatgaggaagatgttggtggtggagagaaagttattaatgtggatgttggtggtggtgaagagagagatgttggtggtggtgaagagaaagatgttggtaatcctgatgatgaagatgacaatgatgaggatgaatggtttatagacttctcttgtatgaggaaggaagttgaagttgaatatgaaacagatggctatcattcagaggagctcaaaaaccccattagtagtgatgatgaagatgaggatgttcacaaagtttatcctcaatacaatgaaagtagttga

SEQ ID NO: 4743 - DNA, 174 bp, Glycine max
  Peptide Sequence Number=SeqID_96428
atggagggggttgttgagttttttggagagttttggctgtggagagactggagagaaccgagcatgaagaggaagctatcttgcagagcattagacgagattttgagtgattgtgagaagcctccctgctatggagagctaaatcctcaattggttcttcctatgggtacttga

SEQ ID NO: 4744 - DNA, 132 bp, Glycine max
  Peptide Sequence Number=SeqID_96429
atggcttgctctccgtggcttatgtttatggactatgtgtgtcaaacatgggtgattccacacagaaagatttgtgaaagcatggacaaacaaagtgatgcatttaggaaacacaactacaaacaggattga

SEQ ID NO: 4745 - DNA, 322 bp, Glycine max
  Peptide Sequence Number=SeqID_96430
atggctttcctagaagcattgtatcagatagggattctaagttccaaagccacttttggaagaccttgtagagaaaactggacacaaaacttcttttctctaccacttgtcatcctcaagcgggtggacaaaccgagatgggatgggctttctaaagccaactttgttaagagtttgcatgagaaggtgaaagcacaaattgagaaaaaggttgaacaatatgctagatatgccaataagggcagaaagaatatggttttcaaatcgggtgatctgatacctttaacatcaattcgagggcagatcctccccaagaaggagg

SEQ ID NO: 4746 - DNA, 507 bp, Glycine max
  Peptide Sequence Number=SeqID_96431
atgccgatctccccctacggaagtatcagttggtctgtaccgtcccgacataggaatcgcagccacaagacacccagtgaactcggaggcgtccaacagggtcctggggtttccagctctggttacgggcctctatcagtcctacagggtgcccgtaccccccccccccccgcaaggtcatgccatcccgacataggtaagattgcgcccgcaggacacccgatggatccaaagaagtccaacagggtcctggggtttccagctttgattacgggcctctgtcagttctacggagtgcctgttacccccttcaaggtcatcaggccccctactaatcgagctttcatcaagaggtactgcgctcccaggcaggcgcaaggcgaaacaccacagcagcctggggatggccagcaacaggcaacaaatgcaccgtcgccacctccagagccgctcagctcatccacaaaaaggttagagtattgcctacgacacatggccgaccaatag

SEQ ID NO: 4747 - DNA, 587 bp, Glycine max
  Peptide Sequence Number=SeqID_96432
tggcactggctggcttcgctaccgtagcgcaggccgctcctaaagatgacacctggtataccggtgctaaactgggctggtctcagtatcacgatactggttactacggtaacggttacgaaaacaacgacggtccaacccacgaatctcagctgggcgcaggtgctttcctgggctaccaggctaacccatacctgggcttcgagctgggctacgactggctgggccgtatgccgaacaaaggcaaccaagttaacggcgcattcaaagcacagggcgtacagctggcagctaaactgagctacccaattgctgacgatctggacgtgtacacccgtctgggtggcatggtttggcgtgcagactcaactcaggctaacctgaacgacggcactcgtatcagcaaccacgacaccggcgtttctccgctggctgctgttggtgttgaatacgcactgactaaaaactgggcgactcgcctggactaccagtgggttaacaacatcggtgacgcaggtaccgttggtgcgcgtccagacaacagcatgctgagcgtcggcgtttcttaccgttttcggtcaggatga

SEQ ID NO: 4748 - DNA, 186 bp, Glycine max
  Peptide Sequence Number=SeqID_96433
atggcccaggtggtggaaggtaaggtcgaagctcaacacccaaaattcggacagacccaggtcgtggtgggaggctcctccatgatggacaagaggtcaagtgtcacccgagatgacctgggtcgcaacaacagtcgtgatggtgatggtgacaacattgaggtgactttcttgtcatctacatga

SEQ ID NO: 4749 - DNA, 243 bp, Glycine max
  Peptide Sequence Number=SeqID_96434
atggttaaaggaagtaggaaaacaaatttacatagcaccttatttaaatcactgctcattttgtgcccaggtgacaatctagtggtttggttttgtcctttgcggaagaagcctgatgctgctatcaagaatgcagtaaatagagtcatgttcaaacaggaaactacgagtgtggatactatgttatgcactggatatggtgcatccggtaacaaaagagaccatgaccacactccagcataa

SEQ ID NO: 4750 - DNA, 552 bp, Glycine max
  Peptide Sequence Number=SeqID_96435
atgcacacacgaagtttcacaaatccacaattccttaaaataggcctaactcacaaaaagctccccagtggagtcgccaactgtcgcaacgtgcccttttgcgggcgagcgaggcgaggctcacgggtgcgctttccaaaggaggaaagatgcgcggagtcgccaccaacgtttatttgtggaaaatgtcagaaaaaccaaaggaaaccggtcaaaatgaaaattctaagttcgggagttgtatttacgcttgaggaaggtattagcacctcttacgttggtctcaaaggacaacagcctatttttagaattgtggaattgtgttatcttaactgttatttctttttattttttgaggtcgacaaaagcggggctcttgctcctatgtaccctccatcaaagaggaaatcaaacctacgtagttcttccttatgcgtgaatcaagggaggagcttgccacccagctcgcccaagcgagcaaggttgcttcctccagaagcaacagccttctggaggaaggatttggaaggcccaagtgggccagattgctaa

SEQ ID NO: 4751 - DNA, 306 bp, Glycine max
  Peptide Sequence Number=SeqID_96436
atggctcctaccaggcaccctctggacccggataagtccaacagggccctgggatttcccgctttgatcacaggacactgccagtcgttcggagtccccgtcgcacctagcaagagccagggttttacttcttttccgtgccctactccggatcagttcaaggcagaggtcgcatggcccggagattggcctgaggcccgggcaggaggggcgccagcagaggctcccgacgaggcagatgaggcccgcgaggacgaggagatgaccgatttacttgatttcttaggagggagcgaagccacatga

SEQ ID NO: 4752 - DNA, 192 bp, Glycine max
  Peptide Sequence Number=SeqID_96437
atgggcgttttagggcgggatctaaaatttctccaacgtgttgcggagccttcggccgtgagaggatctgtcttttggcttcctcggggccgcgtaggagctgggcgaagcagtagcgaagctcaggtggtgatgcaagtgcgcggggagcatagtagccccctcgggcatgctctttgtacaaccaagtga

SEQ ID NO: 4753 - DNA, 346 bp, Glycine max
  Peptide Sequence Number=SeqID_96438
atgactagggccaacccaggtgatttacaatcctttgatcttgaaatagatataaccttgcatagattagttaggcatagtgtgcatcctggtcattctgagcattttgagcattctgagtattctgttgctggtgattctgaatattctgattttgagcattctattactaattttcatactgagaatatggatcaacctccacctcctgagaggactcttaaggagatggctacacctgatttcacttatgaaagcttgtgcattcaatatcctgatgagggtgttccatatgttctcaagattggactaatacatttgctgcccaagtttcatggtcttgcag

SEQ ID NO: 4754 - DNA, 612 bp, Glycine max
  Peptide Sequence Number=SeqID_96439
atggcatgcggagacaaaattatggtcattccgcacccctttgccattcagacacagtcgtgtccgatggcacgcagagacaaattatggtcattctgcacccttttgtcatccagaggcggcgggcccgatgacatgcggagacaaaaattatggtcattccgcaccccttttgccattcagacacagtcgtgtccgatggcacgcagagacaaattatggtcattctgcacccttttgtcatccagaggcggcgggcccgatgacatgcggagaacaaattatggtcattccgcacaccttttgccattcagacacagtcgtgtccgatggcacgcagagacaaattatggtcattctgcgcccttttgtcatccagaggcggcgggcccgatgacatgcggagacaaattatggtcattccgcacaccttttgccattcagacacagtcgtgtccgatggcacgcagagacaaattatggtcattccgcacaccttttgccattcagacacagtcgtatctgatggcacgcagagacatattatggtcattctgcgcccttttgtcatccagaggcggcgggcccgatgacatgcggagacaaattatg

SEQ ID NO: 4755 - DNA, 383 bp, Glycine max
  Peptide Sequence Number=SeqID_96440
catgtttgcattttagtggagaaaacaccgagacttttcccagtctcacaagttatccagaactacgtaggtctgagttcctcattggaggatacgtaggagcaagagcctcgcttttgtcgaccacaccgccttttgttgccataactcaagagctggtagcccgcggagacaccttacggttatccgcacctcgtcattcagtgaccccaagtgtgattgacgagcagaggccaatatggtcatctgcgccctttccggagatgtcagcattttccgatggagacttttcaagtctcacaagttatccagaactacgtaggtctgagttcctcattggaggatacaagcagagaccaagtttggtcattctgcacccatga

SEQ ID NO: 4756 - DNA, 876 bp, Glycine max
  Peptide Sequence Number=SeqID_96441
atggataagagcttgaaggtaggagaagatgagtggagggagagggagagaaggagcacgaaatttcgtgcctcaaatgaggttctcaacaacttcttaaggactagaaacctgacttacatgtgcaagatgattcatagcgtgttcttcatcatagtcatgccaagagtaggatcaagggactatgcgtttaaaggcaatttgaaccccaaggtgaagaagaactttattccttatggaatgctctttattcgaatcaggagactagctggagtggatgtctcttcaaaggagccatcatctggagccacttcgctgaagagggaaactttagctctgtcatcttatgttgatcatactattggaactcaagctaatcctttggatcttgagtctggagcttctcctcaacagatacaacgttctctcatagacgctaaggagaaggcaagagttgaaaaggtcttgttgaggaagaagaagagacgtagagctccaactagctatagagcaagaaaagatagttgcggaagaaagggaggctctagatgctgcaatgctcaatttgtaattaaagtatcattgcaagggtttgatgtttctactaaaaatgattccattgaaacaaaccttggggttgcacctcttcaacctcgtccaatcacaactgaagatgaagttgatgttgaacctctacttgctcatcctatgatgaagagagagaggagacgccacttcaaggagaagatgagtctagaagaagctcaccaccataggaggccatggataagagcttggaggaagaaggaaatgaacgaaggaagaggaagagaagagcacgaaattttgtgctctaaaagagctctgaaatctgaa

SEQ ID NO: 4757 - DNA, 474 bp, Glycine max
  Peptide Sequence Number=SeqID_96442
atgaacaaagcacctaagagggaaggagattccattggtcaaggtgatctggggaggtacatcaggaaaagatgccacgtgggaattagagagttagataaaggagcgctaagcgcaattccaaccgaggggaattgcgctgagcggcccaaatctgcgctaagcccatttccaatcgagaggaagtgcgctgagcacccagaaggcctgctaagcgaaagttgcagggtctttggcacttgctttgggccacgttcatacggtggatgttgtgtatgttcatggggggcgaagtgcactggccttccagggtctttggcacttgctttaggccacgttcatacgtcgtatgtagtgtatgtcatggggggcactttaattggtccatggtctttggaacttgcttttggccatgttcatagctcatacgacacaggaaatagaataactgtggcagagtgtactttgtactga

SEQ ID NO: 4758 - DNA, 123 bp, Glycine max
  Peptide Sequence Number=SeqID_96443
atgagggagataaaggtgacaacggaggagggcaaggcaaaggtggaggttgaggaggccaagacaacaacaacaatgggtgaaaagattatttgtgaatggtttagttcctttcgtagataa

SEQ ID NO: 4759 - DNA, 408 bp, Glycine max
  Peptide Sequence Number=SeqID_96444
atggaagctgacaccagagtctggaatccaggtggagctagcatgaccatttccatgagaggagaaattggaaagcatagcactgggttgattggatgctggaacagcagtcttggaattgagattaatctaggtattggaagtcctggcagaaccagaggagtagggaattggttgaagtgtgtgagtaaggcgagtttcatgaccgtaaagcaaggcctcaatctcagcgatggatggagtatgcttcttgctctcaatgatagagatcatcagcgcataatcggacgagagtccttcaagaagcgcgttaacgtattcctcatgacggaccgaaattccaacaccagcaagctcatcctgcctaggttagctttgctattcttagccggtcccaagcccggataa

SEQ ID NO: 4760 - DNA, 783 bp, Glycine max
  Peptide Sequence Number=SeqID_96445
atgggggaaaaggatttatggttcgaatttaaaaaatggggcgacgtcagggagatattcatcgcaaaaaatagaaacggaagtgggaggagatacggtttcgtgccattcaaaggggttgaagatgttcgaaaacttgagaggcagttagagcaacatggaagggaacgaaagctgacaaggaaaaccaacatcactgatcaatacaacaagggacatcaaagggataagctagcaaagcgagacgagaacataggcaggatgaaaacaacacaaacaatgtggaatagaggagcttggaatcaatatcctcaacgaaatacattaaccgtttcgtacgcagaagcggttgcgacaggcagcaagatgacaacaaagagatcgatcccgacacataaacaggcgatgatgcaaccatcccactcgtcaatacagctaatgatacccatcaaacagaggacatggttcagtgacgcatgggaagaactgatgtgggacagaggtgaggacgttaggcctaagtaccttggtggtgatatggtactactcatgggccttagtgataccagagcagaagatttgtgcagggaagaagacgaaagtggtttgtccatgtttcatacattggagaaatggagcccaaccatgaagtctggtttcaggttggtttgggtcctatgctggggagtcccgttacacgcatggaacatggaaaatatcaaaaagattgcgggggtggtgggtgaagtggtcaagattgatgacgacgctgtagacctctaa

SEQ ID NO: 4761 - DNA, 888 bp, Glycine max
  Peptide Sequence Number=SeqID_96446
atggataggttcgctttcaccttgaatgggagtcaagagcttccaagactaccagccaaagccaaggcaatggcggacgtgtactcggctcccgaggaggtcgatatggaggccttgaaagatcaaatgacctctatgatggaggccatgttaagcatgaagcgattgataaaaagcaatgcagccgcagcggccgccaccaacgtcgccactgaggcggatccgacccatccctttgccataaaccaagcaagccaactcatcccagacgtgttgggtcaaggaggagaggtgttaggccgcaccagcgggggcgcccatgaagaacctcgggagcatgctcaaggtgacttcgacccataccccactttcaccaccgagggactggcatttaatgctattctgcaacccaataccgcaacggctcctcagcatcgtccattgcaaccactacatttctcagtagggggctgcctccgacagtggaagggagggagaaactcgatctcatcaaggagagatgaagggttgtcgaagggagtatgcccaatagtggagagacttggtggcacaggtggtgcctcccatggtggaaagagaaatgataactatgatagtggacatgctgccaatttagtatttgcgaacgagaggatcgaagtaggcttgaagagggggaagttcgattgtgttgctcctgccaatatgggcaataggagattcggggcaagtgaggcaaagaagaaagaagaagatgcccacgctattactttggctcctacttggacgaaaccccaacaaaccgctcacaacacttatcaatatgcccaacataagctgagcttttcggcccgcgtcggaaacccttccattctggcgcctgtctag

SEQ ID NO: 4762 - DNA, 327 bp, Glycine max
  Peptide Sequence Number=SeqID_96447
atggtgggttacacaccttcaagctttgcagatttggtctttgccggcgaaatgatcgaagtgggtctaaaaagaggcaaatctgatcattttgctttgataaatgcaaaaaaaactggggcaagtaaagaggatgagaaggagggagaaacctatgctgtgactgccattcttatacgaccaagtttcccaccaacccaacaatatcattactcagccaataacaacccttctcattacccaccacccagtcatccacaaaggccatccctaaaatcaaccacaaagcctacctaccgcacttccaatgacaaacatcacctttag

SEQ ID NO: 4763 - DNA, 204 bp, Glycine max
  Peptide Sequence Number=SeqID_96448
atgcacacgaagcgatgcactgttaaaagggtccagaagttagaagctgagcttaacaagcttgaatctgaagctgaacacaggcagctgacttcccaagaaaatatgaaaaggaagaagctgcaacaagatttttggtcagcagcccaagctcacgagtctttaatgaggcagaaggcgagatcgcgttggattaaggagggg

SEQ ID NO: 4764 - DNA, 99 bp, Glycine max
  Peptide Sequence Number=SeqID_96449
atggcctcgatcaacctcactatcattccccacccaaaaccttataaacttcaatggctcaaaaagcaaggggaaatgatagttaaccaacaaatgaag

SEQ ID NO: 4765 - DNA, 297 bp, Glycine max
  Peptide Sequence Number=SeqID_96450
atgcactgccaccacctcatcaggctgatccagctgggtcatttggcatggagcggtatttacaacacttggttcgccagcaggcggccaaccacatggggcagagccagggtttttctcctttttgcgtgccctactccagatcagttcagggatgaggtcgcatggctcggagattggcctgaggcccaggcaggggaggcgcctgccgaagctccgagcgatgcagaggaggcccgcatggatgaggagatgacagatttgctcggtttcttgggagggagcggagccacatga

SEQ ID NO: 4766 - DNA, 366 bp, Glycine max
  Peptide Sequence Number=SeqID_96451
acaagtgtgggttgtacatcgaagcaaatcctcctcgcctggttgcccttggaagagtttatgagggatcaacagttcacaacattcctttgttgcctggccaagtgaaggttggtgttgaggaggttaaagatgcacaggctctcgttcctgtacccactaatgaggcaactgtttctccagcaaaacctccacaaaggccggatcctgaggttgatgatccgctatatctgatgacattgaccatcccagagcttttcttgaagcctttccaggttaactgggatgctatcatgttcggggtgtttaatccagtcttcccattgtacatcaagcacgaagatctctccgaaatcgcacacggtg

SEQ ID NO: 4767 - DNA, 474 bp, Glycine max
  Peptide Sequence Number=SeqID_96452
atgccctcaccttcagaggactacacgtcctcacctttagaggactacacgtcctcgccatcagaggactacatgttccccattttcaaaggggggcatgccctcaccttcggaggactacacgtcctcgccttcaaagggtcatgtaccttcaacttcagaggactacacgtcctcgccttcaaagggtcatgtaccttcaacttcagaggactacacgtcctcgccgtcaaagggtcatgtgccttcacctttgtagggctacatgccctcaccttcagaggactacacgtcctcacctttagaggactacacgtcctcgccatcagaggactacatgttccccattttcaaaggggggcatgccctcaccttcagaggattgcacgtccttgccatcataggactacactccctcgccttcgaaaggcgacacgtcctgaacttcagagggctacacgccctcgcctttag

SEQ ID NO: 4768 - DNA, 389 bp, Glycine max
  Peptide Sequence Number=SeqID_96453
agaagtactgcacagctagacaggcacagggtggcgaccctcaggccccagacgcaccgccaccacctcaggctgatccagctgggtcattcgacacggagcggtatttacggcatttggttcgccagcaggcggccaaccacaaggcgcacgtgcagacccatgactctctctaccagcttagcctcagccggcagagccagggttttgcttcttttccatgccctactccggatcatttcagggcagaggtcgcatggcccggagattggcttgagacccaggcaggggaggcacccgcagaggctcccggcgaggcagatgaggcccgcatggacgaggagatgaccaatttgcttgatttcttgggagggagcggaccaacatga

SEQ ID NO: 4769 - DNA, 228 bp, Glycine max
  Peptide Sequence Number=SeqID_96454
atgtttgtattcaatagtgctttgaaaggacttgatgatactccacaaagtaaatccaaggctgttgctaggtggattgttgttaaaatgatgacaaaaagcccaaagaatgatttcaagattgagtcaacaagttcaagatcaagtttaatttcaagcttcatgagaagaaatcaagaagattcaagaatcaagagaagtttgatttcaagattcaagaaaagatga

SEQ ID NO: 4770 - DNA, 139 bp, Glycine max
  Peptide Sequence Number=SeqID_96455
agtggtacttagagatatgtcgcgggggtcaggagaccttggggacgtcaggcttgaaaacgagatcaggaagctaggagagcttctggtaatcgattaccaagggatcgtgatggcggcgcaactaatccatgactga

SEQ ID NO: 4771 - DNA, 776 bp, Glycine max
  Peptide Sequence Number=SeqID_96456
atgaattcattgcctagcgctgttcatgtgtcctccaccttcgagtctagagccccgcgaattgattgcctagcgctgttcgccaattctccattctctacttttattaggagccccatgaattcattgcctagggctgttcatgtgtcctccaccttcgagtctggagccccgcgaattgatctggcgctattcgccaattctccattctccacttttattcggagccccatgaatatattgcctagcgctattcatgcatcctccactaatgagtctggaggcccgcgaattgattgcctagcgctgttcgccagttctccattctccacttttattcggagccccatgaatttatggcctagcgctgttcatgtgtcctcccccttcgagtctggagccccgcgaattgatcgcctagcgctgttcgctaattctccattctccacttttattcggagccccatcaattcattgtctagcactgttcatgcatcctccaccatcgagtctggagtcccgcgaattcattgcctagcgctgttcgccaattctccattctccacttttattaggagccccatgaattcattgcctagggctgttcatgtgtcctccaccttcgagtctggagccccgcgaattgatcgcctagcgctgttcgccaattctccattctccacttttattcggagccccatcaattcattgtctagcagtgttcatgcatcctccaccatcgagtctggagtcccgcgaattgattgcctagcgct

SEQ ID NO: 4772 - DNA, 660 bp, Glycine max
  Peptide Sequence Number=SeqID_96457
atggcctccgcaaacttcttattcccagaaggaaattcaataaataggcctcctatttttaatggagagggttaccactactggaaaacccgaatgcaaattttcatttgggcaataaactttaacatttgggatgccatagaagttggaccttatgtacccaccatggtggctggaaatacaatagagaaacctagagaagagtggtctgaagatgaaagaagattagtgcagatgaagacaaatgaaagtatacaagatatgcagaaaagatttacacatatagttaatcatcttgcatcattaggaagaacttttcaaaacgaggatcacataaataaagtattaagatgtttaagcagagaatggcaaccaaaggaacatgagatggagttgcaaagactaaatcaacatgaagaaaatgataaaaagaagaagggaatttctcttaaagcctcatcttcaatccaagaggaaagtgacatagaagattcaattgacttagatgaagatgaagatcttagcctctttgtccaaagattcaacaaatttattagaatgagagaaatcaaagaagacaaaacttcaaacctaaaagaagaactgaagagtcatctcaaatccaaaaatgctttgagtgcaatcaacctggacatctga

SEQ ID NO: 4773 - DNA, 270 bp, Glycine max
  Peptide Sequence Number=SeqID_96458
atgtctgcccatgttttctttgggagctttgtgaggccaatttcttggagggccaaaagtgtttctattgggaaggcatattgggtagatgacccttcttcttttggtttctgggttaatgacctagcttgggttggtgacccagattttgagggtggattcattttggaggatggctttggtagagtcaatttgaaacctttacgtgtacttcttcttcctcgtaaggaagtgttagatgccttaggtggcatgacaatttctttgtaa

SEQ ID NO: 4774 - DNA, 1846 bp, Glycine max
  Peptide Sequence Number=SeqID_96459
atgttccgcgagcagcgggaagcgaagttctccgacctcccgagccgcgtcggttggcgccgcaacgtcacatcgaagcggggcgccctcgggcactccgccgcgtgggcgtgcatccgcctccgcggtgacctgatctcgaccctcccgatcgacacctatcgcaaggtgccgtggggccaggtcgaggtcccaaagcctcccgtgcttgttgagccgggcggcacgaaggtcgacatcaccgaatggatgtactccacccagaccgatctcgacaccctcggcaacaccttcggcagcatcaccgaggtcgacggcgccggactccccagacgcatcgacctcgtcgcacgtgacgaggtcagcgtcaccagcctcaagggcaaggtcacctaccgcttcaacggcaaggttcaggacgaagacacagtctggcacgaacgccagtacaccagctcgggcatgatcctcggtctctcacctctcgcacacgctgcgctcgacatgcagtctcacgcagcggcgcaggagttcgccgcggcgtggttcggcggcggccttgtcccgctcgcccacctcaagtacgacgccgcagccgtccccgcgagagaagctgaggcgatcaagctccgccacaagctcgccatcgagaacggcgacgcgctcgtcacaggcaaggactgggagtacaagccgatagacgttgcgtcggcacaggcgaacttcatcgccgcaatgcagttcagtgacactcagctgtgccgattcttcggcgtgcccggcgacctaatcgacgccaacaccgctggctcatcggtcacctacgcgaacatcacgcagcgcaacctgcagctgcttgtgatgaacctcggccccgccatcaagcgccgcgaggtggccctctctcgggcgcttgcgcagccccggttcgtgaagctcaataccgacgcgctgctccgcatggatcccgagaccgtctcgaggatgctcggccagcaggtccgcgatcggctgcgcgcgccctctgaggcccgcgagaagctcaacctcgcgcccttcacccccgagcagctcgaggagttcaaggagctgttccccgcccacgcgaacaccatcgaagccgacgtcgccggccggcgcgcagcggcacggtccaaccctgccgacgtcccgtcgaccccgaaccgcagccaggagtttggcgcccagctgcgcgccagtctcgtcgagcgcgacgggaagaagttctatcacttcaacggctgcgcatccacggtcgaacagccctacgagatgtacgacttctggggcccgtacacagagatcgtcgaccggggcgcgttcgacaagactctcgctgcggatcccgacgtcgccttcctgctcaaccaccgcggtacgacgatggcgcggacgaagtcgggaacgctcgagctcagcttcgatcccgagcagggcctcatctccgatgcctactgcaacccggagcgcaccgacgtcaaggatctcgcgcacgcgatcgccgaccgcgacatcgatcagatgagcttcgccttccgcatcgtccgcgggcagtggtcccccgactacgaggagtaccgcatcctcgaggtcgacctcgatcgcggcgacgtgtcggctgtcaactacggcgccaaccccaacacatcgatctcggcccgcgccaagcaggctctcgccgccgtcgacgagctgccgggtcaacgtcctccgcgaggtcgctgctcgtgccgaggaacgcctcggccgcagcacgcccgcggcggcagcagccccggcaaccgccgccgagctcgcggcgccgaccgcgccagccgcgcgacag

SEQ ID NO: 4775 - DNA, 372 bp, Glycine max
  Peptide Sequence Number=SeqID_96460
atggctcaattgatttctaatgccatccactatttgcagggatcacgcccacaagacacccagtggacccggagaagtccaacagggccctggggtttccagatctggttatgggcctctatcagtcctactaggtgcccgtccccccaggatcgcgcccgcaagacccccagtggacctgaagaattccaacagggtcctggggtttccagctctgattacgggcctttgtcagttctacggagtgcccatcgccccagcaaggttatcaggcctcttactaatcgatctttcatgaagaagtactgcgcccccaggcaggcacagggcgagacaccacaacagctggggaatgccggcagcgggcaatag

SEQ ID NO: 4776 - DNA, 147 bp, Glycine max
  Peptide Sequence Number=SeqID_96461
tatgggctaatgacatggggatcatattctgcaacaaaaccgctcatgggcaatgcaagagaagccatcgataagatagtgaaaccgttgggcttttattggcattgggatagccattccacccatattcgtcgagataaagaagac

SEQ ID NO: 4777 - DNA, 381 bp, Glycine max
  Peptide Sequence Number=SeqID_96462
atgtggtggccattcagcagaataggatcttctgggttttcatcatattctactgccgaggaagttactcatggaatcgatggaagtggtctcactgctattgttacaggagcatctagtggtcttggtgctgagactgctcgtgtccttgctttgcgtggtgtccatgtgattatgggggtgatagatatgattggtgcaaaaactatcaaggaagcaatacttaaggagattcccatagctaaagttgatgtcatggagttagatcttagctctatgacatctattcggaattttgcatcaaatttcaattcatctggtggcttgcaatgttcattgttcgatgacaatgatgagattatggtggtgcttcaaatctag

SEQ ID NO: 4778 - DNA, 648 bp, Glycine max
  Peptide Sequence Number=SeqID_96463
atgtacgagaatttgaatgatgcgtcaaagagcaccaccaagcaacttgcaggacatatcacacttttacagtgttggatctacgagcattttccttttgttgcttcttctattgcttcttctattgatgttgaggattatgatgagaggaaatcacgtgtctactattggaaattgacatatgatgttgtgtgttggattccgtatggtgaccatcgtgcattcagagagtttaagattatctttttattttccgaacatttcaaatggggtccatctattgtcacacaccaaccgaagagggttgtaagacaatttgggtatgtgcaaaccattcctccacaccctattgctcattttctatgtatagaagacattgatgatagatggattcagttttccgaatacattgcaccgatgggtcagatatgtgtagcacctgaacagtgtttatcatactacaagaagtggttctatatgatatttcatcccttcatgagttcaacacagcttggggatcctcctagacatccgctcgtggtgcacgatgacacatttgttgaactagatgttcctcagcacccgatggctgcagtggctatggacgaatcacctgaagatgcatatgttgatgtagagcatccttga

SEQ ID NO: 4779 - DNA, 933 bp, Glycine max
  Peptide Sequence Number=SeqID_96464
atggcccgcaccaagaaaactgggcaaatgacgtctgaggcagcaaaggaaatttctgacaagattttaagtcactttcaattgttaattgcaattatttatgattggttggaggagcaggcctcacaaggttcctttgtcacccatgaacgtcaggatgtactgactactgccattaggcgaccagaacaccctggtcgtgtgtgtgctcctggagccggtgtgatgatcaagcaatactttggaccggctccaaggacctccaccatgtcttcatccatggctcccgaagacctggagcagctgacgcaaaaaatcagggaccagctagaggaattgatcacagaaaaagtaactcgacaactaatgttatccttcagccagatgcagtttcaatttcaattgcagatgcaatcacagggactcgtactgcctcctaagcccgaggttggtccttcaacttcttgtgtcagcacaaaggagagttgtgttgatccctcagggaacgatccagacatgggtgactcagacaaatgcaggttgtacgtcgaagaaaatcatccctgtctggttgccctaggaagactttatgaggggtccacaaccgttcacaacattcctttgctccatgatcaagtcaaggttggtgttgaggaggttagagatgcagatgctctcattcctgtacccaccgaagaggttaagttagtggggcatacacttaaaaccttccttgcttggtgttccccccaactcacggttcatttcttctttttttcttttcttttcgaaacacggaagtggggttgcatgtgttaccggcaagcgcaccggatcgtcaagtattttaaattaaaacagagtaatccgagtatcgaacacagggacgtgtggattagacaaagatttgttcaggaatcagacattgtgtaa

SEQ ID NO: 4780 - DNA, 648 bp, Glycine max
  Peptide Sequence Number=SeqID_96465
atggagaagcaaagcaaatcaagaaaacttcagcggccaccaactattggcctcatggcttccactgaagctttaggtgtggcaaagccttcagtagctagttaccttagccaggagatactggtagagcaagaagctaatagagtgcatggattacctgggcagcctctggtgaagttcaacaatatggtgggcaatgttggtgcactcacaaattttgaggtccttgatttcttactaactaaaggaacttcaaaggatccaacaagagttattgccaaagtagcacagtctgaatacaaggtttatgattatttggttgacactgctgcctctgttcaaacaagagagagcatcaatgagttcttgacaactgatggatacgtagcatttgctgatgatgcagatttgcttaaaggttcttgtggcaagtcacttgcttctttccctcaaggatgtttctactttacagaaattggaggattgaaatgctatgagaatccaaagaataagattattgcagtacctgctgaggaagaagaaatctggggtgtattcttcaagaacagagaatcattgatcagtcccaacagtaatataaggttaatgtcaattgagactgcattaggtacaaagggaaaatgtgag

SEQ ID NO: 4781 - DNA, 315 bp, Glycine max
  Peptide Sequence Number=SeqID_96466
atgttaaggttaaggggtgggggtcacaacccactctttgaggattcacctaatgagtgtggtggtggggccgccactgactcgcaccagaagatactacctaggaggattgggatgctttacgcgtttggtacaaccttgacggcaaggttgagcttccaggggagggtgttgatagtaacgcgacccaaaggagtgacagactcaaaagagcacagaggaaaccagcttacctccaggcttacgcatgatcccagccaggggacaactaggataaggataggaattgcaaattctgttatagctgtcggataa

SEQ ID NO: 4782 - DNA, 828 bp, Glycine max
  Peptide Sequence Number=SeqID_96467
atgggctacgtgggagtacgtgagctcagttggaggtgggcaacaggggatggtgggtttatgcgcgctttgtggatgtggaaaacttgttgtgcaccatcgcccgactgccacctagtaccacatgtgatggtggtacctggagatatgtcgcgggggtcaggagaccttggggacgtcaggcgagctcctggcagtcaacagataaaaggaacaaagaccacaaagcaaggaggcttgtggtggttggccaactgtgaattttgtgtgatatatgggttgtggcctctggtaatcgattaccaagggcttgaaaacgaggtcaggaagctagggaagcctctggtaatcgattaccaaggggcctctagtaatcgattaccagcctgtgtaatcgattacacagaggaatgggtcactggtaatcgattaccagcctctggtaatcgattaccaaggctgtgtaatcgattaccagagatgaaaagccttaagataccccttttaattgcatgtagtggttatgagacgcattgtgttgcggcatatggagatggagtgcctagagggagcttgggagaccctcgaaggcaacacgagcgcacggtggagtggatactacccacgcctacaccatatcgtctagtggagccagtccaattgattgaggtaacgtcgtccgaggaagaccttgaggaggatcccgaggagctacctcctgagcctgctgtggatgctcttgactttctagagggtgatgaggatccacttcttgaggctcttcatcctagtggacagctcttcggactagttttgtataccttttga

SEQ ID NO: 4783 - DNA, 468 bp, Glycine max
  Peptide Sequence Number=SeqID_96468
atgccatcaaaggcgatgacatcgccgtcgtggggaactgacccgtggtacttagagcgatggtggtgtttgagggcaagagtggtggagacggtggtgacaggatctaggggtggtgacgtttgttctggaatagggtatttggggtttggacttggaaggagaacgtccaagaaaaggacgacgttggagacgaagaagaagaagcggaagagaaagagaaggatgaaggatattgctacgaagaactttcaacaaatatgcgaagcatatgagattctctcaaatccaaacaaaaggcaaatatatgatatctatggcatggaagggttgacctctggtttggaacttggtccaaagcttaatggagctaaagagatcaatgcagagctcgagagattgaagaggatgaaggaacaagagaaagtggcaacgtattttctatccttcaatataattctaaagtaa

SEQ ID NO: 4784 - DNA, 453 bp, Glycine max
  Peptide Sequence Number=SeqID_96469
atgattattactatagatcctaaaagttcaataatatttgtccgacagaaagtggtgctaaaggtggaactccatgatgacaaaatcaagaaaaaggccatgaaggcagtatctggtatttcaggggtagagtcagtctcagtggacatgaaggaccagaaaatgactataattggggatgttgatcctgtaacagtagttggaaagtttacaaaattcagtcttggcaagcttagaaaattctgtcatgttgagatactttcagttggaccagccaaagaggaaccaaagaaagaggagaagaagccagaagccaagaaagatccaaaggaggaatatgctgaacttctgaaggtagttgaagccaattattatcagactagacatctgcaatacccttattactatagcagaactgtggaagagaatccaactggctgtgttatttgctaa

SEQ ID NO: 4785 - DNA, 522 bp, Glycine max
  Peptide Sequence Number=SeqID_96470
atgaacagtgggcaccacactacccagactttgcccactttagctatgacagagccatctacgaaaaaatacttagggatctacgagtccaccaccatcaattttttggcctgtgaacaaaaatggatattcgacctccacttcactcctccactagatcaacaatcatgcggcagacccctactaacatctagaatgcatgtcgggactcttgaactcacccaaggcctgcttggtacccctgatccattgagacttccacatattgcagcaatacatcttccttcatgtggtttccatatgacggttttaagaaggctcgaccctccattgcaatggactgtcgtcacacttgacgttggcgttggtgacaagtacgttgtccaaccatggtaccaatttcttgcaaacggtgatttcaatcatggagacgagctctcattctactataggcctcacaacaaaatttgggaaattgttattagaagaaaaagaaattggggcgacaacaatagtgactga

SEQ ID NO: 4786 - DNA, 171 bp, Glycine max
  Peptide Sequence Number=SeqID_96471
atggcgagggaagtgctcgcagctgaagaccaggattcacataaggataaagcaactaagcgcaactattatgcaactaaaaactgccgctctcccaaccaagctatgatgatacaagaccaagaatcttgtcaggttgacatgactaaggatggtgctggaaaaccatga

SEQ ID NO: 4787 - DNA, 648 bp, Glycine max
  Peptide Sequence Number=SeqID_96472
gatcctgccagctcaacgattccgtttgatgaaatcttcaagattcttaggtgggttagttgcacgcttgggtcattgcatcatgttcaccatgcttctggattgcttctggatttgcttcctccagaagcaaccttgcttcgaaaatattttggaaggctcttcttgacttccggaatgttgcggaacttttgggattatgcaacaatacttgctttcgacttccggaacgttgcggaacttcacggattacctaacgatggatgtttaagtacctcaaggcggtcaagcgaaggtgaggatgcgaagcaggcggagctaggttgtgaggattcacggaagaagaagaagcaggtgagtggaggttgttttcaatgcggaaaccctttggaggagctcgtcgagcttggcggtaacgtggttctgcgtggtggtatagtggagctgattcgaagtcaacttggcaatggcttcttcgattcgctccgtgatcctaccagctcagcgattccgttagatgtaatcttcgagatgcatgggtgggctagttgcgcgcttgggtcgttgcatcacgttcaccatggtgcgttgctggtttgctatggtggtgcgttgctagtctgcttgtttcctaagagacatctttag

SEQ ID NO: 4788 - DNA, 411 bp, Glycine max
  Peptide Sequence Number=SeqID_96473
atggagcccaaagctatcgttttcgaaccgggctctgcagtgtacttcatcatctacggcggctcatggttttccggcaccatcattggctgcgttgactccgacagattcttggtccagtaccgtcgtaattcggttgagagcacagttgttagtcttcaccagctccgactacttcctccaccggagagccaccgggaattcaagtcgggcgacaaggtggtggtagattcggaggagatgatgcttccaaaggagcagcttagggacaggatcagtgagttacctgacacagttctgctccacatattgaattttatggacacaaaagatgctgttaaaacaagtgtcttgtttaaccgatggaagaacttttgcaaagccctcagtctgggatattcggttccttag

SEQ ID NO: 4789 - DNA, 1758 bp, Glycine max
  Peptide Sequence Number=SeqID_96474
atgagttcatattttgaggaaagagcaccttgttgtggaactcacttttggattttactaagcatgtgttcggcatttgtgttatttgctgctatcacatcaggtctttctctaggactcttgtccttcagccaagttgatcttgaggttcttgttaaagctgggcagcctaaaatccagaagaatgcagcgaaaattatgtccattgtcaagaatgagcatttacttttatgcaccctcctcatagctaaatcaatggcactggagggggtttctgtttttttggagaaaatgttcccagagtggctttctgtattaatagcagctaccattttgggtttgaccgcagagattatcccacaagccttgtgttctcaatatggtttaagtgttggggcagcaatgtctccctttgttcgagttcttatgatggttttcttcccaattgcatatccacttagtaagttgttggattggctttttggcaaggggcatactgcacttctaggacgagcagagctgaagactttagtccatttacatgctattgaggcagggaaaggtggagagttgtcacttcatgaaactagaataattgctggagctttggacttgacacagaagactgctaaagatgctatgactcctataagtgaaacattttctcttgacataaactccaaacttgacatgcatacaatgggcttaataatgagcataggtcacagccgaataccagtctactctggaaaacaaacaaacattgttggcattatcttggtcaagaatctaatcttctgtcatcatgaagatgaaatgccaattaagtttatgactatcaggagagttcctagggttggtgaagattggccactatatgatatcctgaatcaattcaagaagggtcaaagccacatggctgttgtcctcaagtgtgggggtaacatcagaactgctgcaactggacattgcccttcatttgaaccgggagatcatttccgcatatcaactgatgcatcaaattggcattcacaagaaacagaatattatagtgcaacactgaagagtgtcatgcatcgagagggtgactcagatcttctgcaaagaagatcagaacaacctgatgcaagttcatcctttgagaatttggagtctctttcaacagaagtcgaggaagtgattgggataatcacattggaagatgttatggaagagttacttcagtatcagaatcaaactagaacatgcaagaagagtgtcatcagggtcctccagaagggcttcaagtactcgtcaacaacggagaagttcagatgcatctcgatcttcattcaccaactgagctttttctttgcggctgaggtgcaacacatggttatcatcgtgattatccgtatgaacattatggattgtcaatccgtatgtttcttacgaattgtcaatccgtatgaattatacagattatcaatccgtatgaatcatatgacttatcaatccattgtcaattcatatgaattatatggattgtcaatcagtataatccatacggattgtcaattccctaatgcacaaaaaccgcaacattacaaggagaaaagtactcacggcgatgatgatggcgataacgacagtgatggcaaaaataggaggagaaaccaccaacaagtgaagacgaacaaagggttgaaggagggagatcgtgacgcaagaagggagagcgaaaacagaagcagcgtaggaggagggcgatgggtgtag

SEQ ID NO: 4790 - DNA, 432 bp, Glycine max
  misc_feature (398)..(398): n is a, c, g, or t
  Peptide Sequence Number=SeqID_96475
atgggaatagttaatggtgacgaaggcgaacgcgagaatggagacacgcatggaagccatggaggaggcgatataggagaattgcgaagcggtggaggcacgactgagtttgatagaagggatgatacagaaattagcagcggcataggagaaaaaacctcccgaatcgaaccaatcggtggagaactcttgaaatgccaatattcgagggagaagatccgatgggctgggttcaagatcacaatctcccaaaggtttcacgcgtctaacctagggattccttttcaggcattgctggcgctagaacaggaagaaacagtgcaagaattcataggccaatttgagaagcaggtcggaatggtgaaggggttggaggaaccatttctggtggaggtgtntctcaagggactgaaagaagagatcaacactgag

SEQ ID NO: 4791 - DNA, 192 bp, Glycine max
  Peptide Sequence Number=SeqID_96476
atgatgataatcgaccctcccatcgccgtcagattccacgccgccgccgcctttcgctccgccgcagcaccaccacctcatagtaaccgttcaatgtggagtgctgatgacttgaacggtgtgcgttatttcgcgtcatgccggctcgcatgcagctgcggtttcgatgcgccttggtataccgattttgct

SEQ ID NO: 4792 - DNA, 1515 bp, Glycine max
  Peptide Sequence Number=SeqID_96477
atgcctgtgagaacccctgagtggttgaaaaaagtatttgcagcaatcaccaagagtgagaggaatggccctgtatttcgcttttttattgatctaggagatgcagtttcatatgtcaagaagctgaatattccaagcggtgtggtgggtgcctgtcgtcttgacctagcatatgaacatttcaaggaaaaacctcacttgttccagtttgttccaaatgagaagcaggtcaaggcagcgaataaactgctgaagacaatatcagagcacggtgagaagaaaaaggttgatggggtgcctgtgtttagtgcccagaacttagatatagctatagcaactacagatggtattaaatggtatactccctacttttttgataaaaacatgcttgataatattcttgaagaagctgttgatcagcatttccataccttaatccaaactcggcacatgcaccggcggcgggatgtggttgatgacaacttggctgcagaagtgattgaggaaatgggtgatagtttaggggagcctcctgagggatggactacagaattagaggttcaggaattgctagatgaaatgggccatcctagtataccactaagtgttatatcaaaagctgcagagctccagtttcagtatactgttgataaagtatttctgggtaataggcctttgaaactgaaaatttcaacttgtggcattttcacccctgtccttagttcagtggctcctcatccaaatagatttttgtgtcatccacaaagcatgactcttctgtcactgcttgaaagaagcctttcttccagacgttggccatcaaatgagcttgggtgttacatgggatacccaaccaacctagacaatctttattggttgactaaatgcacaagagatcatgggaaaaacaggaaacaaggatccctaaatatcctttcttcttctgaaactggatgtcttgagttgcagagcacttttaaagttggatgtcttgagttaagtgaagcttctctactgagagctacagagtcaagcagctcccttgagaactctaaagtggaagatgataggaaaaatgctgaatgcatagactcttctaagtgcagtttggatggtaataccgaagcaatcaaacaatctagtccaagactaagtctaccatttggtaattggtttcatcacctatggccgaaacagtgtcgcaaaaaagtaggctcatctagaaaaggtgtaaataaggaagaaatgaaaccagcaccctttcttccgaaaattacaatggttggtctctctactgaggaagcaggccaaatgagcaaagctaatttgaagaagacaatggacgatttgacaagagagttggagaagacagagctagatattatgacagatggtggcagtaaagagtgcaaagtagaagatagagatccactatttgtggcaaatgtgggtgattactattctagtttgggaaaaccaggatctggtcgctggataagaggaggatccaactaa

SEQ ID NO: 4793 - DNA, 1063 bp, Glycine max
  Peptide Sequence Number=SeqID_96478
atggtgggacagcgcgtcaaagtgctgttgacgctggcattattggattggactgcaaatgcgttgggtcgtgctctgcgtgcagacacgttggcccgcgctcttggtgcaggcgccttggctcgcgccgtgatggcggctttggtcgcgcttggcagaccagggcgtcttgtcgtgcctacagcaacgccacttcctaaagcgccagcgtcagcagtacttccagtccctaccccaccgctcctgccacctaatcatgtcacagccgaagaatctacaccgggtcgacccgggattgctactcagatcaatttaaagcgtggaaacgccgtcgcgggcacctcagggtcaatatccgtgtccgggcaatcgggttcgccgggtacgagcgttgcctcgttttccagcgtgtcggaccttaccgacatgggagaaagctcagagtttgaagagcatgcgttttctattattacacaagacacggtttcatgggtttcggttccggtgaacgggtttcgcgtgtttgtggtcgccggtgtaggtcacgatgaacgtgttgggttcgctggtgcttcgctctacttgctttctcgcagcgcatcctttgcagctactgcatctagtgagattgaaagtgtaatgttgtggataactggatatgttactgagaaggggtggttggttttgctgtggttgctgttgttctggggtttggagttgctgttgttggaacctgtcaaaaccagtagtggagggtgttccaatgaaggtgtgatttgtgggagcaggaacgagatggtggtggagactttgctgtatctgctgttgtccaatgaatcccgcaacttcagaaaacgtggaattgggattgatgccaaggccactagtgctagtgctagtgctagtaatggtgttgccattttcttggctcaaacccgagcaagaggtagtgttggaggtggtggtggtggtagtggtgggtggggtttctgtgtttgtggtggcagtaaatgtagcagctttgcaacttctaacgatggcaaagagatcccaatcctcatga

SEQ ID NO: 4794 - DNA, 237 bp, Glycine max
  Peptide Sequence Number=SeqID_96479
atggagaattcgtccctaacagtcaaccacttaatccaaccttatttcaatttactaagcgaaaatcaacttagggttttcaatacgcgattaggcaccacatacaccaggaaaactgccaggaaaccacattacaagcgaaacctcaaagagagttgggcttcgtcctcaaaaggaaacaacaccagaaaatctagccttccatggattcaaacagaaaacgcagatgaaacatga

SEQ ID NO: 4795 - DNA, 297 bp, Glycine max
  Peptide Sequence Number=SeqID_96480
atgaagaagatccaaggcctacaagatccacatggagctacatcaggtgacacctctggtgttgctactgatgatgatgccatagatgttgaagttgatgatgattatgttgtagacaatagtgatgctcatagagcttgggatctagggcccacacaggattggggcccaatttttaaccaggatttttttcttgtgagttattggaaagtgatgaagtatgaattgaaacacaacaatgaagaggttagcaagtccaaacagaaatctgttggacaagtggcctcaataacttaa

SEQ ID NO: 4796 - DNA, 159 bp, Glycine max
  Peptide Sequence Number=SeqID_96481
atggatacctcagagccctacactggggcaatgagaggcaccgtgcatgagcctcaagcgaacctaaaggcagatcaaaatttctcacctgtgaacaaaaggtacaagcgaggcgctcttgaggttcttactcaatataaccccctaaacactctttga

SEQ ID NO: 4797 - DNA, 294 bp, Glycine max
  Peptide Sequence Number=SeqID_96482
atgaccaaaatcgtgcaaaataccttcaagagggtagattttccacacccattgggtccaataagcatccaaaactacctacaaggaatgcaaattgaacaatccttaagaataggaagaaagagaaagataaggggaaaaaatggaaaaagagaggagaagattgagaaagagaaagagaaagatgaaagagtgggacgacctcgttggaacgtgattggcgaagaagagaagtggtggctctggcggtgcagcgagcaagaggtgaaacagtgccgtttggggtgggattag

SEQ ID NO: 4798 - DNA, 474 bp, Glycine max
  Peptide Sequence Number=SeqID_96483
atgaaacggactgctattgaacagaggaaggagggaagggttgtaaatgtctcatcaagacgtcataaattatcatatcctgaagggattagatttgataaaatcaatgataaatcagggtataacagtttgtctgcatatgggcagtcaaagcttgctaatgtgttgcataccaatgagctcgcaagacggctaaagtctgtttctgtatgtgttgttctgttttatttacccctgcaaaataaaggaaacatgagaacagggaaacaggggactaatccagcttatcaggaaaatggttgtggaggtggtctactgacaccaacagtttgtgagatgctatttgtttatgtaaaacaaattgttgtgagtggatcaactggagttggggattgtggtgattttgagggtaatgaggatacttatgatgagaaggttgagttcagcttgaaagggttatttctggcacactaa

SEQ ID NO: 4799 - DNA, 297 bp, Glycine max
  Peptide Sequence Number=SeqID_96484
atgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacaggtggaaaatatttttgtccatgtgtcaaatgtgcgaatgggagattgtaacgacccgcctcgtcgctacgaagtgattttgtcacaacataaattcatccaacaacacgccattacttaa

SEQ ID NO: 4800 - DNA, 2334 bp, Glycine max
  Peptide Sequence Number=SeqID_96485
atggacttgcccccgcgcgtgaattcagagatgtcatggagcaccacaaaaggcattcttccagaaaatgctttgccaatgttacagatgcagatgtgtcttatctttcttgcaacctttttcttgcacacatttctgggtcgtctaggagtccccagattcacttccatgagcgtcgttggcctaatctttgcaactaccttctcagaaaaatgggctcagaaatgtagggacttgttcatttttgactctcaggcaaatctggggttgctttcagtatttggctacatgcttttcctcttctacactggtgtcaaaacagacatgagtgtggtccacaggtctagaagaaatgccaccaacatagggtccattgccataatggcaccctttctatgtagcatggctgttgtgcattttcactcaataaaatacttagacattggtcaggcaacaaaacttggagtcatctctggcttgttctccatgacccctttctcaaccatttgcacagttttaagtgatctcaagatcctcaattcggagttggggagattagcccaatcctcaactttagttactgaggtgttcaacttgttcttgataacaatcctaactttctctaaaattgtgttccaagagccatcaagagcttggttttccctcgcagccgcagttttctttgtgctattggttgtattcatcattcgccctgcaatgttttggatcataaaacagaccccagagggttccccagttagtgatcactatgtctattgcatactcatattggttttgttatcatcatatgccacacatcgaatagggttttttgctctctttgggccttgtgtgttgggcttggctaccccagaggggcctccattgggcactgccatcacaaaaaagattgacacttttgttaattgggttttggtgcctgcttttgtgaccacttgtgctatgagggtggacctaagagacttcatgaattggacagaaaaggtgaatggaggtgttgacgagttcatggtgcaaaccctgattattattgtagtgactagcgttgtcaaagttgttgcatgcactttgcctcctttgtacagcaacatgcccttgaatgactctgtgtccctcgctttgattatgaattgcaaaggcgtagttgaaatggctggatactctatggtcagagatgtcatgggaatgcccgataacgtgttcgctctggtgatggtgtgcatcatcctgaacgccacagcaataccaatggtcctgacccacctctacgaccctatgaagaaatacgcagggaactacacaaagcgaaacatcttcgacctcaagacgaacggcgagcttcgagtcctcacatgcatccacagacccgacaacattcccccaacaataaacctcctcgaggccacattccctaccaaggaggaccctgtctgcgcctacgtgctccagctcatcgagctcatcggccgcgcctccccactcttcgtctgccaccagctccagaagaagaagagagccgactccaacagctccatggcggagaagctcgtcgacgcgttccagaacttcgagcaggagttcaagggcgcgttggtggtgaacacctttacgtcgatatcccctcaggagaatatgtatgatgacatctgtactttggccctggacaagtttgcctcgctcatcgtcttgccgtttcacaagaaatggtcttctgatgggaacttcatcgagatagaggacgagtcattgcgagagttaaactatcgtgtcatggagagagcaccgtgttcggttggaattttaatcgaaagagctcaaatgacccatattttctcacctgaaacgccttatactgtatgcatgcttttcattggaggaaaagatgatagagaagcgcttttctttgcaaaaagaatgaccaagaacccgcatgttagactcaccgtggttaggttttttgttgattcatgcaatgagatgaacacgagggattggcagggaatgcttgacactgagattctgaatgatataaaggtgaacaaaaaggtgggagaggcttatgtgaactacattgagaagactgtgaaggatgggcctgacacggctttggtgattaggtctttggtgactgagtatgatttgatcattgttggaagacaagcaggggttgaaacccctcaaacttcagggttgttgcagtggagtgagtatccagaacttggtgtgttgggggatttgttggcttcaactgatgcagctggcaaggcttctgtgtttgtgatgcagcaacagagaacagccaaggatgcttga

SEQ ID NO: 4801 - DNA, 381 bp, Glycine max
  Peptide Sequence Number=SeqID_96486
atggcaagaactagtgatggtggtggtgaatatcatcaactagacggatctcaacatttgctactggacgtgataactacacagatgcaatgtttgttgaaccgtaacaatgaagagctctgtggaaaaattgaaggattggagaaccaactaaatcataatgctagaagacattatggtgggaacagagggggtaatgatggacctaggcaaaacagaatgcaggggcagaacaaaattgagggacccaaaagaacccaaaagaatgatttcaagattgagtcaacaagttcaagatcaagattgatttcaagattcaagaaaagacatcaagaagaatcaagagaagatgaattcaagattcaagagaagaaatcatga

SEQ ID NO: 4802 - DNA, 264 bp, Glycine max
  Peptide Sequence Number=SeqID_96487
atgttcagtccttctgatattgagaaatctcttgaaattagtgagaaaaattgtttccgtggaaaaaatccaagccgaggtgcttccgtaacgctttcgagacgttgctataagcgatttcgtggagattcttcaccgttcttcatcgttcttcgttcgttctttggtcttcaatcgatgaatggtagcggaatggagaaggaagagagagaggagacgtcacttaaaggagaagatgagtctagaagaagctcaccaccatag

SEQ ID NO: 4803 - DNA, 306 bp, Glycine max
  Peptide Sequence Number=SeqID_96488
atgttggggaagcttgagaggattgatggggacccggtgttgagagaaacgaggatatgggctatgtgggagtacgtgagctcagttggaggtgggcaacaggggatggtggagtggtacctggagatatgtcgcgggggtcaggagaccttggggacgtcaggtggggtgctattgcccaaaaccaagcttgaccaatcccgacccaacccgggcatagttagtcactgtgaatcttgtgtgatatatgggttatggcttctggtaatcgattaccaagggtgggtaatcgattacaaggcttaa

SEQ ID NO: 4804 - DNA, 597 bp, Glycine max
  Peptide Sequence Number=SeqID_96489
atgacattctctgctgcttttgcttacttggagggagaacgttttaataatgttgtttgggttctacaacggtttcatggtcttttcatgaaaggtgatgcactccctggggttattgttaccgacaaagatttggatttgataaatgcagtgaaaactgtattcccggatgctatgaacttgttgtgtcgtttggttgactgtccatgtgagagttattttgatgagtaccttaaaaactttgaaatggctctccgtgacctatatttgtcgactatgtgtgccaaacatgggtacgctttaaatgaaattgctgctaagtatgagcgtgtaacttatgcaggcaaaaacccttcacgttgtggatgtgtcacgaggactacccacagtattccatggttatgtgagactaaggtgaccataattgaggagatggaaaccatatcgaaacgatttgagcaactcgatgtttgtggcaaagtacatttgaagacaaagctttgggaaattgtttatcctgatttgaactctatgtgtcctccttcaaaaaaagttgttggatcaagtggcctcggaataattcagaagaggggttga

SEQ ID NO: 4805 - DNA, 471 bp, Glycine max
  Peptide Sequence Number=SeqID_96490
ccttctcctccaccgcgagcccagctgctgcttctttcggttggacgccatttccgttcgagggtagaagacgagagcaggagacgccgaaaaaatggctgacggcggagtcttccggaagacccgttaggggttcttctgaaaagtttccggaagaagtgttcttccggaaagtttccggaagaagtgttcttccggaagtaaccaaacgtcttccggaagaacacttcttccggaagactcccagaacaccttttccgaaaactttccggaagaagtggttcttccggaagaattccagaagatgggctcttccggatgacctttcaaatttccggaagaagtggttcttccggaccggaaaaacacgaggtttaggtcgtgccataggtagagttgtaggcagagatagacctactgaccaggatgctactgatgttcccgagaggcgtaggcctactgcctcagccc

SEQ ID NO: 4806 - DNA, 438 bp, Glycine max
  Peptide Sequence Number=SeqID_96491
atgattaagacaataccaggaacacttgagcaaaacggtgttgcaaaaaggatgaatagaaccttgaacgagagagcgaggtgtttttgggatgaccaaaacaagaaagctatcaaaagcaggaatgtcacttttaatgagaacttattttataaggacaaattttctacagaatctacatgtgcaggtaaactgtcagaaatttctgagaaagcaacacttgaaaaaatttcagaaagtgatgtaaccaatagaaaccatagtataggcgtagaggttgagtcagaaccagaaccattaactcctctaagaaaatctagcagaatttcaataccactagataggtattccccttcattgcattatttgttgttaactgatgctggtgaaccagaatatttcagtgaggctacacaagagaatgattctattgagtga

SEQ ID NO: 4807 - DNA, 222 bp, Glycine max
  Peptide Sequence Number=SeqID_96492
atgacaaaacaaaggatagagggagaccaaggcgtcatcaacaaagacatgagcaccaacccctacaagagcaggaagacgaacctgctcaacaaattagaggcatcatcaacactatcacaggcatattttcccatggaggattatccaactagtcctgaaagtgtcatctctacagcatcaaagacctcaatgtcaattgtgtcaatgtcaaggcactga

SEQ ID NO: 4808 - DNA, 504 bp, Glycine max
  Peptide Sequence Number=SeqID_96493
atgaggtctagatcgtgcgttagacacaggcccactacctcagcacgtaggcaacgggttcctgtgcctgaggaccttacccagagagtcgaggatgttcctcagttgcctgaggatgtgcctcatgtgtctgatggtagcccagagatgacagacaccgccgatggtgttgagacagatcgagtggctagtgatgggagcttgggggcacctgctaatcatgaggggttccccggtgggccacgcgacccatctgttttgataggatttgctgatcatgtggcacatagcatatggagtggacaggaacgacccgatctcaagttggtctcctatgataggaaagtagataaatttgggagaccggctgctgagattgaaggtatgattgcggccaccggatttggtccactgatcaggtgttctgtaatcaccactgatcctggacttatatccacctttgttgagaggtggcatagggagacgagcagcttccacctctga

SEQ ID NO: 4809 - DNA, 141 bp, Glycine max
  Peptide Sequence Number=SeqID_96494
atggagtcatcaatcacacttgaaacgatgaagtatgcgaagaatttacggaaatgtctgctcatctttagtcatggaggccaggatttgagtagtggcaatgagaaaggtggcaaattgagtgagaaaagattcgagtga

SEQ ID NO: 4810 - DNA, 1143 bp, Glycine max
  Peptide Sequence Number=SeqID_96495
atgttcgttggtgcatttagctcaacaattagagattgggttgtgaggataaatcatttgtatagggagagtaatagtgtagctgactctttggcagctttgacttattccaaggccctagggttgcctgttgctcctattctaagacatagaacatgctatacctcggtgtttgtcagaactaaaggtaacatacaccatccaagtgcactcatctattcctttcctccttctcctccgcgaagcactcgtcctctcatgaaatgtactgagttgaaatttgcctctcatgagaggaaggtggaaaaagttggaaggcatgcacctgagattgaagacatagtggctgctataggattaatttatttgattacatattcaatggagacagatgacaagggacttttatatgcttttgccgagaggtggtacaaggaaactagtagtttccatttatttataggagaactaagtataaccctcgatgatgtggcatcattattacatctacccattacaggtgtcttccaaacttatgatgcaattgatgtggatcaagttgttgacttgttagttaagttgcttaaagtgcgtagacaagacacaaaagatgagacttatcgtaccaaatgttgcacactatttgctaacaagagtgtcacacatatcactgtggtattcttggactcattttgtgaccttaatcaacctggagggttttcatggggagcaattgcacttgtacatatgtatgagaatctaaatgttgcgtctaagcattcgactaaacatcttgtaggatatatcactttcttgcagtcttggatctacaagcattttcctacaattgcaaatatgattgctgatgagaattactatgagaggaaaccacatgcttgtcattggaagtgtgggaagacattactagtgaccacctatcgcaagtgcttggataggttgatgtcagatgttgtttgttggataccttatggtgatcatcatggtttcagagaatttgagcttatttcatctattgttagacacctatcagggagggtattacgacaacttggttatgttcagttcattcctccactcaatacttctacatctttatcgacagaagagattgatgataaatga

SEQ ID NO: 4811 - DNA, 303 bp, Glycine max
  Peptide Sequence Number=SeqID_96496
atgaccggagagatgagaggagcctttgagcttcttggcgaggccggcagtggcagagtcgttgggagcctccttgacgaggtagacgtaggcgaagccaccttccccgagctggcgcatgatgccaaagcggtgacgcgtgaggagtggagcatcttggaggcgaggttgcggcatagggtgcgcgtcatggagctgcagggcccacgatgtggcgccgtagggggtggagttgatgttgtgttggttggtgctgacgatttttccgattgttggtatagatctgagaagaaagcagcgtaa

SEQ ID NO: 4812 - DNA, 825 bp, Glycine max
  Peptide Sequence Number=SeqID_96497
atggttcttagtagcacaaaggattccacaacaaacacaaatgcatccaaggaggggacaaatgatgcaaaggaggaaactaatattccttcaaaagttgttgcaatagtagtagataaacctatagaagcacatgctgttatgcactcttcacaaggaaaggtggactatttgagcataaaatggaaaaggatagtgtggaaatcttgtgtttatgcaatcacattggtaatggtgattgcaatgcttcttggtgtaaatatggcatgggctgcaattgcagctgcaattactttggtgggtctggatattaaagatgcagggccaagcatagacaagtgttttattcttcttggaacaggtctcttattcattgttgatattctattcttctgtggaatgtttatcacagtagatgacttcaagaaaactgaaattccaggtgctctttgggacttaatggagccttattctcgaatagaccatgctagtggaatagctatactggctatagttatacttatacttgtcctatcaaatttggcttcaaatgtaccaacagttctattgcttggagcaagagttgcagcctcagctgctgcaatttccaaagaagatgagaagagggcatggttaatcttggcttgggtgagcaccatagcagggaacttttcactattaggatcagctgcaaacttggtagtgtgtgaacaagctcgcaaagctccaaacattggatacacattaaccttttggacccacctaaaatttggccttccttccactcttatagtcactgctattgggttgacactcataaaatga

SEQ ID NO: 4813 - DNA, 330 bp, Glycine max
  Peptide Sequence Number=SeqID_96498
atggttagaacacgaggtctacgtcatgtgtttggcacaggtagaggcagagaccttagtcaggatgtgcctgaggctgatgttcctcggtgtcgtaggcccactgcctcagcacgtaggcaacgggttacccagagagccgaggatgttcctcagttgcctaaggatgtgcctcatgtgtctgatggtagcccagagaggacaggagccgccgatggtgttgagacagatcgagtggctagtgatgggagcttgggggcacctgctgatgatgaggggttccctggtgggccacgcgatccatctgttttgataggatttgctgatcat

SEQ ID NO: 4814 - DNA, 264 bp, Glycine max
  Peptide Sequence Number=SeqID_96499
atggacatatcgttgggtgttactatgggatctgcaactcaaatttctatgtttgtggttccattaagtgtatttgttgcatggataatgggtataagaatggattcggacttcaatcttcttgaaactagatgtctatcttttacaattataattacaatgttcactttacaggatggaacttcacgctacatgaaaggagttactctctgttacattgtcattggagcatgtttttttgttctcaaatcctctaattggtaa

SEQ ID NO: 4815 - DNA, 703 bp, Glycine max
  Peptide Sequence Number=SeqID_96500
atgaagctttgcttctacattaatggcgagggtactagtcataaggaccctctatctagaatcttagatgagttgagttccctcaagagagaaaaggaaagaaaacctcaagaggctaacattgacctcccatacttccatgggaaggacaatgaagagactaacttagattgggaaataagggtagaacaacaacttaaaaggaagtctacttcaaaatcttatgactctcactcttatccaaagaaagaccaaggtcaaggcatcttaggggtgacaccttctaagcccaaagatgataaggggaagacaatagaaaagcaaccccttaaggcttgtatgcaagagaagactaactccatgaaatgctttaaatgtcttggaaaaggacacattacttctcaatgccccaccaagaaaatgttgattatgaggggccaagacatttatagttgccaagatgaggctactacttcaccttcctctagtgaaagtgcagaagcaaaaggggaagaatcgagtgaagagatctacccccaagaagtaggacaacctttaatggttaaggaggagtgtaaggagacacttgttagcattgccacacctcttaggcttgagtttattcctcaagtaaaggaggtgttggataagggtttggttcgcaagagcttaaatccttgtgctttgttggtgcccaaaatag

SEQ ID NO: 4816 - DNA, 432 bp, Glycine max
  Peptide Sequence Number=SeqID_96501
atgtggtggcatatgaaagagggagtgcagtatgataaagaatttggaaaagagaacaaggttctgcagatgaagaaggcagaggaccaattacatgggatacctattgtcataaatatccagggagtgacttggctgaggctggtaaccaatattgtattgttcaagattataattgaggcttgcaatggttacaattacaaaggaagatcagtgaaatggagaagcaaacaacgttggattatttggataagaaacttaggattgctaaattgttatggagaaagagccacatgcttctctagaggaaactacaactatatgcaactacaaagtactaagacattgactaaagttatattggctgtcaagaaggatgaactaccaaatcttgacagtacagaccaagtggggattgttggtgtatgctga

SEQ ID NO: 4817 - DNA, 276 bp, Glycine max
  Peptide Sequence Number=SeqID_96502
atggataagtgccaaagacgatctccacaaacacgatctccacaatgtggttgcagtcacggaagcgcaggcgactttgacacaaggagaaagaagaagaacgatagggttcaagcgcaaggagaaagaagaagaacgataggtttttacaaaactgatgttaacaatggcatactaacatcggttttggaaaaaccgatgttaactaagtctacttatttacaaaaatgccaccacgctttcgttaacatcggttttagctataaccgatgttaa

SEQ ID NO: 4818 - DNA, 202 bp, Glycine max
  Peptide Sequence Number=SeqID_96503
atgggtgccaagcacctcacaaggaccaaacaaaagttgcatgtcatcaagcaaaggtccccggacgaaattaggaaaaatgtctgtgatagtgtcatcggcacgtttcttaacattcaaggcaagacaaaggatggtttgaatactcacaaagatctagttgagatgggtatacgagaccagttacatccaaggtttgatg

SEQ ID NO: 4819 - DNA, 231 bp, Glycine max
  Peptide Sequence Number=SeqID_96504
atggttgtggaagcaatgtcttccaagagggtacatctacttgaagattgttatactgagaacaagagagagtacatctcttgtggatcagttcaagtggagggtacatccacttggtttttcaaagagaacaagggagggtacatcccttatggatctttggcttgtaaagaattttacaaggttaaaagaaatctcaagaaccgcaggttgcttggggactggatgtag

SEQ ID NO: 4820 - DNA, 168 bp, Glycine max
  Peptide Sequence Number=SeqID_96505
atggaaaggtcacctaacttgtctcataaaaatgacgatctcggactcattcaccgttggatcgtcgtgaaatttgagcaccacgttcgcaacccaatttcgagcattctcaccgttgggaatttcgatattttgtctgatataagagaaatacccctcactttgtag

SEQ ID NO: 4821 - DNA, 159 bp, Glycine max
  Peptide Sequence Number=SeqID_96506
atgtctgaaattgggggcgccgtaaaacaaacttgtcctgccagaaaaaacgttggggaggctgctggagccaatattggtgttttggatcttaacctgctgctccaacaggtccagcagctgctgctgctgcaccaaatccttcagccgccattgtaa

SEQ ID NO: 4822 - DNA, 1209 bp, Glycine max
  Peptide Sequence Number=SeqID_96507
atggctgtgccatcatcctcatcttccttcacctatgacgtgttcctcagcttcagaggagaagatactcgttacggtttcactggcaatctctacaaagtcctacacgacagcggaattcacaccttcatcgatgacgaggagctccaaaaaggagacgagatcacgacagcacttgagaaggcaattgaagaatccataattttcatcgtcgtcctctctcagaactacgcgtcttcctccttctgcttaaacgagctcactgcttcctcgagtgcagggttcgagcttaacgtggagaagctgaagaaatggaagatggctctgcgtgaagcagctaatttgtctggctatcatttcaaacaaggggatggatatgaatacaagtttatcaagaggatggtcgaacgagtctctagcaagattaatcgtgctcctttacatgttgctgattacccagttggactagagttaccaagtagctttgtcatgatgccaagactggctaagattattgcttgggaattgaaagggtggctatttccagaacaggttgagggtgaagaaagagtaagctcaatggtgtcttcaaatgtagattgtctttatctctcaggctgcaacctgtctgatgaaattttatcaataggtctcacatggtttgctaattccctacgagaaattagagggattctgccaaacattgaacatttctctgcaagaaactgtaaatccttgacttcttcctgtagaagctcattactgaatcagaaactgcatgaggctggaaacaccatgttttggttgtcaggagcaatgtttcctgagtggttcgatcgccacagtcagggaccatctaattgtttctggtttcgtaacaagttccctgccattgctctttgtattgctattggaccaagaccaattcattacaaacatattgaaattgttggacctattgtgatcatcaatggcattgaatgtttacttgacccggagaatgattcgtatttatggctagacacggatcacacttgtctttttgatctgcaaaagacagattttgcagataaactgaacaaagaagttttagaaaatgaatggaaccatgtggagattacatactcagtcgagcagagattccacgaaaaagagaagcatttggagatcccagtctttattgaaagtgttatctatgtgttcaaatag

SEQ ID NO: 4823 - DNA, 474 bp, Glycine max
  Peptide Sequence Number=SeqID_96508
atgtatatgcttattctctcactctctctcaccattgatttgttactgcttatgtactataaccaaattggagtgtgtggcagggataaagacgtggtcatggtggaccccatgggccctaccgtggtggcggcagcagacatggtcatcgtggaggttttagcaatggtgaagctggtgatgaaggacgtccaagaagagcatttaaactccacagtgggactggacgaggggtttggacgagggaactggggtacacagaatgatgacattgcagaggtgattgaggaagtggtaaatgaaactgaaaagattcttgctgatgagaagcgtataggagaggaagatgcagcagaaggaaacaaggacagtcctgctaatgaaaatgaagaaaaggagtctgaggacaagggatctgacaaggataagcacaaagatgctttggagaaggaggagaaatccaagaaagtgtga

SEQ ID NO: 4824 - DNA, 411 bp, Glycine max
  Peptide Sequence Number=SeqID_96509
atggcaatttatgttgtccaagagagtaatttggagagcccgagaattatcaaggaacttatacatacaaagaagcgaaaggacgaaagaattaaacacttaactgagattatgggagatgccatcatttcaattgacattgaattggctggccctgaaattacagcttcttcttcccaggcaccttcattccttccaactacaatcacaaaagatgtctttgatttggaattgcctaatttggctcgaggtggaactctcatatcagattatgtttctatcacaatggacaactcttgtccaaaatatgtgccaggaccacaaagagggatggaaggatgccatgacattctggctacaagtggaaggataccatgcacattgctagctagcttgttcacattgtgttaa

SEQ ID NO: 4825 - DNA, 324 bp, Glycine max
  Peptide Sequence Number=SeqID_96510
atgatgcgttctaatgcacttgttgttctgaaaggtgcctcttctcagttccaggaagcaatccgtggaagtggtggtggcaaagcatgtatctctgagggagtggaggcattcgtgatatatgttcggttcaaggtagcaacaagtgaacttaagccactacttgaagagattgaaagtaggtcttcaaggaaagaatatggtcaaattctggcagaatgccacagactatactgtgagcaatgcctctctttgtcacttttgactagtctatattgggctatcgtagagctactagaactagaatcagcatttctgatttaa

SEQ ID NO: 4826 - DNA, 1284 bp, Glycine max
  Peptide Sequence Number=SeqID_96511
atggagacacctttagtgaccgaaaagttcacttcagaatctgactacttgccggtgaaaagcttgaaggatgttaagtttgttttgtggacagaaacagtgaagatatggagaatagcattccctatggcactgtctgcactgtttcagtttctcacaatctcctcaacttccatctatgctggccatattggagacattgaactctcttctatctctgtttaccaaggtgtcatcagtgccctctatttttacttgttgtttggtatgtcatctgcattggttacactatgtggccaagcttatggagcagggcaaattcaatcaacataccaagaaatagctgatcttgccggaagatattctatacaagtaattccctacatgttttcctgtgcaatagcttttccctttcagacatttcttcagtcccagatcaaggttaaagttattacttgcatagcacttgctgttttggtcatacaaaatgtgctgctttacatcttcataaatgtatttggttggggtacaactggcttagccatggtgactaatatcatagggtgggtttatgctgcggctttggttgtgtataccattggttggtgtaaggaagaatggactggattttcatggatggcatttagggatttgtggtcatttgctaagttaagccttgcatcatctgttatgagttgcttagaccaatggtatagtacatgcattattctccttgctggtctactagacaatcctgtgattgatgttggttcctattctatttgctttaatgttcagggttggcactcgatgctgcttcttggaataagtgctgccataagtattcgtgtctcctatatacttggcaagtcgcatccaagagcagccatatactctttctgcgtgacaatgtttcagtctctcctcctcggcattgttttcatgactgtcattttcttgagtaaagatgagtttgccaagatctttaccaacagtaaggatatgattcgagctgttgctgatttagcataccttcttggcgtatcaatggttatcaatagtgcttcacatgtgatgtcaggcgtggccgtggggagtggatggcaagttatggttggttacataaaccttgcatgttattacattgttggactccccattggaattttccttggtttcaatcaacatttaggggtcaaggattcttcaaatgttagtcctcttagtcattatttggaagaccaactggtccaaggaggtactcacttggatgttttacgataa

SEQ ID NO: 4827 - DNA, 1014 bp, Glycine max
  Peptide Sequence Number=SeqID_96512
atggtgagtaatattatagggtggttgtatgctggggctttggttgtctataccattagttggtgcaaagaagaatggagtggattttcttggatggcatttagggatttgttggcctttgctaagttaagtcttcaatcatctgtaatgggttgcttagagcaatggtatatgacatgcattatgctacttgctggtcttctagacaatcctgtgattgctcgttcagggttggcacttcatgctgctccttggaataagtacggctataagcacgacagctatgacgacaaccacgacgacgcgagaagctcaacgagagtcactttgggggggttgttgtacgacgccgtttcgggttttcataaactcgtggactcggagcagactcgcgagtctatccaaactcgtccgagtctacgtaaaatcggacgagtctactccggtttcgattctacttccgatttaactcgccaacccttagtaaaatctgttcgcatctccaatgcgcttggcatgtcgcagccaagagcagccaaatacactttctgtgtgaccatgttccagtctctcctccttggtgttcttttcatgaatgttattttcttgactaaagaagacttcgccattatctttaccaatagtgaggatatgatacaagctgttgctgatttagcataccttcttggtgtaaccatggttctcaatagtgcttcacaggtcatgtcaggtgtggccattggaagtggatggcaagttatggttgctttcataaaccttgcctgttattacattgttggactgccaattggatatttccttggtttcaagcagcatttaggggttaagggtctgtggggaggcacaatgtgcggcagtgttcttcagattttaatcctcttactgataatccgtaagaccaactggaccaaggaggtggagcaaactgctcatcgcatgcgaatatggaacgttaacaatttccgctcagacttggcagaaaatgttacatga

SEQ ID NO: 4828 - DNA, 402 bp, Glycine max
  Peptide Sequence Number=SeqID_96513
atgatactagctgattctgatttagcacaccttcttggtgtaacaattgttctcaatagtgcttcacaggtcatgtcaggtgtggccattggaagtagatggcaagttatggttggttacataaacctggcatgttattacattgttggactccctattggaattttccttggtttcaagctgcatttaggggtcaagggtctctggggaggcacaatgtgcagcagtattcttcagattttagtcctctttacgattattttgaagaccaaatggtccaaggagtgtttgccatttgcatttgccggctttattttttcaatgtctggtatcttacggttacggggaatgtatgatgcagatggaacaaacagctcatcgcatgcgattatggagcaataa

SEQ ID NO: 4829 - DNA, 378 bp, Glycine max
  Peptide Sequence Number=SeqID_96514
atggagagtagcattcccaatggcattgtttgcactgctctagattctttcaacctccttaacttccatctatgctggtggttgtggtggtgggagtgggggggggggtttggtatgtcatctgcactggcaacactttgtggccaagcttttggagcaggacaaattcaatctacttgtatttatgttcaaaggtcatggattatacttactgccacttgtacaatcctcttgcctatctttgtatatgccacaccaatcttaaagttgcttggccaagatgaaggaattgctgaacttgctggaagatattctatacaagtaattgttaggatatgggacgtggttatgccttttttctatggaaagatatggtag

SEQ ID NO: 4830 - DNA, 423 bp, Glycine max
  Peptide Sequence Number=SeqID_96515
atggctcaatgttcatccctgagcttcttgatcttactgaggatgacctcattgagaagtttgatggtggtggttacttcactttcattggctatctcatacccaacacttgctgctacaccacacatgtttgtgaatgcctacaagaatgttcttggtgttgtggttgagacagattattctttcctcgaggcagacaaggacccaagtaaatttgttgtcattgttgttgctgctcttgtcgttgagtctggtgctcatgttgcagccaaggaagaggaaaagaaggaagaagcagctaaagaacctgatgatggtatagctcatccccttgggatctggttcagattttgcaagaacatttgggtgttgtgtgatagctcaggcatgttgatgatggcctcaaatattatgttcttttag

SEQ ID NO: 4831 - DNA, 222 bp, Glycine max
  Peptide Sequence Number=SeqID_96516
atgaagaagatccaaggcctacaagctccacaaggagctacatcacatagccttaaagttaaaggtgaggttcaaatgaagaaaggcttatggtggataactaggtacccagagacgaggaagggcatagcagtggcttggttaagggaaaccaccggagccgtagcgaaagcgagtcttcatagggcaattgtcactgcttatggacccaaacctgggtga

SEQ ID NO: 4832 - DNA, 177 bp, Glycine max
  Peptide Sequence Number=SeqID_96517
atgagtatatggacaagccgaacatgcactaaaccaaggagagatacatccaaggctacagtaacaatggcggtgctgaaggtgacgacgctttgcccatgcaagggttgcaacaataggattcacgggacggttgtcggagatgttaagaggaagatagaggttcttctattttga

SEQ ID NO: 4833 - DNA, 255 bp, Glycine max
  Peptide Sequence Number=SeqID_96518
atgacccattcatcatggcagcgcaagctagataggtgttttatgtccaagattcatgcgactcaagatggtcagtggttctacaagggagaacaacttgtatcggtgaccacattgatgacttatggcaacacccccaaggtcccctccatattcagatattccttcaaaggctacgtcgaagaggaccaaacaatccacacagctaagaaggttgactatttgaagcttggatcagccacgaccaacgattaa

SEQ ID NO: 4834 - DNA, 141 bp, Glycine max
  Peptide Sequence Number=SeqID_96519
atggtgccaaaatactttgttcacatcctggtactactacttatttttgtggatgtgaaatctaaccagcaagtgcaccgggttgtcaagacaaaaataccaaacaccggtgtctcgtcattttggactgatttaaactaa

SEQ ID NO: 4835 - DNA, 1062 bp, Glycine max
  Peptide Sequence Number=SeqID_96520
ggtgacctcgacacttactgcctagttttcctaactgagagtgtcgtgtggacacgcttaggctatttccttggggatggtaccacattgcatttgagagttgaggtcagcaacaaggcgagtcgttacagccgaggtcacccttggtgcttcttctctattttagcaaagaggaagcgagataaaggtgttggggtgtcatgccataagaagttgagggcccctttgagccttagtgcattgaggcaagctgtagggttgatgcctggttcgggtcacccttcgagtttgcaagatctgcctctagctccattgtctgtcgaggctttcattgctcttattgttgttattcctccttcttcacctcctcctgttgtgcctattcaggaggtttcttctactgctaaagttagtgtgctagccgctttggctagtatggtgaccatgaatgctcttgtgatgccgccacatttttcttcagctccaccagttcctccctctgttgtgttggcgtcgacgtccacctattctcacccttgtgtttccttggaccacatctacacctcaagcgatgcagattccctgtggaatgtgagttacaagcctgaacagaagaccatggttggctttgtgtcagcctttgacaaaaatctcatccaagcaactgggttccaacatgttatggattctaccaagggctactgctcacaaagtttggagaatggagcgcctgaggtagttaatgccacagtcgccttcactgaagctatgaagtcaaaccaccaactatcttccaagggcattgtggcaaagaaggatgagtttgccaaggtagtggcggacctcgaggctcggctgaaggagtcggagtttaggctaaaagagtctgagttacaggtgggtagggaaagggaggccagcaaagagcttgaagaggagttgttgatgtacaagaaggaacttgacttgggtattttttactctttcaaggacgtgaaggatgatgttttgcttaacaaggaagacatagatgttgaggagaaggatgctagcgaggagtag

SEQ ID NO: 4836 - DNA, 223 bp, Glycine max
  Peptide Sequence Number=SeqID_96521
atggattcattcgaagactcagaaagtgaagtcgtgaatctaagtctcatggctaaaaactatgaaagtgaagaagaggattctttgaagaaaagttggtacattgatagcggatgctctaaacacatgacgggagatgcattaaagtttactcatatttctcccaagaatagtgggcatgtaacatatggtgacaacaacaaaggtagaatccttggagttg

SEQ ID NO: 4837 - DNA, 825 bp, Glycine max
  Peptide Sequence Number=SeqID_96522
atgcgtcgggtgcacactcatctccctcggcttatggatcaggaagactcccttgcaaatcctttgtggaaacgtatctggaagtttcctgtgcaggagaagttgcggtttttcctttggcaatttgttcatgctgcttttctaactaatgagagaagattcggaggcagttcttcatattatttgagattgtcctcacgctccaaagaactacaaggccttggatatggtggctactattttggcgccttagatacccaaaactcgtacaccggattccaaattctagcagctggtttggcgccaccggctatccccggtgggttgtggaggttaccgacacgagccggaccgtatctcgcaccatcgacgacccctagcctcttcactcccttccacttctcctccatcgatggaaaaacctcgtgcgccgctatcgacggtggcctggtgatgaacaattcggcagcagctgccgtcacgcatgtcctccacaacaagcgcgatttcctatcagtgaacaacatggaggatctcctcgtcctgtccatcagaaatggagctcaggcgaagagaatgaacaatgccggtgagtgctcgacgtcgatggtggttgacattgcgctcgacgacatttccgagactgttgaccagatgctaggaaatgccttctgttggaatcgtacggactatgtcaggattcaggatgaggagatcctccacaccattcatcgatgggaaatcgcgcttgttgtggaggacttgcgtgacggcagttgctgccggattgttcatcaccaggccgccatcgacggtggtgcatga

SEQ ID NO: 4838 - DNA, 303 bp, Glycine max
  Peptide Sequence Number=SeqID_96523
atggttgtcatatatatgctattttttttaactagtgcaatgaagataataaccagttcttttgaaggcatgtctaatcaaggtgcacctcggtgggttgaacccaagagtaatgtgcaaagtggaaggtttgagtgcggatattatgtcatgcactggatgtggtgcatcgtgactgccggcttgaaggatgactggcacaagtggttttctgatggctcatcgttagacgtggagaccatcacaacagttcgacaaaaatgggcaacttactttttaacttttaggaaaagcagttgctaa

SEQ ID NO: 4839 - DNA, 945 bp, Glycine max
  Peptide Sequence Number=SeqID_96524
atggagactcaaaagctaattacgcatttcattcttctttttcttcttcctcttcttttcatttcttgttcatccgctttcactaccatagataactaccttatcagctgtggatcacagaacaatgcctctatcttcaatcgcatcttcatcagtgattctaccagccaaggttcaattttcctctctgctgacaaatccatttccctcaccaaccaaaacccccctccaaatttgcctactttgtaccacactgcaagagttttccccagcactgggagctacaggttcaacatgaggatgaatggttcccactttgttcgttttcatttctcaccttttaaggctcaaaggtttgatctaaaatctgctaactttagtgtcttggttgatggcaatttggtgctgagaaatttcaagccaagtaatggtgcactgcttaaagagtttattttgaagatagagtcaaatttgcttgaaattgtgtttagacctgaaggtaattcaggttttggctttgtgaatgctgtggaggtgttcactgctcctgctgattttgttgtagattatggagctaggttggttggtccttctggtgtggtagagtacaagaacctttcatctcaggttttggaaactgtccataggattaatgttgggggtgtgaaagtaactccttttaatgacaccctttggaggacttggattcctgatgaggaatttctggttttcaaggatgctgctaagcgtgtggggatcactcacacaccaaattaccagaagggaggcgcaactcgagagatcgcgcctgataatgtttacatgactgctcaggaaatgaataaggatcactccattatagcttcacagttcaacataacctggaattttcctgtggctccaggtggtgttcggcacttggttcggctgcatttctgtgatatt

SEQ ID NO: 4840 - DNA, 699 bp, Glycine max
  Peptide Sequence Number=SeqID_96525
atggtgtttattgaaccacttgctgtaattgactttgttgctcaaattttgggaaaagatgtgctctgtatgccattgtcagatgcagattgtgtcaagatatatgatgtgttgacatctgttaatgttcaaaatgttagaatagcctatggtatgctatctgatgctgaagagattggagcaatttctcctgggaagatcattttggttgacccaacaactggaaatacagcacttggcattgcttttgttgcagcaacaaagggggctaaaggggaagttgacaaacctgaagaaattgttcgcaacacacccaatgagtgcatgttttggcagtttgataacatgactaatacaaagatccacttccaaactacatggccagagatatgggaggataccatgggtaatgttgatgtattggtagctaggattggaactggtggcactgttactggcattggacgttatctgaaaatgatgaacaaaaatataaagtgtgctgacagtatgtgcattatatttctcgtatttgaaacctctagtgagttagctctatgtcctgtgttggaggacaattatgattcaaagattgaagctgttctcatccctctcctcttcatgttccaattcctttgttcaaaagttgtttctttttatattgatatggatatgccattgcaatttgcaacctcttag

SEQ ID NO: 4841 - DNA, 234 bp, Glycine max
  Peptide Sequence Number=SeqID_96526
atggagatgggaggagatctccatgaccacatcaacaagttcaattggctagcgctgttgttgttggtctcactaccaaggtccttcaaagctttggttcaaacgtttcttgtgggaagatcaactttgaatttggatgaggtgattgctgctcttagagaaaatgagagaatgatgagagctgaaaatgttgatgatgaacacaatgcaatagttgtgatggagtctgagtaa

SEQ ID NO: 4842 - DNA, 225 bp, Glycine max
  Peptide Sequence Number=SeqID_96527
atgattttgatgattctgcatgctctatgtagcttactctgcagttgggaagggcataccagaacaagagtgatgggcaagtgcaagggttgtggaaagttaggaagaatgaggccaagtcatatgagtgcttatgaattttctctgatgctggctcctgttgtttctgtttgggattgcatagttcgcaaaatgaggtactcctacagacctgagtgggtgtag

SEQ ID NO: 4843 - DNA, 204 bp, Glycine max
  Peptide Sequence Number=SeqID_96528
atggatgattttctatcaaaccaaaagagacaaaccagcaacaactttggcaactccttcatcaataattccttcaaaatcatcaatagacaaaggatcaagctgaatgttttgatgatgccaaaggttcacatgcgtctcaaagctttattcaagacaaagaaattaaagatattcaagatggatgatcaagacagtctctaa

SEQ ID NO: 4844 - DNA, 573 bp, Glycine max
  Peptide Sequence Number=SeqID_96529
atggcaatcatcggcaatgcactttgccaggcgttcatgatgaagcacgagtataggagccttagagaagaagacaaggcatggggtaagcttcagagacccataatggtggcttccgtggccatcatcatgctcgcaatcatcgtgttcattgttatatgtttgaaaattgtgtttccgagtagcgatggaagaagaacgttctacgagattgctaattattactggatgattgtgttcattccctcaatgattgttttcatgctctccgttgtgtatctcattgctgaaatctaccctgaggttcatgagaaccctagggccttcttcagcagctctagcccaatcctcttgctcatggctctagtgactggtcccttcctagggaggattgcatcaccatggagaccagtaagggccacactattttgcgagaatgctccaaccatgtgggatcggcataggcttaaaggagcactcaaattgggtgtatttacccacaaggtctacactctgaagagtccgtcagggcctctccctcctaattcaggtccaacccaaaaaacattttag

SEQ ID NO: 4845 - DNA, 276 bp, Glycine max
  Peptide Sequence Number=SeqID_96530
atgacagacacaaccactctacaacaactccaaaaccgtattgcagagatggagcgacgccatgaggaagagttaacaaatgatgaggacatgaccaagagcaagggcaaggatccacttgaaggacttggaggacctatgacaagggctagagcaaggaaagccaaggaaactcttcaacaagtgttgtccatactatttgaatacaagctcaagtttcaaggagaaaagtccaaggttgtgagttgtatcatggcccaaatggaggaggactaa

SEQ ID NO: 4846 - DNA, 2239 bp, Glycine max
  Peptide Sequence Number=SeqID_96531
tcgtgtaaaggagtttgatggaacctgtatttctgagggactcatcgtctgcttgtcatggactagccaaggtggcctaggtcatgcggtgagacctactagtggtgtactgcgcactgaatcattcgacgagggtgttgaagttgtctatggacctaggttcgcttgtgtcaggaagacgtccagatgctcgtttggatctgttgtcatatcgtaccactcgaggttgagtggtttccaccccaagagtattgttgcctgtgcgtcaaggtgcaattccccttgggtgcattcaggcaaggagcctctagctggtcatggtcagcctttagctttgtcaactcttcctaatgacgtcgctccatctccgcgatgcgaccgagtgctaaccatggatggatgtgaaaggattgacgagaggccgtgggtgagtcccaaacttcacacgttggcttggagaggtgcctttgacaggagggagacctacaaaacaaaggactccgatgctcaaacatgtctaattctaccatcggtctgggtggcagcgattctgggggctcgattgagcaacccatcatcaggaggtaatctcgatagtgggggcgcttctcgccctcgtagaggggtgtggccttccgatgctaccgggaagcctgtcccggttaatgtgatccttcccccgtcttctttcgggggtgtgaggagacatagtggaggtggagattgggtgagggacgatgtgctgaaatataagtcatgtctgacctcagtagcgagggtcacagcgcttaagcgccaggtaaagctggcaaaccctgagaactcttgtaagctggtcgttaaggcttacgggtgggatgacttcccattttttagggtggcacatagtcgtttgcctttctttttcatgtatagatgtttgtttgaggtcttgggtgtcattctacccttgaccgcttttcggtgctcagctggagcacttgaatgtggccccttcccaacattacccaaacagttaagcgatgctactgatgtcatggctaatgacatgccactgatgcttaataggggcagggatccctgctacccattctactggaagtctaatcccaccagcgatcctctcgctgccttggatgttgagtgcctaaccttgccctcgtttgtgtttgaggtcaaacctgtaggtgggactgtgccaccgtttattgttgctccgtctgttggagaagggggccaacctgctggtgaggttggtcctgttgctgaggctgtttggccacaagaagtcgaaggcccttatgagtatttgtgccctgaggcaggctgcagggcttttgctgctacttttgcgactcctgctactattgctccttcacctcctcccattgtttttgttcaggaggttactcctactattactgaagctgttgtgccagccactcaggctgattatgttatggcgttgctatccactatcgcgacacctttgttaagtgctggtgtggcggccactagtgctcccacagtgttgccttattcctctgcgactctggtggcttctccctctgttgttctggcaacggtggcgtcatcttctttgtcctctcgccttcatatcttgcttgatcacttgtacacctctagtgatgctgactcactatgggccttcaataagaaccttattaggtcgaccagggtgcaaaatgctactgactctgccaaagtggctattgctcgtactctttggcgagtagagcaccctaagggggccaatgccactattgcttttgctaaggctgtaaggtcgaaccgccaactgcctgccaaaattggtggtgtattggtcaagttgttgtgtacccgattagatggtgataaactgtttagacgctacaaggacttgcatgttgagaagatgaacctgggtggcaaagtagagagcatggtggcagagaaggatgggcttgccaaaggaggcagcatggagcttaaggaagagttgattctgtacaagaaagaggtcgtcgagcagcatgagaaaggctttcagaaggctgtcaggatgcaagaccttgttgatgtagaggtaggaccgtggtggtcttgtgaaaacttctcccctgatggttgtgaggagttgtgtttgactcgcccctggttgaaggtcttgcctaaccagtgtagggataggtcaattgaccggctaagttcctcctctgatggttatgaggagtaa

SEQ ID NO: 4847 - DNA, 675 bp, Glycine max
  Peptide Sequence Number=SeqID_96532
gctgaatttgatatccttgaagcttttgacggtaggacaaagaagaaagtacttcagactgttggggagcagtggagacagtttaaatctgatttgacgaggaaatgggcacttgcagccaacaaggatagtgtggacgacactgtttgtgaaaaatacgacattagcaaggagaaatgggcccagttttgtcagacccgcagagacccctcctgggaggatgtgcagaaaaagacagatgtcatccagaagcaaaacaccgccccccacgtgttgtctcgtgggggttatgaatatttagaacagaagctgatggctgagaagacaaagaaaaaactggaggaagctactcaattcaaaagcactgaaggcgtgattgaccttccatctcccattagacaacacatgaagtggaagatggcccgcaccaagaaaactgggcagatgacgtctgaggaagcaaaggaaattgctgagacgattataagtcatttccaattaagaattgtgtcacaaggttcatttgtcccccatggacgtcagcatctcctgattgctgccattgggcgaccagaacaccctggtcgtgtgcgtgctgctggagctagtccagatgcagtcccagttgcaatcacatgtccaatcacagggacttgcactacctccggagcctga

SEQ ID NO: 4848 - DNA, 948 bp, Glycine max
  Peptide Sequence Number=SeqID_96533
atggagattggtggactcgggaagggtacatcctttgtggtacaagtagagggtacatctacttgggttgttgtaactgagaacaagagagggtacatctcttgtggattagttcaagtggagggtacatccacttggttgttcaaagagaacaagggagggtacatcccttgtggatctttgcttgtaaaggattttacaaggttgaaaagaaatctcaaggactgcagttggaattatctatttccccttggaactatctctgcagttggaacttataacactatcacggacaagagtgatgtgtatagcttttgggttgtgcttattgagctgatatcatccatgccagtagttttagcagccagggaaagagatgagacatctctaatcttaactgcattcgctgcaggacaagctgctacctttaaaatgtttgaagcgattaagaggcagcctgatattgatgcttatgacactgatggtcgactgctagatgatatttctggagatatagagcttaagaaggtctgctttagttatacttctagacctgataagcaaatactcaatggattttcaatttcaataccaagtggcactactgcagctttggaaccagttctctttgcttgcagcattaaacagaatattgcctatggtaaaaatgtcccaacagatgaagaaatcgaagctgcagctgaacttgctaatgttgctaagttcatagataaatttctccatggacttgacacaatggttggcaagcatattagaacaagcactaatttaagaggggcaatgggatacattgcacccgaatggctaaggaatgcaccaataactgccaaagttgacaaatatagttttggggctaaggaatgcaccctgctttcgatgtatgtttgtgataacactacgctacccttaggggagttgctatcatag

SEQ ID NO: 4849 - DNA, 1404 bp, Glycine max
  Peptide Sequence Number=SeqID_96534
atggcagttgttggggttatcttcacagttttgttattgggattacaaggagttagggttgttgaatgcagagtagccaatggattggactgttttgagtaccctgctatcagctgcagaaaacacagtgcagttttgactgattttggtggtgttggtgatggaaaaacatctaacaccaaagcttttcaatatgcaattagcaatctcagccattatgcatctgatggtggagctctacttgttgtgccaccagggaaatggctaacaggaagcttcaatctcacaagccacttcacactttttctccaaaaggaagctaccattcttggatctcaggatgaatcagagtggcccacccttcctgtgctaccatcatatggcagaggaagggatgctcctgatggaaggtttagtagtctcatttttggaactaacctcactgatgtagtaatcactggttacaatggaacaattgatggacaagggtcttattggtgggacaagttccacaagggtgaattgaaactcaccaggccttacatgattgagattatgttctctgatcacatccagatatcaaatctcactttgatcgattctccatcttggtttgtccatccaatttacagcagtgacattataattcaagggttgaccattcttgccccagttgactctcccaacactgatggaataaatccagattcttgttccaacactaggattgaagattgctacattgtctccggtgatgattgtgtagcaataaaaagtggttgggatgagtctggaatcaaatttggaatgccaagccaacacataataatcagaaggcttgaatgtgtgtccccagatagtgccatgattgccttaggaagtgaaatgtctggtggaatccgagatgttagagctgaagaactcacagctctcaacactcaatcagcagttagaatcaaaactgcagttggtagaggagcttatgtgagggacatatttgtcaaaggaatgaacttaaacaccatgaagtatgtgttttggatgacaggttcttatggctcacaccctaacaccgattttgatcccaaagcacttcccaacattacaggaataaactacagagatgtcattgcagataatgtcacatattcagcaagacttgaagggattgctaatgatccttttacgggaatctgtatttctaatgtgactatccatagtggaaaaaagaaaccgcaatggaattgcactgacattgagggggttacaagcaatgtctatcctaagccttgtgagttgctgcctctgaaagagaaaattgagtgtccttatccagatgacaaattgcccattgaaagtgtgcagctgaagacttgttcctttaaaagtgtctcattcttctga

SEQ ID NO: 4850 - DNA, 771 bp, Glycine max
  Peptide Sequence Number=SeqID_96535
atggtttttgtaatctttagcatgcttccgcatatacgtagtcatgcacagaaatactttctaaaagttcagaagagtgggacaagtgaacatcttccaccacccaggcctaaaagaaaagctgcccatccatatcctcaaaaagcttccaaaaatgctcctgtactctcacaagtatccggacgttttcagtcttcatctgctttgcttgaacctggatacatctcaaagaatgatgccccaccaatgcttaaaactcctattatgaacaccgtgtcatcatcctggtcaaacaacaccttgcaaactgtcaatttatctcctgtgaaaaaagtgaataatccttgtagtagcggtgaaagtactcctaaagtgcggccggttggtgaatctaatggtcaagggaataaaatccatccattgagaggcaagtttaatgttctttttcttagtgcagttcttccagattttactgaggtatacggcttcattggcagtttgtttgacccaaatgcaactgagcatctgcagaaactaaaaaagatggaccgtatagatgttgagacggtgctactgttaatgagaaacctgtccatcaatttaactagcccagattttgagcatcatatacatggcatgccattgtctagtgccatgtctatagcatttcatttctcatcctactaccaatgtccttttattcattttgtccttgagcttagctccatcaagaaacatcaaactcggaggctattattaatcatcatttaa

SEQ ID NO: 4851 - DNA, 957 bp, Glycine max
  Peptide Sequence Number=SeqID_96536
atggagtgtttcatccatctgaggttatggaaaaggctatcacattgtccattaggcaacaatttgctaacccatggccaacatggggagcaattccaaaagatcatcaggaactctttttctagcattttaagagaaaattggtctggagacccgaggaaaagaatgaaattaagaaagcttttaactcgaaagcctctcatagactttctgatatgtttagggatgcccgaaatgaaaataaaagatcatattcgcttggagattgtgtctggtattatcacattggaatgcacctggacaggtggttctattagcttgcaagatcacaccattcgcttgtcagatgagcttggtcgatctgcatacgtaggtgagatatttcagcaaactcatttacgaaaggatattggtcaatttgttgatgatagatctaggcagacacatgctagactatctcaagctaggtctaatgctgcatcaagtgttggtgaatcaaaaatcactcctttagaccttgctaaagaacaaagacttaggacttggtgttgggttgctgctacggggccaaagcgtaagggatgcctttatggtactggagagatcttgctcatacttataaatgtggagatgacaacttcatgcagtatacacaaggatcttcctgtcgcgcttaagattcatcgaagcttaaccgaagggaggagctttgtcaatcaaaggaggagatgcgtatatttcagtcagttgttctttaatttctacctcctgaagcgtggaacaatattcatcaacttcaacaaccttaccagcagcatcaggaacatcaataacaacaagacaatgatcaaccagatgactagcaaccagatgactaacaacaagacaatgaccaacagagacactctcccaatgaatattttgattattgacataacaacacaaagttactattaa

SEQ ID NO: 4852 - DNA, 1209 bp, Glycine max
  Peptide Sequence Number=SeqID_96537
atgggttctaaaggcagtttttgcaatgtcgagcttggagaaccagctggcaccgccgagcttgtcgaggagctcgttaattgtcggtatagggaagcgatccttgattgttgcaaagtcggtgagcagggtagagatgtctgggtgaatgggggttggggaaatgggtgtaaggaagagttgtatgtggaagaaggcactagcggcattggtctggaccagtcatcaaagttgtggaggagagattgcctccaggtgctgagtcgtatcacctttgagctgaatgatcgaaccaccatggatgaacttcatggtgtggccttgaatttggatggtggtgtcagggcacacatggtggcattcgagcttgttatcgatcccaacaaggacacgcagggctggggtgggtttagtggtcaagttcaggtgccggaggagcctcgcctgcataaaattgtgtgtgctcccaccgtcaatgaggatgacaacgggatgcttttcttcatctgcaatgagaagatagaagcgagaggcacatcggtgcccatgggtgtacttcttgtcgcagttgaagcagagacgatgctcctaccggtgagccattttggcgggtgtcaattgcttcaagggggcggtgttgatcagcaagtttttcctcatggaggcgagccaatcccgcggcctgtaccaggcttcaaactgatgcaggtaatcgctaaccgagccccgttgtgtgagtttgaagaggattcctgttgggtcctcgtatggggagtgggcgaagcgcgtctcaatggcctgcaaaaacgccacccacgtcgggagctggtggttgcgggtcatccactagaaccacgtaagagcggggccttccatagcgaaggaggcgatgaggggtcggtgccattaaattttggaacattgagtttcatttttggtgggttatgggttgtgtttggtgcggggttgggcgaggaagaagatggtgaggctgaagggcaagctttgcaatggcttcctcaagacgttctaaggtggatttggagcgagagtcctccattagagaggaggaatgaaagcaccagaatgttaagaactgagaaagagcctagtattcaaggtctaggcaccttcagaataaagtttttcatgatgctatcctctaacaattatcctaatggtctaatggcatatgccttggaggaatga

SEQ ID NO: 4853 - DNA, 779 bp, Glycine max
  Peptide Sequence Number=SeqID_96538
gccagttccaagtaccacagccgccaaaaaccctcaaacaccaccgccgctccaagtaccaccggctagttccccgagatggtggcatcgtaattggggattccggcgtgttgtacctactccccaccgcgccgttcgagtttcagttcgactattccaagacgtcgaaggtgaagccgattgccatccacgagctgtcattcccgcccttcgtgccgcctacaatgtcacggtcatggaccgagaaggcaccactaaagggcaagaagagcaagaaggttccccactgcccgaccacatcgacttctacaacgaggtttccactgctgctcgactcaacgatgatgtcctcctccttgtcaacgtcgttgagggcatcttacatccagacccacaccatcctccactagagggagagaaagcgagaaaatcgttgttctttctagggtttctggtgttgttcctttcactgccatcgtcaatggcaaaattcgtggtggagaagaacagcttgacagtgacatcatcggacaacatcaagggcacgcatgatagggcaatttggaacttcaggatactccaatacgaaggcagcatcgttgggaatattttgtacccaaaggacaacaaaaagggttgcaaggagtttgatgagtatgggatttccttcaaatccaaacccagtgctcttcccactaccgttttgctcgatcgaggaagtaaaattctcttaccctctaatcttttcatgtttgattttaaggtttcaggttttgctg

SEQ ID NO: 4854 - DNA, 189 bp, Glycine max
  Peptide Sequence Number=SeqID_96539
atggatgtgcaaccggaggtgcaatatcagcaaaagccgaaggatcccaggggtactgatcagtattttcatcctgttagtttaactgcatgtttaaattttatgtctaaacctcccattatacatatctttggagcaaattgcactgttatagtacctactcctttagcaattattgttcttgattga

SEQ ID NO: 4855 - DNA, 186 bp, Glycine max
  Peptide Sequence Number=SeqID_96540
atgggaaaatcctttccagaatcgatgttgttcagccacggacacgctcgcgaggtagcagacattcacgtcgaagaagaaggagaagatctttgtggcgaaggagaagaagcaaagcaagggagacgtttgctttttggggtttttctcgtggctcgaggtggaattgtggatgagaccctctag

SEQ ID NO: 4856 - DNA, 642 bp, Glycine max
  Peptide Sequence Number=SeqID_96541
atggaggcaccgcttaaatctgaggtattttgttcatcttttatgctttttttccctgcttttggtggaactatgtcagctgaatcagtgatcccaaattcatcttcatcagtgaatctcgagaaagcaactacagtcaattctttcctcgctgtcaggttgtctattaatcggctggtggtatggagccagcaacttagtctgaggtattttgctgaccttttatccattttcggcctgcctttggtggggttatttgccaggtgccttgattccaatgcgttcgactttgtgttcttcatacaaggttttgtttttgtttccatcctcgatcctttgttgtcttctaagttggctattaatgaaccagtggactggaaccatcaattaaatcggaggcattttgctaatctattatgcatctctttgtctacctttgatcgagctatttgccaggcgaggctcacgggtgcactttccaaaggaggaaagatgcgcggagtcgccaccaacgaaggtattagcacctcttacgtcgacaaaagcggggcttttgctcctgcgtaccctccatcaaagaggaaatcagacctacgtagttctttcttaagggtgaatcaagcgattctttttacttggaag

SEQ ID NO: 4857 - DNA, 500 bp, Glycine max
  Peptide Sequence Number=SeqID_96542
atgcgaattttcgctggccaagttgagccgcttaacatcaatcactacggaatctgtaaggatttcgcgatgtttcagaaagaaacgggcaaagaactcaaggtaggggcaaaagggtccattctggataacttaggggagaagcaaccagctcgcctgggggagctgctcgcctgggcgagctactcgcctaggcgagcaagtgctaattttcatctgctcgctaagccaatctgccagctcagtgagccatccactgagcgcaacactcctttggctgagtgcgacgaagaatctggaagaaggatgagctgtgcatgttcgctgagcgagggatttctagagagaaaggtccaaattccagagagttttgagagcttttgctatgcgaagactggcagagaactaagcatgaagaggaagccatcctgggagcatgagatgagtctgaagcttcccagatatggagagctaaatccactattggttcttccttgtag

SEQ ID NO: 4858 - DNA, 207 bp, Glycine max
  Peptide Sequence Number=SeqID_96543
atggaagtgaagatggaagagacagaccacaaaaatggagaagaaagaaagcacggaggaaacctcgtttcagaggaaacaacaggagaaggctggagaaggaggcatgtggagcaaccaaagcttgaagcaggttgtggctggttgtgttcgaatcggaagagaatagaagaaaatagaagaagaaagaaagaaagaggcacatga

SEQ ID NO: 4859 - DNA, 159 bp, Glycine max
  Peptide Sequence Number=SeqID_96544
ggacgccacaaccgacccatggttccagttacttgatgaaaaaaaattgatccccggagatgaggtagtcttctactaccgatttgatgaccatgcatgggaactgctggtcaggaaagatattgaatgggagaacgacgacatcaactttgaagaaat

SEQ ID NO: 4860 - DNA, 313 bp, Glycine max
  Peptide Sequence Number=SeqID_96545
atgaacaagcaacaacttaaaagaaagtctacttcaaaatcttatggctctcactcttatccaaagaaagaccaaggtctaggcatcttaggggcatcaccttctaagcccaaagatgataaggggaagccaatagaaaagcaaccccctaaggctacaccactcattgagctggtgaggaacaatgttccctcatgggaagatgtcaatgaaaggggtgtcgagggaaggggcccagaatatgaagaacctcgggatttgaggtcaaatcatttccaaggtggtggggatgatgcaatcctaccgcccaagg

SEQ ID NO: 4861 - DNA, 558 bp, Glycine max
  Peptide Sequence Number=SeqID_96546
atgagagaggtgacgatctcgttggacgacgtcatgtctcttctgcatcttcctatggttggcagcttacatgtctttcagcccttacacgtggatgatgcggtacagatgttggtggagttattgatggtctctacagaggctgccagggctgagacagggcagtgtcgtggactgtatgtacacctccaatggtctgactgggaggtacacttggggagtagctgcgctggtgcatatgtacgaccacctaaatggtgcttctatctgcaccagccgacaacttggcggttacatcacactgttgcagaagactgtgaagagcatacgtacaccgatgtacagggagtgcctggaccgactccggattccggatgtctgttggatcccatatggggagcaccaaccgatccaggagttccatatgatttcatgctattttggtctgctgcactgggggcccgtcgttgtgtattaccgaccagagagggtcatgcggcagtttggatacacccaaaccattcctgctccgcctgtcggttcatgggtgtcgtatga

SEQ ID NO: 4862 - DNA, 225 bp, Glycine max
  Peptide Sequence Number=SeqID_96547
atgttcctccagaaggcggttgcttctacaggaagcaacctggctctcctgggcgagctgggtggcaagctcctcccctattttcctataaatagagggaggagtgaaggagaaagggtcagcccttctgaaaatccaagccgaggcgcttccataatgtttctgtgggtgatttcacgaagattttcaaccgttcttcgtcgttcttcggtcttcaaccggtaa

SEQ ID NO: 4863 - DNA, 177 bp, Glycine max
  Peptide Sequence Number=SeqID_96548
atggaaaggatacaaaagttcacttctagtgataattcccaagggtggtttcatggactatcagcgaaaatgcatcaccaaaagaggaaaactctagatgaggctccactgtcatcaagcaagtcgaagacccagcatgaccacagatcaacctccactccttatggctcacattga

SEQ ID NO: 4864 - DNA, 381 bp, Glycine max
  Peptide Sequence Number=SeqID_96549
atgggggagacacatgaagcaccccgagaccacaatctagccgacttcgatcctcaccttggacatgccgctgaagggcaggcgttttgcagcgtacctatgccaaacactttgggggcccctcagtattgcccacaactacaaccgttacattttatggtgggaagagctcctcctgctatggtggaaagggagaaatttgatcatatagaggaaagactaagggtcattgaaggagttgtgcctagtgcccgacgtggtcattcctctgaagttcaaggtgttggatttcgtaagtacaaggggactacttgccccaagaattacctgaagatgtactataggaaaatgggagcatacgcaaacgatgacaacttatag

SEQ ID NO: 4865 - DNA, 183 bp, Glycine max
  Peptide Sequence Number=SeqID_96550
atgggagcgtgtccaagaaaggaatatgctcggagtcgccaccaacatttatttgaggaaaacgtcggaaaaaccggaaaagaggaaaataggggagaagcttgccacctagctcgcccaggcgagccaggttgcttcctccagaagcaaccgccttctggaggaagaatctggaaggcccaa

SEQ ID NO: 4866 - DNA, 148 bp, Glycine max
  Peptide Sequence Number=SeqID_96551
atgagtaagttatacagtccggaatcagccgcaagcggagtggagcaggttattcaactgctggaagggcgctggaaattaatcatcctttttcatctgttcgacggccaagtacagcgctattcagattttgaaaaattaattcccg

SEQ ID NO: 4867 - DNA, 331 bp, Glycine max
  Peptide Sequence Number=SeqID_96552
ctaccaccaaggccttgaaacaagagaccaagaggctcgtagggaagagcacggccggaacaagttccgaggggctctgtggggcagcaacaacgagcttaagctctggagagaggaaagagaccaatcacgagtagacagtttgatcttgaaagatgagttgaaggtttgctcaaggtccaaaaggaacttgtctcagtgtttatgcgagacaaagaccaacatgttagccagcgtcagcaagtaccaagaagaactaaatctagccacgacccacgagcatagagtggcggacgagtatgcccaagtgtacgcggaaaaaggaggctag

SEQ ID NO: 4868 - DNA, 552 bp, Glycine max
  Peptide Sequence Number=SeqID_96553
atggcttctaggaaaagaaaggcaccatctacacccacccaagttagatttgacagatcaagatttacttcccaagaggcttgggaaagatacacaaacattattgtgcctaggaagcttttgccagagaggaacgtggtggtctactatacagagttcgatgagttcaaggaggaactcgaaagacgccattgggacaaggagttaactgactttagggatggcaacattgatgttgccattgtgaaggaattctacgccaacctctatgaccccgaggacaaatcacctaagcaggagttggctgctaagctttgtatcccgggaaggggattcgagcttaatgctgatgggcagcccctgaagattttgaggaaaaacatgaccaccttagctcagacatggagtgttctttccttctctaacctgattcctacctcccacacttctgatgttactcttgacagggccagactcatttatggcattattatgaagatggatatgaatgtggggtacctcatttcccaccagatctcccttactgcttag

SEQ ID NO: 4869 - DNA, 135 bp, Glycine max
  Peptide Sequence Number=SeqID_96554
atggaccttttcgggtctcgaagaggatcaataacaatgcttataggttggacctcccagaagagtggagctgatattgaggaagaagaaccaacagatttaaggtcaaatcctcttcaaggggggaggggatga

SEQ ID NO: 4870 - DNA, 84 bp, Glycine max
  Peptide Sequence Number=SeqID_96555
acacacccgtgagtctcgtgtcgccctctcgctgaagggtaggttgcgacagttggcgactccactagggatgattgttagaga

SEQ ID NO: 4871 - DNA, 325 bp, Glycine max
  Peptide Sequence Number=SeqID_96556
gctgccgtcccttgggacggacgtgtggggtgctaataccttccccgtgcgtaaatacaactcccgaacctttcacttaaaagttcgtagatcgcgtcttttccggtttttccgacgttttcctcaaataaacgttggtggcgactccgcgtgtattcctttcgtggaacacgcatcccgcgagtctcgcgtcgccctcccgccgaagggtaggttgcgacagcatggcctggagattggcccgattttcagacaggggcagggcccgcagggacctccagagatggagactaggcccaggaagacgatgacatggccgatgtga

SEQ ID NO: 4872 - DNA, 456 bp, Glycine max
  Peptide Sequence Number=SeqID_96557
atgcagtcccagtttcaatcccagatgcagtctcagggacttgcattgcctccagagcctatggctggtccctcaggaagattttacgagggatcaacagttcacaatattcctttgttgcctggccaagtgaaggttggtgttgaggaggttaaagatgcactggctcccgttcctgtacccactgatgaggaaattgtttctccaacaaaacctccacaaagggtggatcctgaggtcaatgatccactatatatgatgatattgaccatcctagagcttttcttgaagcctttccaggttaattgggatgctaccgtgttcaaagtgtttaatccagacttcccgctgtacataaagcacaaagatctctccaaaatcgcacacggtggtcaatgtctcagcatatctatcatacagttgtggattctgtatgtcaatttagctcattgttaa

SEQ ID NO: 4873 - DNA, 435 bp, Glycine max
  Peptide Sequence Number=SeqID_96558
atggctcaacctccacctcgtgagaggaatcttagggagatggctgcacctgatttcacttatgaaagcttgtgcattcaatatcctgatgaaggtgttccatatgttctcaagactggactaatacatttgctgcccaagtttcatgttcttgcatgtgaagatcctcataagcatcttaaggagttccatattgtttgttccaccatgaagccccctgatgtccaagaagatcatatctttctaaaggatttccctcattctctggagggagtggcaaaagattggctgtactaccttgctcccagcaacatggagaggagtatgattgatgctaccagtggtggagcccttggtgatatgactcctgctgaggctaggaatttgattgagaagatcggcttccaactcccaacaattcagtgcaagaaatga

SEQ ID NO: 4874 - DNA, 404 bp, Glycine max
  Peptide Sequence Number=SeqID_96559
tcggagtccccgtggcagctaccaaggtgattcggccgcccatcacctgggcttttattgagaagtactacacccagagacaggctcagggtgatgctccgcaggccgcagatgcgccgccacctcatcaggctggccaggctggatcgtttgatacggagcggtatttgcggcatttggttcgccagcaggcagccaaccaccgggcacatagtcagggcttcgcttctttttcatgccctactccagaccagttcagggcagaggtcgcatggcccggggattggcccgaggcccaagcaggagaggcgcccccagaggctcccggcgatggagaggaggcccacgaggacgaggagatggccgatttgcttgacttcttgggagggagtggagctacatga

SEQ ID NO: 4875 - DNA, 264 bp, Glycine max
  Peptide Sequence Number=SeqID_96560
atggccctggggtttccagctctggttatgggcctctatcagtcctacagggtgcccatccccccagcaaggtcatgctatcgtgacatagggatcacactcgcaagacacccagttgacccggagaagtccaacagggtcctgaggtttccagttctaattacgggcctctatcagttctacggagtgcccgttgcccccagcaaggtcatcaggcctcgtaataaccgagctttcatcaagaagtattgcgcccctaggaag

SEQ ID NO: 4876 - DNA, 264 bp, Glycine max
  Peptide Sequence Number=SeqID_96561
atggctaaggatcccctaggtcaccaaggtatgatgagttttcaaaaggaggaaatgaaatgtggttacaaaaagcggaaaaagggaataaaggaaatgagacaactccaaggagttgaaagagggctaagaggcctcctagaggtaaaaggattatacccaacaacaacaacaacgccttttcccactaggtggggtcggctacatggatcaacttccgccataatgttctatcaagtaccatacttctatccaaaccattaa

SEQ ID NO: 4877 - DNA, 176 bp, Glycine max
  Peptide Sequence Number=SeqID_96562
atgtcattcaatactaatattattacttctggttttctcgagatcctacgtatgcgagaggcgacggcgaacacgtgtcaggagcatcattctggtattggcatacttggacaagagagagaatcaagactcagttctggaaaaacagaaatatgcatcacgctttcattgcgtag

SEQ ID NO: 4878 - DNA, 7060 bp, Glycine max
  Peptide Sequence Number=SeqID_96563
atggaggctgtgtcatccgcactactagagccagtaactaattctgtgttggatctgcttaaaaagcaagtggattacatccgttacaggcgaaactttgatgaactagacgagtgtgttaagcaacttaaacttgaaaaggcgagagtagatcatcaatgtgacgaagctgtcaaaaatggacacaaaattgaaggtaaggctagagaatggttagggaaagtgggtaaatttgagacagaagtggagaagtattggaacgatgatggccacaaaaagacacggttttccaattgtttatttccttactttaggcatagactaggcagactagcaaagaagatggcagttgagggtaaaaagataaccgacgattgccccaagtctgctgaaattgcctatcgggtaaacgtaacatctaatgatgccattttgtctaatactgaccttatggattttggttctagaaaatccataatggaacaaataatggcaacacttgaagatcccactgtgaaaatgattggagtgcatgggccaggtggggtgggtaagagcactttaatcaaagcaattgctgaaattgctcgcgacaagaagttgtttaatgtggtggctttttcagaaataacagtcaaccccaatctgaaaaaagtccaggaagatattgcttacgtgttgggattgagattggaaggagaaggtgagaatgtaagagctgatcatctacggaggaggttaaagaaagagaaggagaacaccctcataatcttggatgacctttgggacagattagacttgaataggatggggattccacttgatggtgatgttgatgataatgataaacagggtctcaaaggaccgacaaaagaaaaatctcttggtgattataagggctgcaaaattttgctaacttcaaggaataaaaacgtattaactgataaaatggaagttaagtcaactttctgtgtagaggaattagatgaaaaggatgctctgaagttgtttcggaaggaggctagaatacagggtgaaatgtcccagtggaaacaagaaattgttaagaagtactgtgctgggttacctatggcaatagttacagttggaagggcattaagagacaagagcgactcagagtgggaaaaacttaaaaagcaagacctggtgggaattcagaattctatggagatttctgtaaaaatgagttatgaccgtctagaaaatgaggagcttaaatccattttctttctttgtgctcaaatgggtcatcaacccctaattatggacttggtgaagtattgctttggtttgggaatacttgaaggggtctactcgcttggggaagctcggggcagaatatctacatcaatccaaaagttgaaaaactcaggtttagtgttggatggaagttctagtattcatttcaatatgcatgatctggttcgagatgctgctttatctatagcacagaaggagcaaaatgtatttactttgagaaatgggaaacttgatgattggcctgaactcgagaagtgcacttctatttctatatgcaacagtgatatcattgatgagcttccagaagaaataaattgtcctcaacttaaatttttccaaattgacagtgatgattcatctttaaaaatacctaacagtttttttaaaggaatgaaaaagctcaaagtattaatgttgactggtattcaactatcaagcttaccatcttcaattgaaagcctatcagacctcagattgctttatttggagagatgcaccttagatcacaacttatccatcatagggaagctaaaaaaattaagaattctcagcctttctggatctcgaattgaaaatttgccaactgagttaaaggacttggataaactacaattactagacatcagcaattgttcaatagtcaccatgattccacctaatcttgtatcaaggttgactttgttggaagagctgtatgtaagaaagtgcttcatggaagggtcggaggaaggagagagaaaccaatgtcaaatttcatttatttctgaactaaagcatttgcatcaattgcaagtggtggacttaagcattccatgtgctgaagtttttcccaaggaattgttctttgacaacttaagtgattacaagattgagattgggaacttcaaaacgctttcagctggagatttcagaatgcctaataagtatgaaaagttcaagtctttggcattggagctgaaggatgacactgacaatattcactctcagaaaggaataaagttgttgtttaaaagagttgaaaatttgttgttgggagagctgaatggtgttcaagatgttattaatgagttgaatttggatggatttccacatctgaaacacttatccatcataaacaaccctagcatcaaatatatcatcaactcaaaggatttgttttatcctcaggatgttttttccaagttggaatctctatgtctctacgaactaagaaagatagagatgatatactttagttcaggtacagagattatatgctttagtccatttacagattgctcattcaccaaattaaaaaccatcaaggtcaagaagtgtgaccaattgaagaatcttttctccttttgcatggtaaaattgcttgcgagtcttgaaacaattggtgtttccaattgtggttctttagaggagatcattaaaatacctgacaattctgataagattgagtttcttaagttgatgtctttgtcacttgaatcattatcatcattcactagtttttataccacagtagaggggtcttctacaaacagggatcagatacaaattactgttacagagaatgagcatagtgagatggctcctcctctttttggtgaactggttgaaataccaaacttagagaacttgaatttaatctcaatgaacaagatccagaagatatggagcgaccagccccctttgaggaaactgaaaggcctctttgtaagcaagtgtaaaatgatggagaagatttttagcacagaaggaaatagtgcaggcaaggtctgcgtctttcctaagttggaggaaatccatctcgaaggaatggttgagttaacagacatatggcaagctgaagtgagtgctgattccttttctagtgtcacttctgtgaacattgatagttgcaataaactagacaaaaattttccgagtcacatggaaggatggtttgcgagtttgaacagcttgaaggtttattattgtcagtcagtgaaagtgatttttgaaatcaaagattctcagcaagcagatgcatctggtgggatagacacaaatttacaggttgttgatgtatgtggactcccaaagttggagcgggtgtggagcagggatccaggaggaattcttaacttcaaaaaactgcagagtatacaagtgttctcttgtgatagactgaggaatgtatttccagcttctgtggccaaagatgttccaaagcttgaatacatgtcggtcagatggtgtgatggaattgtggaaattgttgcctgtgaagatggatccgaaacaaacactgaacaattagtgtttcctgaactaaccgacatgaaattatgtaacctatcaagcatccagcatttctacagggggagacatcctatagagtgtccaaaattgaagaagttggaagtaagggaatgtaacaagaagctaaaaacattcggaaccggagaaaggagcaatgaagaagatgaagcagttatgtcagctgaaaagatattccccaacttggagtatttgtatattgactttgacgaagcacaaaagtggttattgagcaatactgtgaagcatcgaatgcaccgtttaaaagagcttaggttaaccgaagttaatgatggtgaacgtctctgtcagattctgtacagaatgccaaatctagaaaagttatacttgtcgggcgctaaatatttgcttaaagagtcgtcggagtcacgtttgggaaccgtattacagctgaaggaattggatttgtggtggtcggagacaaaggatataggatttgaacgagaaccagttctacagagactagagcttttgagcttaaatgggtgtgacaaattgaggaatttgggtcctccctcggtatcattggcttacttgacaaatttggaagtatggtattgtaaaggattaaggaatttaatggcatcctcaacggcaaaaagcttggttcaacttaagtccatgaagatagggggatgtgatgaattagaggaaatagtaagcgatgagggaaatgaagaagaagagcaaatagtgtttggcaaattgattactatagaacttgaggggctaaaaaagctgaaaagtttttgcagttacaagaagtgtgaattcaaattcccgtcattggaagtattgattgtgagagaatgccgaatgatggaaagattcacggagggtggcgcaagagcagcaaagttacaaaacatagttactgctgatgaagaaggaaaagaggaagccaaatggcagtgggaaggagacttgaatgccaccatacaaaaaggtttcaacaagctttttgagtctgcaagtactgaatcatctcttagtctcatagatagcccactacaagtgatatggcttgactcacggcggatcccaaagtcgtgcttcagtaagttgaagtctttgactgtggacggatgccaatttttaacagatgttgtcatacccttctatttacttcctttcttaactaatttggaagaattagaagtctcggactgtcgttctgtgaaaagcatatttgaagtgaaaacagctatgggattgggagcagcagccttccctagacctctccctttttccctcaagaaattgactttagagaggctgccaaaactggagaatgtctggaatgaagatcctcatggaattctaaccatgcaacttctacaacatgttattattgagaaatgtaaatgccttacaagtgtgtttccggcatcagtagccaaagatcttgtgaaacttgaagatctatttgtgcaagactgtgaggaattgatggaaattgttgcagaggataatgcagatccaagaggagaaaatctagagcttacgttcccgtgtccctgtgtgaggtcattgaaactacaagatttgcccaagttcaagtatttttactactgctcaccgcagtttgacatgttccagacacctagcgaggatgaaatgcctacatccaacttacagtgcctgtcactcggtgaaaaaggactggagatgatcaagcgtggagaatttcagagaaacttcttacacaagctacaaccggcgcccaatatagagaagcttgtggtgtgtgatggttccttcaaggagattttctgctttgatagtcttaatgtggatgaggctggactcctattacagcttaaagtcttatgcttggactcccttccagagcttgtttccattgggttagagaactcttggattcagcccttactgggaaatttagaaaccttggaagtaatagccaaaagtttgactcgactcaaaagaatggagatagaatggtgtgattcaattgaagaggtagtctctaagaagggaggtgaatcacatgaggatgaaataatatttccgcagctcaaatgtttgaaacttgaaggattaggaaagctgagaaggttctacagaggaagtttattaagtttcccattattggaggaattgtcagtaatctattgcgagtggatggaaacattatgtccaggtaccctaaaagcagacaagttggttcaagttcaacttgaaccaacttggaggcactcagatcctattaaattggaaaatgacctgaactctaccatgcgggaggcattttgggaaaagttatggaagtatgcacgttgggaatcagttcttcacctcaaagatagccgactacaagagatatggcttaggcttcactcactgcatatccccccacacttccgcttcatttggttacagaccttgattgtggacggctgccattttttatcagatgcggtcttacccttctctttacttcctttattacctaatttggaaacattgaaagttcgaaactgtgattttgtgaaaatcatatttgatgtgacaactatgggaccactcccttttgccctggagaatttgattttagagcggctgccaaatctggagaatgtttggaattcaaatgttgagcttacgttcccccaagtcaagtcattgtcactgtgtgatctgccaaagttaaagtatgacatgttgaagccatttacacatctagaaccacatcctctaaatcaagtctctattcaaaagcttacacccaacatagagcacctggcactcggtgtgcatgaactgaagatgattttgcgtggagaattccagggaaaccacttaaacaagttaaaagttcttgctctgttctttcatactgagtccgatgtgtttctacaacgggtgcccaatatagagaagcttgaggtgcttgatggtttcttcacagagactttctgctttgatagtcttaatgtggatgaggctggattggtttcacagctgaaagtgatatgctgggactcccttccagagcttgtttccattgggtcagagaactctgggattgtgccctttctcagaaatctagaaacattgcaagtagtcagttgtttcatgagtttaataaatctggtaccatgcacagtgtctttctccaatctgacatatttgaaagtaaaaagttgcaagagtctgctatatttgttcacatcctcaacagcaagaagtttgggtcaactcaaaacaatggagataggttggtgtgattcaattgaagagatagtgtcttcaacagaggaaggggatgaatcagatgagaatgagataatatttcagcagctcaattgtttgaaacttataagattaggaaagctgagaaggttctacaaagggagtttaagtttcccgtccttggaggaattcacattaaaggattgcgagaggatggaaagtttatgtgcag

SEQ ID NO: 4879 - DNA, 252 bp, Glycine max
  Peptide Sequence Number=SeqID_96564
gggacttttggcattttcataaaatttgttgagagcttctctctaggttccttgttgaaccaatctcagacttatcaaggtaatccttgtggcgtctaccctgacttatcttccttcaccggaagtggcgtcatccaaatctccgagcctgtatcaagcgatctgctcctaggcaggatcacatcatctggtatcagagcttcgactcttgatacagcctattcgaattctgtttgggtaaaaattacctaa

SEQ ID NO: 4880 - DNA, 642 bp, Glycine max
  Peptide Sequence Number=SeqID_96565
atgcaatcacagggacttgcactacctccggagcctgaggttggtccctcagctgtttgtgtcagcacaaaggaaagttgtgttgatccctcagggaacgatccagacacgggaagagtttatgagggatccacaaccgttcacaacatccctttgttgcatgatcaagtgaaggtcggtgttgaggaggttaaagatgcagatgctcccgtttctgtacccactaacgagggagctgtgggaccagcaaaacctgtagataggccggatcatgaggtcgatgatcccttatatctaatgacattgaccatcccacaactttttttgaagtcattgcaggttatgtgggatgctaccgtgttcggggtgtttaatgaagacttccccttgtacataaagcatgaagatttgtctgaaatagcacacggtggtcaatgtctcagcatctctgttatacagttgtggactttgcatctgattgagacaagtatgcaagcagggaatttcgatgtctatggattcatcgagccacaatccatccagagatctgggcaatcacaatttgaatcaaaaagttacatgaagaactggatgcagaattcaaaatggaatgtctacctaggcgcctacatgaatgggtaa

SEQ ID NO: 4881 - DNA, 372 bp, Glycine max
  Peptide Sequence Number=SeqID_96566
atgacgacaatgatagtagacacattaccggtattctactatgaaaagatggtgagctacacaccttcaagctttgatgatatggtcttcaccgacgaaaggatcgatgtgggtctaaaaagaggcaaatttagtcatcctgcttggacgaatgagaaaactggggcaaatgaagagggtgaggatgaaggagaagcccgtgctgtgactgccattccaatacagccaagtttcccaccaacccaacaatgtcattactcagccaataacaaaccttctccttacccaccgcccaattatccacaaaggccatccctaaaatcaaccacaaagcctacctaccgcacttccaatgacaaacaccacctttag

SEQ ID NO: 4882 - DNA, 789 bp, Glycine max
  Peptide Sequence Number=SeqID_96567
atggcttcaagaaaaaggaaaagcactacatccaggccccaacctaactatgatacaaggaggttcaccttagaagaagcctggaacagatacgccgacaacaccctcgaccgaaacatccttccagagaggaacatgaagctctatatcatggagtttgatgagtttagaagggagttagagaggcgcaacctgcacaagcatctcaccaacttagctgatggaagtattgatgtcacggtggtcaaggagttctacgcgaacctctatgaccctgaagataactcaccaaagcaggtgagagtgagagggcacttgataaagttcgatgcagacaccctcaacacatttctggagaccccagtggtattggagcctggggagaccatccctagatattccagattttgcagactgaggatggatcctcaagagatagcggctcgcctctgtattccaggcaggggatttgttctaaatgctgaaggcatgccatggaagctgctgaggagagacctcaccactttagcacagacttggagtgtgctatcatattctaacctggcctctacatcacatacatttgacctaaacttggacagggcacggctagtttatgggttggtgacgaggatggacatgaacattggagcactaatttcaggaaagatctccctcattgctcaatccaactcctctaggttgggatttcctgccttgatcacaactctctgcaaggcaatgggagtcacttttgattccctatcttatgaatcactgagtgtttga

SEQ ID NO: 4883 - DNA, 303 bp, Glycine max
  Peptide Sequence Number=SeqID_96568
atgtgggggtaccttatggttatccgcaccttttgtcaaccagaggcaagcgagcacgttgacacgcaaagactaacatcgtcatttgcaccttttgtcaaccagaggcaagggtatcttatggttatccgcacatttctgctaatcctgaccagtgaagtcaggtggcaggcggagatacccgagtggttatccgtacaaagacaacttctattaatcctgacccgtgaagtcaagtggcatgcgcgggtaccttatggttatccgcactttttgtcaaccagaggcaagcgagcccgttga

SEQ ID NO: 4884 - DNA, 821 bp, Glycine max
  Peptide Sequence Number=SeqID_96569
ctaacgcagacccaatcaaatacgaagttgacaaagagagcggcgcactgttcgttgaccgtttcatgtccactgcgatgttctatccgtgcaactacggctacatcaaccacaccctgtccctggacggcgacccggttgacgtgctggtcccgactccgtacccgctgcaaccaggctcagttatccgctgccgtccggttggcgtactgaaaatgaccgacgaatccggtgaagatgccaagctggttgcggtaccgcacaccaagctgagcaaagaatacgatcacatcaaagatgtgaacgacctgccggaactgctgaaagcccagatcactcacttcttcgagcactacaaagatctggaaaaaggcaagtgggttaaagtcgacggttgggacaacgctgaagcggctaaagctgaaatcgttgcttccttcgagcgcgctaaacagaaacggccaaaaaacaacgccacccgaaggtggcgttgccgttttcaattactggtctctgtccaaccagtttccgctctcaatctgcgcaaacccctcgacggagcgctggtagacatacatccacgcgctgccgtaaggcgtttggatcagatggcgcgcgtattcaccgcccttggtgcgcagcgcatccagctcggccagcgtcgatgcgtcgatacgatacacttcaccatgtactgtgccctcgcccggcaccgcgcctggatagtggcccaggctgtacagctgataatcgtcgacactatgagcgcccagcaactgggcgttggtcatccagtggctgttgccttgtttgcgtcgtaa

SEQ ID NO: 4885 - DNA, 390 bp, Glycine max
  Peptide Sequence Number=SeqID_96570
atggtggggtacacaccttcaagctttgcggatttggtcttcgctagcgaaaggatcgaagtgggtctgaaaagaggcaaatttaatcatcctgcttggacgaatgagaaaactggggcaaatgaagagggtgagaatgaaggagaaactcatgctgcgactgtcgttcctacatggaaaatcccccaccagctcaacaacatcattactcagccaatatcagcccttctcattacccaccatgcagtcatccacaaagccataacccctgctagggttcctcaacctccatttttccgaggatatgacttgaatgcaacatgtgcatatcatggaggagttccgagacattccattgagcactgtatgacctcgaagcgtaaggtgtaa

SEQ ID NO: 4886 - DNA, 312 bp, Glycine max
  Peptide Sequence Number=SeqID_96571
atggctacagccaggtgggcactcaagcatcccgtttatggcattgtgatactacggttgggaatttacacaaacagacccaacgtttccaagacaacgtccctaaatgaaaaaattctacgcgattccggaatttcaacaaacactattgacaacaacgaagtaaacactaacgtaacagttcaaacgatatgtatgtacaaaacaaaaattttggatgttagcatttcgtttctaaacgaccatttagaggaaacactgggtccaacaaaaataggagaaaatcactcaaagtgtatcaatctcacacag

SEQ ID NO: 4887 - DNA, 231 bp, Glycine max
  Peptide Sequence Number=SeqID_96572
atggggtttcgatggaggaactgtggagatacgatggaggcaagcaccttaaggccccgcccctgcatgcatgccgcccctgccctcgccgccctcgtcctgatcgtcgaggatgaggccgagatcgccgatattctcaccgcctatctggaacgcgaaggactgcgtacactgcgcgccgccgacggccacagcgcactggacctgcaccgcagcgcccgccccgacctg

SEQ ID NO: 4888 - DNA, 426 bp, Glycine max
  Peptide Sequence Number=SeqID_96573
atgaggggccaagacatttatagtagccaagataaggctactacttcaccttcctctagtgaaagtgaagaagcaaaaggggaagaatctagtgaagaaatctacccccaagaagaaggacaaccattagtggttaaagagaagtgtaaggagataagtgtttcctccaagagacaacctccacattttctcttttgtaaaaagacacttgttagcattgccacacctcttgggcttgagtttattcctcgagtaaagaagttgttggatgagggtttggttcacaagagcttaaatccttgtgctttgttggtgcccaaaataggtattattaggcatcaagtccctaaaataggtggtatgatgaatgttttgagtggtgcaaccctcttttgtaaaatcactcgtacacctaacatcttcatg

SEQ ID NO: 4889 - DNA, 561 bp, Glycine max
  misc_feature (73)..(73): n is a, c, g, or t
  Peptide Sequence Number=SeqID_96574
atggagaggagtatgattgattcttccaatggtggagctcttggtgatatgacccctgctgaggctaggaatntgattgagaagatggcttccaactccccacaattcagtgcaagaaatgatgctattgttcttagaggagtccatgaggtggccacggattcatcttcatctactgaaaataaaaagcttgaaggaaaacttgatgccttggtcaacctagtaactcagcttgttatgaatcagaaatctacaccggttgcaagagtcagtggtctatgttcttctgcagatcaccatacagatctctatccttctttgcagcaatctggagtcaatgagcaacctgaagcttatgctgcaaacatttataatagaccccctcagcagcaaaaccaacaacaacagaataattatgatctttcaagcaacagatacaatccaggttggagaaatcatccaaatctaagatgggcaagtcctccacaacaacaacaacctgtccctcctttccagaatgcttctggtccaagcaagccatatgctcctccaccaatatag

SEQ ID NO: 4890 - DNA, 753 bp, Glycine max
  Peptide Sequence Number=SeqID_96575
atggcaccagtgactatgggattatgtactgtcattgttcagattcaatgctggttgggtattgtgatgctgattgggctggaagtgcagatgacagaaaaagcacttctggtggatgtttctatctgggcaacaatcttatttcatggttcagcaagaagcagaactgtgtgtccctatctactgcagaagctgagtatattgcagcaagaagcagctccccctgttcctgaaaaactggttcccaaacgacaacagggtgtgaagatctctgaaaaccctagccttgcaacaagtcctagggaagtagacacggagatggacaagaagatccgcagtattgtaagtaacattctgaaaaatgcttctgtccctgatgctgatgaagatgttccaacatcttccatcccagatgttgctgttcctgatgctgagaaagatgttccaacatcttccacaccaaatactgaagccgtctcttcacccagcaaagaggaatcaacagagaaagaggaacaagccacagaggagacccctgcaccacgggcaccagaacctgctccaggtgacctcattgacttagaagaggtagaatctgatgaggaacccattgccaacaagttggcacctggcattgcggaaagactacaaagcagaaaaggaaaaacccccattaagaggtctggacgaatcaagactatggcccagaagaaaagcactccaatcactcctacctcatccagacgaagcaaa

SEQ ID NO: 4891 - DNA, 186 bp, Glycine max
  Peptide Sequence Number=SeqID_96576
atggggatacaaaagacttctcaggcgggagaagggagacacaaaagaattcaggcggttagtcctttgttcttttggaaaagggagaagagagacataaaaagaattccggcggttagtccttggcaattctttttggcaaagggagaagagaatgaaaagatgatagcacaggggatcctctag

SEQ ID NO: 4892 - DNA, 159 bp, Glycine max
  Peptide Sequence Number=SeqID_96577
atggcgggcataatatccgacgacgagtccggtgaaggtactaatacagaggaccctgacgtcgattttgaacgaatagcaagccaagccgaggatggagaagataacgatatggggttttccccagagctagaaaggatggtcgctcaggaagactga

SEQ ID NO: 4893 - DNA, 72 bp, Glycine max
  Peptide Sequence Number=SeqID_96578
atggggtgtggaggtgggagggagagaaggaagaaagatgatggtggtggcggtgaaggtaggaagagataa

SEQ ID NO: 4894 - DNA, 216 bp, Glycine max
  Peptide Sequence Number=SeqID_96579
atgtgtctattggggaaacacattcacaacctaacagtaaatgaaacttcttttttgggaaggccttctattctttcttctgagggtaagggtaaaagttcctatctcgggtcaaggtttatggccgaagggttgaggctttggctcaaaaaggcttgcagaaggcaagacatgacgtatgttaggctatttgcttggcaagcggttcagggataa

SEQ ID NO: 4895 - DNA, 1035 bp, Glycine max
  Peptide Sequence Number=SeqID_96580
atggctacctcaccaaaagaaacttcagctcctggttcaccctctgcaccatcaaaccaggaacgacctgaattcaatatccagcccatacaggtgattcctggtcaagcccctgttcctgagaaactggttcccaaaagacaacagggagtgaagatttctgaaaaccctagccctgcaacaagtcctagggaagtagacccggagatggataagaagatccgcagtattgtgagtaacattctgaaaaatgctgctgtgcctgatgctggtgaagatgttccaacatcctccaccccgaatgtttctgtgcctgatgttgataaagatgttccaacatcttccactccaaatgctgaagccctcccttcacccagtgaagaggaatcaacagaagaagaggatcaagcctcagaggagacccctgcaccaagggcaccagaacctgctccaggtgacctcattgacttagaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaagaggaaagaaatttccttttcctcatccgattctgatgatgatgtcgaactagatgtctcgacatctaagagggccaagaaatctgggagaaaggtgcctggaaatgttcctgatgcaccattggacaacatctctttccactccattggcaatgttgaaaagtggaaatatgtgtatcaacgcagacttgcggttgaaagagaactgggaagagacgcattggattgcaaggagaccatggaactcattaaggctgctggactactgaagacagtcaccaaattgggagactgttatgaaggcctagtcagggaattcattgtcaacattccctctgacataacaaacagaaagagtgatgagtatcaaaaa

SEQ ID NO: 4896 - DNA, 236 bp, Glycine max
  Peptide Sequence Number=SeqID_96581
tcaatatctggaattcaaggccatatgtctcaagtttaagtcacatgctagatgaacgcaatgcccatgctaaaagttttaggatggtcagggatagattggcaaatgatgaagccgataatatcaaattgcaactgatagctactcgggaaaaagatggttgtgtatataatatgccaaatgttctcgaaattactgcacttattgtgacaccctttaccccgacatatatataa

SEQ ID NO: 4897 - DNA, 301 bp, Glycine max
  Peptide Sequence Number=SeqID_96582
agagctttttccggaggagccctggtgcttaccaacatggatggcgaagagttaccttcacccggatttcccgtctgctgtatctcttgttataatctctcaaagaaatgaacgtggattcgaggctttagtcctcacgttggggcaggatcatcttgagctaccttctggggtggggaccaaacatggaaagcagaaaccaatcaagggacggatgcaagtggggatggggtcacgaccgactgatcgttgccctttctctgcgctagacaagcagagaacgtcgctgcaaggcagcccc

SEQ ID NO: 4898 - DNA, 504 bp, Glycine max
  Peptide Sequence Number=SeqID_96583
atgtccaaatcttgtggatttgggatgaccggccctctcgatgagtcgatctcttgctttctcataaggaggactacacgtcctcaccttgagaggactacatgtcctcgccatcagaggactacatgtccccgccatcagaggacttcatgtcctcgccatcagagggctgcacgccctcacctccagaggactacctgtcctcgccttgagagggctacacgccctcaccttgggtaccagttaccctcaccgttgagaggactacacgtcctcgccatcagagggctgtacgccctcaccttcagaggactacacgtcctcgccttgagagggctacacgccctcacctttggtactagttaccctcaccttcagagggctacatgtcctcgccatcagaggacttcatgtcctcgccatcagagggctgcacgccctcacctccagaggactacctgtcctcgccttgagagggctacacgccctcaccttgggtactag

SEQ ID NO: 4899 - DNA, 150 bp, Glycine max
  Peptide Sequence Number=SeqID_96584
atggcacatcgaggaggttttttgtggggaagggggtatttagggattgggattggtggttgtggagtggcggagacggtggtggcaagatctgtgggtggcggcatttgttctggagggggttatttagtgtttgaacttggaaggtga

SEQ ID NO: 4900 - DNA, 471 bp, Glycine max
  Peptide Sequence Number=SeqID_96585
atggcggaatcatcaaagaagcgcaagggttctttgagtagaagccaacaacactccaaggctcaggatactccaattccttactccatttcctcctcctcattgttctcatcagaagaacaacgtacacggtacacaaacctcttctcctctcgttctatcattgaccctaagttcatagatatggatttcttttttgatgatagtttcgaatgcatcaagcatttcagaactcaaatctcattccctttgtctttaaaactgcctgtgtattctgaattggtaaaagctgaattggtgcactggatgattggaaatttcatttttctgtgcatgatgccccccggtttgatgcaatcctaccttgcaagggcattggatagaagactccaagaagattgggccagagatgcaagagaaggccttatggttctcatgagccttagggtagatttcaggcccatgggctaa

SEQ ID NO: 4901 - DNA, 231 bp, Glycine max
  Peptide Sequence Number=SeqID_96586
atggtgtcgcaacctacccttcgacggcagggtgaggggacacgtaaaagtgcgtcttctcatgaagaaaacgctaaaaaaaaccgaaaggaggagggtgttgcccttactcctgcgtatcctcagtctctttcaagacaactttacaacagtagtgatcggttaagattgaactttgcaaaggaaaacaagatcatttatgatagatggagaagatggatgtgcacataa

SEQ ID NO: 4902 - DNA, 513 bp, Glycine max
  Peptide Sequence Number=SeqID_96587
atgagccatccatccagacatgctgagtatgtaaacaagaagactattgccgccaaggttttaggagtgaaggtggtattgtcctgtgacacaagtgctaaggaaaagatatgggcctacattctaaacaagagtgttcactatgaaacaagtttcaaaacaactctttctgatctccacaagtttgtcctgtttcacttgatggaaaacctcccgtttgaccttcctcataccatatacattaacatgatatggaacctcaaaggcttaggtagtctggatgacatctactatgcagccctcatcaacaagctcatgtgggataaaggagtatactatatgttcaacaagatggatgagaattctaagcacaccttgatagttaagggttcagtggttgctaaacaacaaaagtttagcaagactaacctgaaagctatgaaggtggctttagaacaaagcttaaaggaggctcttgaagtggacatggacgctaccaacaaaaggaaatag

SEQ ID NO: 4903 - DNA, 399 bp, Glycine max
  Peptide Sequence Number=SeqID_96588
atgaaagccgacaaaacaagaaatgaattgaaagtctcatattcgaaaacttaccggttgaagaacgaagaatggatgaagaacggtgaagaacgatggaaaaccttcacagatttgttcatggaaacgtctcaaaaacgttacagaatcacctcggcttggattttcttcacggaaacaattttttcacccaaaaaagctgaaatgcatagccaaggcggaaaaagggggaggaggttgccgcccagctcgcccaggcgagctgggttacttcctcttcaagtaacccagctaccaaaatgttctagaaggcccaaattcgaaaaatggaaaattgctattggcacccccattttgataagttcatccccactttttcgtaatttacggaaaagttaa

SEQ ID NO: 4904 - DNA, 180 bp, Glycine max
  Peptide Sequence Number=SeqID_96589
atgtcacccgacttcatgggtcaggatgacaaaggtgctgaagacgatcttgggtatcttcgcatgtcacccgacttcacggggatgacacaaactgtttgtacggataaccgcttgggtatctccgcatgtcacctggcttcactggtcaggatgacgaaggtgcagaagacgacgtaa

SEQ ID NO: 4905 - DNA, 351 bp, Glycine max
  Peptide Sequence Number=SeqID_96590
atgaatttagaagttactgttgaaagtgagattattgttgtaagcaatcagttagtggtagttcattattcttattggtatcttcaacatcaagggctacattcacttgttcatatgcgtcctagacaaagaatggtagaactttgtctgcagacaggagtcaaacttataaagtttctctttcaaaaaataattatttcaaagagaaaaagtatttctcctaaatatgtagatacatttggtgggatgaagcaatcctcccaaggaagggacccatcaccagagccatggctaggagactctaggaagattgggccagggatgcaggagaaggtcctatggttctcatga

SEQ ID NO: 4906 - DNA, 957 bp, Glycine max
  Peptide Sequence Number=SeqID_96591
ggtggacccttgggtactagtaccctcacctttagaggactacacgccctcaccttcaaaggactatacgtcttcaccttcagagggctacacgcccttgccttcagagggctacacgcccacgccatcagagggctgcaggtcctcgccttcgtagggctacacgccctcaccatcagagggttgcacgccttctccttcagaggactacacgccctcacctttagaggactacacgtcctcgccattagagggctgcacgccctcaccatcagaggactacacgtcctcgccatcagagggttgcacgactacatgcacgtcctcgccttcagagggctacacaccctcaccttcagagggctgcacaccctcaccatcagagggctgcacgccctcgccatcagaggactacatgtcctcgccattagagggctgcatgccctcacttttagagggctgcacgtccttacctttagagggatccacgtccttaccttcagagggatacatgccctcacctttagagggttgcacgtcctcaccttcagagggctacacgccctcgccttcagaggactacacgtcctcgcctttagagggctgcacgcccttgcctttagagggctacatgccctcttcttcagaggactacacgccctcgccttgagagggctacacgcccttgcattaggtactagtatcctcaccttcaaagaattacacgccctcgcctttagagggatgcacgccttcacttttagaggtctgcacgttctcgccttcagagggctgcacgccctcgccttcagtgggctacacgccctcgccttcagatcgcaacacgttctcgactttagagggctgcacaccctcgcctttagagggctatgggtcctcactttcagtgggttccacatccgcaccttaagagaatttaaggtcctctgcccttaa

SEQ ID NO: 4907 - DNA, 141 bp, Glycine max
  Peptide Sequence Number=SeqID_96592
atgaacaagaagaaatatagaaatggctataactcaagctacatggctccaaatgagaacaaggttgaagatgaaatggtggaaggaaagaatcactctttccggcgagggcaacacacaaaggatgtgaaagacctttga

SEQ ID NO: 4908 - DNA, 358 bp, Glycine max
  Peptide Sequence Number=SeqID_96593
tttgtgttgtttgaatgcgaattacttggatgttgggaagcttgggaggattgatggggactcggtgttgagagaaacgaggatatgggctacttgggagtacatgagctcagttggagttgggcaacaggggatgagtggtacctggagatatgtcgcgggggtcaggagaccttggggacgtcaggtcgggcgagctcctggcagtcaacagataaaaggaacaaagaccacaaagcaaggaggcttgtgtggtggctggccagctgtgaatcttgtgcttgaaaacgaggtcaggaagctatgggggcttctggtaatcgattaccaagggggtgtaattgattaccaagcttag

SEQ ID NO: 4909 - DNA, 1377 bp, Glycine max
  Peptide Sequence Number=SeqID_96594
gatagcgagctggtgctcgacaagctctccaccggtttcgataaattgaagtatggtttggtgacggtcgccgcgccgcgcgtgagcctcaaccggccgctgcgctggcggcgtgatgaacaaagcccgcagttcaacggcgagctgcaactggcggcggataaggtcagcttcagcgacggcggccatctgccggcgccggtgctggcgctgcaggtgaacggcctttcgccggacagtttccagctgcagggcaaactgcaggcacagcagatcgggccgatcgcgctgcgcggccgttgggacggcgaacgcctgcgcggtgaagcctggtggccgaaacagtcgctgaaggtcttccagccgctgctcgcgccggatctcaatctcacgctgcgcgacggcgagttttatgcgcagtcggcgttttccgccgcccgcgagcagggcttcgaagccggcggccactgggtggtgaaaaacggcggcatgtggctgaaagacggcgagatgagcggcctggactttatcctgtcgtaccggttcaagcagcatcagtggctgctgggggccaaacagccggtgtcgctgcgcatcaagtctttcagcaacctgttcgagatgcagaacatttccgccgatctgcagggcacctatccttatagcgaagggcagccgctgacgttgagcaacgtcggcgtggacatgctcaacgggcatatcagcctgtcggcgctgcggttgccgcagcatgacgccgcggtgctgaagctggacaaggtcgatctcagcgcgctgtttaccgccctgaagccgaagcagttcgccatgtccggccgggtcgacggtgagctgccgctgttcctgaaccacccgaaatggctggtgcagaacggctggatcgccaacgccggcaccctgacgctgcggctggacaaagacatggccgacgccatcggcagcaacaacctggcgaccggcgcggcgatcgactggctgcgctacatggaaatcaaccgttcgcacgcccgggtcgatctcgacaacctgggcgaactgacgctgagcgcgcgtatcgacggcatcaacccgcagaagaacgccaagcgcgagtttgcgcttcggcgacaatttacaggagtggctggagcaggccctctcacaacctggggagcaacaatgaaaatcatgagtgtgtcgacgctggcagcgctgctgtgcgtttcgctgctgagcggctgcgtgccgcgcatcgaggtggcgacgccgaaggatccgatcaccatcaatatgaacgtcaagatcgagcatgaaattcatatcaaggtggataaggacgtcgaaaacctgctgaaaacccaaagcggtctgttctag

SEQ ID NO: 4910 - DNA, 846 bp, Glycine max
  Peptide Sequence Number=SeqID_96595
atggatgatccgtatttgtcaggcaagagatctatgcgcaaatccgttttactgttgctgtgctcactcccgctcatcgctgctcaggcggcacgcgccgacggcccgtccaaggccgagcaaacgcgtctgtttttcggcaaagatgaacgcatcaaggtcacggataccaccgcccagccctggcaggccatcggccaggtcgaaaccgccagcggcaatctgtgtaccgccacgctgatctccccacacctggcgttgaccgccggccactgcgtgctggcgccgccggggcaactggataaagccatcgccctgcgcttcgtggcgggtgataaatcctggcggtatcaaaccgacaatatcgaaactctggtcgacagcaagctgggcaaaaagctgaagccggacggcgatggctggatcgtgccgcccgccgccgccgcttatgactttgcgctgatccgtctgaaagacaaaaagccgctgccgatcgcaccgttgccactgtggcaaggcgacagcaaggcgctgacccaggccctgaaacaggccaagcggttgattactcaggcgggttacccggaggatcatctggatgacctctacagccaccaaaactgcaaggtcaccggctgggcccagcaaggcgtactgtcgcaccagtgtgataccctgcccggcgacagcggctcaccgctgctgttgaaaaccgccgacggctggcagttgatcgccatccaaagctcggcaccggcggcgaaagatcgctaccgcgccgataaccgcgccctggcggtgcccggcatccgcgaagcgctggacgccctggcggcgggcaaatag

SEQ ID NO: 4911 - DNA, 354 bp, Glycine max
  Peptide Sequence Number=SeqID_96596
atggcatgtccattggcatgcgttccaaaggatccctcatgcacacatccacacatcgaagcagtaccatgtcatggttcctcttgtataggatattcccgctcacgaagaagccggctgccaaccttcacaatgttctcttgttgttgtcagaggcttcctgcttgtgtagaagcaaagcttcatggtgaatcaaaggtgattcaaaggtgttttgatgataacaatgatgatgacaaaggtgatgacaaaaagctcaaagatcaatcaaagaacaactcaagtgaatcaagaacaattcaagagttcaagaaaagaatcaagaagaattcaagactcaagaagaaagcctag

SEQ ID NO: 4912 - DNA, 246 bp, Glycine max
  Peptide Sequence Number=SeqID_96597
atggacgggttttggttaaagccacgagctgatctggaaaatctgagatttccacttcgaattcgaagtatcctgacgagggatcttcggatggctattctatttatggctattccagctgaagcattatattctgaaacatggtgcgaatgtcatgtaagatgtctcaaggttgtcatgagatccaatgtaggattggaaggggggaagaaactcaaatggtggaattgtaagcttttacaataa

SEQ ID NO: 4913 - DNA, 477 bp, Glycine max
  Peptide Sequence Number=SeqID_96598
gaccgtgaatgtgcagagttaattggtcaatcggcggatgaagtcaacagactcaaaatagaagatggcgatgttgatttaaatgcctctcttcaagtactagataggctattggattgtttccttgcattcaaagtcaaggtacaaccaaggttcaggaatgctgttgttcttagatattcagatgaatcaaacttgatcaatgttgtgctggatatgcttcccgatactgagatcgagcgttcaatacttgactcgattgaccctacagagcttgaatctcaatctatgtttattacctccgatgatgatcgttcaatgcttgactcgactgagcctacagagcttgaatctcaatttgtctctgttactgctgataatgaccctcttctcaggattccattgacaccaactaagcgtgcatcttttgatgagttggatgatggacccaaaaactttgagatttcacatgccaaa

SEQ ID NO: 4914 - DNA, 753 bp, Glycine max
  misc_feature (23)..(23): n is a, c, g, or t
  Peptide Sequence Number=SeqID_96599
atgatcattgatcaatcattgtncttttctttgactaaattacccagtcaaggtgcagcttttgagggcaccattgttgatgactggaaatttgattattcttgtcatgatgctcgccgtatggtttgtaatgaccaggctaaaatgaccggtagattgctggccggatcattgacctttgataatcgcatcatgcactacattattgttagaattttgcttccccggtcttcaaatttggctcaagcctctgaggaggacttgattttgatgtgggctttccttaccgatcgtcaaatcgactgggctcacttggttcggtaccgaatgcataaggcattacgggccaatgcacctcttccttaccctcaattggtcactctgtttctctgtcattttcaaattccgcttgatgatgaacaatttgttcaagtcaagcgttcctttgctattggtgctggtgcaatcacttcttttggataccgtaaggatcggaatggtcaattactgaagaaagatgcatttcctccacaagatgagcgtactccttctcctcctcctcagcgagatgattcagccctcatgactgaagttctttccgagttacggggtctttgtacttatgttggagaacgttttgattcattggataatcgctttgccggaatggatatctgtctcacacatcttgaagaagatgtgggttatattcgccagagcttcgatcttccaccaccacctccaccttcttag

SEQ ID NO: 4915 - DNA, 183 bp, Glycine max
  Peptide Sequence Number=SeqID_96600
atggtgaaagttggaacctcttacgtgccgatcaacgtctcattttcgccaaaagttggcccagggcttcccggtatcaacagggacaccaggatttatttattctgcgaagtgatcttccgtcacaggtgctccaagtggcttctgtttctaatcaagctgtccctcctgttcagctactga

SEQ ID NO: 4916 - DNA, 594 bp, Glycine max
  Peptide Sequence Number=SeqID_96601
atggcctctaggaaacacaagagtatcagttcaagacccacaactcaatatgatacaaggagatttcacttcttagatgcatggaactggtacacggataatgtattaggcagaaacatcttgccagagaggaaggtgaagctctaccacattgagtttgatgattttaagactaagttggagaggcgtaatctccataaacacctcaccaatttggttgatgggagcatagatgtggctttggtgaaagagttctatgcaaacctatacaactttgaaggtccttcaccaaagcaatccagggttagaggccatctagtgaagatcaatgctgacagcctcaacacattcctagagacacctgtggtgttggcagagggtgagacgttgcccacatactccagatactgcagactgcctttagatcctagggagattgaggttgccctatgcataccaggccgagggttcatcttgaacgttgagggccatcttgggaggatcctgaggaaggatttgacaactttagcccaggtgtggagtgttctctcatactccaacctggctgatcaaggccgtacccgaatcaaataa

SEQ ID NO: 4917 - DNA, 639 bp, Glycine max
  Peptide Sequence Number=SeqID_96602
atggcctcattgcaaatttcgcaaggcatatttcacctgagcgatagccgtaccctgaccctgccggacttaaccctgcacagcggcgaaagctgggcctttgtcggtgccaacggcagcggtaaatcttcgctggcgcgcgcgctgtccggcgagctgacggcggcaaagggcgagctgcggcaggattttcagcgccgcacccgtctgtcgctggagcagctacaacagctggtgacgcaggagtgggagcgcaacaacaccgatctgctgagtgaaggcgaagatgacaccggccgcaccgcgctggagatcattcaggatgaagtaaaggatgaggcgcgggcgcaggtgctggcccagcagtttggcatcagcgctttactgactcgccgcttcaaatacctttctaccggcgaaacgcgcaaaacgctgctgtgtcaggcgctgatggcgcagccggatttgctgatcctcgacgaaccttttgatggtctggatgtggcatcgcgcgccagtcttgccgatacgctgcatcagctgcatcgcgacggctacaccgtggtactggtgctgaaccgctttgacgatatcccggattttgtccagcagtcggcgtgctggcggagtgcacgctga

SEQ ID NO: 4918 - DNA, 210 bp, Glycine max
  Peptide Sequence Number=SeqID_96603
atgggagaatttaatcatgatagctgggattggaaccttagatggagaaggaacttatttgatcaagaaagtgatttagcagcccttcctatctacctactgtcattcttcaaaattcctaaaaaagtggtgcataaggcttccgtcgaaatgaaaggaaaatcaacgagtctgacagaacaacttcagtcttcactcttcactatttga

SEQ ID NO: 4919 - DNA, 441 bp, Glycine max
  Peptide Sequence Number=SeqID_96604
atgacggtgaaaacctctgacacatgcagctcccggagacggtcacagcttgtctgtaagcggatgccgggagcagacaagcccgtcagggcgcgtcagcgggtgttggcgggtgtgggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgagaaattcaaatggtcataa

SEQ ID NO: 4920 - DNA, 228 bp, Glycine max
  Peptide Sequence Number=SeqID_96605
atggtgcagaagaagactcaatacacaaaacttgcaagaaaacagaaagaatctcacaggaagaagacacacttcattgaaaacaatcaagactctctaactaacattcctcacagaactggaatagaaatagaggaagagaatgtatattattattattttgctgccttcaacacccaagacagaatacagataagtttcgaggtctcaccaccctcctcttcctaa

SEQ ID NO: 4921 - DNA, 216 bp, Glycine max
  Peptide Sequence Number=SeqID_96606
atgtatttacacttttttagctttcgaagaagatacggaaactcacggattgcgcaacaacacctctttttggtttccgtcacattacggaatttcacggatcgcataaccctgcttccttttgacttccgacgtgtttcgagacttacatattgtgcaacaaagggtgccaagtatcttgaagcgaccaatcaaaggttgcatgtcatcaattaa

SEQ ID NO: 4922 - DNA, 399 bp, Glycine max
  Peptide Sequence Number=SeqID_96607
atgattctgaaggatgaactgaagacttgtctgaggtccaaaatgagcttgtctcaacggctgagcgagatcgaagcaaacatgttggccatcatcagtaagtacaaagaagaattggatttggccacgacccacgagcataaggtggcggatgagtacgcccaagtgtacgcaaaaaatgaggcaaggggaagggtgattgactcattacaccgagaagcaatgatgtggatggaccgattcgcccttactttgaacgggagtcaagatcttccccgattattggcaaaggccaaagcaatgacggacgtatactctacccccgaggaaatccatgggctcctcagctattgtcagcatatgatagacttgatgacccatataattaggaaccgttag

SEQ ID NO: 4923 - DNA, 303 bp, Glycine max
  Peptide Sequence Number=SeqID_96608
atggggtgtacccatgggccagaaatctaccctaaggcttataagaacccaagggccttctcttgcatctctggcccaatctacttggagttttctatccaatgcccttgcgggagctctatcatcgtccctgggggcccctgtgggtcttgcccctatttcaaaattgagctcatctccaggccatgcaattgtggccccgaactactcgggggtaggccatgggaaaggactagtgtcctggctctcctggtgtgtactggtagaaggtctcattcagctgcacctgacccttgtgattag

SEQ ID NO: 4924 - DNA, 663 bp, Glycine max
  Peptide Sequence Number=SeqID_96609
atgaaggctgatatggaggccttgaaagatcaagtcacttccatgatgaaagccatgttaagcatgaagagaatgatggaaagcaacgctgctgcagttgccgccaccagcaccaccgctgaggcggatcctacccatccctctgccataaaccaagcgaaccaacccgccccagacgtggtgggacaaggaggagaggtattgggcagtaccagtggtccacacatggggtataatagaaatgcttacccctatggcttaccccccaattatacgccacccaccatgcacttgcctaatgagaacgttcatcatgttgttcccatttcctttgaggggcagcaacccctgtctgtaggaggtgcccgtgaagaacctcggaagcatgctcaaggggacttcaacccatatcccactttcaccgctaagggactggtgtgtaatgatatgcctaaacccaataccgcaggagctcctcaaccccgccctctacaaccgttgcatttctcagtaggggggccgcctctggcaatggaagtgagagagaaacttgatctcatcgaagagagattaagagttgtcgaagggtttggtgattaccctttcgccgaaatgacggaattgtgtttggtacctgatgttgtcatccctccaaagttcaag

SEQ ID NO: 4925 - DNA, 129 bp, Glycine max
  Peptide Sequence Number=SeqID_96610
atggcattaggaacaatgaaaattgttggttccatggcttcgtgttatgtagcaacagatgcaattggtgatgtgattgagaaaaatgatagaaagaaaattgaaacatgcaaagaaaaaattcattga

SEQ ID NO: 4926 - DNA, 510 bp, Glycine max
  Peptide Sequence Number=SeqID_96611
atggatgcccttcgagtacctatcgacgatgaccaggatgacggtgaactcgtgggactacggaaggtgggtgataaagtccatagaaatgtcttcccagatttcggtgggaaatggcaagggttagagaagaccggccagccaacgagtactcatcttcgtttgttagctaacactgcattcatgaacaaatcgcttaacgtcctgatgcaaggtggaccaatagaaacaagattcgagtctgtgggtagtcttggctacgccgaggtgaccgccccaaggtgtggcatggaactcaagcaagagggtggggatatagggcaactcattgtggatgcgatagttaggaagttggggcttgcatgcagtgtgcatcgaagatcatcgaggaagttgaagttaggcaccgagagtaggagaagctggccggaggaacatagtgtcaacaacctccatggccgtgctgaaggcgttagtttcgacggtgaacgactatgcaaaattcaatag

SEQ ID NO: 4927 - DNA, 597 bp, Glycine max
  Peptide Sequence Number=SeqID_96612
atgggttcaaggtcaagagaggttgtaggttcaggacaagggaagaaaggtgttgagaagtccgggttagggtcgtcgggctcagaggtctcgggttggtgttgtggcttggtgttggaggagggagattggcccgatgcgggggacagcagtcacacaacttatcttcttggagtttggcgagggccgttgcttgcagcagggagattggttgaagagccaatacttctcggtggattttcggaaggagcgaatcgggattccaatgcttgcaagaagccagaccaggaggtgatgaacccgttgtggaacatccactgctaccaacttagagcggccccgtcgagtgattatgattgggcgttagtaggtggaagcgatcgagaatcgaatacactttgccggaaagttcagagtactatcggcgaggttgcatggtcggccatggcggcggcggcaggtcgaaccagtgttagggcagaggtggtttctgttgatgcttgctcccttgaagctgttgtcaggtctcgtagtcttgcatgtacccatgtcttgtggttatccttctggacctttctggattggactcttgattag

SEQ ID NO: 4928 - DNA, 306 bp, Glycine max
  Peptide Sequence Number=SeqID_96613
atgtcgctcatcctcgacgctgttgtccttgccacgctcctcgtgtttacctatgcttctagagctttgagaatcttcaaagggatcgttgcactcaaagcccatcaaaaccaagagtcagagttgggaagagtgcctcttcgtagcatgtttgcattttcaagggcgaggctcacgggtgcgctttccaaaggaggaaagatgcgcggagtcgccaccgacgtttatttgtggaaaacgtcggaaaaaccgaaggaaactggtcaaaatgaaaattctaagttcgggagttatatttacgcttga

SEQ ID NO: 4929 - DNA, 279 bp, Glycine max
  Peptide Sequence Number=SeqID_96614
atggagtcgccaactgtcgcaacatgcccttcgcgggcgagcgagggcgaggctcacgggtgcgctttccaaaggaggaaagatgcgcggagtcgccaccaacgtttatttgtggaaaacgtcggaaaaatcgaaggaaactgcaaaataggggagaagcttgccgcccagctcacccaggcgagcaaggttgcttcctccagaagcaacagccttctggaggaatcttctggagggcccaagtgggcctggttgctatttacaccccctatttactaa

SEQ ID NO: 4930 - DNA, 315 bp, Glycine max
  Peptide Sequence Number=SeqID_96615
atgcacttgccaggtttgaacaagtttttggccccgttgccagggaacttctttctatttggaaaatctcccacaggcaatttagttcctttggacttggagattgaagctacgttgagaaggaataaagccgagaggagaagaaaattactgcaagataggacagtagcgtccattcttgaggaagaaactcatttttctaattcttcatcatccgactcaccatcatcaagggaatctgcgacttatttaccggaagccgtttccatggctgatgagcacaacaaagagttacccttgaggactattcaagaa

SEQ ID NO: 4931 - DNA, 318 bp, Glycine max
  Peptide Sequence Number=SeqID_96616
atgggaacaaatcaaaccgacaagaggttctaccaagtcaaggttaaaagcttagataccaccagcatcaaggaattagggcggttgatggaacctctccaaatgcaagctttccgcaagacttacggaaaaatcttagagttgaccttagcagagaagtacctagaagacaaggcgaggggtatggccaatcaaggagactgggtcccgtttatggatgtgttagctttgctaatttttggggtcgtcctctttccaaacgtggatggtttgatagacatagcagcaatcgacgctttccttgcctacccaccatag

SEQ ID NO: 4932 - DNA, 528 bp, Glycine max
  Peptide Sequence Number=SeqID_96617
gtggattgctacgaagaagaccgtgaagaacatacgtacaccgacgtacagggagcgcctggaccgactccggatttcggatgtctgttggatcccatatggggagcaccgaccggtccgggacttccatatgatttcatgctattctggtctcctgcgctgggtgcccgttgttatgtattacgatcagagagggtcatgcggcagtttggatacactcagatcattcctactccgcctgtggattcatgggcctcaaatcctctgccagatggtcatgctccgcagccccaagtcatccctcaggtcccagagacagatatccctcacgtgccggagccaggagcaccatcgacatctgcgaggcccactgtggacgagcctagacatgcagtggaagtttgctatgggattgctgagaggttggagcgccatttgagcctaggggtggtcaccccaggctcatcgacacatgaggtgatcgaagaatgcctcaagatggctaggagtgtcacacaggaccagcta

SEQ ID NO: 4933 - DNA, 153 bp, Glycine max
  Peptide Sequence Number=SeqID_96618
atggaggttgatgaaccttggctagggttatggctaccattgaattatcaagctttctcgctgcaaaattcatttttggttgggggttttggttttgctaaaggtggtgttcggcattggaagtgcggtagacagactttgtggttgatttag

SEQ ID NO: 4934 - DNA, 446 bp, Glycine max
  Peptide Sequence Number=SeqID_96619
atggctccgagaaagctttccatgaaaagatctaggagggacgccgcggctgaagggaccaatgccgcccccgagtttgatagccaccgtttccggagcaccgagcaccagcagcgtttcgaggccatcaaaggatgccggcgctgtacatcgctggtcactcccatggctaagtttgacccatatattgtcctagaattttatgataatgcttggcccacagaagagggagtgcgggacatgcgatcatgggtgaggggtcagtggattccctttgatgcagacgccctcagccaattcctgggtgaaccgctggtgttagaagaaggccaggagtgtgagtttagtcagagaaggaacagggccgacgggtttgacaaagaggccattgcccagctattatgtataccgggtcaggattttgcccggaccgctgcagggaggcg

SEQ ID NO: 4935 - DNA, 261 bp, Glycine max
  Peptide Sequence Number=SeqID_96620
atgggtgccaagtacctcgaagtggtcaaacgagggtcgcatcccaacaatggatggttcccggacgaaattaggacacagaatgaccataatttgtctctgcgtgttgttggacacgatagagcctgggcggcaagacacagaatgaccataatttgtctctgcgtgccaccagacacgatcgcctctggatggcaaaaaggtgtgcggaatgaccataatttgtctccgcccacctctcgacttactgtccccgaatga

SEQ ID NO: 4936 - DNA, 1681 bp, Glycine max
  Peptide Sequence Number=SeqID_96621
atgacctatgcgcctgctggcggtcatgggccggatgtattgaatagtttgtggtttgctagtgttggtgatcttccccaatcgccatcttcagcggcaatcatcggcgggcagggcgctattttttccggcttgctagccagccaattgccgggagtgcaatctaacagcatggctaccatgtgggcagacaagaaaataacgaatgcagtatgggtggcagatcaatggcagagcgtcgattgggccgatattgctgatgccatacaaactgggcaagtttcggaattgaatgtggtgctcccttttgctgagcgcagcgtccacatacagtataaaaaacaatttcgctggcaattctggcgaaaagcatacacattggaaacgttgttacagcagttagaaacgacattgtccaccatcagtaattttgagaccctgttggcgcagggtttgccacccttgctggcacggctgctggcagcaagggcggtcagcgcggatgactgggtcttacaagagatgcctcatttgctcaagccagatgcacttaccggcgctacccagatggcgcaattgctggcagatgcgattgcacaacaaaagcgcatcctgatcattggcgattatgatgcggatggcgctaccgcaaccagcgttgccatgcgtggcttgcttatgatgggtgcccaggtggattttctagtccccaaccgatttgaatatggatacggcctgacgccagaaatcgtcgccttggcagcgacacagcagcccgatgtgattttaactgtggataacggtattgccagcattgatggcgtgatagctgcaaaagcactagggatgcaagtgctgattactgatcaccatttgcccgcagaacaaacacccgccgcggattgcatcgttaaccccaatcagcggggatgtgatttccccagcaaacatttagcaggggtaggcgtcatgttctatgtactgatcgccttgcgtgccgagcttaagcagcgtggcatgctggcagaagaccgggtgcatttgggcagtttgcttgatctggtcgctttgggtacggtggccgatctggtcaagctggatgccaataaccgcatcctggtcaggcaaggacttaaacgcatcaggcaaggacaagcttgtcctggcattctagctattctcaaactggcgggacgtgaccctgaacaagtcaatgcacaagacttggggttttacgtgggcccacgtctcaatgcggccggcaggctggacgacatgaccataggcatacgctgcctgcttgctgaaacgccgcaagaggccatgcaatatgcgcagcaattgcatgtgctcaatgcagagcgcaagcagattgaagccgaaatgcaatgggatgccatggcagacctcgcacaagatttcaaagacacgcaatatacgattagcgttttccagccagactggcatcagggtgtgatcgggatcctggcttctcgtatcaaggagcgttaccatcgcccggtcattgcattcgctgatgccggagaagcgctcatcaaaggctctggccgttccattgccggtttgcatctgcgcgatgcattggacctcgtcaccaagcaacagcctgatttgattgtcaaattcggagggcatgcgatggctgccgtcaagagtatcc

SEQ ID NO: 4937 - DNA, 138 bp, Glycine max
  Peptide Sequence Number=SeqID_96622
atgccggagggagacgcgagggctcacgggtgcgtcttccaagggaggaaggcacgcggagtcgccaccaacgtttatttgaggaaaacgttggaaaaaccggaaaagggtgtttcctttgctcctacgtatccttaa

SEQ ID NO: 4938 - DNA, 111 bp, Glycine max
  Peptide Sequence Number=SeqID_96623
ctcaaaactcaaagtattcaagccatggtggagttaagaagacagtgtgccaaagctgccagcaccagcgatttcaacctagaaatcaagagtagtgtttatgttgcttaa

SEQ ID NO: 4939 - DNA, 903 bp, Glycine max
  Peptide Sequence Number=SeqID_96624
gaagcagagcagccgctataaaccggtggagctgaaggccgagctcaccgacgaagaggtggcgcgcttctcggtcaatcagttccgcttcaccggcgtcaccatcgatacctatcaggatcgggaatacccgtacggcgccgatctggcgcacgtggtcggctacgtgtcgaagattaacgataatgattacaagcggctcaatgccgagggcgtgggcgaaaactatgccgccgaccataacatcggcaagcagggtattgagggctactacgaatccctgctgcacggcaagaccggctatcaggaagtggaagtagataaccacggccgcatcgtgcgcgtgctgaaagaggtgccgccggtggcgggcaaaaacatctggctgacgctggatctgcatctgcagcagtatgtggagagccagctggccgggcagcgtgcggcggtgctgattgaggatccgcacgatggcggcgtgctggcgatggtctccagcccgagctacgatcccaacccgttcgtgaagggcatcagctacaaagcctataaaacgctgctgcaggataaaaacctgccgctgatcaatcgcgtcacccaggggctgtatccaccggcatcgacggtaaaaccctacatggcgatgtcggcgctgctgagcaaagtgattacgccgggcaccaccttctttggcgcgccgacctggacgctaccgggcaccgatcgcaaataccgcgactggaaaaagtccggccacggcatgctcgacgtcaccaaagcgattgaagagtccgccgacaccttcttctatcaggtggcattcatgatgggcatcgatcgcatccacagcatgctcagccagtttggctacggcaaacctaccggtattgatttgaatgaaga

SEQ ID NO: 4940 - DNA, 706 bp, Glycine max
  Peptide Sequence Number=SeqID_96625
atgccagcgcaaccagacgcgctccagcagctgtgcgcccacgtccgccagcttgccgagcagggcgtacagcacgatcgccaccaccaccacgtcggtttgcaggaattcacgcgcgttcatcgccaggtagccgatgcccgaattggccgaaatggtttcggcgacgatcagcgtcagccacatgaagccgagagcgaaacgcacgccgaccataatcgacggcagtgcgcccggcagcaccacctgtgtaaacaggcggaaaccgctcaggccgtagctgcgggccatctccaacaggccgcgatcgatcgtaccgagcgccaccagaaagatcttggcggattcatcgatgccgaaccacaggatcaccagcgggatcagcgccaggtgcggcacgttgcggatcatttgcaccgagctgtccagcaggcgttcgccccagcgcgacagcccggtaataaagccgaggatcagcccgatgctgccgccgatggcaaagccgatcagcgcgcgctggctgctgatgctcaggtgctgccacagttcgccgctttggctcaggctccagaaggcggccagcaccgcgctcggcgccggcaaaatgcggttggacagccagccggtttctacggcgatctgccagaggatcaccagcgccagcggcagcgcccaggggggccagccgatacaggatgcgttgcgc

SEQ ID NO: 4941 - DNA, 411 bp, Glycine max
  Peptide Sequence Number=SeqID_96626
gttgtctacgcggaacacaacgtaaatctccgcgtgtcaacgggcttgttgcccgcgattgacaaagggttgtctgcgcggaagacgacgtatatctgcgcgtgtcaacgggcttgttggccgcgattgacaaagggtgcagaagacgacgttgtctgcgcggaagacgacgtaaatctccgcgtgtcaacgggcttgttgaccgcgaatgacaaagggtgctgtcgcaacgtgccctctagcgggcgagcgagggcgaggctcacaggtgcgctttccaaaggaggaaagatgcgaggagtcgccaccaacgaaggtattagcacctcttacgtcgacaaaagcgggactcttgctcctacgtaccctccatcaaagaggaaatcagacctacgtagttctttcctaagg

SEQ ID NO: 4942 - DNA, 446 bp, Glycine max
  Peptide Sequence Number=SeqID_96627
gaataacaataacttccaggttgatattaaaatagctgaaaggggtttcatcatgttggagggggtatggctggtagaaagtcagagggtagtggtggctaatatctatgcttcttgggacttcaactgcattaaacacccagctgaaagaatgggaagcactctttgtaatgcagacactaatcttatagctgaatttaatgagtggctcgctgaaatggaggtagatgatattccttgcttgggcaagccctttacttgggttaggcctaatggttcttgggacttcaactgcattaaacacccagctgaaagaatgggaagcactctttgtaatgcagacactaatcttatagctgaatttaatgagtggctcgctgaaatggaggtagatgatattccttgcttgggcaagccctttacttgggttaggcctaatggttctt

SEQ ID NO: 4943 - DNA, 280 bp, Glycine max
  misc_feature (244)..(244): n is a, c, g, or t
  Peptide Sequence Number=SeqID_96628
atgtcggcttcgaaagagcaaatggcttccatgatggaggccatgttaggaatgagacaactcatggggaaaaatgtggccaccgctgccgttgttagttcggttgccgaagcagacccaactctcttagctaccgcgcaccatcctcccccaaacgcggtaggacaagaaaggagtacactggggcacaacagcaacccccatttaggatacaaccgggtggcttacccttatggattgccgnctaattacacgccgccagtcatgcctgatgacgcgg

SEQ ID NO: 4944 - DNA, 219 bp, Glycine max
  Peptide Sequence Number=SeqID_96629
atgatttctctagaacattcttgtagaatttggcctaaggatgtttctagaaattgggcttttagactaataaatctcaaaatcaagtttatatttgatgcaatcctccctaggaagggaccaatcactagaaccatgagcaagaggctccaagaagattgggctagagctgctgaagaaggccctagggttctcatgaaccttagggtagatttctga

SEQ ID NO: 4945 - DNA, 423 bp, Glycine max
  Peptide Sequence Number=SeqID_96630
atgacttatagagttatgttttatttcagtggcaagactctaggtgacatcttggatgcccttccccgagaatggatatcagaagatctgatggaggcactcatgaagaaaggagtttgtctctctcctgcaatatttgaagtgggagactgggtgaagtttagaaaaacttccatgactccaacaaatgggtgggaaggtgatcggcagaagcaggtgggctttgtgcaaagagttccagacaaagataatctcattgtttcattttgttctggagagtattatagtgttttggccaatgaagttgtaaaagtcattccattagacaagggacaacatgtgcagcttaaagaggattatgaattacaagaggaaccatcttctaaatcagaactaattagccctggcaccaatcatccatga

SEQ ID NO: 4946 - DNA, 312 bp, Glycine max
  Peptide Sequence Number=SeqID_96631
atgtggatgttgagggagtggtttccggcagatttcaggcgggaggagaaagagaagagcgattttaggcaggaggacaaagagaagagggagtgcaaggagggagaggccctgacgaattctttggagtgtaggccttggtggtcacctggtttgagtgctcctttaagcttgtgccgatctcacatgattggagcattctcgcaaaacagcgtgaccctgactggtctccctatgattttacttagtgagagtgacctgacatacccattgtgtggtgtgtcttgtcatgtactcctaggtgcccgatga

SEQ ID NO: 4947 - DNA, 219 bp, Glycine max
  Peptide Sequence Number=SeqID_96632
atgtacttagatcagccaaggccaatggtttatgtgaaccttagatgcagcggaagacaaaggagaagaggtgagaggaggcgccatccactagggaataagccatggaagaaggagcttcaccaccaagatgagccttggataagaagcttagagaggatgcttcaatggaggaaaagaaagagggagagaaagagagaggggggagcacgaaattga

SEQ ID NO: 4948 - DNA, 729 bp, Glycine max
  Peptide Sequence Number=SeqID_96633
atcaccgtttatctggataaagcgctcgacgataacgcggcggcgcaggtggtcgggcaaatccaggccgagcagggcgtggagaaggtcaactatctttcccgtgaagaagcgctgggcgagtttcgcaactggtccggttttggcggcgcgctggatatgctcgaagagaacccgttacctgcggtggcggtggtgatcccgaagctcgatttccaggggaccgattcgctaaatacgttacgcgatcgcatcacccggattaacggaattgatgaagtgcgcatggacgatagctggtttgcccgtcttgccgcgctgaccgggctggtgggacgtgtgtcggcgatgatcggcgtactgatggtggccgcggtgttcctcgtcattggtaacagcgtgcgcctgagcatttttgctcgccgcgataccattaacgtgcagaaactgattggcgcgacggatggcttcatccttcgtccgttcctctatggcggcgcattgctcggtttttccggcgcatttctttcactgattttgtcagaaattttggtgatgcgtttgtcatcggccgtgacggaagtggcgcaggttttcggaactaagtttgatatcagtggcttaggcttcgacgagtgcctgttattactgctggtttgctcgatgattggttgggtggcagcctggctggcgaccgttcaacatttacgccactttactcccgactaa

SEQ ID NO: 4949 - DNA, 642 bp, Glycine max
  Peptide Sequence Number=SeqID_96634
atgaaaaggaacgcgaaaacgatcgtcgcgggagtcgttgcattagcgatttcccacgcggcgttggcaaaggatattaaagtcgccgtcgtcggcgcgatgtctggcccggttgcccagtggggcgatatggaattcaacggcgcgcgccaggcgattaaagacattaacgccagcggcggcattaaaggcgacaaactggttggcgtcgaatatgacgacgcctgcgatccgaaacaagcggtcgcggtcgccaacaaaatcgtcaatgatggcattcagtacgttattggccacctctgttcctcctccacccagccggcgtctgacatctatgaagatgaaggcatcctgatgatctcccccggggcgaccaacccggaactgacccagcgtggctaccagggccgaccgccgcgaaatatatcctcgaacacggtgaagccgcagcgtattgcgattattcatgacaagcagcagtacggcgaagggctggcgcgttccgtgcaggacaacctgaagaaagccggcgccaatatcgtcttctttgatggcatcaccgccggtgagaaagatttctccgcgctgctggcgcgcctgaagaaagagaatatcgacttcgtctactacggtggctactaa

SEQ ID NO: 4950 - DNA, 669 bp, Glycine max
  Peptide Sequence Number=SeqID_96635
gccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggtttattgggatctagaaatcttttgtgatgaacgattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaa

SEQ ID NO: 4951 - DNA, 441 bp, Glycine max
  Peptide Sequence Number=SeqID_96636
atgtcgatctccccctacagaagtatcagttggtttgtgttgtcccgacataggggtcgttcccacaagactcccagtggacccgaagaagtccaacagggacctggggtctccagctttggttacagacctctatcgatcctacagggtgaccatactccccggcaagggatcgcgcccgcaggacaccaagtggacccaaagaagtccaacagggtcctggggcttccagctctaattacgggcctctgtcagttctatggagtgcccatcacccccagtaaggtcatcaggcctcctactaaccgagctttcatcaagaagtattgcgtcctcaagaaggcagagggcgagacaccacaacagcctggggatggaaataggcaacaaatgcaccgccgccacctcttgagcccctcatctcatccacaaaaaggttag

SEQ ID NO: 4952 - DNA, 186 bp, Glycine max
  Peptide Sequence Number=SeqID_96637
atggatgaaatggctccgaaaaagctttccgcgaagagatctaggagggacgccgcggttgaaggaattagtgccgcccccgagtttgatagccaccgtttcaggagcaccgagcaccagcagcgcttcgaggccatcaaaggatggtcgttccacagagagacacgtccagctcagggacgatga

SEQ ID NO: 4953 - DNA, 439 bp, Glycine max
  Peptide Sequence Number=SeqID_96638
atgcatagatctcctacagtaactttagttcctttggacttagaaatagaagctacactaagaaggaacagggctgagaggagaaggaaattgttgcaagacagaacagttgcgtccattcttgaggaggagactcatttttctgattcattatcacctgattcgccatcatcaagggaatccgctaatcaatattctgaagctgttaccatggcagatgagcatgatcagaggactacccttgaggactattcaagtggctctgtaccacaattttttactagcattgcacatcctgaagtgcaagcgcacaacataacctacccacattctttgatccatatgatacaagggaatttatttcaaggattacccaatgaagattcctatgcacacttggcaacatttatagagatttgcaatattgttaagattgtcg

SEQ ID NO: 4954 - DNA, 129 bp, Glycine max
  Peptide Sequence Number=SeqID_96639
atgttattggggcatgttagtttcatgacatatggaattgaattgtttggatattgtgaaagcttggaggggttgatgggacccggtgctgagaggaacgaggataagggctacgtaggagtgcgttag

SEQ ID NO: 4955 - DNA, 636 bp, Glycine max
  Peptide Sequence Number=SeqID_96640
atggatgaacctttcattatggcagaacaagcaagacaagtgtttgatgtccaagatccatgtgattcaagattttcagtcattctacaaggaagaccaagtggtatcactcaccaaaatgatgatccaacacttgacttttgtgaggcgcctgctttttcaaaactaatgccttctataagtgaacaacaagacgtcgatgatgtacaagcaaattgtactgatcatcatgagggtgatgggtacaccgccaagcccagaccaacagttaacattgatccagcaactagtagaggatcatgcccacacaaagagaagttccaatcctatctaggggtcgtagctcaagaaaagattcctattatacatagcaattggaaagatgtaccgcattctctcaaggacctagtatgggatgacattttggccaaattcgatatcccaaaggtaccgaatgccaagaagaaggtcatgtcgaaagtggcgaccagatggagacaattcaagtctaccctcaccatgaagtttgtgtatcataacaatgaggtgcaggataaacaagaccctttttataaatatggtctagatccacaaacttgggaggaatttgctgcaactcagcagacccttaactag

SEQ ID NO: 4956 - DNA, 225 bp, Glycine max
  Peptide Sequence Number=SeqID_96641
atgatgacaaaagtgatgaacaaaaagctcaaaaggtcaaagaacaactcaagtgaatcaaagaacatctcaagtgaatcaagaacaagtcaagatttcaagaatcaagaagaaagcctacaaacaagaatcaagattcaagattcaagatctcaagaatcaagatcaagattcaagactcaagattcaagaataaagaaaggactcaatcaagataagtattaa

SEQ ID NO: 4957 - DNA, 966 bp, Glycine max
  Peptide Sequence Number=SeqID_96642
atggagttggatgagttcaaggctgaattggagaggcgtaacttccataagtgccttaccaatttagctgacagcagcatcgacctagccttggtgaaggagttctatgccaacctctacagtcccgaggggccttcaccaaaacaagtcagaattcgaggccacttgataaaaatttatgtagacagcctcaacaccttcctgaagacacctgtggtactggctgagggagaatccttactcacttactccagatactgcaggatgcccattgatataagagagattgaggttgctttgtgtatacccggtcgagtgtttgttttaaatgctgaaggccatcttgggaagatcctcaggaaagatctgacaattcttgctcaggtttggagggttctctcatactccaacctggcttcgacttcccacacctcagatttgactttagatagagctaggtctagaggggttgcttttgacagcctagtcttcgaacgcttgagcccgatcattaacttggcctatatcaggaagaactattggaaccctgctgatctgacagttactattagaggggttaggagagcgagggcaaggccagctgaggctccttccacatctgcagctccttctccagcacatacctcagcagctccttctaccccatcttatgcagactttcaacgtcttgaagccatgcttcaaagcatacatcaggggaagattgttttattacaaagtttacagctggtagcacctccaaactctatcccttctattgaacagtttaatgaatgggtagcctggcccgggactcagcctccccttcacagggaagatgaaggtctcaccgctcaggtagcagacccatccactcctaaggatcggactacaccagtcctgtctccgaacacctctcctccagctacccttgtgcttcgcttaacagatgaggaggatgtttag

SEQ ID NO: 4958 - DNA, 180 bp, Glycine max
  Peptide Sequence Number=SeqID_96643
atgtcagtgaaaaaacttgtcggacgcctaggagtacatgacaagacaaaccacacactagcaagtcaggtcactctcactaggcttaaaggagcactcaaactgggtgtatttacccccaaggcctacacttcgaagagtccgttagggtctctcccttctaattcaggtctaacctag

SEQ ID NO: 4959 - DNA, 123 bp, Glycine max
  Peptide Sequence Number=SeqID_96644
actgagagagagctgagcttgatgaggaagccatcttgcggagctttggatgagattttgagagattgtgaggtttctagaggtggaggagacactcacattgggaaatggtttgatccttag

SEQ ID NO: 4960 - DNA, 249 bp, Glycine max
  Peptide Sequence Number=SeqID_96645
atgaccgaccctctcgatgagtcgatctcttgctttctcataagggtgaacccttgggtactagttaccctcaccttcagaggactacacgtcctcaccttcagagggatacacgccttcgccatcagaggactgcatgtcctcaccttcgtagggctacacgtcctcaccttagaggactgtacgtcctcaccttcagagggcttcacgccctcgccatcagaggactgcatgtcctcaccttcgtag

SEQ ID NO: 4961 - DNA, 114 bp, Glycine max
  Peptide Sequence Number=SeqID_96646
atggaggttgaggaaccttggctggggttatggctaccattgcattattcagtagatatgggaggtggtgtttggtatttgatgtgcggcaggcgagctttgtggctgatttag

SEQ ID NO: 4962 - DNA, 153 bp, Glycine max
  Peptide Sequence Number=SeqID_96647
atggaagctaaaaatgtttcaacaaacacaatgatgcaatcctatctcgcaagggcattgggtagaagactccaagtagattgggctagagatccaagggatggccctagggttctcttgagccttagggtagatttcgagcccatgggctaa

SEQ ID NO: 4963 - DNA, 213 bp, Glycine max
  Peptide Sequence Number=SeqID_96648
atggcctcctatggtgaagcaaaggaatccattgatgaagaagatcctaggcctacaagctccaatggagcttgcaccatgtggtatcaagagcatcttcatctaggtgttgagggaaaaagcccagagtttcaagaacctcgggatttgaggtcaaatccttttcaagggggagggaatgatgcaatcctaccccgcaagggcattggatag

SEQ ID NO: 4964 - DNA, 239 bp, Glycine max
  Peptide Sequence Number=SeqID_96649
atggtggaattacatgctttgcaagatcttgttgtaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 4965 - DNA, 183 bp, Glycine max
  Peptide Sequence Number=SeqID_96650
atgggtgccaaatacctcgaagtggtcaaacaagggtcgcatccccacaatggatggttcccccggacgaaattaggtgatcaagggattgccatgaaccctaagagaataaaggtcatccttgaatggcccactccaccaagtataaaaaaatttggggcttccaagagggaggtgacttaa

SEQ ID NO: 4966 - DNA, 270 bp, Glycine max
  Peptide Sequence Number=SeqID_96651
atgacgctggcttacggtaaagcgctgaaagatgaagtgattatgcgtatcgctgagaaacataatgcgacggctgcgcaggtgatcctggcatgggcgatgggtgaagggtatgcggtgatcccatcatcaactaaacgtgaaaacctggccagcaacctgttagccgtggatcttcaactggatgctgacgacaaaaaagcgatcgctgctctggagtgcaacgaccgcctggtcagccctgaaggtttagcgccaaactgggattaa

SEQ ID NO: 4967 - DNA, 192 bp, Glycine max
  Peptide Sequence Number=SeqID_96652
atggtgaaagttggaaccttttacgtgccgatcaacgtttcattttcgccaaaagttggcccagggcttcccgctgtccctcctgttcagctactgacggggtggtgggtaacggcaaaagcaccgccggacatcagcgctggcaagtgtagcggtcacgctgcgcgtaaccaccacccccgccgcgcttaa

SEQ ID NO: 4968 - DNA, 333 bp, Glycine max
  Peptide Sequence Number=SeqID_96653
atggaggcccgaaacacatacgtttcacatgagatgcggagagtattcataggaggtgtcctttttgttgacaagagcagcagcaaaatttccctaaggtacctgcaatttttacgtgactttgaacagtgcagcacgtatgcatggggacctgccgtgcttgcttttttatatacagagatgtgcagcgccaccgattacaaaattaaatcgatcggaggtatgtgcatcttaatccaaatgtgggcatgggaacgatgcacaactttggctccaaagaggactcatcccgtaatagaaaataaaccactcggaaacaggttagttgtttaa

SEQ ID NO: 4969 - DNA, 147 bp, Glycine max
  Peptide Sequence Number=SeqID_96654
atgacactgctagaagctccacatggagctacatcatgtggagctacatcactgctagaagcttcaaggcttacaagctccacatggagctacatcatgtggtatcaagagcatcttcatctaggttctatcatttttcagtcataa

SEQ ID NO: 4970 - DNA, 463 bp, Glycine max
  Peptide Sequence Number=SeqID_96655
atggaaaaggaaagcagagacaatgaaatattgtctgggggtgccaagaatgtttttgcccttaagttaaatcctcaacctaggatggagtctgcatgcacctattttgataagaaggatgctcaaaaaaatgaggataaaaaattgagaagacttatgagaaagcaagtcccaaagaagctcaaaactctaaaaagattgcataaaaggcttttgaagatgcttagaatgagtttgaaattacataatcacctcaacagatggaaaaatttccatacagagtttcatctgaggaagaagacccttctaaagaaccattggactatggagaagttgatactggtgatcagcatactcataatgcaacaaaaggagctcagaaagactaatgatgtcctcaatgttgagaatatcattgatgtgttggccaaactaaaaaatgctgactctggtgtggataagg

SEQ ID NO: 4971 - DNA, 390 bp, Glycine max
  Peptide Sequence Number=SeqID_96656
atgtctcttgccattatttttggcaaactgcaagaacatgaaaggaaaaggaaaagaagcatagcactcaaagcctcctcctcaatgcaagaagaagaagaagaagaagaagaagaagaagaagaatctgatgatgaagaggacttctcactctttgtgaagaagtttcataaatgctataagtgtaatcgacccagtcacataaaggcacactgccccacaaatgaatcatggccagaaaagaatgagaaaaaaagccatgaagaaagaagatccaagaaggcgtatattgcttgggatgacaatgactcatccgatggttcggagaaggagatcaaccttctatccaaggactatgagagcgatgagaacatctctcaagaagattaa

SEQ ID NO: 4972 - DNA, 192 bp, Glycine max
  Peptide Sequence Number=SeqID_96657
atgacaaaactgagaggcgacgatgacgagcactggaacgacgaggatgaacacgatggtaataacgactgcaacgagaggcgagatcaagagatgatttgggcgcagagaattatcctatactttaaaagaactagtattagaaatagagatatattcagaaaaagggaaaggtggcaggatacaagttaa

SEQ ID NO: 4973 - DNA, 426 bp, Glycine max
  Peptide Sequence Number=SeqID_96658
atgaggcgtcatctactagagaataagccatggaaggagaagtttcaccaccaagagagtgccttggataagaagtttagagagaaagcttcaatggaggaaaagaatgagatagagaggggggggcacaaaattgaaggagaaaaagagggagaaaagttgaactttgaagtgtgtctcacaagtttcacattcatcaaagttatggcaagtgttacacatgcttctatttacagcctagaaatctaccttgaggttcatgagaaccccagggccttcttcaacagctctagcttaatcctcttgaagtcttttatgcaatacccttggggggtaggattgcatcatcccctaccccttggaaaggatttgacctcaaatcctaaggttcttgatactctgggcttcttccctcaacacctgtaa

SEQ ID NO: 4974 - DNA, 201 bp, Glycine max
  Peptide Sequence Number=SeqID_96659
atggcgaagagtgttaagcatctcaactcggttggcaagaatttaaatggtgaaaaaacattttgcaatagaagctcgaaaggacatcttgtaacagacccaaatgatctcatcactacactttcactgaaacgagactattggcaatgcgttatggttaacttgtttctcaaggatactccaacccatgggatggtttga

SEQ ID NO: 4975 - DNA, 327 bp, Glycine max
  Peptide Sequence Number=SeqID_96660
atgtaccctctcttgttctcagttacaacaacccaaatagatgtaccctctacttgtaccacaaaggatgtaccctccaatgtgttaagacaaagttctcaagcgtttagtcctttgaaactttgtgaaggggaaacaaaagatatctcaggagatgatgtcaaaggtgatgacaaaaagctcaaagatcaatcaaagaacaactcaagtgaatcaaagatcaatcaaagaacaactcaagtgaatcaagaagattcaaggttcaagatctcaaaaatcaagatcaagattcaagactcaagactcaagaatcaagagaaggcttaa

SEQ ID NO: 4976 - DNA, 336 bp, Glycine max
  Peptide Sequence Number=SeqID_96661
atgactgaaacacgtcaaaagagggtacggaaagtaaatgaaaacgagaataaaagtacacgaaacaaatggggaccaccacgggggagcagcttgccacccagctcgcccaggcgatctcagctcgcccaggcgagacagctttcgaagaagttacgaaaactcacggattacgcaacaacacctccttttggttccgccacattacagaatttcacggatcgcgtaaccctgcttccttttgattccaggcgcatctcgggacttacatattgtgcaacaaagggtgccaagtatcttgaagcggccaatcaaaggttgcatgtcatcaagtaa

SEQ ID NO: 4977 - DNA, 738 bp, Glycine max
  Peptide Sequence Number=SeqID_96662
atggcttccagaaagagaaagagcattggtacaaggcccacatcttattctgaagaccgtccaccaaagcagttcagagtcaaaagtcatttggtgaagattgatgctaacagtctcaacgcattcttggagacacctgtggtactagctgatggagagactctacccgcatactctagatactgctggttgcctacggacttcaaagagatagaggcttccttatgcatacctggccgagggttcatcttgaactctgagggccatcctgggaagattcttaggaaggatttgactacactggctcaggtgtggagtgtcctctcatactccaacttggcccccacatcacatacctctgatctgacagtggatagagctaggttgatctttggtcgagtctctcacttggatatgaacatagaagcattgatctctgtccagatgacctctatagcccagtctaacacttctagacttgggttccctgctttaatcaccgcattatgtcgggccagaggggttgtctctgacagccttacttttgagcgcctgagcccaatcattaacctggcctacatcaagaagaactgttggaaccctgaggatctaacagtctctatccaaggggctaggagggcgagggcaaggccagaggagcttccttctacttttgcagctcctactccagcatccacttcagcaaccccttctgtcccaattcaaacaaatttttag

SEQ ID NO: 4978 - DNA, 270 bp, Glycine max
  Peptide Sequence Number=SeqID_96663
ccaggagcccaaccttctccttctagagggtatggggccttcgcagcccaagagactgttcctgaggagccagcagcagagggggaggatgagctcacccctcctgagcctttttattttgatgcaggtgtacacatggctcaggaggaggagacttctacagaccagatcccagagccatccccaacacctatacctgatgatcccataccatctgcactagcttctgagttagagcaccctatctctcaagattcaccagccgcttag

SEQ ID NO: 4979 - DNA, 474 bp, Glycine max
  Peptide Sequence Number=SeqID_96664
atgacccaagagctagtagcccgcggagacaccttacggttatccgcacctcgtcattcggtgaccccaagtgtgattgatgagcagaggccaatgtggtcatctgcgccctttccggagatgtcagcatcttccggtggagactttttcaagtctcacaagatacgtaggagcaagagcattgcttttgtcggccgccccacaagatctgtcatattgaccatgaggtcatgtgacatgcggagacaaaatttggtcattctgcatccctttgccattcagacacagtcgtgtccgatggcgcgcagagacaaaatttggtcattctgcacccttgtgtcatccagaggcggcgggcccgatgacacgcggagataccttacggttatccgcacccttttgtcatccagaggcggcgggcccgatgacacgcagagacaaaatttggtcattctgcacccttgtgtcatctag

SEQ ID NO: 4980 - DNA, 124 bp, Glycine max
  Peptide Sequence Number=SeqID_96665
ggtgctgaaacactcgtgggtgctcaaagctcaaagctttctccgcgagatctcactgccattgtcactgtttgggttcgagcaccagtagagataactagtgataaggatcctgttattgtga

SEQ ID NO: 4981 - DNA, 207 bp, Glycine max
  Peptide Sequence Number=SeqID_96666
atgtatcgtgggccccgtggctcgttcggtgtagaaggtcgatcgaaagtcggcccgtgcgatcataccagcactaatgcaccggatcccatcagaactccgcagtttaagcgtgcttgggcgagagtaatcgaattcctgcagcccgggggatccactagttctagagcggccgccaccgcggtggagctccaattcgccctatag

SEQ ID NO: 4982 - DNA, 588 bp, Glycine max
  Peptide Sequence Number=SeqID_96667
atgcagttcataaatgaggagggtcttagaaagcctaaacctttggtgatatatttcaccagagacgcagctccccaaacacctcagtacccctcagtagttagacttgttccattcccctacaaaaacaaccacccagttccgtggaggtatgcgcctccaagcgaaaggaaggaagaagccaccgacatcagctcgttgtcgaccaaggtaaccaatatcacggggctgagtggcgtaacctgcagtggtcacatgttcgcaccccccgacctgccaacaccacccgcaaacgttaaagggaaggcgaaggtagcggaagaacaaagtgacaaagtgatccctactctggacgaggatattccagtaaaaagtctttcggggaaatgggatggctatggaaagaaagaagtatcgctagaggaggcagcccaagacatctccatagaaggctttggaggactcgtcaataacatcaccaccaacaactatctcgccttcgctgaagaaggaatccccgccgaggggagagggcataacagggctttgcatgtgttagtcaaatgcatggaccacgttgtggccaag

SEQ ID NO: 4983 - DNA, 386 bp, Glycine max
  Peptide Sequence Number=SeqID_96668
gtatggcgcctaccaggcatcctctggacccggataagtccaacagggccctgggatttcctgccttgatcacaggactctgccagtcgttcggagtccccgtcgcacctagcaaggtgattcggccgcccatcacccgagcttttattgagaagtattgcacacagagacaggcccagggggatgctccgcaggacgtagacgcgccgccacctcatcaggctgctccagccgaatcgtttgatacggagcagtatttgcggcatttggttcgccagcaggcggccaaccactgggctcttgtacaaactcatgattgtctttaccagatgagcctcagcctacagagccagggttttacttcttttccgtgtgtcataccctaa

SEQ ID NO: 4984 - DNA, 252 bp, Glycine max
  Peptide Sequence Number=SeqID_96669
atgggcgggcgcggcatcggcagcgcgctgctgacgcgtctcatcgcgcaatgtgaacaggggccgtggcggcagatgctggcgattatcggcgacggccacaataacgccgcctcgattgccattcataagaaatttggctttaccgttaccggacagctgcgcagcgtcggctataagatgggcgactggcgcgataccctaatcatgcagcgccagcttggcgacggcgactggacgttaccggagtga

SEQ ID NO: 4985 - DNA, 213 bp, Glycine max
  Peptide Sequence Number=SeqID_96670
atggactatgttcatcatgtggcagtgacagtttggaatgaagaggaacattctgagttgaagttgtcctcccatggaaggaaagtagagaaatttggtaggcctgctccaaagattgaagacttagttgctaccataggattaagtcctctgattgcatgttccttggacactaatgatcggagacttatatctgcttttgcggagaggtga

SEQ ID NO: 4986 - DNA, 80 bp, Glycine max
  Peptide Sequence Number=SeqID_96671
atgaccaagggaattaaacattttgaagtggttgccggaggtcgtatgctgacaaacaatggtctccggatgaaattagg

SEQ ID NO: 4987 - DNA, 640 bp, Glycine max
  Peptide Sequence Number=SeqID_96672
ctatgagcctgtttggaaaattatttatgagaggtgggatcatcagcttcacaggcctttgcatgcagctgcatattatcttaatcctcacctgcattatgaacctactttcagacatgatgaccctcagctgaaagaaggagggcttttctctatggaaaaggcaaaggacagtagaaaaatcatgcaacctggagaatggtgggagatgtttagtgatggaactccagagttgaggagatttgctattcgtgttttgagcttcacttgtagctcttctgggtgtgagcgtaattggagctcatttgaaatgttaaaaggtaaacaaaatagaaaaactattgctcttccatttgatgagattgaatctgacaatgaatggataactgaagagggatataatgatgaggatgagcaacctcaagctgaaggtcatggtgacaatgttgaattagtgggagatgttggaggaagttcaaatgatccagttgtagatgcttttaatctagataatttaattttcgtggaacctaatgatgatgcacagtctgaggaagaccttgatgatgatggagatggtgatgaaagtgatgatattcatggagatgatcctattataggattggacatgcttctttga

SEQ ID NO: 4988 - DNA, 752 bp, Glycine max
  Peptide Sequence Number=SeqID_96673
ggatatggcgaatcaagaggagtgggtcccgtttatggacgtattagcattgctaatctttagggttgtcctctttccaaacatggatggtttggtggacctagccgcaatcgacgctttccttgcatatcaccatagcaaagaaagcccagtggtagctgtcttggtgaacttatttgatacatttgaccgaagaataatcaactggtttcctcgatggaaggaaggaaaggagggagttctcttctcatgtggggactacccaaacatcccgttgatagggatgaggggttgtattaactacaatcccgcacttgctataagacagttagggtaccccatgaggggagcaccgacgaaagagagcctctctcttttccttgtgaaagatttcagcgtgagagataaagaacttaggggcatccataatggcatcatcggtggttatcatgaatggctgaaagttcgtacacgagggttagattggctctccaagttgaaaattatcaacgagcagaacttcgaagctccgaaagaggatgaagaagtccgagctctaaaaacagaactaggaaaagcaagacttgccaaagaaaaattcaagttagtcgctacaaacgtccggaaggagtgtgccgggttacgagaagaaaatgaagctaccgcaagagcccttgaacgagaaaccaagaaggctcgcaaggaagagtatggccgagacaaattccgtggagctttatggagcagcaaca

SEQ ID NO: 4989 - DNA, 426 bp, Glycine max
  Peptide Sequence Number=SeqID_96674
atgggatcaagtcaaacgccttcgcttaaaaataggttctatcaagtcaaggtcaaaagcctaggaatcaccagtttaaaagagctagggcaattgatgggtcagctccagcagcaagcttttcgcaaagcttacggtaaaatctgggacttagccatggtagaagtctccacagagtccattgcctccctcgcccagtattatgatcagccgttgaggtgcttcacttttggggacttccaactatcacccatggtggaagaattcgaagaaatcctaggatgtcctctagggggaaggaaaccatacctcttctcaggtccaaatctcggcgcaggaattagaccgccaaaagcaagtcgaaaatggggtggtcgggataacgataaaatgtttggaggcaaaagcaagaatcttggcaggtag

SEQ ID NO: 4990 - DNA, 393 bp, Glycine max
  Peptide Sequence Number=SeqID_96675
atgttggtgcgcatgatctgcactcgtctctttgcagcggcgtgggtgaaatcttgccccggtatgcatagtagctacgtgttagcctcctcctttggttgtgcttgcacagttggccttcctccaggattagggggtggcccaggaattgataaaaggaaactattgccctctaaaggcgagggcatgcaaccctctaaagtcgaggatgtgtcgccctatgaaggtgagggcgtgcagccctctgaaggcgagggcgtaagccctctaaaggtgagggcgtgtagccccctaaaggtgagggcgtgtagccctctgaaggcgaggacgtgtagtcctctgaaggcgtggatgtgtagtcctctgaaggtgaggatgtgtagccctttgaag

SEQ ID NO: 4991 - DNA, 916 bp, Glycine max
  Peptide Sequence Number=SeqID_96676
atgggtatgcctgcggccagagcttttgtggataaagcggctcacgatggcccaattcagtgtggcagtcctgacgttatcattggtggatttcccgccgcccgaaaaggtgatgaattttcctgtaagcaacatggtggcggtattatcgtcagcggctccggcagcgtattcgttaacggtatggcgctggcccgtcagggtgataagacacagtgtcatgcaggcggggcgtcggcacctgcgaaatgtaaacctgcacccccgcaatattgggggggctcgctggcgaagaaggctggtgaggatgggatgttgcatggtgagcactacgatgcgcgaattttaggagcgtatgccagcctgaaagacagtactaatgatggcagttatgacactgtgtcgacagggttttcactggaaaaccttacgatgggaaatattaaaagtcacgatctgtttagaggcgaattccgcaataaaatagcggacgctgatgcaaccggagctttttacaacggcgacagcaatatttatgggataaatggtacagccacagcgacgggtatgcaatatggtgttacaggagcggcagggagtgagggtactttgtatgcgaatgctaccggcgatgtaaccatagctactgctgatgcaaaagccactgcagaagtttataccggaaataaaggtcgctatgggttcaatcttggcggcggtggagggcttgcagcagtcaaagagaaagtaggcgcaaaggtaagcctgtttggcctggtgatagcaaaagcgaaagctgaagcgcatttgggggcggtaggggcgtcagcgggcgctgctgcttattttgataaaacagattattcagtcacgctaaaagctaacggcagatttgctgtattattggggttagcag

SEQ ID NO: 4992 - DNA, 726 bp, Glycine max
  Peptide Sequence Number=SeqID_96677
atgaccgaccctctcgatgagtcgatctcttgctttctcataaaggttgatccttgggtactagtacctatcacctttagaggactatatgtcctcgccatcagaggactgcacatcctcgcctgcagagggctgcacgccctcacctttagaaggctacgcatcctcgttttcagtgtgcttcatatccagaccttaggagaatataaggttattgcccttagatgcttcaccgagacttgcgctctcggtaaaggggccggtagtttcctttttatcagtttctgggccaccccctttgatattagagggcgacccaactgtgcgagcacatccagagagggaggctatcacgcatctactatgcataccggggcaagatttcaccccgtgcccgctgcaaaaagacgaggatcgcgcccacaagaccccagcgggcccgaagaagtccaacagggccctggggtttccagctctggttacgggcctctgtcagtcctacagggtgcccgttcccccagcgaggaatcgcacccacaaagacacccagtggacccggagaagtccaacagggccctggggtttccagctctggttacgggcctctgtagtcctacagggtgcctgttccccccggcaaggtcacgtcatcatagggatcgcgtctgtaaggcacccagtggccccgaagaagtccaacagggtcttggagttatcaagctctaa

SEQ ID NO: 4993 - DNA, 327 bp, Glycine max
  Peptide Sequence Number=SeqID_96678
atgaagagaagaagagaggagagggggttccctgagattaaggtgtcaaggcggtcgaagaaggccacaagtggaagcaaccgatgctttggtcattcagttgactccgccagtcaagctgagtcaagtcagagaaaagagacccctctcagagaaagcgttatcactatacgaaatatcggcctattcactcagctagggaataagactaacctaatttccctattcactgaacccaagactaagggcaaagagaacttcctttgctcccttccttcaacttataggatggaacccggactcctaactaaaccctcttccgattga

SEQ ID NO: 4994 - DNA, 123 bp, Glycine max
  Peptide Sequence Number=SeqID_96679
atgggtgccaagtacctcgaagtagtcaaacgagggtcgcatcctaacaacggatggtccccggacgaaattaggggatcaaaacccgaattagtgaaaatgaagggaccaatacctatataa

SEQ ID NO: 4995 - DNA, 261 bp, Glycine max
  Peptide Sequence Number=SeqID_96680
atgggtgaaaatgatataatcattgataaacagcacaggagtgactggaggagtggtagtcagtctcaggactggtgtgacagggtcatctggcatctcaagcactggggtaggtgtagacaaaggatcaggctgtatacaaaggatcaagctgaaagttttgatgatgccaaaggattacatgaattatatgcttctcaaagatttactcaagacaaagcaattagagatattcaagatgataatcaagacagtctatag

SEQ ID NO: 4996 - DNA, 675 bp, Glycine max
  Peptide Sequence Number=SeqID_96681
atgggaaatcagcagaggcaaggatacaaccaaggaggattttcaggtttccagcaaggtccctacaatcagcaagggcaatggagatcacaccctggcaatcaattcaataaggaccagggtggaccttccaacaggccacctcaacaagggccaaatttttttcagaggactaccaaactggaggagaccctagctcagttcatgcaagtgaccatgtccaatcataagagcactgagtcagccctaaaaaatcttgagatccaggtgggtctactggctaagcagttagctgagaagtcatccagcagctttggagcaaatattgagaagaatcccaaagaagagtgcaaagttgttatgacaagaagcagaaagcttatggctgctgaggataaggatattgttgctttgaaggaacaagttgttttgaaggacactactgataaagagaatgatgaggtaaaagatgaaaggagtcagtggagagaaaaacaaataattgtcggaaagaaagaaataaaagacaatgaaaaagaaataaagggagaaaaacaaaaagaaaaagaagaatttgaaaaatataaagaagaaaaaaaaagtaagagtgaaaaagcaagagaaaagagaaaagaaacaacttctgatgagggaaaggaaatgccataccctttg

SEQ ID NO: 4997 - DNA, 558 bp, Glycine max
  Peptide Sequence Number=SeqID_96682
atgcgcgagacatcgtggtttagtagttcaggagacaacatagagcacaagaacattgttagatctcctacaggtaatctagttcctctggatttggaaattgaagccactttaagaaggaacagagccaaaaggagaaagaaattgttgcaagacaggacagtagcttccattttagaagaagaagcttcatcctctgattttgcatcatcttattcaccgtcatcaagggaatccactacaaatttaccagaagcctctgtcatggctgaagaacatcaacacagggttacccttgaagattactccagtagttctgtgctgcaattctttacaagtattgtgcggccagatgtccaagcacataatataaactatcctcattctttgattcatctcatacacaggaacctatttcatggattaccaaacaaggtgatgcaatcctaccctgcaagggcattagatagaagacttcaagtagattgggccagagatgcaagagaaggccctagggttctcatgagccttagggtagatttcgggcccatgggctaa

SEQ ID NO: 4998 - DNA, 591 bp, Glycine max
  Peptide Sequence Number=SeqID_96683
atgagtgaaatagaggaggtgcaagagcagatgaaggtcaacatggaggccatgaaagagcaaatgaccacaatgatgagtatgagaaggatgatggaggtcaatgtagctatagttgttgccacaggtactgccactgaggtggacccgactcacccatctggcctcaaccaagtaaatcacccagcctcggatatggtaggtcagggaggcaaagcattgggaagtacgggcgacccccattttgtgcaggtccaaagcaagcattccttcccaccatatggcttgcctcccaactatacatcacccaatgttccacacactcccgatgagaatgttgacaactctactcccatacccactgagagccaacatccccaatttggtcttgcacaggtctctcaacacatagaggagacacgtgaagcatcccgagaccacaatctagtcgactttgagcctcacgtcggatatgccgcagagatccaaaaaagatttccagccaaccccttcacatcaaagccttcatccttcaagctttggaagtttatccatattctagggataaaccagtcctcagggaaagcttaa

SEQ ID NO: 4999 - DNA, 624 bp, Glycine max
  Peptide Sequence Number=SeqID_96684
atggtgaggaaatttgtacaagttggttgttgcatggacattggttcattccatcttagaagaagtaaatcattgtcatatgaggacaatatcctctacagtagaagctctccaactattggccaactcagtgcactagaaaccccatatgtgatcaatgtagtttacaaaagaaaaggtgaaacgaaatatattgagctggtagaggaggaacaggcacggattggtgctgattcttctagtgggacctccaataaatctgagaattataaggaggaagcacgaaatgcaacacaggagcataaaccaaagagggtggagagtgtcaatgctgatgcagaagcctttgctgcaccactaaaacatacgaagaaaagagatacacgccatcaaagtgtgtcattggacaataagacaggagattcaactgtactgaagataggaaattcggctaaagttgtgataaaacaagacatgaagggaagaaggcataaatatgggtttaacaacaacaaacgtgagaaggcagagaagaaaacggtggtggatgatgaaactggcgacaaacatcagctgcatgaagtcctaaggatgccatgcacatgtgtatttatgaaaatatag

SEQ ID NO: 5000 - DNA, 837 bp, Glycine max
  Peptide Sequence Number=SeqID_96685
atggtcaccaaaggttggagctttgttggacaacaatggtggatgagagaaaagaagaagaaagctgatgtcacaaggggagcgccaacagaagagaatctctcgcctttccttgtgagagattttggcgcgcaaagtctcaaggttatacaaagagtccacaaggcgtggacaagtctgttgaggaaagacaaagagctttggggcgtccgtaatggcatcatcggtgttatcagtgaggagaaattcgaagctccggaggaagatgaagaagtccaagctctaaaattagagctagggaaggcaagactcgccaaagaaaagttcaagtcagccgctagaaacatccggaaagagtgcatcgagttacgagaggaaaacgcggccactgcaagagcccttgaacaagaaaccaaaagggcccgcaaggaggaacatggccgagataaattccgaggagctttgtggggtagctacaatgagctcaagctccggagagaggaaagagaccagtcacaggtgcatggcatgatcttaaaagaagagttagctgcttgcgcaagatccaagaggagtttggctcaacacttggaagccacggagcaaagcatgctagctatcatagggcagtacaaggaagagttaaaccagtctctgacccatgaacaaaagttagtagaggatttcgcacaagtgtacgccaaaaaggaagcaagagggagggtgattgatgcattgcatcaagaagtgactatgtggatggataggttcgccttgaccttgaatggaagtcaagacctcccgcgactactagccaaagcaaaagccatcgccgaa

SEQ ID NO: 5001 - DNA, 306 bp, Glycine max
  Peptide Sequence Number=SeqID_96686
atgggggagacacatgaaattccccacctcaatctagccgactttgagcctttccttggatatgccattgaagggcaagcagttggtggtatacccctacaaaacactttggagggccctcaattttgcccccaaccacaagtgctcttcctatctttttttgatccagcaaaatctgaatctgagtatcctactaagttgcataaagaattcttaggataccataatcttaaactaactgttcctaataaatatcttataattctttttactgccattaaatgtgaaaactttggatctgattga

SEQ ID NO: 5002 - DNA, 625 bp, Glycine max
  Peptide Sequence Number=SeqID_96687
atggccccgaggaagcttgcctcaaagagatctaggaaggataaagcggctgaaggaaccagctccgctcccgaatatgatagccaccgctttaggagcgctgaacaccagcagcgcttcgaggccatcaagggatggtcatttctccgggagcgacgcatccagctcagggacgacgagtataccgatttccaggaggagatagttcgccggcggtgggcatcactggtcacccccatggccaagggtcaatggatcccatttgatgcagatgctatcggccatctcctgggatatcctttagtgctggaagagggtcaggagtgcatgtatggtcagaggaggaaccggtccgatgggttcgacgaggaggccatcgcccagttgctatgtataccggggcaggattttgcccggactgctgccgggagacgggtgcggatcatgcgcaccaacatgaccaccctgactcagatctggatgactttgctgctcagcaacatccagcccagcgaccataattccgacctccccctgccgaagtgtcagctggtgtacgccatcctgacacggatgagcattcacgtggctcagctaatcgttgatgccatctatatatttgcag

SEQ ID NO: 5003 - DNA, 736 bp, Glycine max
  Peptide Sequence Number=SeqID_96688
cgggtactacaacaacaccattttccatcgcgtgatcccgggctttatgatccagggcggcggtttcaccgctgacatgcagcaaaaatccaccaaggcgccgatcaagaacgaagccgacaacggcttgcgcaacctgcgcggcaccatctcgatggcgcgcaccgccgacaaggacagcgccaccagccagttcttcctgaacgtggcggataacgccttcctggatcacggccagcgtgacttcggctacgcggtgttcggcaaagtggtgaaaggcatggacgtggtggacaaaattgcccaggtgccaaccggcaacgtcggcccttaccagaatgtgccgaccaaaccggtggtgattctgtcggccaaggtgctgccccttgccttcatcactgttttctcccgcgcctcatgctctaatcggcagacaataatcagaccggaaatccggcgtgctgttgctgttgcagcagatgtgcgtctatctcgttatcgcctatctgctgagcaaaaccccgctgttcatcccgctgatgcaggtgaccatccgcctgccgcacaagctgctgtgctacgtgatcttctcggtgttctgcatcatgggcacctatttcgggctgcacattcaggattcgatcgccaacacccgcgcgataggcgcggtcctgggcggtctgctgggcgggccgtcggtgggctttctggtcgggctgaccggcggcctgcaccg

SEQ ID NO: 5004 - DNA, 358 bp, Glycine max
  Peptide Sequence Number=SeqID_96689
gttacaggttgtaccatttgtggtgaggctcatgaatcaggtcattgcattcccattgaagaacacactcaggaagttcattacatgggaaatcaacaaaggcaaggatacaaccaaggaggattttcaagtttccagcaaggtgggtcaactagctaagcagttagctgagaagtcatccaacaactttggagcaaataccgagaaaaatcccaaagaagaatgcaaagctattatgacaagaagcatgaagcttgtggcggctgaggatgaggatattgtcactttgaaggagcaagttgttttgaaggacactgctgataaaaagaatgatgaggtagaagatgagaggagttag

SEQ ID NO: 5005 - DNA, 207 bp, Glycine max
  Peptide Sequence Number=SeqID_96690
atgagtcaacatgttggaattcaaccaaagattgtttcaactttaagtcaaatgttggatgagtacaatatccatgcaaaaagttttagaatggccaaggacagattggcagatactcaagtcgataatactcaagaagggatattattgttgaaactcaaaatggagaattacaaagaatccatgaattacactctagctatctag

SEQ ID NO: 5006 - DNA, 552 bp, Glycine max
  Peptide Sequence Number=SeqID_96691
atgtcagccacgcaggcgaataattgttatatcccgagtatagccagagtgggtagcaaatgctgcaaaccgaagcccggctgtgagtcagatcatgggttatcgcttttttcgctcgcgctgaacgaaaatcatcgctggaaaaaatttaaacagatctcctacactgaaaatgagggccactcccgtccgggtagcgcgctcagcttttccccgctgcaggtaacgtcattgcggctccagccgggaggggaacatgatcagcactatcgcgcttttttgggctctgtgtgtggtttgtctggtgaatatggcgcgttacttctcatcgttgcgctcactgctggcggtgctgcgcgggtgcgatccgttgctgtatcaccgagcaagcaggtgcggctggtgcgctatatctgggagaaacgctatcgcgatcatcacgacgatgaatttattcgtcgctgcgagcgggtacgcggtcagtttgttctgaccagcgggctgtgttttctggtggtggtgagcctgatcgccttagcgatttggcactga

SEQ ID NO: 5007 - DNA, 312 bp, Glycine max
  Peptide Sequence Number=SeqID_96692
atggcacgagaatgcttcccaaatgaatatatgatgtggaattgcccctccagtgtagataaatggcatgaaagtttcttttcaaatgcaagtatgtgcgagacgaaatggccccgaggaaacttgcctcaaagagatctaggaaggataaagcggctgaaggaactagttccgctcctgagtatgacagtcaccgctttaggagtgctgtacaccaatagcgcttcgaggccatcaagggatggtcatttctccgggagcgacgcgtccagctcagagacgatgagtatactgatttccaggaggagataa

SEQ ID NO: 5008 - DNA, 432 bp, Glycine max
  Peptide Sequence Number=SeqID_96693
atggcagcgcagttgatccatgatcgtgtcgtgatggagtgcctaaagggtgtttgggagaccctcgaaggcaatgagaggtgtcgattccgtggcacaattcgactcactgctacttcgctagtacatccggagcaacccgcacgcacacttcagcaacctgtggagtggatactaccaacacctactccatatcgactagttgaaccagttcaagtgatagaggtgtcatcctctgaagaggatcttgaagagaacccagaggagttacctccagaacctgctatggacgcccttgacttacctgaggatgatgaagacccactccctgatgttgattctccagaggattttatgtcagcatctgaggcaaactctacagaggagagcgtccctggagggacaacgattagtgacgactcttcatcatag

SEQ ID NO: 5009 - DNA, 213 bp, Glycine max
  Peptide Sequence Number=SeqID_96694
atgcaaggtgctggaagcaccatcaagccaccacagagaagaagatggagctggaacggctggtcaaaaggctttcagaaaagtggcattgatgatggagaagcagctgagcaagaagatgaagcagccgaggaagaagaagaagctgctgaggaagaggaagatgcagcagaggatactgaatcagatgatgattccgaagccaccccatga

SEQ ID NO: 5010 - DNA, 155 bp, Glycine max
  Peptide Sequence Number=SeqID_96695
gaatcacgcccgcaagacacctagtggacccaaagaagtccaacagggtcttgaggcgcaaggcgagacaccacagcagcctggagatggccggcagcgagcaacaaatgcaccgccaccacctctagagttcacctcagctcatccacaaaaag

SEQ ID NO: 5011 - DNA, 471 bp, Glycine max
  Peptide Sequence Number=SeqID_96696
atgaaacaaaatgagtttgtctgggagccttacacagcaactgtgatggcagcgtcgcctctaatttgtgtggttggaagtgtagtgtggttcgcggtggtgccactaatttgtttccatgttgttgagtggcaccaacccgatagagttttgcgacaatttggaatgcaacaacctattcccgggtgtccttcgcaatcgcagaatctccatggcataacgctcaaaggcaaacaagatgaaaattggttccagctattggccccaatgatcagtcaatggaacaatcgagctgagtttagggtcgacgtttatcctcgacaggagggcctactgagttttaactccgactacatggtctggtataggcgtaaaacaaagatgtttgtcgacccaaataatgcaaacacaactacattgggtgaagttgtgtcaccacaagggaggaacacattgttgttgtatgtatga

SEQ ID NO: 5012 - DNA, 375 bp, Glycine max
  Peptide Sequence Number=SeqID_96697
atgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaaaatttaggaagtcgggcggcccccatgatgtgcaaattcaaaacgagcacgccttcccgtcatatggcttgcctctcaactatacgccacccaatgtggcgtacactcccaataagaatgtcaataactccactcctatacccattgaaagccagcaaccccaaactgatcatgcacatgtctcttaaaccgtggaagagactcatgaaattccccatcacaatctag

SEQ ID NO: 5013 - DNA, 607 bp, Glycine max
  Peptide Sequence Number=SeqID_96698
gtacttagggacggacgcaagtagaggctatggtcacgaccgatggattgtcgtcccttgcccagctctgggaaattggaaagcactgctgcaaggcaacccaaaaatggcttcgaaaaagcttttcgcgaagagatctaggagggacgccgcggctgaagggaccagtgccgctcccgagtttgatagccaccatttcaggagcaccgagcaccagcaggacgatgagtacgcggattttcaggaagagatagctcgccgacgttggacgtcgctggtcactcccatggctaagtttgacccagatatagtcctggagttttatgctaatgcttggcccacagaagtgggagtgtgggggatgcggtcatgggtgaggggtcagtggattccctttgacgcagatgccctcagccagttcctgggtgacccgctagtgttagaggaaggccagaagtgcgagtttagtcagaggaggaacagggccgatgggttcaccgaagaggccattgctcagctattatgcatatcgggtcaggacatcgctcggaccgctgcagggaggcgggtgcggatcatgcgcaccagcatgaccaccttgacctag

SEQ ID NO: 5014 - DNA, 528 bp, Glycine max
  Peptide Sequence Number=SeqID_96699
atgtcgatctccccctacggaagtatcagttgggatcacacccacaagacacccagtggacccggagaagtccaacagggccctggggttttcagctctggttataggcctctgttagtcctaccagtgatcgcgcccgcaagacacccagtggacccggagaagtccaacagggtcctggggtttccagctttgattacgggcctttgtcagttctgcggagtgcccgtcgcccccatcaaggtcatcaagcccccgattaaccgggctttcatcaagaagtactgcgccccccaggcaggcgtagggcgagacaccacaacagcctggggatgccggcagcaggcaatagacgcaccgccgccacctttagagcccctcagctcatcttcaaaggctagagcgttgcctacgacccgtggtcgaccagcgggcgacaagtccaaagccaaaggtaagcaaagtactaggtctgtgactgacaagtcatcacgcgtccagctcaagacgttaaagaagcgctactag

SEQ ID NO: 5015 - DNA, 144 bp, Glycine max
  Peptide Sequence Number=SeqID_96700
atgaagtcgctgagaggtaaagagatcgcgttggtgaaagtgcagtggggacccgacgatggtgattcaacttgggagttagaggataggaagtatgtacattgggggagaaatacgcgggttagactaattaacgaagagtaa

SEQ ID NO: 5016 - DNA, 1113 bp, Glycine max
  Peptide Sequence Number=SeqID_96701
atggtcggccagcgcctggatgacctgaagctgcgcgaacggtatggcgcgaacgtgatcggcgtggagcgctggcgtcgctttcgccgggtcatcgtcaacgtgaacggggtgtccgaattccgggcgcgtgacgttctgctgatcgatatgtccaccgcagaggtcgatctgcgtgagttttgcagtgagcagctgctggagccgatggtgctacgcggagagtatttctccgaccaggcgctggatgtgggtatggcggaagtgtcgctgatcccggaatcggaattgttgggcaaaaccgtgcgtgaaatggggttccgtacccgctacggtcttaatgtcgtcggcctgaagcgtgatggcgtggcgatggaaggggccgtggtggatgagcctatcctgctgggcgatatttttctcgtggtgggtaactggaagcttatcagccagctcggccaaaaaggccgcgattttgtggtactcaacatgcccgttgaggagagcgatgcctctccggcccacagccaggcgcctcacgccattttttgtctggtgctgatggtggcgttaatgctgaccgacgagatccccaatccggtcgcggccattattgcctgtctgttaatgggcaagtttcgctgtattgatgccgagagcgcctataaggcgattcactggccaagcatcattctgattgtggggatgatgccgttcgcccttgctctgcaaaaaaccggcggtgtggatttagtcgtcaaagggctgatggacgttggcggcggatacgggccgtacatgatgctggtatgcctgtttatcatgtgcgccacgattggactgtttatctccaataccgctacggcggtgctgatggcgcccatcgcgctggcgatggcgaaatccatgggcgtgtcgccgtatccgtttgcgatgatggtggcgatggccgcttccgcggcatttatgacaccggtgtcgtcaccggtgaacacgctggttctggggccggggaactaccggttcagcgattttgtgaagctgggggtgccgttcaccgtgctggtgatgctggtatgcgtggtgttgataccggttttattcccgttttag

SEQ ID NO: 5017 - DNA, 654 bp, Glycine max
  Peptide Sequence Number=SeqID_96702
atgacccatcccgtcccctcacaagcagcgagcacgatcacgcgaagcgctccgctggccatgcccgcaccgtcgctttccctggacatcaaggtcctcatcggcctccttctcttttcggtggtctggctgctgcagatcgacagctccagcctcacggcacccaaggacaacctcgagcagctgacctgggtgcacagcctggaatggggctactacaagcatccaccgctgccgacctggatgttctcggtgccggtcaatgtgttcggactgtctgcccgcaccagctatgtgacgggcgcgcttttcacgctggccggcctgcttgtcttctggaagctgatgcagaccttgcgcggcagccgccatgccacgctggccctgctggcggccctgtgcatcacctactacaacgagcggctgcacttcttcaaccatgaagtggcaactgcgctggtgggccgccctgggctgctgcctggggctgggcgcactggccaagtaccagatgatcctggccgccgtggcggtattcctgttctggctggcgtcaggcgcctggcgcgagcgggtccacatgatcggcctggtgctggcggcggccatctcgctggccatcatctcgccgcacctgtactggctgtttcctga

SEQ ID NO: 5018 - DNA, 348 bp, Glycine max
  Peptide Sequence Number=SeqID_96703
atggcgagcaacctctcaaaagctcagaagaaagccaagagttccaaaaggaagcaagatgaatgctctcgagctgctctcgataggttggacacatgcaagggttcaatttccctaatatgctggaagcacaagaaagaagtagccggtctggacatgggtggagtctacaagttcgaagaaacaactgatgggtacagcaagatgcaaacctataagggaatgcttcttgaccctgcaaagaacttgaagaatctcctaagagtaggtggcctgactaccgaggacaaaatgcttgtctacctcattacctacattctcactccaaggtcaagtaatcacgcttag

SEQ ID NO: 5019 - DNA, 405 bp, Glycine max
  Peptide Sequence Number=SeqID_96704
atgaccggaaggcttctttctggttcattggctcttgaaagccgcatcctccattatctatttgtccgtatcttactccccagatcttcaaaccttgcacaggcctttcatactggcagacaaattgattgggcatatctagtctggtatcgcatgcataagtcattgcgattaaatgctcctttaccctatccatacttagttactttgttccttcaacatttgaacatccctcttgattctgaaccatatgttccaatcaagagatctttcttgatcggtgcagttgtggttgcctcctttggttaccgcaaagagcgtgatgcctcttgggtaaaaaagggtgctcagccaaatgatgatgaaggaaacttaccagttgaaagggactcttctctcctttag

SEQ ID NO: 5020 - DNA, 702 bp, Glycine max
  Peptide Sequence Number=SeqID_96705
atggggcagggacagatcccggcctacggcctgacgccgccctgtattcacggtatttctctcaatacgccagcgtgggcgcagcagacgcaggcgcaacgtaacgcggcagcgaagcagctgctggcggaagctggcttcaatgcccagcatccgctgcgttttactctgctgtataacacctcagaacagaacaagcgtcaggcgattgcggctgcctcgatgtggcaaaagaatctcggtgcgcaggtcacgctgcaaaatcaggagtggaaaacgctactggagacccgtcatcaggcacagtttgatgtggtgcgcgccacctggtgtgcggattataacgagccatccagcttcctcaatctgctgctgagtggctcctccatcaacaccgcgttttatcacagcgccgcatttgatgcgctgatggcgcaaacgctcaacaccgcagatgacgcgcagcgcgcgcagctctatcagcaggcggaacaacagctggatcaggattcaccgatcattccggtttactaccgcgttagcgtgcggctggtgaagccgtgggtgggcgtcgggcgtcacgttgccgtggtaaccctgcagggtggtagtgatcttcgcgcagacaggcggagatctcccggaaacggggtacgccgggcggtcagccgacccggtgacgataataaaactggagcgtaa

SEQ ID NO: 5021 - DNA, 487 bp, Glycine max
  Peptide Sequence Number=SeqID_96706
cttgctaagcgaggtggttgtctcttctacactaagcgcaagattggcgctaagccaaatatcacttactcgcgctaagcgcgcctttgagaaaacagaggaaaagctgagcaaggaagcaaaggtcctaacttttaggaactttagcattgacaaatgtattgtttcctcgaaacttgatagagcagggctagataactgtagtgctagacatagtgtgcaggttgaatctctgttgagagaaccattccaagttcagaaacttcgaactcacattcttcatgacataaatcatcttgaagttagtcttcttattctcgtctgtgaaccaaatatccaacctattgagagttgcttgagagcactctcattgcttccttttcgaggacttggctttcttctgagctttggcaggattgctggccatttttcagaacaaggcttgaaggtagaagaaaggttagggttttggaagaggcaactttga

SEQ ID NO: 5022 - DNA, 126 bp, Glycine max
  Peptide Sequence Number=SeqID_96707
atggctcgtgagccgatggttcaagttggtgaccggctcagacgagtatgcaagtaccgcaggtggccagaatggctagcggcacagcgtgccccgcaggtgaagcggggtggccagaatggctag

SEQ ID NO: 5023 - DNA, 201 bp, Glycine max
  Peptide Sequence Number=SeqID_96708
atgaagatgaatgacagtagaatagagaaggaaaagagagagaggagacgccacttcaaggagaagatgagtctagaagaagctcgccaccataggagaccatggataagagcttggaggaagaaggagatgaatgaagggagaggaagagaagagcacaaaattttgtgctctaaaagagctctaaaatctgaagtttaa

SEQ ID NO: 5024 - DNA, 207 bp, Glycine max
  Peptide Sequence Number=SeqID_96709
atggggaataagtgggaagtaagaaaaagcagtaggctcatttggctagaggcttataagaacaaaatgcctaaatcatctcccaacatgcatgtgaagcaagaagtatcaacaagagtcaagccaaggctattgtgcaagcaatcaatggggcaaaacacactgaataaaatagatgatgatggctcaaattctcaccaagggtaa

SEQ ID NO: 5025 - DNA, 69 bp, Glycine max
  Peptide Sequence Number=SeqID_96710
atggtggaagagccaattgactatatttggccctatcaaggtcttctcacccacctcacaccaacataa

SEQ ID NO: 5026 - DNA, 387 bp, Glycine max
  Peptide Sequence Number=SeqID_96711
atggtggaagaatttgaagagatcctaggatgtcctctagggggaaggagactatacctcttctcagggttctatccctcattagctagaatttataagatagttcaaatctcgacacaggaattagaccacggaaagcaagtcgaaaatggcgtggttggaataccgagaaaatgtttggaggcaaaaacaaggatattggcaggcagaggtgaatgggccccgttcatagacatcctcgcacttttgatcttcgggggagtcctctttccaaatgtagatgggttggtggacctggcagcgattgacgctttcctcgcctatcatgaccgcgaggaaagcccggttgtcgctatactagccgatctatatgacaccttcgactaa

SEQ ID NO: 5027 - DNA, 674 bp, Glycine max
  Peptide Sequence Number=SeqID_96712
atgaagatcggatttgccggactgggtgggatgggcagcgccatggcggccaacctgttacaggcgggcttcgccttaacggtatggaaccgctcgccgcaggcggcgcagccgctggtgagcaccggcgcgcagcaggccgaacggccggagcagctggccgatgccgacgtgctgatcaccatgctggccgacgatgccgccacgcaacaggtggtggtcgacagcgggttgctgcaacggatgaaaccgggcgcgctgcatatcaatatggcgaccatctcggtcgaactcgccaagcgtttgacggcgctgcatgcggaacacggcatcggctatctcgccgcgccggtgctggggcgggtcgacgtggccgccgccggcaagctgaatattctggcggccggcgatagcgagctactgaagcaagcgcaaccgctgttcgatgccctcggccagaaaacctggcacttcggtgccgatccggcgcaggccaacgtggtcaaaatcgccaccaactttacgctggccagcgccattgaagcaatggcggaaggcagcgcgctggtgcgcaactacggcgtgtccggcgccgactacctgcagatgctgagtagcaccgtcttcgccgccccggcctatcagggctatggcgcgctgatcgccgccgagaa

SEQ ID NO: 5028 - DNA, 97 bp, Glycine max
  Peptide Sequence Number=SeqID_96713
atgggagaaactaaaaaaccaaccacaacacagagaagaaaaggaacgaaagctcctgatcaaggatcgaaagaaaacagacgacatatgcagaacg

SEQ ID NO: 5029 - DNA, 139 bp, Glycine max
  Peptide Sequence Number=SeqID_96714
atgacgggaagacgcactctggtgtgcagttatcgtgccacggtaaacgctggagcctccggtagcacagccgagacagcgatgggttctctgccccagcggggatggagcgaaagaagttttgagaattcaagagaag

SEQ ID NO: 5030 - DNA, 371 bp, Glycine max
  Peptide Sequence Number=SeqID_96715
ggtacatcctttgtggtacaagtagagggtacatctacttgggtttgactgagaacaagagagggtacatctcttgtggatcagttctagtggagggtacatccactaggttcaaagagaacaagggagggtacatcccttgtggatctttgcttgtggccatcttggcatacagaggacaactcacaaggtgcttgactgcggtttctattggcccaccatcttcaaggatgcgtggagaatctgtagtacttggtatagattttatggggcatttccctgtctctttcggtttagtttatattctccttgctgttgattatgtttcaaaatgggtggaagccaaacccaccagaactaacgatgctaag

SEQ ID NO: 5031 - DNA, 164 bp, Glycine max
  Peptide Sequence Number=SeqID_96716
actcatcttctccttgaagtggcgtctcctctctctctccctttctccattccactgccattcatcttccaagaagcaaaggaatccattgatgatgaagatcctaggcctacaagctccaatggagattgcatcatagagtttttaggataccataatcctag

SEQ ID NO: 5032 - DNA, 51 bp, Glycine max
  Peptide Sequence Number=SeqID_96717
atggacacccgtctccgtgtgattggtgatcccatgaatggagtacaacgg

SEQ ID NO: 5033 - DNA, 241 bp, Glycine max
  Peptide Sequence Number=SeqID_96718
aacaagatatgtgaggagatacatggagaaaaatgaagaaacaacaatggaagagaagggtgggatctttgagcttcaatggggtcctttaatggtgattttccaccatggagatgcagcggaagacaaaggaaaggagcttggagaggatgcttcaatggaggaaaagaaagagggagagaaagagggaggggggagcacgaaattgaaggaagaaaaagggagagaagttgaactttga

SEQ ID NO: 5034 - DNA, 216 bp, Glycine max
  misc_feature (178)..(178): n is a, c, g, or t
  Peptide Sequence Number=SeqID_96719
atggaagacacacctgtgagcctcgcctcactcgcccgtaaaaaggtaggttgcaacaaccttaaaacatttcttttaagtgatttttatggacaaagcttgatttggaaaaaaaagggaggtggttgccgcccagctcgcccaagcgagctgggttgcttccaccagaaggcaccgncttctgttggaaccccctggaaggcccaagtgggcctg

SEQ ID NO: 5035 - DNA, 287 bp, Glycine max
  Peptide Sequence Number=SeqID_96720
atgcatctgagccataagcatttcttcatgcattcatccatttttcccgtaaccgatgtcggagtcttgatttgcacaggcgcctgggctcaaaaagaggttctatcaggtcaagatcaagagcctaggagtcgccagtctgaaaaagttagggcagttgatgggtcaactccagcgatgagcctttcgcaagacctatggtgcttcaccattggggactttcagttaacacccacggcggaagaatttgaagagatcctgggatgccctctgggaggaaggaaacc

SEQ ID NO: 5036 - DNA, 444 bp, Glycine max
  Peptide Sequence Number=SeqID_96721
atgactagaggcaatccatctgacttacaaccctttgatcctgagatagataggacatttcatagattagttagacatcatttagtaccttttgagcatcctgagcatgctgttattggtgattttgaacattattgttttgaacattctgagaacattgcacaacctccaccccgtgagaggactctaagggaaatggttgcacctgatttcacctatgaaagcttatgcatccaataccctgatgaggatgtcccatatgttcttaaaactggactaatccatttgcttccaaagtttcatggccttgcaggtgaagacccacacaagcatctgaaagaattccatattgtctactccaccatgaaaccaccggatgcccaggaggatcacatatttctaaaggcctttccttattctttagagggagtggcaaaggactag

SEQ ID NO: 5037 - DNA, 327 bp, Glycine max
  Peptide Sequence Number=SeqID_96722
atgtgggccatcatcgaccaatacaaagagaagctaagtctagtggcaacccatgaacaaatgctagaggacgagtatgcgaaggtatcagtcctgcaagcagaaagggaagcaagagagagagtaatcgattcattacatagagaagcaatgatgtggatggataggttcgctttcaccttgaatgggagtgaagagcttctgagatttctagtcaaagcaaaggtgatggtggatgtatactcagcccccaaggaagtgcacgggctcctcgattattgtcagcacatgatcaatctgatggcccatgtagttaggaatcactaa

SEQ ID NO: 5038 - DNA, 733 bp, Glycine max
  Peptide Sequence Number=SeqID_96723
atggcttctaggaagagaaaggcacctgcctcagcatcccaggccttctatgaccgccatagattcacatctcaggaggcctgggatcgctactctgatattgttattggcaggaaaatattgcctgagaggaatgttatgctctatgatactgagtttgatgaattcactgaagaactagaacacatgaattggcacaaggtgttgacaaacttcatggatggcatcattgatgtggccattatgaaggagttctatgctaacctctatgatcccgaggataaattacctaagaaggtgagggtcagaggtcacttggtgaaatttgatgcagacactttgaacacttttctgaagacccctgtgatcattgaggagggggagaacctatctgcctattctaggtacagtcagttgaggccagatccacaggaactggcaaccagattatgcatccctggcaagggatttgaattaaatgatgatgggctgcctctgaagatcctgaggaagaatctaacccttcttgctcagacttggagtgttctttcattctccaacctggtccttacttctcacacatcagacattacactggatagggccaggttgatctacgacattattcagaagatggacatgaatgtgggacatatcatctcgagtcaaatttctgtgatagctcaacatgactgctcgaggctgggtttccctaccctcatcactgctttat

SEQ ID NO: 5039 - DNA, 282 bp, Glycine max
  Peptide Sequence Number=SeqID_96724
atgcagaagacgatgttagtctctgcgcgtcaacaggctcgtttcccctggttgacgaaaggtgcaggagacgacgagacgacgttagtctctgcgtgctactggacattgagtctgacggatagcaaaagagtgtgtccgggttaccctatagggcgtctccgcgtgccaatggactcttgggtcatggtaacaaaagatggggtggtcgacaaaagcggggcttttactcctacgtatcctcaatttgtgctgaagaattcagacctgcgtagttcttga

SEQ ID NO: 5040 - DNA, 201 bp, Glycine max
  Peptide Sequence Number=SeqID_96725
atgcttgtttttcctataaataggcgtgaagggaggctgatcaaggggttccaaggctcaaaagtggagagaattgagagaagagagaaagaagaagaagaagaaagaagaggaaacaaagccgaggcgctgccgaatcacgattgtgaccaatccttacatcgttcctttttcggtgttcatcatgcaaccatcagttag

SEQ ID NO: 5041 - DNA, 516 bp, Glycine max
  Peptide Sequence Number=SeqID_96726
atggagaggagtatgattgatgctgccagtggtggagctcttggtgatatgactcctgctgaggctaggaatctgattgagaagatggcttccaactcccaacaattcagtgcaagaaatgatgttattgtccttagaggagtccatgatgtggccacggattcatcttcatctgctgaaaataagaagcttgagggaaaacttgatgtcgtggtcaacctagtaactcagcttgtcgtaaatcagaaatttgcacttgttgcaagtgtctgttgtttatgttcttctgctgatcaccacacagatctctgtccttctttgcagcaatctggattcaatgagcaacctgaagcctatgcttcaaacatttataatagaccccctcagcagcaaaacctacaacagcagaataattatgatctttcaaacaaaagatacaatctaggttggaggaatcatccaaatctgagatgggcaaatcctccacaacaacaacaacagcagcagcaacaatag

SEQ ID NO: 5042 - DNA, 123 bp, Glycine max
  Peptide Sequence Number=SeqID_96727
atggcgttgccctgcctccacaaccccgttcatctttggccgatagggggtggagttatgatgctggatcttgaaatccctgctcatttcctgcatcattttgttattcagattggtgccatt

SEQ ID NO: 5043 - DNA, 495 bp, Glycine max
  Peptide Sequence Number=SeqID_96728
atgggggttttcccttttctgctttgtagcctttctgcaatgccaggtgccaacttgttggcaatgggttcctcatcagattctacctcttctagatcaatgaggtcacctggagcaggttctggtgcccttggtgcaggggggacttcagcatttggggtggaagatgttggaacatctttgtcagcatcagggacagaaacattcgggctggaagatgttggacatcttcatcagcatcagggacagaagcatttttcagaatgctactcacaagactgcggatcttctgatccatctcatttctcaggaacagggcctggaccaggaatcatttgtatgggttggatattgaattcgggttgttcctggtttgatggagttttggaggatgatggagatgatggtacagagggtgaaacaggggatgaggcttcttttggtgaggtagccatggagaagcagagcttttggagtggtttcgtgaatatctga

SEQ ID NO: 5044 - DNA, 210 bp, Glycine max
  Peptide Sequence Number=SeqID_96729
atgtggagccctcagaaagtgaggatgcatagtcctctaaaggcgaggacgtgtagccctctgaaggtgagggcgcgcagccctttgaaggtgaggacgtgtagtcatttgatggcgaggacgtgtagtcctctgaaggtgagggcgtgcagccctttgatggcgaggacgtgtagtcctctgaaggtgagggtgtgcagccctctgaag

SEQ ID NO: 5045 - DNA, 288 bp, Glycine max
  Peptide Sequence Number=SeqID_96730
atggtagccataaccccagccaaggctcctcaacctccatttttccaaggatacaactcgaacgcaacatgtggttaccatggaggagtttcggggcattccattgagcattgtaggacctggaagcgtaaggctcagcccgcatccaccgtgatgagagaatctagaagagcacaagaatcaaggccacacgctaagtgcgagatcagctcgttaagcgagacgttcgtctcttgccaggctcaacgcacaactggcgccaagcccaaatccacttactcgcgctaa

SEQ ID NO: 5046 - DNA, 1269 bp, Glycine max
  Peptide Sequence Number=SeqID_96731
atggtctcccgtaaaagaaaggcacctgtttcagcatcccaggaccgctatgacagatccaaattcacatcccaagaggcctgggatcgctattctgactttgtaattggtaggaagatccaacctaaaagaaatgtaatgatttatcatacagagtttgatgaatttaaggcagagttagagagaaagaactggcataaggaattgatgaatttcagggatgggagcattgatgttgcattagtaaaggagttttatgctaacctatatgatccggaagacaggtcacccaagcaagtacgggttaggaaccatttgattaaatttgatgtagatgcccttaacacctttctaaagacccctgagatcatacaagaaggggagaccatgactgcttactccaggtttgcccagctgaggctagatcctcagcaattggtagctaaattatgcatccctgggaggagatttgagttgaatgctaatggtctaccactaaaaattttgaggaaaaatttgaccaccctcgctcagacctggagcgttctttcattttcaaatctggcccctacctctcatactttagacatcactcttaacagggtcaagatgatatatggcatcatccaaaagatggttatgaatgttggctacatgatctcagctcatatttccatgataactcagcatgactcctcttggttgggtttccttgcactcatcactgctttatgcaaggccaagggagtcacttcagattcactatcttttaagagtctcagtccaaccattaatttggcttacatgaagaaaaactgttggaacctcgatgacccctcagtcacttttagagggcctcgcaaggccaaagggaagaggtcagagactctcccatcttctaagattcccccatcagcagctccttccattacagttccagcttcttctgccccatatgcatctgcacccttaccaactcctattacagctcctcctataggaccatcttcctttacttcagagacattatatgctatgttgcagagcctacacagagtacaggtggcttggccaggagtccagccttctccttttggaaggggtgaggccttcgcagcccaggagcttgtgccagtagcaaaggatgagcttattcctcctaagccgtttatcattgagactaatccagtcattcaggaggaagcagcagctcaggagcctatttctccatttcctatctctccaacacccattactgatgattcctag

SEQ ID NO: 5047 - DNA, 330 bp, Glycine max
  Peptide Sequence Number=SeqID_96732
atggctccattatcgtcactccaaaatggtcaagtgactaaatcaaacagaacatacactctgagggagttcccggagagatttgcaaaaaataggacaagatttcctaaatctaatgtccaaacttttgagtttgggatgagaggcccgtttgatgagtcaatctctggtatgagagggttgtacaacctcgccttcaaagggctacatgtcttcaccttcagagggctacacgtcctcaacttcagagggctacacgtcctcgccttcagagggttgtacatcctcgccttcaaagggctgcacgtccttgccttcaaagggctctag

SEQ ID NO: 5048 - DNA, 957 bp, Glycine max
  Peptide Sequence Number=SeqID_96733
atgaataatattctgtcaaaatgggttcctgtgtcagagagaagtagatcactagcgctggtctacagtggcatgtatcttggatcagtcactggactggccttttctcccttcctaattcatcagtttggatggccatcagtattttactcctttggttctctagggacagtctggtgttctgtgtggcttagtaaggcacatagttcacctcttgaagatcctgaactgcggcctgaagaaaagaagctcattactgccaactgttcctccaaggaacctgtgaaaacaataccttggcgattaattttgtcaaagccaccagtctgggctctgatagtgtcccatttttgccacaactggggaactttcattctacttacatggatgccaacatactataaccaagtcttgaagtttaatcttacagaatctgggctattttgtgttttaccgtggtttataatggctatttctgcaaatgttggtggttggattgcagacactctagtgagcaagggtctatcagttacaagggtccgcaagataatgcaaacaattggatttctcgggccagctttcttcttaactcaattgagccacgctaattctcctgtgatggctgttttgtgtatgacatgcagtcagggaactgatgctttctctcagtccggattgtattcaaaccatcaagatatcgcccctcgatattctggcatattgcttggtttatctaataccgctggagtattggctggtgtctttggaacagcagcaacaggttacattctgcagcatggctcctgggatgatgttttcaaggtttcagttgggttgtatttggttggaactgtggcttttgtgcctcacagaatggtaaattttgtggatagaggagcattggagcatatagatcagagggatgacaatgtgtccttgaaagaggaattggcataa

SEQ ID NO: 5049 - DNA, 306 bp, Glycine max
  Peptide Sequence Number=SeqID_96734
atgataacaaaagatgatgacaaaggtgatgacaaaaagctcaatgagttcaagatgttcaagatagaatcaagaacacttcaagattcaagaggaaagttgatttcaagaatcaagaatcaagattctggagatcaagattcaagactcaagattcaagaatcaagagaaggcttaatcaagataagtgtgaaaaagttttttcaaaaattaagtagcatatggatttttctcaaaacatgtttatccaagagtttttactctctggtaatcgattaccagattgttgtaatcgattaccagtag

SEQ ID NO: 5050 - DNA, 354 bp, Glycine max
  Peptide Sequence Number=SeqID_96735
atggtaaggaatgcacatagatcaaaatgtcctaactctcttaaaacagttcccagtggagtcgccaactctcgcaacctaccctttggcaggagggcgacgggaggcacacgggtgcgtcttccaaggaaggaaggcgcgcggagtcgccaccaacgtttattcgaggaaaatgtcagaaaaagcaaaacgtgtgatctacgaactttaattgtgaaaggttcgggagttgtttttacgcacggggaaggggtggtcgacaaaagcggggcttctgctcctacgtatcctcgatttgtggtgaggaactcggacctacgtagttcttgcaaaaacggtaaagttacgtgttga

SEQ ID NO: 5051 - DNA, 279 bp, Glycine max
  Peptide Sequence Number=SeqID_96736
atgacgcagctgaagaggtcttccaacatgttgaagaagctcgtgttgatgcccaggattttccaggtgggttgcgtgattgtctatgttgatcatgttgcagttattgtttggaaaggagagttatcctcccttggaaggaaggttcagaaatttgggaggcctgatgctgagattgaagggttagtcgttgccacaggattaagtcctttgatcgcttgttcattgcacactggcgaccggggactttgttggatcaagtggccttggaataattaa

SEQ ID NO: 5052 - DNA, 312 bp, Glycine max
  Peptide Sequence Number=SeqID_96737
atggaggccataaaagagcaaatggccacaatgatgaaggccatgatgagcatgaagaagataatggaagccaatgcggttatagtcgccgctattagcgctgtcgctaaggtgaacccgatgctcccatctggcctcaagcaaataaatcatccaacctcaaatatggtaggcaaagatttgggaaggcaagcagttggtggtataccctttgaaaacactttggagggccctcagtttcgcccacaaccacaaccattgcattttgcggaagagcccctcctgctatggccgaaaaggcggatcatctaa

SEQ ID NO: 5053 - DNA, 205 bp, Glycine max
  Peptide Sequence Number=SeqID_96738
gtcattaatggagttagagttggagatgaagctgagaagaagattactcttgtgatgaagagagagaggagatgccacttcaaggagaagatgagtctagaagaagctcatcaacataggaggccatgcataagagcttggaggaagaaggagatgaatgaagggagagggagagaagagcacgaaattttgtgctctaagagag

SEQ ID NO: 5054 - DNA, 210 bp, Glycine max
  Peptide Sequence Number=SeqID_96739
atgttaggattcacaagcgattctcctcaaatttcagccagcccgcatcaattagactttgcaccttatgcttcagggccctacaatgctcaatggaatgccctgaggctcctccatgataaacacacgttgtgtttgagtcgtatccttagagaaatggagattgaggaacctagcaggggttatggctaccattgcattatcaagtag

SEQ ID NO: 5055 - DNA, 180 bp, Glycine max
  Peptide Sequence Number=SeqID_96740
atgtttgctagtggtaattgtggcttctcgggagaattgatgaatgcatcaaagatgcacttgctattgctagtaccaccccggactgtggaacaaaggagtatcccgaacctacaccgaggtattgacggcgattctcaaatatcgcagaacagaacagaatgggatacgatgagatag

SEQ ID NO: 5056 - DNA, 219 bp, Glycine max
  Peptide Sequence Number=SeqID_96741
atgaccaaacttggtctctgcttgtcatcgggcccgccgcctctggatgacaaaagggtgcgaataaccataagtctccatcggaaaatgctgacatctccggaaagggcgcagatgaccatattggtctctgctcgtcaatcacacttggggtcactgaatgacgaggtgcggataaccgtaaggtgtctccgcgggctaccagctcttgagtcatga

SEQ ID NO: 5057 - DNA, 261 bp, Glycine max
  Peptide Sequence Number=SeqID_96742
atgagccatgggcgttttgtatcaacgaaggataaagaacgcattcgacaagaaggtacgcccgcgcaagttcaacgagggggacctcgtaatcgaggcaagtgggccccgaattatgaaggacctttcatgcaaggagcagaatcgtctcaggtcaaagttagaagtcaagacaagttgactgcgaaaatcaaccaaggtacatggggacggatgcaagtggggatagaccgaccgatcgttgccctttcccggcgctaa

SEQ ID NO: 5058 - DNA, 183 bp, Glycine max
  Peptide Sequence Number=SeqID_96743
atggctgaggtcacattgcatattgattcaaggagttttgatgataacaaagatgatgacaaaaagctcaaaagtcaagatcacttcatgataacaaagatgatgacattcaagaataagttcaagattgagttcaagattgagtcaagaacacttcaaggatcaagaggaaatttgatttaa

SEQ ID NO: 5059 - DNA, 461 bp, Glycine max
  Peptide Sequence Number=SeqID_96744
gcgttctcagaagaactcgctaagcgcacctactgcgctaagcgagttcgtcctttgaggacaaacactcatcctcttgctgagctacctatggctaagcgagatggcttccagaaagagaaagagtattggtacaagacccacatctcagtaggatacaaagaggatgaattggagaggcataacttccataaatgcctcaccaatttagttgacagcaacatagatctagctttggtgaaggagttttatgccaatctttacagctccgaaggaccttcaccaaagcaagtcagggtcagaggccacgtggtgaagattgatgtagacaacctcaacacctttttggagacatctgtggtactagctgagggtgaaaccttacccgcatattccaaatactgcgggttgcccgctgatattagagaaattaaggttgccttatgtatcccaagtcgggg

SEQ ID NO: 5060 - DNA, 243 bp, Glycine max
  Peptide Sequence Number=SeqID_96745
atgacgctatcgctgtgggaagacactggaaaattgagtagtacaaagttgaatgtgtcaatttgcgatatacatgggttggacctgaatcaggagggagaggccctgacggactcttcggagtgtaggccttgggggtcaccgggtttgagtgctcctttaaagcctatgctgattccatatggttggagcattctcgcaaaacatcgtgacccagacttgtctccctatgatcttacttag

SEQ ID NO: 5061 - DNA, 222 bp, Glycine max
  Peptide Sequence Number=SeqID_96746
atggacggggaaccggcaagaagagtcacacttgaggacttctctaataccgccactcctcagttcttcacaagtattgcaaggccggaggttcaagcagccaacatctcctgcccgcactctcttattcagttaatccaagggaacctcttccatggtcttccaagcaaagatccatatgcgcatctagcctcatacatagagatatgcaacactgtttaa

SEQ ID NO: 5062 - DNA, 378 bp, Glycine max
  Peptide Sequence Number=SeqID_96747
gagctactcaagcaagcttccatcactatcatatctgaagaagttgatataaatgttaaaaatgaggaagatgttggcgtgaaagtagaacacattgattgctcttatgtctttaatacttctcagttgtttgctactcgtgatgaagttttacattgggcacgatcggtggctcatgaaattggatttgttgttgtgataatgaggtcagacacaaatactaatgttggaggaagagcctcatttttgttaatagcttgcgaaaggagtggtgagtataggcctaagaagaaggatttggttagaacatgcactggcagtagaaaatgtggatgcccgtttaagttgcgtgcgaagccagttttaggaggagaatga

SEQ ID NO: 5063 - DNA, 1218 bp, Glycine max
  Peptide Sequence Number=SeqID_96748
atggcgaatcaagaggagtgggtcccgtttatggatgtattagcatttctaatctttggggttgtcctctttccaaacgtggatggtttggtggacctagccgcaattgatgctttccttgcatatcaccatagcaaagagagcccggtggtagctgtcttggcagacttatttgacacatttgaccgaaggtgcgaaaagagtagtgcacggatcatctgctgtttacccgctctttgtgtatggttggtttcacacttattccaacaagacataaggcatccatgtccgctccgaagccatcgctcgtgtgtcgaaaaaagaaaagtagattgggaccaacacttggctgggataggagacagtcaactggtttccacaatggaaagaaggaaaggagggagttctcttctcatgtgggggctacccaaacatcccgctgataggaagaggggttgcattaaatacaatcccgcacttgctataagacagttagggtaccccatgaggggagcaccgacggaagaaagcctgtctcttttccttgtgagagattttggcgcgcaaaatttcaaggttatacaaagagtccataaggcgtgggaaagcccgttaaggaaagataaagaacttaggggcattcgtaatggcatcattggtggttatcatgaatggctaaaagttcgtacacgaggtttagattggctcgccaagttaaagattatcaacgaagagaacttcgaagctccggaagaggatgaagaagtccgagctctgaaaaccgaactaggaaaagcgagacttgccaaagaaaaattcaagttggtcgctacagacgtccggaaagagtgtgtcgggttacgagaagaaaatgcagctattgcaaaagaccttgaacaagaaaccaagagggctcacaaggaagaacatggtcgtgacaaattccgtggagcgttgtggggcagcaacagtgagctcaagcttcgaagggaagagaaagaccgatcacgagcacataacatgattttaaaagaagagttagccgtttgctcaaggtccaaaagaaacttgtctcagcgtttatgcgaagcagaaaccaacatgttagctatcatcaccaagtaccaagaagaactaagtctagccacggcccacgagcatagggtgcggacgagtatgcccatgtgtacgcggaaaaggaggctagaggaagggtga

SEQ ID NO: 5064 - DNA, 240 bp, Glycine max
  Peptide Sequence Number=SeqID_96749
atgcaagcttctatataccaaattgaaggaaatgttcagcgacaagcaacggcacctcgtggtggcctctggtggtcgtgggtggtggagaaggagatcttgcttagcaagctcatctcgctaagcgggagtccacttttcacgcttagcgcgacaattggcactgagcgcaactccctctgcattaattctcgctcagcgcaattccctctcaggttgaaattgcacttagcgtgctaa

SEQ ID NO: 5065 - DNA, 666 bp, Glycine max
  Peptide Sequence Number=SeqID_96750
atggagtataacattatgaatacactccaacatatgatcatggtagttacggcctaccaaacctcccatgaatgtttggaagaaaccattatagatattttagtggcaggattttccggacaattaaaagctcaacacttcattggagacccatctttgtggaaatacaagtctgcagaattattgtcaaaccttaagtgtagaaccttagcagacttaagactaaaaaagaagttaagaaaccttaacttagaaccagctattgaagagcaaataaacaatttgcttatagaaacctcggaggaagaaataaaaacttcatcctctgtgctcttcgatgaaaacctaaacataatccaacaagatgaccaactatcatcaacagatgatgatgggcaaatcaataccctaacaagagaacaagatctcttgtttgaagcaatcagttctatacccgacccccaagaaaagaaggtttttctggaaaaacttaagaaaacattagaggtaaaacctaaacaaaaggattttattacaaataataagtttgatgttaataacatattcgaaagattagaaaattcttcagccaaaccaacaacagtccaagatctccaaacagagataaacaatctaaaaagagaagtgaaagaacttcgtcaataa

SEQ ID NO: 5066 - DNA, 312 bp, Glycine max
  Peptide Sequence Number=SeqID_96751
atgtcatatgttcctattttgagaagcattttcgtgccatattcaacatatatgcacatttgcaaagcacttggctacctattcaacatatcccaaaccaagtgctggcctaaaggggaaacctcaccaacatgctctcattttcatgccttcttgcattcaaactcaaaggcttgggttcctaggcctaagtcacattttggcatttaccctaacctctgcaagctatccacgcatccaaaaatggcaaccatgtatgcacagaccaattctataagaaaaattcacaaatttatgcgtgaatgccattga

SEQ ID NO: 5067 - DNA, 621 bp, Glycine max
  Peptide Sequence Number=SeqID_96752
atgtcacgggggtcaggagaccttggggacgtcaggtggggtgctattgcccaaaaccaagcttgcccaatcccgacccaacctgggcatagtcaggcagtgagaacatgtgacgtacctcagcaggcgagcttctggcagtcaaccaataaaggaacaaaagtccacaaagcagggaggcttatcgcgatggcagcgcagttgatccaagatcgcgtcgtgatggagtgcctagagggtgtttgggagaccctcgaaggcaatgagaggtgccgattccgtggcacagttcgactcactgctacttcgctagtacatccggagcaacccgcacgcacacttcagcagtctgtggagtggatactacctacgcctactccatctcaactaattgagcctgttcaattgatagaggtgtcatcctctgaagaggatcttgaagaggacctagaggagttatctcctgaacctgctatggattcccctgacttaccagaggataatgtggacccgctccctgatgttgattctctagagaatattatgccagcatctgaggcagactctacagaggagagtggccctggagggacaacgaatagtgacgactcttcatcatag

SEQ ID NO: 5068 - DNA, 291 bp, Glycine max
  Peptide Sequence Number=SeqID_96753
atgtcattaccaactggtagatcaaagatggtcaaggacaacaatgataaacctgtcatggccacacctttcaaaacaaaggatgtcaatgaggaaataaccccgaaggatattaggagcctaatggaacaagctaattacaccaacaaataccttcaggtgttaggggaatctattagtaaagaaaaggtttttactaaacccaaggaccacgagtcgtcatcatcaccctttcaaatgaaaaaacctttattcaaaccttttaaggaattaatgaaacattgggcttaa

SEQ ID NO: 5069 - DNA, 360 bp, Glycine max
  Peptide Sequence Number=SeqID_96754
atggtcactttggggacattttccaaccctgggcccattagaaagcttagggatgaagtaactagctcgcctgggcgagctaggttgcttctggaggaagcaagcagctcacctgggcaagttgagcttgcctggggagaagggagacacaaaagaattcaggcggttagtcctttgttcttttggaaaagggagaagagagacacaaaaagaattcaggcggttagtccttggcgaattctttttggcaaagggagaagggaatggaaaagaagaataacacaagtttttgaacaaagaacttttcttggaagagaaagttttgaacaaaaactttttagaaagatgaagagaagatga

SEQ ID NO: 5070 - DNA, 1035 bp, Glycine max
  Peptide Sequence Number=SeqID_96755
atggacatagcacattgctatttaaagggtaatgctgatgctgtggagttttgtccacatgatccctaccataatgttttagcggtatccacttacacattacaagaaggttctcagccctgtcgacatggaagcatttcactcttcaatgttgatgtggaaccaggtcaccttgacatggtttttagtgaggaaactgctgggatttttgacataaagtggaatccacctggagggcatgcaagtccttttctagctcaagcagatgctgatggatacttgagaattaaaatgctggagggttgctgtaatggagtggaaggggttaatctaaaggagatcacaaatgaaaaaatcagtaactctatgtgcctgtacctggattggaacccttcagccacatccatcacagtggggctttctgatggctctgtgtctattgtttcttttcttgaatccaaactggaaattcaagaagagtggaaagctcatgattatgaactttggacaacctcctttgatatccaccaaccaaatttggtatacactggctctgatgattgtaaattcagttgttgggatttgcgagataaacctcccaatgtggtatttcagatctctaaagtccacaaaatgggtgtttgttgcattgagaagagtccacatgacccaaataccttgttaactggcagctatgatgaattcctaagggtatgggatttaagatcaatctcaaaaccccttaattcaattaacttggggggaggagtttggagggttaagcaccaccccttcattccaggcttggttttggctgcttgtatgcacaatggttttgctattgtcgccattaaaggcgacaatgccgaagtgtcggaaacttacaagaagcatgattctcttgcctatggagcagattggcagaaaggagaagcaaatcacataggtgagaataccaaaccactggtggctacttgctcattctacgacaaacttgttcgagtgtggaggccaggaaatgattttatcttgtag

SEQ ID NO: 5071 - DNA, 282 bp, Glycine max
  Peptide Sequence Number=SeqID_96756
atggtggaagggcgtttagtcattgtctcaagggaagaggacattttagtaagctgcccttcttctatgtcgtatgttgaagccgcagaagaatccttggagacgacttttcaatcctttgaggtagtgagcaatgcttcgatggaatccctctcgatgcgaccctgcatgtcagacaccatgatgatggtggcctatgtgatgttaggacatgggtataagcctggaatgggttttgttggatcaagtggcctcaaaataattaagaaggagggggattga

SEQ ID NO: 5072 - DNA, 441 bp, Glycine max
  Peptide Sequence Number=SeqID_96757
atgaagaaagcattctcaggaggagcactggtgcttgccagcatggacgatgaagagttaccttcacccgtgaacaccgatatctcggaggataagcaaagatttggtcgataccacaccgaattcaaggcaaaggcccgtgatcaacatatcatcatcccacatctggctcaagacgttaaagaagcgctactaggaggcagcctagagatggccccgagaaagctccccacgaagaggtccaggaaggacaccactggagagggctctagtgcggccccacaagctgacatggacttcgacagacaccggtttcggagcgcagaacaccaacagcattttgagaccatcaagggatggttgttcctcagagagagacaaatctatgtgagggacgatgagtttcctgactttcagggagagatagcccacaggcgctag

SEQ ID NO: 5073 - DNA, 483 bp, Glycine max
  Peptide Sequence Number=SeqID_96758
atgtggtttgtacatcgaagaaatcctccccgcctggttgtcgtaggaaaagtttatgagggattgacaacgattcacgacattcatttttcgcatgatcaagtgaaggtcggtgttgaggaggttagagatgcagatgctcccattcctatacccactgaagaggttgagttagtggggcaggcacttcacaccttccttgcttggtcgacacatctcatcaagtgtttatcagaacatggagctgtgggaccagcaaaacctgcaaataggccatatcatgaggtcgatgatcccctatatctgatgacattgaccatcccacagctttttttgaagccgttgcaggttatgtgggatgctatcgtgttcggggtgtttaatgaagacttccccttgtacataaagcatgaagatctatctgaaatagcacacggtggtcaatgtctcaacatctctgttatacagttgtggattctataa

SEQ ID NO: 5074 - DNA, 135 bp, Glycine max
  Peptide Sequence Number=SeqID_96759
atgaaggcctgggtgatcgacgatcggatcactttactgggggtgacgggaaccccgaatgactggcagaggcccatgatcagcgccggaaaccccaggcccctgttagacttatccaggtccagagggtgcctg

SEQ ID NO: 5075 - DNA, 297 bp, Glycine max
  Peptide Sequence Number=SeqID_96760
atgatgcggctttcaaaagccaatgaaccggcaataatgcgtccagtcatatccgcatggttggtgcaaaccaactggcgggcatcgtatgcagagaaatcaaatttccaatcgtcattcagtgtaccttcaaatgcagaaaagaaatccatatctatgaacttaggatcgataatggaacgagatgagaaaaggtttgagtaccgtatctgctgttcttcggaagaaaatagtgtggaagatgataaggagggtggaattggtgctgtggatgtgctggtggctccggaacgatga

SEQ ID NO: 5076 - DNA, 262 bp, Glycine max
  Peptide Sequence Number=SeqID_96761
tgctttgaaaggacttaacgatatgtcacaacctaaatccaaggttggtgctaggtggattgttgttaaatgtaatagacaaaaaggaagtactgagtgtgactattacgtgatgcactggatgtcaactataatcttaggaagtttcaagaataattgggaaatgtattttaatgatgctagaccattggaatcagagagattgaaggcgcttcacatccagtgggcaaagtattatctcaaagttagaaatgaaacttag

SEQ ID NO: 5077 - DNA, 309 bp, Glycine max
  Peptide Sequence Number=SeqID_96762
atgccatccggggatgcggtggggcatgacatattcgggatgctgaccatttgtggcacttctcacatggacacaacaatcactttcctgcatgcccgttggcgtgcgttccaaacgagccctcatggacttcctcgatcatgtgatttgcctccttggcatccacacatcgcaggagtgtcatgtcgtgatttctcttatacagtgtgctccgctcatgaagaaactggctgccaacctcctcaatgtccttttatcgttgtcggcaatctctggcggggtattctttgcttacgacatatcgcttga

SEQ ID NO: 5078 - DNA, 138 bp, Glycine max
  Peptide Sequence Number=SeqID_96763
atggaaaaacctgacaagaaaactttcaaagataagaaaggaaagaaggtgtacatcacttgggaagataatgatatggattcatcaagcctcatggccaaagactatgaaagcgaagaagaggactccttgaagtaa

SEQ ID NO: 5079 - DNA, 570 bp, Glycine max
  Peptide Sequence Number=SeqID_96764
atgcctgtagtggcgcaagcggaaatttctattaaaaatggcagcgttactgaagcctcaaatggtgtgccgattgtcaatatcgcgaaaccgaatagcaatggtctttcgcataacgtatatgacaccctgaacgttggcgctgaaggggtgatctttaacaacgcgacaagcgcggcgcagtccgtgctggctgggcagattgcggccaacccgaaccttacggaccgcagcgcgatggttattcttaacgaagtgacttcaacgaatgcgagtaccattaatggcatgatggaagttgccggggattccgctcacttaatcattgccaaccctaatggcatcacgactcagggaggcgggttcatcaacgctgaaaaagggacgttgacgacaggtacgccaaaattaggtgaggatgggctgttaaatggctattccgttaatggcggaacgattaatgtaagtggctttcagagcgaatcaccgaccgaaattctggcgcgtagtgtcgttgtgaatggtgcgctttcagccagtgagcttaagattgtcgcagggagtaatgcg

SEQ ID NO: 5080 - DNA, 459 bp, Glycine max
  Peptide Sequence Number=SeqID_96765
atggggacaaatcaaaatggaaaaagatttcatcaagtcaagattaagagtctagatgtcaccagccttaaggagttgggacggttgatgggacccctccaaaggcaagccttccgcaaagtgtacggaaagatcttggatttgaccgcagtggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccgtaccttttctctgggtttcttccctccttgagtaagactgcagctgtggtcggagattcggcaaaagagttggatcacatgaagcaaactcggaacggcgtagtgggcctaccgcagaaatacttggaaggcaaggcaagggatatggcaagccaagagtag

SEQ ID NO: 5081 - DNA, 399 bp, Glycine max
  Peptide Sequence Number=SeqID_96766
atgatggaggcccgggtgatgttagggtatggctacgtgtccggaatgggtttaggcaagaacaacggcggcagaaccatcctggtaagcaccagaggaaaccgcaggaagtttgggttaggctataaactcacgcaagcggacataaggaaaagtatcgcggaaaggaagagtagaagccaagccaaatccgaggacgagtccctcgaaggtactaatacccgggacccggccatcgatttcaagcaagaagcgggtcaaacagagagtgaagaggacgaggatgtgggacttcccttagagttggagaagatagtcgctcaggaggaccgagagatagggcctcatcaagaagagacagaactagtagacttaggaaccggcagtgggaaaaaggaa

SEQ ID NO: 5082 - DNA, 324 bp, Glycine max
  Peptide Sequence Number=SeqID_96767
atgcgactccagacaagaaatttcacccgcaaccctaaatgccacgcttggggctgggtggggctactataccgcactaacgaaagctgcccacggtgcggtagacttaacaccaacccaatctcgaaaagaaaattcaaccccatcaagcattttccactcgagcggaaacagctgaccaagagacaagagctacctcaccagactccattgctcctgaagagagtcttactaatggcatacttcttcagtcgtatgctcctgggcattgaggcttccttctcgcagtcgaagcggtactggaacgagtttgttccctattag

SEQ ID NO: 5083 - DNA, 1433 bp, Glycine max
  Peptide Sequence Number=SeqID_96768
atggctggcgagaaaaagaagccgtattgcccgcgtattgtgtctgagaatgatgtgggagtgcataaatcgctggggctggaggcgcagacctgcagggttggcattccccgaccgatgccggggatagtgattttggtccatggcgtgaacgacgtcggcgaggcgtaccagaatcaggagaaggggattattgccggactgaagaaacggcttaatcggccggatttttacgcccacgtatggaaagactaccgaatcaccgttcccggccgttcacccatcatcccgttctattgggggtataagcctgtcactcatgcggattatgtggcagatcagaaacgctatcgtaatgaagtaggaaagctgagggaccaggcccatctgccgttcgacgcctatcaggaagataatgaggctaaaaaagccagcctggggaatgacggaaaaggtgcatttaagtaccagaacgacaactttaaaaatgcccttgatgttaactttgccaaagggggcgggacgttcgcgaacgccacaacgaacatcccggatatgctcgggccgggggcgggaggggtagcgttagccgcagctggatttagcacgctgtacatgaacggcggtgattttacgcaccctattttccctaatccacatcgtatttatcagttttttgccgcgcaacgtctggccgatttgatcctgacaatccgaagtgagccagtgacggaaaatgatgtgattaatatcgttgcgcatagccagggcacaatcattaccatgctggcgaatatgctggtaaaacaggccggaagccagccagttaactgtgtcattttgaatcactcgccgtattcgctggaagggcgtctgagtgaagatattcagcccgggcatcaccagacggataacgcccggcaaacgacctttaaaaatttttgtgcgttgatggcaactcagtacaaaggcggtgaaatatcagaagctaacttgctggcaatggaaggggcctgtacgttacgaaaagcgtcagatagcccactgcggcaggatgaaaagtaccgtcgggacaataatggcaaggtctataactatttctgtccaaacgatggcacggtatcgctgaagaatattcagggaattggctggcgggggatccccaggaacatagccagtgctattcccaatctgtatcaacgggtgttctatcagcatgggcagaccggaatcgccccgaccgggaagccttttgagttaccgccatcacataaaggggatgcggaatatagctctctcaccaacacggcttataccgcgcatgatgttgtcgttaatggagaagaactgccgcagccgttcgtctttaaactgcaggggcaggataaccatccggacaatgatccgaaaacgagcgataaaccgtataccgc

SEQ ID NO: 5084 - DNA, 207 bp, Glycine max
  Peptide Sequence Number=SeqID_96769
atggcacgcagcgtgtccgcttcgtgcccctatttaagggacctatatgggagggagctaactaggcttttagtgataattcccaaggtggtcatatctctcttgatggtctctagaggtatcatccccttcgaagaaaggaatacgcgcggagtcgccaccaacgtttatttgaggaaaacatcggaaaaaccggaaaagacgtga

SEQ ID NO: 5085 - DNA, 534 bp, Glycine max
  Peptide Sequence Number=SeqID_96770
atgttgctaagcaacgtcatccatatctgtgtaagagtagtcaagttggtgcgcatgatccgcactcgtctctttgtagtggcacgggtgaaatcttgccccggtatgcatagtagctgtgtgatagcctccctctttggttgtattcgcacagttggcgccctccaatatcagggggtggcccaggaactgataaaaggaaactactggccccttaaccgggagtgcaagtctcgccctccgaaggcgaggacgtgtcgtcctctaaaggcgagggcgtgtagccctccgaaggcgaagacgtgtagtcctctcaaggggaggacgtatagtcctctaaagatgagggtgtgtagccctttgaaggtgaggacgtgtagtcctctaaaggtgagggcgtgtagccctctaaaggtgaggacgtgcagccctttggaggtgaggacgtgtagtcctctgaagttgaggacgtgcagtcctctgaaggtgagggcgtgtagccctctgatggcgaggacgtgtagtcctcagaag

SEQ ID NO: 5086 - DNA, 1113 bp, Glycine max
  Peptide Sequence Number=SeqID_96771
atggcgtcgttgccggatgaccgaatgaccagtatttccgaggtgacggatgtctatggcgtttcccgtaatcatatggtcaaaataatcaatcagttaagccgtgctggctacgtgacggccgtgcggggaaagaatggggggattcgccttggcaagccagctaaaatgattcgcgtgggtgatgttgtgcgcgatcttgagccgctatcactggtgaattgcagcagcgaattttgccacattactcccgcttgccgcctgaaacaggcacttgccgaagccgcgcaaagtttcctgaaggaactggataactacacgctggccgatttgcgtaaagagaactcacaaagcggcggcgtgcgccacccagagactttcatcggagatgacaacggaggaaccgatatgtcacaagatccattccaggagcgcgaagctgagaagtacgcgaatccaatcccgagccgggaatttatcctcgaacatttaaccaaacgcgaaaaaccggccagccgtgatgagctggcgattgagttaaatatcgagggcgaagaacaaaccgaagcgctacgtcgtcgcctgcgtgcaatggaacgcgatggccagttggtgtttactcgccgtcagtgctatgcgctgccggaacgtctcgatttagtcaaaggtgtcgttattggccaccgcgacggctacggctttttacgcgtcgaagggcgtaaagacgacctgtatctttcatctgagcagatgaaaatgtgtatccatggcgatcaggtgctggcccagccgttgggcgccgatcgtaaggggcgtcgcgaagcgcgcatcgttcgcgtgctggtgccgaaaaccagccagatcgtcggccgttatttcaccgatgccggtgtaggcttcgtggtgccggatgacagccgtcttagcttcgatatcctgatcccgcctgaagagatcatgggcgcgcgtatgggctacgtggtggtggtcgagctgacccagcgtccaacccgccgtaccaaagcggtcggcaaaatagttgaagtgctgggcgacaacatgggcaccggcatggccgttgatatggcgctgcgtacccatgagatcccttac

SEQ ID NO: 5087 - DNA, 456 bp, Glycine max
  Peptide Sequence Number=SeqID_96772
actctagaggatccccgtgtcattttcaccttgaataggagtcaagaacttccaacactactagccaaagccaaggcgatggcggatgtgtactcggcccccgaggaagtgcaagaacaaatgaaggccgatatgatggccttgaaagatcaaatggcttccatgatggaggccatgttaagcacgaagaaaatgatggaaagcaatgcggccgcagtttccgccaccaacgtcgccgctcaggcaaagcctgcccatccgtctaccataaatcaagcacatcaacccgtcccagacatggtgggacaaggaggagagggtcagaaaccccagcctgtaggaggcgcccatgaagaacctcgagagcgtgctgacttcgacccatatcccacgttcactgctaagggactggcatttaatgctatgcctcaacccaataccttgggagctccttaa

SEQ ID NO: 5088 - DNA, 270 bp, Glycine max
  Peptide Sequence Number=SeqID_96773
atgcataaggcattacgagccaatgcacctctttcgtatccccatcttgttaccttgtttcttcaccatttcaatgttcctttagaggatgaaccttttgttaaggttaaaagatcttttgctattggtgctggtgctgttacttctttcggatatcagaaagatatggatggccaatgggtgcgtaagcaagacctgccacctcccattcctgatgaacgtgttggacaagtggcctcagatatcttaagaagggggggggggggttga

SEQ ID NO: 5089 - DNA, 201 bp, Glycine max
  Peptide Sequence Number=SeqID_96774
atggaaagatctgagaggaaaaccttcaatgataagaaagcaaagaaaacttacatcacttgggaagataacaatatggattcattcagagactcagaaaatgaagtcgtgaatctaagtcttatggcaaaaaattatgaaagcgaagaagagattcattcactgatttgcataaagaatcagtcaaacttgaaaaactag

SEQ ID NO: 5090 - DNA, 189 bp, Glycine max
  Peptide Sequence Number=SeqID_96775
atggagcggtatctacagcacttgctcagcctcagtcagtttagggctgaggtcgcatggcccggagattggcccaaggaccagacggaggaggcacctgcaggagctcccaacgatgcagaggacgcccgcatggatgaggagatgacagacttgctcggcttcttgggaggaagcggagccacgtga

SEQ ID NO: 5091 - DNA, 225 bp, Glycine max
  Peptide Sequence Number=SeqID_96776
atggtggtccgggtgatgttggggaatggttacgagcccggaatgggtttaggcaaagacaacggtggcagaaccagcctgataagcgccagaggaaaccgttggaagtttgggttaggctataaaggccacacaagcggacataaggaaaagtgttgtgggaaggaagaacggaggtcaaggctcgtgattgggacacgaaggcccgcccttccacatcagtag

SEQ ID NO: 5092 - DNA, 147 bp, Glycine max
  Peptide Sequence Number=SeqID_96777
ctaaaagaagagaaggttcaagtagctaatgactcgctaagcgaggcagatccgcttagtgagtggcatcctctaagcgaggcttacatctcgcttagcaggttgggaaaccctagaagaggattagtcagagatgtgctcacctag

SEQ ID NO: 5093 - DNA, 381 bp, Glycine max
  Peptide Sequence Number=SeqID_96778
atggagaggagttcgtcatcctacacctccgagacccgaagtcgcatgttgtgcctctataacgtagaggctccactggtgacatcgtggaccgaggataatccagggaggcgcttctatggatgtggtctatacaaggttacaggtaggaaagggtgtaattattttgagtggcacgatccagttgccaacattcgccagaagaaaatcatggtgacattgatgaagaaagttgatgaattggagtcgagggagaaggatttgcaaagcagaatcagggacacgaagaggaaggaaatttttttagggattcttttggttgtgtgttgggtagtgttcaggttgtatattcctgaatgtacaattgtggaatatgcctaa

SEQ ID NO: 5094 - DNA, 537 bp, Glycine max
  Peptide Sequence Number=SeqID_96779
atggagaatcttggacttgatcttggattagtggaagttgttgcctccatccaagccaaagcatctgctaaagttgtggacgaaaccattatgcgtagagtcatcattggtcttacaaacactggtgtcatggatgaaactcgtgaggcgtccaatggcaaacatgttgttgtcattgtttattcaaccagttttggcccctttcctctcaactatgcgcaatctgccaccgtcactcgtgaccaaggtcatgatatgattggccaagccatggagtcctttgtcaaacgccaatgccaagagaatgagcaattccctctctctatgcaaaatgccattacaactcagttctcctacctcgatgtcttcctattgcaaaacactcaacaggctcaaatgtctatgcttgaagctgttgttgcagctgcctttgtacctcaaccacctcttatacctgcacctcttgatccttcattgccacccttggctccgataccaccaccacctacaacctttccaccaccatctcaagactga

SEQ ID NO: 5095 - DNA, 886 bp, Glycine max
  Peptide Sequence Number=SeqID_96780
atgagacaatttggaatgcaacaacctattccgcgcctagtaatgcaacccaacaacatacatgacttgacattaaagggaaaagaaggaaaaaattggatgcgactaatgcaactcgcgcttaatgaatggaatagtcgctatgaaaggagagtagagcaagcgccgccacaaacagggacccttagtatgaactcagaatatatgaggtggtacaggcgtaaaacaaaaggcgaaatcgtcgaaacaatgcattttatggtgtcgcctcttgggagaagggtttgtacttttgacgatttactgccatgtattgagaagatcactcttttgtctgacgaagaagataggatacttgaggcacatgaagatgctcccccttctcagccacaatttgaacatcaacagtttaatatattacagcgaagtgtggatactcgaggcttagcgcaacgtcgggaaactgttgatgcagcaccatacagtttccctccgatgccagaacgacaacatgaaatgtattgcacaccgcagacattcacccaagaattgttgcagatgccgccgatgtattcatacacacatgatttacaaccagggtacaatatgacagacatatttgggtcctctcctccttcaaggggaactccttcatttacccaaagtgatgaactatcaaccccaaatgccccacttggtggtccgtggaatgtacttggaaatatactcgacatggatgacttattaggggtcgatttacgtcatgatttctctgttgaggctgaccaagtggatgaaagggtgaatcatagaagaagaaatcctgatagggcagctaggaattggggccggccatgtgggactctgtcgcggcatcacagacata

SEQ ID NO: 5096 - DNA, 600 bp, Glycine max
  Peptide Sequence Number=SeqID_96781
atgagttcaattattacactcgtctatttaaatggtaagatctacaaaactgatgatggtatcacatttgaaggccctaaaaaagctattcaaataaagcgtggtattagttttgagagtttaaaaaaaaggatacacgacaaggactcattagacgaggatgatgatattgatgaaatatctgacacagatgatgaagctgcccgtttgatcaaacaacttacagttgtgcaatcgggagaaggtggaagtcagactcctttatgggattctgcttctcactatagtaatattaattggagtcatcctgaccaagaagatatttgcggtttagatatgggatcaacttttgatatgggtcaagaattatatgttggtatggaatttgataccaaaagcgcaataaaaaatgcattacaacaatatgtaatgaaagtgcatcaaagtttcaaagttgttgaatctaaatcgcagaaatatgtcgtctgttgtggaaatagaagcgttgacatcccatgctctttttatatgagagcaattttatctaaaaaaatgatacatggaaagttacgcaatagggaggaccacatagttccttga

SEQ ID NO: 5097 - DNA, 291 bp, Glycine max
  Peptide Sequence Number=SeqID_96782
atggctcttgatttaagtctcggtgttagatccagagtcatgaaacaaaaggggcttttttgcttgcctagaaaccagcgtgggatggtgttcaccagtttggagaatcatcatgcgctcatttctcccactgcaacggaagtcgtgaacaatgttgtattcaagatcgcgaccttgaagcgcgagaaggcaatgaagatggacgagattctgaagctgagaaaggagacggattcgttactatgtaaggcagtgctggaatcagagatgagcgcagttgagaaagcttga

SEQ ID NO: 5098 - DNA, 858 bp, Glycine max
  Peptide Sequence Number=SeqID_96783
atgacatttgatgttttgcttttctgccagaccttcattgacaagttccgttataatgcgaagagggcatcacttgttcaatctagaatcaaggctttggatcgaatgggccatgtggatgaaattgttaatgatcctgactacaaatttgacttccccactccagatgatagacctggtgcaccaataataagtttcagtgatgcatcatttggttatcctgggggccccattctgtttaagaatttgaactttgggattgatctcgacagtcgtattgcaatggttggaccaaatggtattggcaaatcaactatacttaagttaattgctggggatcttcagcccagttctgggactgtcttccgatctgctaaggttcgtatagcagtgttcagtcagcaccatgttgatggactcgacttatcctcaaatcctcttctgtatatgatgcgctgctatcctggagttccagaacagaagcttcgagctcacttaggttcttttggtgtaaccggaaatcttgcgctgcagccaatgtatactttgtcagaaataatgtatgttgggacacttggtgggtgttgtggtcagaaaagcagggttgcctttgcaaagataacttttaagaagccacacataatattgcttgatgagccatccaatcatctggatttggatgctgttgaggcgcttattcaaggtcttgtgctgttccaaggaggcattctcatggtgagtcacgatgagcacctcatctctggaagcgtggaggaactatgggttgtatccgaaggaagagtggcaccattccatggcacattccaagattataagaagatactccaatcatcctag

SEQ ID NO: 5099 - DNA, 576 bp, Glycine max
  Peptide Sequence Number=SeqID_96784
atgggttgtagcagccagcacgtatctactccacttgatgggttgtactcttttcaccaacaagagttcaacccatgtacatgtcgtgcacctgaaggctttcagggacctggcccaggcagggggtttcgtctggggagcgactgcaggtggcttacgggtaaaactcatatgacgggggatcaagggatccccatatcggagacgtatggatgccctgacgtgtgctggatgccctatgttgagcaccggggagtcaggggctttgacttgatattgtcgtacaacagtcagctcagatggggtcagattgttgtgtacgttcggcctgagcgggttcttcgacagtttgactacattcagaatgtccctccaccgtcggttgactgcgaaggatgtcaggggatggctgaggatttaggagcaattgttgaggatttggagcgggacatcaacctcaggatggtcactgaagacactcacttatatgacatcatgactcgttgtctgaggagagttagaggtgacgccatagatgaaagtcttaggctgcgacagagacgtcgcatagattaa

SEQ ID NO: 5100 - DNA, 594 bp, Glycine max
  Peptide Sequence Number=SeqID_96785
atgcttttatttctgagtggtgcaggatcctatccatgctcggttagctattctttgaaggcttctaaattgactattaatgagccagtggcaccaattgaagatttcaatcagaaatatagagttgaagtgatggtcaattataaagatgaaagcacaaaattcctcttgcgggatcgtgaatgcaccgaattgattgggcagtcagctgatgaagtcaataccctcaaagtagaagatggtgatctggatttaaatgcctccccaaaagcacttgataaactactgggtcatctgctcgccttcaaagtcaaaatccaggcacagtatagtaattctgctgttttgaaatgctcaactgacttaactttaattaatgatgttctggacatgttgcctgctgctgagacatgttcaaagattaaagttacaacaccgtttgattccaatgatcctgtgcacgatgaatctcaatccatttctataacaacataccatgatccacttattggacttcccttgacaccaacaaaacgacagccatttcatgaatgtgatgatgaagcaagaaactcccacatttcaccaacttag

SEQ ID NO: 5101 - DNA, 447 bp, Glycine max
  Peptide Sequence Number=SeqID_96786
atggacatcaagggaggacttacgaagcgaatcaccgatcctgaggttgtgatatttggaccatttgtcgtagagagagacaccaaaaagaggttaaatccaggactactaagattggccattttggttctgatcacccctcacgttcaaacttggattttcttagatttaagagctgatcgaatgagcagagggaaagggaaagggagacatgcaattggccagaatgtgccgactgcaagctttgatagtgacatgacaaaaactttcaaagtgttgggttacaagtgtgaggtgaagtcccacatcgggcttccttatgtggtggctcgtggtccactggtgtacccctcgaatctccccaacaattggtatccgaaccgatggttcaagttagtgaccggcttagatgagtatgtaagtaccgcaggtggccagaatggctag

SEQ ID NO: 5102 - DNA, 420 bp, Glycine max
  Peptide Sequence Number=SeqID_96787
atggtgtcaccacaagggcggaagacatggacagttgatgatctcgtgccttatgtggagaagctaacaattttatccaaagagcaagagaggatcactgagcctgtggtacatggtccaacattagagcgtcgatttccgccacaacaatttcacatgcttcagtccagtgtcgaaactcgaggtcatgacactgatatgtctgcaagcgaacattcgtatgatggtgttacgaaaacacatcctcatttttcatggccgcccatgaccccttcgcagcaacatgatgccccaatggcaacacctaatgccccattagctccacaatggaatgtacccggagcaatacctgatatgggtgatttattaggtgttgatttgcgtcacgagttttttgttgaggctgaggggatcctctag

SEQ ID NO: 5103 - DNA, 372 bp, Glycine max
  Peptide Sequence Number=SeqID_96788
atgactgtttgggagaactatgctattcaacttcatcatgctattgacaaaaaccttctgcttcaggaaccattgattgttatgttgagcctgggtaaaatcaaagatgctatagacaagtatcctctgagcgtccaaaatatcaagtatgggtctagattgtatgtcaacactgacattgcagagatacaacaatttcgtaatagtttgtgtgtgccattttactcaggtggaataaccgatgataacggtggttctcagtcccaacctagccaaagtaatttggtggacaagtttttgcacaatgctcaggtggagtgttactgtttgactattgggacagttgacaaaatcatcattgatgctccatag

SEQ ID NO: 5104 - DNA, 1041 bp, Glycine max
  Peptide Sequence Number=SeqID_96789
atgatgctttcctctgccaaaggtgcacagtcttacaaagacattagaacagtcaatgatgtggtgtatggtacatttagggaagcatgttttgcaaaaagctttctaggtattcaacttactgaaaaggaagcaatccatttatgcttgactgaaattgaaaatatgctacaagccaacagaaaaagaccacgagattttccttccatgaaatacccaataggatatgcacccaatcaagaccataataaactcatcttcaatgaaatggcatatgacaaacaaatactagcggcagaattcaacagatcttaccatttgttgacagacaagcagaaatctattgtcgataccattatccgtgtcgttgacactcaatcagcagaattttacttcctctatggatatggtggaactaacaaggcatttgtctggacaacattatcatctgctatatgctccaatggtggtattgtttatatagttgcttcaagtggaattgcttcattactattgcttggtggtagaacaacacatttcaaatttgttataccagtgcctgcaacacaaaattcaacatgtaatattcatcaaggtagcaacttagctgaattattgaaggttacaaaactaatagtctgggatgaagctccaatgtgtcacaagtttacttttgaggcacttgataaaagccttaaagacatcatccacaacaacctgccttttggaggcaaagttatagtttttggtggtgatttccgacaaatactacctattattccaaaaggtaatcgctcggatattttccatgcaactataaatgcatcatacatttggggtcattgccagattcttagattgacaaaaaacatgaggttgctatcaaatgtttctgggcagcccaataatcaagagctcaaacaattttctgattgtctactagacataggtgacggcaaagttggacaagctaatgatggattttctgaaatcaccatcccagatgagttccttataaaggattatactgatcctatctag

SEQ ID NO: 5105 - DNA, 552 bp, Glycine max
  Peptide Sequence Number=SeqID_96790
atggacatgtggcattggtctcgcccgtctcactggcgatttgaccatgcagggggactagccgggcatatagccagtggcactggcaagttgcgcttggaaatagctagtgctactggcaagataactgatatagccattggcactggcgagatcatcagggtatatgaagagaatgatggtgtaatatttgaaggcagtaaaaaagcgattcagattaaactttctggaaaatatgttgctttgcaaatttgtgatgatgaagatgttgaaaccatgctcgaaagttttcaacaacaaaatcaaatgtcagttttggaattgtacatagaaaaggatgtggttggtggttctatgtttcattttgcaaattctcttacatcatgcggaaataatttatctaataatgaggcgcaaccgccaacaaatgtgagcaacttacatggtgatgaagatgatgatgatgataattatcttgtgtctaactcatacgttgaagagtcttcagacgaagatgatagtgttaacagtatatctgatacagacgatgaa

SEQ ID NO: 5106 - DNA, 489 bp, Glycine max
  Peptide Sequence Number=SeqID_96791
atggctcgggcgactaaccagtttgactggcgagttgcgctagaggagctttttcagggtaaggttgcaggcacgcgtaacagaagaagagcagggtgcagtgaaggcaggaccagcaggcgcaaatcgcaggctctagtggcgatttggttggaggaaatcccaggcttcagtggtgatttggttgaaggaaatcgcaggcttcagtggcgatttggcttatcaatgacatcttcctcgtcatgttcatcaaatatacaaattaagtctggcccgattgatggtgacgtattatggatgcaagctaaacatgtttcagaacatgtttggaatggggaagaagactggaaattacacatcaaacgagttatccccacgtatcaaggggaagaagaaataccagaggaagttattcctctacttcggcaatatggtttttactggataatgaagatgggatccctaaaaataaatgttggcattaattag

SEQ ID NO: 5107 - DNA, 222 bp, Glycine max
  Peptide Sequence Number=SeqID_96792
atgctctcaggaacggaagcttcgtgcacactccagacatcttctcaaagttcccaacagtcaaatcatggacaaatgtcttgtgaagctgcagaccaaattttgaaagatccaacggttaacaaagtctgggaagcgtttttaccgaggcagcttcatgtagcttcctcaagaagcttcattaagaggcttcctcaagaaggttcttcgtggcttctttga

SEQ ID NO: 5108 - DNA, 699 bp, Glycine max
  Peptide Sequence Number=SeqID_96793
atgggggaagaatggcattgtcctaaccttagatctaaatgggccttggatgttgttcaaccattacctcttgatatagaggatgtgggaagtcacctagggactatgcttagggttgatcaaaacatgtgtgttcatagttgtggggttacaccttatatgttttgggtgtggaaagtatggacatcggccttgaaaaaccctaacctagaggaaaaagataaggttgatgcctctctagcaaatcttaacccacttcagtctgttgagcaagaggatacctcggcttttaggccattgatgctggcaagaaagcctactaggcgacggaaaaccttttccaaccttatgcatgaccttataatgatttatggcttgcagttggtggctttggtcgagcctagaattagtggtgcttattccaacttagttgtcaataaggttggggtggatggtgcttttcatgagaaagttgggggtaggagattggactataatgttagcagtaaaatgcttcaatgtctttcttcctatgagctcatggatatggatttctttggacccttcctcactttatcaaaaggtagcctcaagaagcatattgaccgagtggtggctaataaatcttggcaagtggcctttttgaattccaaggttatccacttagccttgcctgcttatgatcatcgtggcctttag

SEQ ID NO: 5109 - DNA, 87 bp, Glycine max
  Peptide Sequence Number=SeqID_96794
atggtacctgggtacacttacacggagaagatgcactggcgggatcttggggatattcatgcgaataagccaagtgcagctgaatga

SEQ ID NO: 5110 - DNA, 206 bp, Glycine max
  Peptide Sequence Number=SeqID_96795
atggcgagtttgctgtgcaacgcccacgtggcagggaaaccaccattcgtgatggcaagttggtgtcaggtggaactcgccacctctgctggcgagtcagccaatggttttggaaaccgctggcgaggtgcaggcgtaggtggtgcagctacggtgcaggtgcaggaggagcaggttgactggcttggaaatcgccaccatgacag

SEQ ID NO: 5111 - DNA, 1160 bp, Glycine max
  Peptide Sequence Number=SeqID_96796
atgtctcttatcatgtttaggtcttgcttggagggtcttaagatccatgatggtaattcttgcaactggagtgggcttggacgccttctcaaatggatagttggacttggttgcttgcttcggcttgtccttggcctgtgtagtatgaacatactcgaactacgtccattgaggtggagttactacctcatattgtttgtggatgggttctatatacggccggtggacgatgtcttgcttagggtaatggttctgttgattcctggtaccgagaacatggatgtgttaattggagagagaggcttcttggtctgcagaggtagtggactagatggctatggaatgggagtgggacttgcgtccaactcttgtcttcctcttcttttccaaagaagaggggatcatatgttggtcagtcctttgttggacgatagggtcttatttttgcttccttgggatgataagagggttgttttgcctttgactcttcctgactggagtagtcaatggacaagtccgttaggactatattggataggagggtttagacttctcatgtcctttcttggtctgtttctccttggacacaatttcttgttcttattcttgttgggcttgctttcttgtctgaaccaagccctgctgctctctaagaatcctttgaacctttttagcgagtccaaagatctccaaagctttgtcttcatcagccactgttctggccagtttcttctgcctcctttgttgaatatcatcttgatcaacaagagggacaagagacaaagccaaaaggaagagcaaaatggtcttttcatgaaggtttctgactctaaattcgcccaggctagatctagctcgcttgggctaagatgtaacttcaaccctaagcaagcaactcgcctgggcaagtcgatgccttcaccattaagccacaattcgcttgggcgagctacagcttgcctgggcgaatttccctgcactccttggttgttttctataaatagccatgcatggttgaagagaaaaatagtccagcagtctaaaaccatagagaaaacacataagaagaaggagaagaggaaaagtggagccgaggcgttgcatggagccgaggcgttgcagagttgtgaccatggatcacttccttcgttatttctctt

SEQ ID NO: 5112 - DNA, 240 bp, Glycine max
  Peptide Sequence Number=SeqID_96797
atgtatgttaaagtagacggtctgggttgttctactatcccatcacaatttaatgaagttagttcttgcatgttgcaaacgattgtggattcgaatgaagacgatggtgactatgttgtgtcaaactcatttgttgaggaaacatctgatgaagaacatgtagcgaacatggattcttctgacatgaatgatgaagcaacatctattgagccaaaaaaaattgatcatcgtgcatcataa

SEQ ID NO: 5113 - DNA, 510 bp, Glycine max
  Peptide Sequence Number=SeqID_96798
ggtgcaccttttgagggtacccttgttgacgacgggaagtttgattactccagtcatgatgcccgccgcatggtctgcattgaccaggcggatatgaccggtagactacttgccgggtcattggcatttaattttcgcatcatgcactatatcattgttagaattctgatgcctcgctcttctaatgtcgctcaagcctctaaggaggacttaattctgatgtgggctttcttgaccgtttctttggattctgagccttttgtgcttgttaaacgatcctttgctattggtgcttgtgcggtaacctcctttggctaccataaggacatggatgggaaatgggtgaagaaggacgcctatgttggtgaacgctttgattccttagatggtcgcatagattccattgatgctcgctttgaaggaatggttacccgcatcactcagcttgaagaggatgtgagttatcttcgtcagtgcttcaaccttccaccaccaccttcattaacttag

SEQ ID NO: 5114 - DNA, 711 bp, Glycine max
  Peptide Sequence Number=SeqID_96799
atgggaaagagcaaagaggaactctttgcaatgatgacggggcatgaagccaagaaagaattttctctaactacagagcttactctgaaagaagaacctccctttgctgatggaataaactatgaagaatcaaagaaggaagaaatcaataatcaaaccatgtctaggttaacctcagcatgtggcaaagcttactcgagtacagttaagaaggcttccagcgtgatccaaaataatggagttaaggtggaagagtctcatgcagatcggaacattggacagaagaaacttaaattatcaggggaagataggccttctatgacagatttgagtggatacagttttaagcaagaggaatttgatgttgaatacgacaatgatgcagagcaagtgttggctgttatggaatttaaggacactgatactgaagctgaatatgaaatgaaactgcagcatgagattcttcatagtcatccacttattcatctgcttccccgagcacaaagttcaagatcatcacaggatccaaacacaaacaacacacagggaatcatagggacaccagtcagggtcacagtgttttacgagaatgctccaccatatgggatcaacataggcttaaaagagcactcaaaccgggtgatccccaaggcttacactccgaagagtccatcaaggcctctcccaaggccaacccagaaaatattttag

SEQ ID NO: 5115 - DNA, 388 bp, Glycine max
  Peptide Sequence Number=SeqID_96800
atggctgcttctggcccggttttctccttttctggaacgcccactatcactactgcaaaactcaactggaaaaattacctatcttggtcagcttcagtggaattgtggtttcttagccaaggacattatgaccacttggaaaggggagttagtgctgtcccaaacgacaagaaagctgagtgggaaaaacttgattttcaattgtgtgttgtgctatggcaatctgtggagtcggatgttttggaaatcattagatcattcaaaacatgttgctctttttggaagaaggcccaagagatatttgcaaacgacattcaaagtctgtttgatgcaacccaaaaagttactgctctcaaacaaaccagccatgatatgattgcacatatag

SEQ ID NO: 5116 - DNA, 447 bp, Glycine max
  Peptide Sequence Number=SeqID_96801
atggttgagtccaatactcttcaagaagtttttcctactccctatcttggtccatcaccttctttgcaggaatcagagtcaactgcagattctaccatagatattcctaacaatcttccacttgagcagactcaaagatcacccattgtatatcgacgtcgtcctcaaattcctgacgtagaacttgaaggtaatgaaagaccagctgaatcatgtcctactctagcaaacaacccaaccatggacctacccgaagagaatcttgacttgcccattgctcttacgaaaggtactcggtctacaagccttctctatgaagacaaaggaaacactcaaattgttggatattatgatgcaaattgggtaaactcgcctattgctagacaagggcttctctatgaagacaaaggaaacactcaaactgttggatattatgatgcaaattag

SEQ ID NO: 5117 - DNA, 513 bp, Glycine max
  Peptide Sequence Number=SeqID_96802
atgatgtggaaaatattaaagataaaggtcataacagagtatgtatttgattatagccatagaataagaaaatacatgtttccttattgtgcgtttgtgtgccaggtccgtagtccagtcaatgtgatggatttggacgatataatgtcagagttggaaagtagtgacaatttttgtagcttcgtgaatggtgatggtgacaatgatgttactgaagtgtatccaaatgatgatgatgaccaacatgatgtcagacttgaagatgaggacgaggtggattcggaggtacacaacgacgatggtggagattatgatgatttctggattccaggtttgttgaaagaggaatgcataagtattgatagcatgatagatattagacaatttgacatggaagaaattaccgatgaagttgtccgcaggttggattttggtgatttggagttagcgtatcagttctattgttggacgatggacataggaagatgttcgcatttgatattatgcaagtga

SEQ ID NO: 5118 - DNA, 222 bp, Glycine max
  Peptide Sequence Number=SeqID_96803
atggatgaatgtggcagacaaatgagagtccaaaagtgtggccaatgtggtggaagtggccataataagcgttcttgcaccaaccgtcctcgaaatgcaaatgcttcttttggtggttcatgtatttcatccagtgaacaaactaacactatgttgcaacctacagatgaatataactatgaactggattatcgacttgaaagtaacttgtgcaagcattaa

SEQ ID NO: 5119 - DNA, 174 bp, Glycine max
  Peptide Sequence Number=SeqID_96804
atgtgggatcaatacaagcttaaaggagctctcaaaccgaggaataagccatggaagaaggagcttcgccaccaagaatgtgccttggataagaagcttggagaggatgcttcaatggaggaaaagaaagaaagagagaaagaaataggggggagcacgaaattgaaggagtaa

SEQ ID NO: 5120 - DNA, 828 bp, Glycine max
  Peptide Sequence Number=SeqID_96805
atggattcgttctcaaatccatccagtggttcgtcgcaccaattatctgcgcacgatctcaaaaatcagttgaagaatcaacttgccattgagtatgctcaacaatttcttgaggagaaaggagaagacatcggtgggtggaaggaggaaatagtaatgggaattgggatatccggcatgggaactgtgggaagaaagtgttttgagaagtgtgttacaaaaccaggttcaagcctcggtgggagtgaaagcagttgcatctctagatgcgttgatcgatatattgaagccacaggcataattagcaaagctaaagacttgggtggggtccaaggactgcagcaatctaacccataccaccatgtggataccaaatggcacgttggacaaatcaattgggtaaaagctattactgacggatccgttacgcagaaaggaaaacaagtggcttgtgctggtgttttcagagatatgcattgtagcgctccacatggtatggccaagtggcattcgcaagttaacagtggaaaattggagattggggatatgggtttagggtttaaagattgggaatatgggtttaggatttggggttttggatttgggattggagtcgtgaactcatggatctcaagagatattgatctcaaacctgtttcatgttctctatcagtatcacagttcaagaatcctccaccttctccaatccaaacttgggctcagactagttttagccttcaagaatgtgtacccagcattattgctggtgcacccagcactaaccatgaaaagacagaaataccccttacggatcaagttgatccgtaa

SEQ ID NO: 5121 - DNA, 340 bp, Glycine max
  Peptide Sequence Number=SeqID_96806
gtggaaatatagccgctccactgttggggaacgtccgtgcattgggaatgcgaaaattttccaacatgcttctaggggagacacaaacctagtgaatcaagcagaatggtgcatattgttgaagacacagtccgatgaagcccaggcattgggtagaagactccaagtagattgggctagagatccaagggaaggccctaaggttctcatgagccttagggaggtgagcttagctattagagagctaagctctagcttctcaaggaagtttctcaaagaagcttctcaaggaagttttctcaagaaagcttctcaaggaagctacctagtctataaatag

SEQ ID NO: 5122 - DNA, 774 bp, Glycine max
  Peptide Sequence Number=SeqID_96807
atgtctcgaaaggaaaatctcatatctgagttacatacaagaaaaggaacatggaagatagttgtccgtatcactaatctttgggaagttagaaagcaaaatagtaaacaagcaattaagatggtgttgatggaccaaatggtgtttcagggtacaaagattggtgctactctctggcaagaattgttcgttgagttttggcacaaaactacatttgtcaaggagatccagcatccagaaattccttctaatgtctacatgattactctgtttgctgatataatctccggggtggcgccacgccatactttagtggacattgttggggtggtcgctgatctcattgatgttaagacagttaatccccctcacaggatgacagtcaggctcaaagataacagtaactcggacatcataatgattgtttgggagtactatactattcagcttcatgatgctattgacaaaaaccttctgcttcaggaaccattgattgttctgttgagcctgggtaaaatcaaagatgctatagacaagtatcctctgagcatccaaaatatcaagtatgggtctagattattgtgtgtcccattttactctggtggaataacacatgataaaggtggttctcagtcccaatctagccaaagtaatctggtagataagtttttgcacaatgctcaggtggtcaatatatgtgaaattaacagcctcaaacaggtgatagctgttgagcctgaaagttcaccgccaatttaccatcctacggattga

SEQ ID NO: 5123 - DNA, 2043 bp, Glycine max
  Peptide Sequence Number=SeqID_96808
atggcggagaatgtgaaaggatcgaagcttcccatggaaggaaagcgtaacatccttatcacaagtgccttgccttacgttaataatgttcctcacctcggcaatatcatcggatgtgtgttaagtgctgatgtgtttgctcggtactgtcgacttcggggttacaatgctatttacatttgtggcactgatgagtatggaacagccacagaaactaaagccatggaagaaaattgctcccccaaagaaatttgtgacaaataccatgctattcacaaggaggtctacaattggttcaatataagttttgatgaatttgggcggacgtcatgccctcagcaaactgaagtttgtcatgcaatttttaaaagtatatatgacaagtggctctccgagaacacaatacagcagatgagtgctagccctggcataaccgtaaagttgtgcattggtgatcgtttgatcataagttcaaatttggaactatctatttatacatgcaaggagaagactgcagacaataacctcttccttacctccgcaaaagtgaagagccttaagcaatggagtatagatctttactgcgacagttgtgaaagattcttagctgataggcttgtggagggtacctgcccgactcaggggtgcaaatatgattctgctcgaggagaccaatgtgagaaatgtggaaagcttctaaatccgacagaattgaaaaatcccagatgcaaggtttgtgagaaacctcctcgtattcgcgatacagaccacttgtttcttgaactccccttattgaaagatagattggaaaaatacatcagtgagatgtccgtggtcggtggatggagtcagaatgctatccaaacaacaaattcgtggcttagagaaggattaaggtcccgttgtattacaagggatctaaagtggggggtttctgttccacatgaaaaatacagcgacaaggttttctatgtttggtttgatgctcctattggatatgtctcaattacttcgtgctacacacgtgattgggagaaatggtggaaaaatccagagaatgtggagttgtatcaatttatgggcaaggacaatgtgccattccatacagtgatgtttccatctactctacttgcaaccggtgaaaattggactttaatgaagactattagcgttactgaatacttgaattatgaagcagggaagttttctaagagcaaaggtatcggggtatttggtaatgatgtgaaagatactagcattccagttgaagtatggagatattacttactcacaaataggcccgaggtatcagatacattatttacatggcctgacttgcaagctaaattaaactgtgagttgctgaataatttgggcaacttcattcaccgggttttgagctttattgccaagcctgcaggtcgaggatatgattctgttattccctctattcctgatgatgtaagtggcgaatcccatattcagaccaaaatatttgctgataaagttgtggcatatatagaccaatacatagaagcaatggagaaggttaaacttaagcaaggattgaaaactgcaatgagcatatccagcgaaggaaatgcatatctgcaggaagctgaattctggcgcctttacaaggaaaatagacctctttgctcccttgtcatgaaaactgcagttgggattgtgtatcttcttgcttgtttgttagaaccttttatcccatctttcactcgtgaagtatttaagcagctaaatttgcctgcggtgacacatgtctcactttgtcaagacaaaggagatattgatagggtaaaaagaccctgggatatcataagtgctggtcataaaattggaacacccgagccattgttcagggaacttaaagatgaagaagtggagttctataggaagaagtttgcaggaagtcaagctgataggactgtgcgggcagaggccgaagctgaaaatgttgctgggcagttgaagaaaacgaaactttcaataattggaaaagaggaaattagtcttaacccctag

SEQ ID NO: 5124 - DNA, 504 bp, Glycine max
  Peptide Sequence Number=SeqID_96809
atgccaagcctgccattggattgtagcaacgcgtgcttacctcctccatctgaggtgtttcgagaccttggtcagtctaggggctatgcctggggagttgccgcactggttcacattgagcaccaggcagttaggggctttgagcttatttcatgctaccaggggcagcttagatggggtcatgttgttgtctacgtccgaccagagcgggtgctacagcagtttgggtacaagcaagccatccctttgccgccggtatcaacggactacatggattggttttttcagatctctcactcgttcgtcacgccgacccaggaaggcgatgcgccgagacagtcagctaccccatatgtggatgcatacgtcgagccacatgtgccagaggtttcagacgcagatgatctccccagacattcaatggtttcttgtgaaggttgtgaagccatcacagaaaggttagagcgtgtgctcaaccttaggatggtgactgcaggaacatag

SEQ ID NO: 5125 - DNA, 255 bp, Glycine max
  Peptide Sequence Number=SeqID_96810
atgatgacaaaggtgatgacaaaaagctcaaagatcaatcaaagaacaactcaagtgaatcaaagatcaatcaaagaacaactcaaatcaatcgagaacaattcaagagttcaagataagaatcaagaagaattcaagactcaagaagaaagtctagagacaagaatcaagattcaaggatcaaagatctcaagaatcaagatcatgattcaagactcaagcttcaagaatgaagagaagactcaatcaagataa

SEQ ID NO: 5126 - DNA, 765 bp, Glycine max
  Peptide Sequence Number=SeqID_96811
atggtgtacaacacctcaagcattgagccttatggtgtaaatgctttaagtccaaatcgtccttccttgagagttaatgttcacgggatatccatcatgaatgtcctgagatacccatcttggatggtgtacaaccgcttaatcattgagccttatggcttaaatgctttaagtccaagttgtcgaggttctttctcaagacccaatagtctacccgggatgcccatcatggaggtgtctttttcaagagatgatgatgacaaccaacacattcattcaggtgaagccaccaagcgagccttttcctctttctttgtcaacctgttattttcggttcctaaaattgaccccttggataattctaacgagtcgatcatgggtttcatcagtcaatttgaggaaggcgacataaaaaataccagtgtggagtatgccttggggggtccgacaatgatgaagttgttgataatatactttgacgatattcgagatgcctttgatggtgaaacaaggtataagggaaatggcatagaagatgttgagggaaccaacaaggatgtccctattgatattggggtaggtggtaacaatttggttaaagtggagtcgtgtagtgataatgagaggatttgtgagtcgcctcccataggagtggacgagtttacttatatgtatgaacttcttgctaggaaatttagtgttgtatttcccttgtctaacttccattgctctgctgtatgcactatttattgtgcaccttcctaa

SEQ ID NO: 5127 - DNA, 462 bp, Glycine max
  Peptide Sequence Number=SeqID_96812
atggtattcgcatctggtatgacataccaatttaaggtcgtatttcatgttgacaggaatatcattgaggtaccctctatttatcataaacaatgggctccagattacccggattatgtggtgttggactacaatggaaagaagcaccatataagagttagaaaatttagtaaccgagtctacattgctaatggtctcaaacacttcaggagtgatatgggaatatatgaaggagacgactatgttactgtccttggtgttcgtgggcgtcgtcacttttggaagttgagtatgcataatgggcttaaatgttttgctgagccatggttccaattcttaacagaaaacgatttgatggccgttgacgaagttgtcttttatttcaggccgaatcaacttctttgggaggtcattgccagaaagaaaactgtgtgggacgaggacgaggacgactccccatga

SEQ ID NO: 5128 - DNA, 711 bp, Glycine max
  Peptide Sequence Number=SeqID_96813
atgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttggagaccagtcagggtcacagtgttttgcgagaatgctccaaccatatgggatcaacataggcttaaaggagcactcaaaccgtgtgacccccaaggcctacactccgaagagtatgtcagggcctctcactcctgattcagggttcccaaacgttaaagaggatgagaagagattgaagcctctatttgtactgtcatcgtgcgattcctttttctccctcctcgaatactatttcgcaaataacaacggtgaagctctggatttctgcgggaaaggaaaatgctacaatgcgaggggtatttctcttagcttagatatgatatcgcaattcccaacggatgctcgtccctgtggtggtttttttggctggattattagtgttctattgccgtttatggccattgatggtggtcgaagtagaaattttctctcacctcatgttggacgccaaatatttttactaagtttggaagaatcttctcacaatggcaatccttcccaagctcctccatggacaagggtggaggtacctacaaagatacttcgacgctcaaattag

SEQ ID NO: 5129 - DNA, 1818 bp, Glycine max
  Peptide Sequence Number=SeqID_96814
atgactatgcctgcttccgcagttgatggaggtggcgatcctctgccgaacggagttctcatgccgccttatcagaattcagtgcacacaaacttcaatcactccatcacagaaaagctcgattccatcattctcatcgcggatttgatgttattagagaacaagagtttgatgttattaaaggtgataatttttgtatttgagaataacacactaagtgaagttctatcaactggtatcagagttccgatcttggagcatagaatcgttaatagtgacaagggcatatgcaagaatggagacgtgcatgaaagccatggagaaagtgatagaagagaatcgcgaagcagtggaatggcagttgagttcaatcgaagggatgatacaaagggaaaagaacaaattggaggctgttatggtcgcaatgaatggggaaactctggttggttccaatggtgggaatcttggaatccaaaccattcttgggatgggttcaagattactgtcacccaaaggtttcaagcttcgagcttgggaaatccttttcaagcattgctggtattagaacaagaagagaaagtgcagggattcataggccaatttaagaagtgcgttggaatggtgaagggattggaggagccatttctggtggaagtgttcttcaagggattaaaggaagagattagcaccgaggtaaggcttcatgaaccaaagaacttgatggaagccatggttaaggctaggagagtggaggataagaacagaattttaggaaacttacccatgagtaatgcaaacaataaggtgactgaccttcataatgctgtaaaaacagggacaagtggctggaaaggtagaagaacattccgcaatttgtctcctacggagtttagattgatgattatggaagaagaggaggaaggagatcctaagagccagcaatgggagaatagggaagaagagatgggggagtttcatcaactatccttgcctattgaaggctttaccacccggaaatctcttaagttgttagaggtaacccccacaaacccatattctgtagaagtaggagatggacatagggttaggtgtcaaggaggatggaatggttggctggattgggggagatcagtgttgtcaaatggcggccatgacggcgcaatggcggaaaagtgtggtggatttttggaaaaatgccatcgaatagtggtggcatggcggctttcgaatggcggccgccatagccatggcggagttgggctgacccgacccaaccctacccgccgcgatgccccacacccaggtgcgacccgctgcacacagaacacagccagcagcaacgaccccacggcggcgacgagaatggcacgaacggcggcgacaagcaccggcacgaacaacagcaacgacccacacgaaggcagtgaacatcgcgatccaactcagtgtcgggtaacgttgcagcttccaagaaaagatattgatgtgtgcaataacaaccaacaattgaagcaaagatataatgcaagagatgaaattgatccaatttctcttaatgatattgatgtgtgcaatgaatggctcgtgggagagatggatcaagatggtgataatgatgctggaaatgatttggtatttgaagatgatgatgctctaaattgggcaactgtgtatcaggcttcgggggagaatattgatcttgaatctgaagaagaaatcatggtcaattttgaggtgtttgatggggaagagggagatgctccattaccatatgataacaacgaagatgattatgttgggattgaagaagatgattag

SEQ ID NO: 5130 - DNA, 837 bp, Glycine max
  Peptide Sequence Number=SeqID_96815
atgcggttgcaatcaaatcctactgaccattccaacttggatgaactaaaacaattttctgagtggttgctagacataggtgatggtaaacttgcagaacctaatgatggttatggtgaaatcaccatcccagatgagtttcttatcaaggactttcaagatcctatccaggaaattgttgaagcaacatatccagacttattacacaactacaacaatggcgatttcttgcaaaaaagagttgaccttgcctctacaaaagatgagaaagagcattgtagtgctgattctgttgacaaatcagatgaactactcaatcctgcatttggagtactaacagttgaatttctaaactcattgaagacatcaggcataccaaatcacaagctcataatcaaggttggtacacctatcatcctactacgaaatctggaccaagctgatgggttatgcaacgaaactaggcttattgttacaagacttggttcaagtgttgttgaagcgaagattattactgggtccaacataggtcatagaacttacataccaagaatgaatctttctccttctgattcaccatggccattcaagctaattagaagacaatttccattcatggtttcatttgcaatgacaattaacaaatctcagggacaatcgttggcacatgttggattatatttgccaaccccagttttttctcacgaccaattatatgttgcactttcacgagttcaaagcaaaaaagggctccacattcttattcatgataatcaaggcactcccaaaaatactaccattaatgtagtatacaaagaagttttttcaaacttataa

SEQ ID NO: 5131 - DNA, 825 bp, Glycine max
  Peptide Sequence Number=SeqID_96816
atggatgaggtaatgggaatgaggttgttgtcaatgagcagggcaacctctgaaaaactcatggcacacctgaaaggattcctgaggttgactagcaccatcaatgtgcaaaacgtgcctagaaaagatattgagaattttgtgtcgaaggagcaggagagtttggctcaagcatctgagaggaaatctcatgttgaagctaccaagatcattgaagatatgccttctaatccctacaaaaattatagggataagaggattgtgaggagattggtgaaacaagtggaggctcatagaggaagagaatgcccagtgagtaatgcacttgcacatgccatggaggaagtaaactatgctggtgtacagagtataggatatgatccttactttaatacattcaaccaagatgttatgatccaatatatagccaagaatgatgagcacatgaagttcatggagactcaactctccaccatgaaagatcttttgtcccaaagagctcctaagactcttccttctcaaatagaggttaatcctaagaatgaggagtttaatgtagtgagcaccagcatcggaaagcctatggtagagtcgaagaagacaaagaaagccactccaacactagaaaaagaggctctcactgaagaaagtcacaagatagaaaaagtgggtgaaaaaagggtattggcacctcctcaggaccctcacttacccacaacgggtaatgcaaaacttattggtcaaggggccttgattgatgtccaagaagggaaattgacatcgaggctaggtgatgagaaggaagtgtttaaggtgtttgattaa

SEQ ID NO: 5132 - DNA, 444 bp, Glycine max
  Peptide Sequence Number=SeqID_96817
atggcattcttgttttcatcagcatttcccaacacctctcggaatttcacgaaaacattccaaaggctctgcttctccatggctacctcaccaaaagaaacttcagcttctggttcaccctctgtaccatcatctccgcaccagggacaacctgaattcaacatccaacccatacaaatgatccctggtcaagcccctgttcctgagaaactggttcccaaacgacaacagggagtgaagacttctgaaaaccctagccttgcaacaagtcctagggaagtagacacggagatggacaagaaaatccgcagtattgtgagtagcattttgaaaaatgcttctgtccctgaagctgatacagatgttccaacatcttccactccaaatgtttctgtgcctgatgctgataaagatgttccaacatcttccaccccaaatactgaa

SEQ ID NO: 5133 - DNA, 132 bp, Glycine max
  Peptide Sequence Number=SeqID_96818
atggcagaggaatggagaaggaagaaagattattggagatgccacttcaaggataagagcttgaaggtagaagaagatgagtggagggagaaggagaggagcacgaaattttatgcctcaaatgaggtctaa

SEQ ID NO: 5134 - DNA, 330 bp, Glycine max
  Peptide Sequence Number=SeqID_96819
atggacttgggtggtggcgtcgcgtgcatgcgaagggataggtcacccaccagctatggtgtttgggtcgtggatgttgttgtagctgcttctgttggtgacaagattggggatgttgatgttggtggtacgattatggtcgtggtggaatggtgtgcgcatgaccttgatgattcatatgggtactcaaaccttgataattcatatggctctccctcttcccttcccttaccacctttcaattcactagcaccacaacctacattgtcaagttccattgctcctctaaatttgacacctccaagcataggtggtaaccctttcttctag

SEQ ID NO: 5135 - DNA, 549 bp, Glycine max
  Peptide Sequence Number=SeqID_96820
atggcattcttaggagagacttcgtcccagacgatcgtgaactcgaggttggcattcatttttccaaatggaaccgtcattcacaacgagtgtggggtttattttcaaagttctagtccagtgcccatgcgagtaccaaacctatgcgatttttcaactctcaaaagcagaatacacaacagtcttcggctaaacaacaatcaagttgtggatgaaattcattaccggcgaccagtggaagatacaggatgtagcatagatcaactaaaggatttgatcaagcaagtagcacctaaaggaaatcctcctcatgggattcacgaattccaagttgtaaggcgtttgttttatcgacaacctagtcatttggagtattctgagaaagttttagaatttgaaattgttgagctgaaatgtgacgacgatgtgctaaaggtgctggtagagtctaattactggaaacaatttgtgccaatagaaattttggctctctttagtaaagtggttatggaaaatgaggacgatgtgattacgtccttgcatgattga

SEQ ID NO: 5136 - DNA, 1095 bp, Glycine max
  Peptide Sequence Number=SeqID_96821
atggatactcagttaccgtcaaatattaggaattggatttcacaagtagattttggagggataattggagaggggggtgataggtggagatggaaccttaagtggagaaggaggtggttcgaatgggagaggaatttgattgacgacgtggagctttcggtggaaattcacaaggagccttcttcttcctccttcgatttcttcttcttcttccgtgacccaaagcttcttcaccttcgagttcttcttcttccgcgaccagagctccaagtgtccagcagtcttctccccgcgtccaggttgaagacaagccttcttccgcggaaggttcgtttcttccgcgcgtgtctgggtgccgttggaggtcgggcggaagatcgtttctttcgcggactccagcggaagatggaagatatggcacttccgtgggattccgcggaagaaccatcttccgcgagaaggaaatatgccatatcttccatcttccgccggcatccgcggaagaaaggttcttccgcgggagtgcttttccttcttgcggaagaaccttctttcgcgagcacaagtagaggcagagaccttagtcagcatgtggctgaggatgttcctcggcgtcttaggcccactgcctcaacacgtaggcaacgggttacccagagagtcgaggatgttcctcagttgcctgaggatgttcctcagttggctgaggatgtgcctcatgcgtctgatggtagcccagagaggacaagagccgtcgatggtgctgagtctgatcgagtggctagtgatgggacagctgctgatgatgaggggttccccgatgggccacgtgatccatctgttttgataggatttgctgatgatgtgacacacaacatatggagtggacatcaacccgatctcaagttggtctcccatggtaggaaagtagataaatttgggagaccggctgttgagatcgaaggtatgattgcggccaccgaattggatccattgatcaggtgttatgtgatcaccactgatcctggactcatatccgcctttgttgagaagtggcatagggagacgagcagcttccacctcccagtaggggag

SEQ ID NO: 5137 - DNA, 1029 bp, Glycine max
  Peptide Sequence Number=SeqID_96822
atggacaacgcagctgctgaacttcaaagtgaggcagcagatcctgctcttcttctccgccatcagacttgtgctggaaatgggattggtgacagtacctccttgattccagaatcctccagaagaccaagcctctcctctctgcaaataccagcaaggtcagtggaaaatgcattatcatcttttaacaagacagatggtcctacattgatatcaagtgcaggttccagtagagggctacccccaaggccaaattcagccagtgccatcaagtccaccatgagaactttactctctgagaggagctttagggctaagaattcttcacaggatagtgaaaggactgttctgattgttcctgatgcctcaccatctgatggtcctgtggataataagccttcgacttcgcggtccctttctcttaacaagtttttgttcgcttcttcaaccaaagcaggacattcgttgccggttaccccaactgcaaattcaggtgtagagaatgtacatggaagacatctagggtgtgattctgatttaagtaaagtgaaagtaaatcagcacatgactcgatctgtttcggttccagttaatatcaaaactgctaatttaaggcatacagattctagaaggctggttcgtgtaatttctgtaagatcacttccaggcactagtggtggcatttcagctgacaatgctttgggatcagagattgtcaatgaagatgcttctgaggatattccggaggaagatgcagtttgtaggatttgtttggtggagcttgtggaaggagggaatactcttaggatggaatgcagttgtaaaggtgagcttgcacttgctcaccaagactgtgcagtaaagtggtttagtatcaaaggaaacaagacctgtgatgtctgcaagcaggaagtccaaaaccttccagtaacactcttgaaaatttctaatccccaaactgttactcggcagccattgaatgcaccagaaccacaacagagagaagtaacttcttacaggcaagcttaa

SEQ ID NO: 5138 - DNA, 228 bp, Glycine max
  Peptide Sequence Number=SeqID_96823
atggaaaacaatgtcgtacatgtggattatggaagcgatgtaggaaatggaagagaaggaggacacatactagtgtttgtgggttcggaatatggaaggcttggttctgtgatggacttggattatgaatgctacaaggctataactacacgatggtgcactaacaccagtttgttttacaaagtaactcttcaggatgaactttcatttgcggccactgcagcttaa

SEQ ID NO: 5139 - DNA, 375 bp, Glycine max
  Peptide Sequence Number=SeqID_96824
ttagtgtcacatgggaggaaggtgacattgattgggaggccagtgcatgagattgaaggactggtaggtgctacaagattaagtccactgatcgattgttcagttgttactggcgatcctggacttgaatccgcatttgtggagaggtggcacagcgagaccagcaccttccaccttccggtaggagagttgacgatcacattggacgatgtgtcgtcactcctccatttgcctatcactggcgcgctgcacagctttcatgctctttctacgaaggaggcgatctttttgctgaccgagttgctagaggtgtctgccgaggaggctagaaccgagacaacactgacacgtggggcatacgtacgactgggatga

SEQ ID NO: 5140 - DNA, 612 bp, Glycine max
  Peptide Sequence Number=SeqID_96825
atgtctcaaaaagaaaatcttatatctgaattgcatccaaggaaagggacatggaagatagcaatgcgtataaccaatatgtgggatgttaagaagcacaatgggagacaagtgattgacatggtcttaatagaccaaacgggtgtaaagattggggcaacgctatggcaagagttgttccctgaatttcaaccgaagttagctttaggttgttcatacttgatccaaaacatcaaagttgtggacaatcaatctgaatacaaagaggttgaaagacttgaaattcctgctaatgtacacgtgataactgaaattgttgatattatttctggcattgcaccgcgacatactttagttgatgtcgtgggtgttgtcgctgaagttattgaacgaaaaatagtgaatcctgcatacagggttacagtgaagttgagagataatagggagccgttggtgcttatgttaacattggctaagatcaaagatgccaaagacaagtattccctcagtgtccaaaatataaaaaatggttccaagttgtatgtaaacttcgatgatattgctgagataaggaaattccgtgataggtatgataactgcaaaacaaattaa

SEQ ID NO: 5141 - DNA, 1233 bp, Glycine max
  Peptide Sequence Number=SeqID_96826
atgtacaacaacaaagatgttcttgatgaagacattatcattgccacgaagaatatgctagataacaacaaccattatgcgcaaaagtttagaatggcaagggataaactacaatcttcaatagtctctgacctaaagcttaaactgatttatgattggcagtcagatggaagattatacaatttgccaaatactactgaagttgctgttttgattgttggtgacgagcacacaggtaaccacagggatatcataatagaaaagcaaacaggattgttgaaaataatcaatgaacttcatcctgcatatttgcttttgcaatatcccctattgtaccctagaggggaagatggctataggccagatattcctcataaggatcatccaaatatccatgcagcaaagagaaaaaaggttaccatgcgtgaatatttttgttacaggctacaatcaatgaacaatgaagctcaaacaatactgcattcaagaagattgtttcagcaatggattgttgatggttactgtatgattgagtcgcaaagactaaattatgttaggcaacatcaacaacaactcagagttgaaaaatacatcaatttgaatgtctataacaatgcccctgaaacacttggcaatgaaaaagttatttacactattgagtggcaaaaaagaggattgtctcatgctcatattttaatatttttgcaacctgcaaacaagtatccaaatccagaagacattgataaaattatttctacagagatacaaaataagtacacagatccagaattgtatgaaattgtctccaaacatatgattcacggtccatgtgaactcccaaatagaagtgcaccatgtatggctgatgggaagtgtattagatttttccctaagaaattcaacgaagccataattgtagaccaagatggatttccagtatacatgagaacaaatgacgggcatacggttcagaagcatggtattgaacttgataatcgctttgttgtaccatacagtctacaattgctactcaaatacaggacacacatgaatgtcgaatggtgcaatcagagcacatccatcaaatacctgtttaagtacatcaacaaaggttctgatcgaattacaacatctactgttaatgtgcagaaccaaaacggtagacaacatcaggttgacaacgaaattaaacagtatcttgattgtcggtatgtgtcaaacatatcttcttaa

SEQ ID NO: 5142 - DNA, 1110 bp, Glycine max
  Peptide Sequence Number=SeqID_96827
atgctggcagccaagaaaacaaggaaatacaatagggaggctgatatgggtaccccttcaactggagagttgttttacatgaggatgatgttttcctccgctaaaggctcacaatcttacaaagatatcagaacagtagacaatgttgtctaccatacttttagagaagcatgctttgcaaaaggtttcctaggaagtgatcaagaatttgttggtgctttgcgagaggctaacacttggggaactccacacttccttcgaaagttatttgtcaacctgctatttatgaatacaatggagagaccagaatatgtgtggcaacaaacttggcgatggatggcagatgatattgtatttaatcatacaagtcaaggctatgctgccaacccacaccaaaataagctcatctacaatgaaatggcttatgacatggaagttttggctgtcgaatttaacagatgctatcactcaatgacagatgagcaggcttctatttttgataatattatgcgtgttgttgcaagtcaattagggggagtttattttctctatggatatggtgggactggcaagaaatttatgtggaaaactttatcatctgctatgcgctctaatggaggcattgttttaactattgcttccagtgggattgcttcattattattgcccggaggtgatggcaaacttggccaacctaacgatggacattgcgaaatcaccatcccagatgagtttcttataatggattttgaggatcctatccaagaaattattgatacaacatatccagatttattacaaaactacaacaacgcagatttcttgcaaaagagagctatcctagcctctacaaaagatgttgttgacaaaataaatgactatgtcctgtctttgattcctggtgacgagaaagagtattgtagtgctgatagtgttaacaaatctgacgaactactcaatcctacttttggagtactaacacctgagtttcttaacaccttgaaaacatcagggatacctaatcacaagctaagaatcaagattgatggtttatgcaatggaactcagctaattgtcaccaaacttggaaccaatgtagttgaagcagag

SEQ ID NO: 5143 - DNA, 423 bp, Glycine max
  Peptide Sequence Number=SeqID_96828
atgagtgaaatagagaaggtgcaagagcagatgaaggctgacatggaggccatgaaagagcaaatgaccccaatgatggaagccatgatgagtatgagaaggatgatggaggtcaatacgactacagttgttgccacaagtcagggaggcaaagcgttgggaagtgcaggcggcccccattttgtgcaggctcaaaataagcattccttcccaccatatggcttgcctcccaactatacgccacccaatgttgcatacattcccaatgagaatgtcgacaactccacacccatgcccattgagagccaacaaccacaatttgatcatgcacatgtctctcaacccatgggggagacacatgaagtaccccgccacactgtagccgactttgagcctcacctcaaatatgccactgagggacag

SEQ ID NO: 5144 - DNA, 1176 bp, Glycine max
  Peptide Sequence Number=SeqID_96829
atgttgtcaaccattatgttcgtttctaacgcattcaatgctttcacgagattcaatgatgacctcgtttacacctgtggagattcccatgttagtgatcaagtctctagcattcgtgttggtgatgccgttgctagttgcaccatcactcaccctaacataagtgtcgtcgcttttgtgggtggcatcactgctaaggaaaggcctcacccttactctggcatgtgtcttattcccgtggaggatgaggccgagtcttctcagctgaatcctcctcaaaatgtcatagacttagactcagaggctatgaccatccaagtgattctgggttacttgatgcaatcctaccccccaagggcattggatagaagactccaagaagattgggcaaaagatgcaagagaaggccctaggattctcatgagccttaggactcatcttctccttgaagtggcgtctcctctctctctccctttctccattccgctgccattcatcttccaagaagcaaaggaatccattgatgaagaagatcctaggcctacaagctccaatggagcttgcatcattactcctgggttcatcaggaagttggattctacgaaagaagtcgtcggaccctacaccacctcttataagaatttcaagggtcatttctttcaattcattaaaaagcttgttgtttacatgttcgattcagatcaagaggacatggtcattctttataagtttcctaaaggccttcactgcaaagccttggtggatcttcccttttccaagactccggatgtaatgggaaaatttgactatcgatttatcaagaaagctcaagccgagaaggttcctcctcctcctccttctgttattactagaatttccatccaagaaagccatgggcctctgagtggagggccttcaaagaggcaaagggtggagttgataccggttgccactccttctgtcattgagagtctcaacgccttcttgtctatgaaaagaagagtgccttctttgtgggttgttccttgcacgccaatggattacattgcttgtttcaccaaattctggggcgatgagtttgaaagggcaaatgtcgagtgtcagagggcacagtctgattgtgccaaggttgaaaaagccttggttaaagccacacgttctaatgagatgtgctga

SEQ ID NO: 5145 - DNA, 1905 bp, Glycine max
  Peptide Sequence Number=SeqID_96830
atgcgggcgaaagaggttgtccagtgtcgaagtagattgcccctcatcgagggaatctatctgacgactggggtagtaatcttgacaagcagagggtcaatgtggcttgtcaagcccccgagcctggacatgtgttgtttgggttgcttctatcaagttgtccgtgatggacgtgtatttggcatgctaggtaagggcatctctttagctcccgccagttatcgaaaagtccatctcccctataaatggagtggacgtgtgattttgagtcattgttcattgtcttcttacttcctcgcttactctcgttcattcttgattccttgtgcttttttgacttttggtttcccttttcgtccaccacaatgtcttcttttttgtatgattccaccattggactgggcgacaatgattctgggggctcaattgagcacccatcatggattgaaaggtcatctcgataggcgggtacgactttctactgctgctggggagctagtcccggttactatgatcctcccctcttgtgctttcaggggtacgaggagagctagtggtgatggagatgtgaggtcgtctcctcgtgtacgacctagcgcgacgagtgtcgctgcacttcagcgccaggtgaagctggcgaaccctgaggactcttgtaagatggtcgttcaggcttgcaagagtgatgacttcccattttttagggcggcgcctggtcctgggtgtcattctaccttgaccatttttcagtgtgctctgctggagcacttgaatatggcctcttcccagctccacccaatcagttgggcaatgttgtctggcaagattggatgggattccttgaacagcgtgtccaagaagttgtttgagtttgattggaacatttttcaccgttttaaggaccactttttcaagtctgatcccactaggttcaagtcgtatgatgaggatctgttgacccttgtgaagagggtcgtcaaagtaattttagagcagttgttggcctcgttggacacgtgggccatcttgtctcttcctttggaaagcggctttgccggtattatgagtgactttgcttggaggccacttgtgaagcaggtcgaacttgtaggtggaatcgtgccaccatctgttgctgctccatccgctggagaagggggccaacctactggcaaggttggtcctgtttttgttgttgttgaggtcgccctcagtgctccttcctctattttggtaaagaggaagggagattatgctgctaggccattgggccgcaagaagtcaaaggctcctatgagcctccacgccctgaggcaggctacagagttagggcccattacgggtcacctcacgattgtgcaagatgtgcctccagcttcaccggtcgttgaggctcttgctcctttatctcctcctgcgactgttgttcaacaggtttctttcactgttgttgaaactgttgtgccagccactaaggctgagtctgttgtggtgccattgtccatcgttgcgacccctttactaagtgtcaatatagcaaccattggtgctcccatggtgccacctttttcttcattgactctggtggccctccttgttgctgttttggtgactatggcatcacattcttcatcctcgcaccgccgcatctccctcgatcatttgtacacctccaatgatgctgactcactgtggggtgccacttacaagctgaagcaaaagaccccggctgactttgtgtcagccttcgacaaaaatctcatcaagttggttgtggtgcagaatgctactgactatgccaaggtgttcctccaaaggagtttggcaattctggaggagaacggtttacgacaccgagaggcggtgcaaaaggtggcgtccatcaagtatagaaaggaaatgtaa

SEQ ID NO: 5146 - DNA, 1044 bp, Glycine max
  Peptide Sequence Number=SeqID_96831
atgaaaagatttcatagtaaaagaaaactcttgatcttcctggtggtaatcccaagcctagtcgctgccgagtgcacgtgcgatgaagaagaccaagagcgagacaaatcaaaagctttaaggtacaaaatagcagctttaatatcaatactagttgctagtgcaatcggggtgtgtattccacttcttggcaaagttatacccgccttgagccctgagaagaacatattcttcatcattaaggcctttgccgcaggtgtgatattggcgaccggttttattcatatcctacccgatgctttcgagaaccttacttcgccgtgtttgaataagtatccatgggatgctttccccttcactggctttgtggcaatgtgcactgccatggggactctcatggttgagacttacgccacggcttattttaaaaaacatcatcactcacaagtccagacaacatacgtggaaaaggaggaatcaggggatgtgcatcttcacacacatgcaacacatggtcatgcacacggccatcttccctctcatgatcatcaatcatcggcacttcttcgtcatagggtcatatcacaggtgttggagctaggaattattgttcattctatcatcattggaatttctatgggagcttcagaaagtcctaaaacaataaggccactggtagctgcattgacttttcatcaattttttgaaggcatgggacttggaagttgtataattcaggcaaatttccagaggttatctattacaataatgggattgttcttcgcattaactactccagtggggattggaattggcatagggataactaatgtttacgatgaaaacagtccaactgccctaattgtggaaggaatcttcaatgcagcatcagctggaatcttaatttatatggcacttgtagatcttcttgcagctgattttatgaatccaagaatgcaaaaaagtggtagcctccgattaggagccaatctctctcttctacttggagctggatgtatgtctcttctggctaaatgggcttaa

SEQ ID NO: 5147 - DNA, 246 bp, Glycine max
  Peptide Sequence Number=SeqID_96832
atgtacttgcctgctcatcttcaaagttcctccatatcagatacttgcctgctcatcttcaaagttcctccatctgcatgtacttgcctgttatcaaatggtgcatggccaccgcatggtctaggttttggatattcaacgcaacctatgagaactgcttgctacttggataaagataaagctggtcaatcaatagatataaagaaatatagagatatcaagccaatcccaaagaatttcacttaa

SEQ ID NO: 5148 - DNA, 357 bp, Glycine max
  Peptide Sequence Number=SeqID_96833
atggggttgttcttagctttaactactccaatggggattggaattggcatagggatcactaatgtttatgatgaaaatagtccaactgcccttattgtggaaggaatcttcaatgcagcatcggctgagatcttaatctacgtggcacggatagatcttcttgcagcagattttaaaaatccaagaatgaaaaaaactgctactaacaagaatttcctttgtcctagtgcagttagcaagggtcctaggatgtccattcctcaaacaatgaaaggtcgtggggagacaataggatgcaacttttcagccgagcacatagttagcttggtcttggtcaagacatttgagtatgggtga

SEQ ID NO: 5149 - DNA, 444 bp, Glycine max
  Peptide Sequence Number=SeqID_96834
atgggaatgaaacaagtcattaaaaacctcgacgcctttcctcgcgccgaggatcacttgttgcagaaaacccaatctggggctctcgtatccgtaattggtttgattataatggccacattgtttgtgcacgagctcggttattatcttacaacttacaccgttcacaagatgtcagtggacttgaagcgaggggaaactcttccaattcatattaacatgacgtttccttctttaccttgtgatgttttgagtgtagacgccattgatatgtcgggcaagcacgaggtggatcttgatacgaacatatggaaaaagattcacttatcacttatcagtattgtttcgtactggtcaatagccaagaaagcgatgctattgcagtgtgttgcagtagcgtattattgtagccgtctcattattgagagttgtattgatgcttag

SEQ ID NO: 5150 - DNA, 615 bp, Glycine max
  Peptide Sequence Number=SeqID_96835
atggctcttaacaccagaagcttttccaccatcctccccatccccgatggcaagaattgggaaagatggtgcatccagatgaaggcgattctcaactatcaagatgtcatggacatcatggaagaaggctacccaagccttcctgaaggggccacggaggcgcagaaaactatccacaaggagaacaagaagagagactctgcaacttccaaagaagcatgggacattctggaaaagggaaattccggtgcaaatcaattgaagaaagtaaggttgcaaatcatgaggcatcagtacgagctaatatcgaagaacttcaaggatcccttgaagcccatgagcaacgaatcaatgaaagaaccactaagaggcacacagatcaggcgttgcaagcataaactcacaaaagaggaggaagcagtggtaaaagctacaacaaaacacgaggtaggggtagagatccaagatcaaatgctggaaaggctcctcaacaacaagaacctgaaaaacatgactcagaacagcctgaatcgtccaatgataaaggagggtataggcagtatagaggaggaaagaaaagatttgatagaaaaaggcttaaatgcttcaattgtg

SEQ ID NO: 5151 - DNA, 411 bp, Glycine max
  Peptide Sequence Number=SeqID_96836
aagaggttttccggagtcttccggaagacgtttggttacttccagaagaacacttcttccggaaactttccggaaaatgttcttccagaacttccggaagaacccctaacgggtcttctggaagacaccgctgtcatcctttttcaccattttttccggcgtactctaatcttctcccctctcgtcttctaccctaaggttactaccctaagtaaaagcaatggagagttagggagactaacctcgaaggctgttcgcagagaagacggagaagaagaagaagcttggctcgtggtgtccggaagaagacgaaagcttggctcgcggtgtcacggaggatcaacaggaatggaagaagaaaagaagcagcagtggtcttccgagaagaggagcgcgtttttaaatttttaa

SEQ ID NO: 5152 - DNA, 390 bp, Glycine max
  Peptide Sequence Number=SeqID_96837
atgtgggtatctatagggtcgaacgtttacaagttgggtaggtgtttggaagaggatggtggcatattttgtgagaagggatgctatttctgggatcagacgttttacttgttgagaggaaacattctcgggtgttataggggcgtctactcgaagggttacagattcaccattatggaaggagattggttgcaaggcctgtacctctctgcggatttctggaataaggccaaagatgaagcaactgaggagaaaggacatgggcagtccaacaatccggccatccatatagaacgaggagacagtgatgcattcttcatctggagtattgtgataatcaaagaattgggagatcttaaagatccatcccatggcgtcttgatagggtag

SEQ ID NO: 5153 - DNA, 510 bp, Glycine max
  Peptide Sequence Number=SeqID_96838
atgtatgatattgatttgaatgatcataacatgcatgaattgatgaatgacattgcatgttggccatggcaatatgataggaaaaccatctataatggcctaactaatgagataaccctcacccaccttggaacaaagtttgtgttgcatcctcaaacaccttcacaggtggccaaagatcaactaactatgaaagatatgagggatgaggaagaaaaactagaaaaacaaaagaaaaagaaggatagtaaggccttgtcttcaaaggccaaggggaaggaaaaagaggaaaggattcctccaagaatattgttaagaaggaaaaccattttgcaacaaaaggtgatatcaaaagagcacttcttcttaaacaatccttctaccttttcttgtcaagggaaacatcccttagcattgccatacctcttgagcttaaggtattatgaggcaccaaatccctatgataggtggtatgatgaatgtgttgagtggtgcaaccctcttttgtaa

SEQ ID NO: 5154 - DNA, 342 bp, Glycine max
  Peptide Sequence Number=SeqID_96839
atggaagagattgtttgtctcttgacgtgtgagaaacttgaacacaagggtgagggatcccaaggtgtgttcaaagattgtaaaggatttacaaggatagtggaaaaatctcaacaatgccatattaaatctgagtgtcctatctaccttagaaaacatgatgaaaagaaaggaaagaaggatagaaaacaaaagaaagcctacatagcatgggaatatagtgcatcaacaacttccagttcttcaagtgatgaagaaattgtcaacatgtgcttaatggcaaagtccagaccatggaggatagatctgtttgatcctcgacatagggcctcttcatgctga

SEQ ID NO: 5155 - DNA, 3030 bp, Glycine max
  Peptide Sequence Number=SeqID_96840
atgggcagtgttcgaaaactgatcgtggaggtagtggacgctcacaacctcgtccctaaggacggccacggaacctccagcccctacgtggtggtcgacttccacggccagcggaggaagacgcggaccgcggtccgtgacttgaacccggtctggaaagaaacgctgtcgtttaatgtagacaatgttaactcccagtcgtctcaaatcttcggcgacacgctcgagctcgacgtttaccacgacaagtcctacggctccacccgcagacacaactccctcggccgaatccgcctcagctccgcccagttcgtcaacaaaggcgaggaggctttggtgtactacgtcctggagaagaagtaccttctcagcatgatccaaggtgaaatcggtttgaaaatctactacgtcgacgaggagaaggttcttaaaatagaggaagcaccgccgcccccaccaccaccgcagaaggaagcagagattactgaaccggagaaagtggaagaaacacctccaccacaaccaccagaaggtgagaaacctaaagaagaagaaatgaaggaaaaagagaaagaaaacgctgaacctcctcctcctccagctccagctgctgcaactgaaaaaccaccacctgaagctgaacaggattatcaaccgttggatccgttgttagatgtgaaggcagcgtctgtgtcgaggtcgaattcggaaataagattcaacggaaccaataacggtcctgcacctcctcaaccaatgagaaggtctgcatcaacggcgagttttgcagcatcagaggcgtcgagtgaaactagcagcatgatgacgatgatggaacggtcgtcgtttgatcttgtggagaagatgcactacctcttcgtccacgtcgtcaaagcccgctacttacccaccaacggaaaccccgtcgtcaaaatcgccgtttcggggcagcaccacgtcacgtccatgcccgcgcgcaagtccaccgtgttattcgaatggaatcagaccttcgcattcgcacgcgacgcacctgattcctcctccgtgctggaggtctctgcgtgggacccccaagcttccgaggctctgctcggtggtgtgtgctttgacgtcaacgagattcccgtgcgggacccaccggacagccctctggccccacagtggtacagattggaaggcggaggggccctccacggcgacctcatgatcgccacgtggatgggaacgcaagccgacgaatcatttcccgacgcgtggaagagtgacacgtttgctcatgtgaactccagagccaaagtttaccagtcaccgaaactgtggtacctgagagccactcttctcgaagctcaagacgtttttcttctgccattaacctcatccaaggaatcgtgttttcgagtaaaggccaaactcggattccaggtgctgaaatccaaaacggtggttactcgtaacggcaccgtttcatggaacaacgaagacttcatttttgtggtggcagagcccgtgagcgaccacctcatgttcactttagaaaaccgacaacctgacgcgccggtgacaattggagtcctcagaatacctttactcgctattgagagaagggtcgatgaccggagcgtggcgtcgcggtggttcaccttcgataacgagagcgacgacaaagcaagcagcaggcccagggtgcacctgcggttatgcttcgacggcgggtatcacgtgatggacgaggcggctcacgtttgcagcgactaccgccccacggcaaggcagctctggaagccaccggttggcacggtcgagctcggcatcattggctgcaagaacctgctaccgatgaagacggtgaacggtaagagctccatggacgcgtactgcgtggccaagtacggtagcaagtgggttcgcacgagaaccgtttcggataacatggaacccaagtggaatgaacagtacacgtggaaggtttacgatccttccaccgttctcaccatcggagtattcgacagctccctcctcgacatggataatgacaaaaataccctcataggaaaagtacgcgtgcgtatctccacgctgcatacagggagagtgtataaaaacacttacccgttgttggtgctgagtccggtttcggggctgaagaaaatgggggagattgagatagcgataaggttcgttcggacgactcaacggctagatttcctccacgtgtactcgcagccgatgctgccgttgatgcaccatgtcaagccgctgggggtggtgcagcaggaggcgctgcggaacaccacggtgaggatggtggcgggacacctgtccagggcagaaccgccgctgaggaaggaggtggtgttctacatgctggacgcggactcacacaacttcagcatgaggaaagtgcgcgccaactggtataggatcataaacgtcatcgcggccgtggtagatattgtacggtggatagagcacacgcggggatggaggaatccaaccgcaaccatattggtgcacgcgctgttagtgatgttggtgtggttccctgatttaatcattcccacgttctgtttctacgtttttgctgtaggtgcgtggaactacaggtttagggcgcgtgacccacttccgcatttcgaccccaagatatctttggcagaggttgtggatagggaggagcttgatgaggagtttgacactgtgcccagtaacaaagcgagtgaggtggtgcgagtgcggtatgacaggttgagggcgctgggggcgcgcgtgcagacggtgctgggggatttggcgacgcaaggggagcgcgtccaggcgctggtgacgtggcgggacccacgcgccacgggaatatttgtgttcttgtgcttgactgtggcgttcatgctgtatcttgtgccttcaaagatggtggcgatggctttcgggttttactatctcaggcaccctatcttccgtgatcgcctgccctcgccggcgctgaacttcttcagaaggttgccttcattgtctgatcgaatcatgtag

SEQ ID NO: 5156 - DNA, 369 bp, Glycine max
  Peptide Sequence Number=SeqID_96841
atggattgtgggggtagacgtttgtaccatgttagtgcctgccctttgagggaggtaggaaagaccttgcatatcacggtgtcatcattgaaatacaagttgacttgcatgctgaatgcatcaagtgttcaacgggatctgaggtaccgtcatatcattcaatgttcaggggtttccaggtatgtgtctcggcataggtgggtggtagggacagggaccgaggtagagatagtggtggtgggggtggcggaggaaaaattatccccggtcccaaggcgggcgccaaatgttcctactgagttccaacgaggtccgaccaatctgcttggtcctcttcttttgagtggaatcttcgatctccggcgatga

SEQ ID NO: 5157 - DNA, 635 bp, Glycine max
  Peptide Sequence Number=SeqID_96842
tagccaaggctaacaagaagaccaaaactatggccacacaactgaagtcgatgaagtttgagcttggcaagaccaaggaactcaacttagagttggccaaaattgatgacttggagaagcaagtgaaagatatcagtgtcagggtggaggagctgacttttgagaagatggtggaggagaatttgacaactgcggaagacaaagttgttgatttggagaagaaaattgaagatctgaagtgcgagttgctaaagaaggaggaggctaaatttgtgttgtcgactgagttggacaaggccaaaagatggatcatcctaaatcaccgagaggattcaagaaggctcaacatcaaatcaaacttctgcttgcctattggtctagggatgctctatcgaggatgtgagatgcttgatgtcaaactggttgaggaattcttcgtggcctttttcaatgaattgtcttccattgtctaccacgttggcttgagtgaagtagtccatggtgacgaggaggaacttgatttggtctttggctatggggaatggtccaaggatgtctattctgtacatgccaaaaggccaaggagaagtgatgttgtggagcacctcgggtgcgtgcgtggtgggcattgctga

SEQ ID NO: 5158 - DNA, 491 bp, Glycine max
  Peptide Sequence Number=SeqID_96843
atggaggatgggtctcctatttggggtaagtcctttgtggctagggaggtgaggggtataggggaatttgggagtaagggtgagttgtctttttcgtctccttcatctatatttgattctgagagaacaaaggacttcttggcgagtgaaatcaacttgacgaccttgaatgatgccgagttgttgaccatagagccctatagcgtcgaggagcgtgtgtttatgagagcatcaaaagaacaagttaaaggtggcaatgctgaggtggagatcgtccatttgggcggtcctgagatggcggacaaaggagttggagaaggcaatgcagtcgaggagcttgctgaggtgttggacaagggccaacaatttaaacaggggtatctcgaaagaataaggttactctgcattatcataacggtaaacttcatcgtctggatcatgttttttgtggctcctgaaaaagatgatggtactcacacaaaccaagaggg

SEQ ID NO: 5159 - DNA, 627 bp, Glycine max
  Peptide Sequence Number=SeqID_96844
atggctaggcttccctctattgatccaaatacaactactattttgatttatggatatcctaatgttggtaagagctcgttcattaagaagattaggagagctaatgtggatgttcagccctatgctttcactaccaagtctctctttgtgggtcatactgattataaatacctaaggtaccaagtaattgatatgccatggattttggacaggccttttgaagattgtaatattattgagatgtgcagtatcactgctttagcacatttgagagctgcaatgttgtttatcttggacgtctctggatgttgtggttatagtattgctcagcaggcagcactgtttcacagcactaagtctttgtttatgaacaagccgttgattatagtatgcaacaagactgacttgcagccactggaagggatatcaaaggaagacatgaagttggagccttgcctattgtcctatatacaaatttttaagaagtttgtgcttgagtgggaaaagaagagtggtaaggctcgggtccactctctccctgaagtcttatcctatcaaattcacaagaggtcgtggagtatagcccttgagcttattggagttgaagttgaagaaggtagtgagtga

SEQ ID NO: 5160 - DNA, 243 bp, Glycine max
  Peptide Sequence Number=SeqID_96845
atggccatggtgagcattactatgcttgtgagtatggatggtttgttgtatgacatcctacattccttcttgttcatcaatgttggacagtttggatatggaaacaccaatgttaccgattgttctaccactattccttatggagatttcaagataactcttgcaccacacctagttttacgggagaactcatctttgaacaatttccaagttagttttcttgttccacgtttgactttgtag

SEQ ID NO: 5161 - DNA, 186 bp, Glycine max
  Peptide Sequence Number=SeqID_96846
atggaagaaatgttcatattcaggaatgaagtcagacaagcaaggcacaagtgcaacaagcgagaaggaagcaccaagaccgaatcacacaagttagacaagaggcacaagtcggacaagcaccagcctatcccaaaaaggcccaggctttcaacttggaggtacccttcctgctacctccaatga

SEQ ID NO: 5162 - DNA, 444 bp, Glycine max
  Peptide Sequence Number=SeqID_96847
atggttttggtccctgagctcatccctttcgaattcagtctgatacaccatctagagaaagaaagagagagagcttggaagaaccaaaaacaagaaattcttcatggcaatggctggagaggagttgagttgtatgatgacagagacactgaaaaaaaagcttatttgaaggagtttctattggtttgctatgaccctaaatggaccttcccagttggggccaagctttcctgctcggggatcttttttggtttcaccttaaacttgccatacgaggtcaccaggttgaaagtctcatggttgaacctttgtattgtatctcctcgctactcagagtttggtagctacttccctaatccttgccatgttttcttcaacggggatcatggcgtttgtgccatatgtaagtcagtatggagtttccttggttgctgtctggggtga

SEQ ID NO: 5163 - DNA, 432 bp, Glycine max
  Peptide Sequence Number=SeqID_96848
atgccacgtaggatttgtgggtcctgggcagtacataagcctccaagctctgagctggagtttgtccagtgccgaaggagtttgtctgatgtttggggtagtagttttccgatccccctaagtatggatgagtgttgtctggtgtcggacgtggtggccttgacgagtgtgagagttgtaggtcgatgtggcttgtcaagcccccgagccaagacatacgttgtctgggctgcttctgtcaagtcgtttgtgatggacttatctttggtggttcctcatctgaggatacttgctgaggtgcctttgatagcttgtcctcctcttcagagaagggagccagtctcggttatagtgatcctcccctcttctatttttgggggtgcaaggagagctggtggtggtagagatgtgaggtcgtctcctcgtgtctga

SEQ ID NO: 5164 - DNA, 288 bp, Glycine max
  Peptide Sequence Number=SeqID_96849
atggaagaagatggagagaaaggagtattagagtcatgggagaaccttctacactctaggcatgagtggaacttgcaaggggattggctccctcttcatgatgaagttaagtctttcacaaagacatatcttgtgatcgccattagaaagaaccttcattcaaagaggttctcctttgtggaacctcaaggtttcgaagaagaattgaacgtagctcacgagttagagggaatacataagcgatcgactctagtggaagtgggagattgttgggatatgtgtttatga

SEQ ID NO: 5165 - DNA, 276 bp, Glycine max
  Peptide Sequence Number=SeqID_96850
atgtcttttctttccctcattttcgttttctctcttctcctctccaaaaccctttcttttttctacctatctcagaaaaacgatgatcccggactcattcaccgttggatcgtcgcgaaatttgaggagaaacataaatcgcatgatgacagtacaagtggaggcttcaatctcgtctctgtctctttgacgtttggaaactctatcggagcagttagaggaaaaaaattggaggaatctcagggaaccgctagagatgctgctatcgctggctga

SEQ ID NO: 5166 - DNA, 633 bp, Glycine max
  Peptide Sequence Number=SeqID_96851
atggttgaaaaaggctacaaggagccgcaagatgagacttcactatcccaagtacaaaatgagactttaaaggattcaagaaagagaaacaagaaagctcccttcctcatctatcaagcatcaaaacaacttcaaggatcactgcaagcttatgaggagaagcataaaaataagcaagagatcattgagcaactcttcaagatgcaactaaaggagaaggaaaaagtcaaggaaatgaaagaagtcaatgaggccgaggtagaggtcgaggtcattgctgaggacaggttggacgtggcaacagtggacgagattcaaatttcatcaacaacaattacgagaaaggaaaaagctcaacaagagaacatggaagaggctatacaagcacaagaatgtagatttgccaagaataaagttgaggagcagactaactatgtggggcaaaaagacgagaagtttgaaacgttgctcttagcacatggaggtaataaaggtagccaagaaaacacatggtaccttgatactagtgcaagcaaccatacatttggaaaaagaagcatgtttatggatcttgatgaatcacttgctacattgatgcatcctggctatggtatcatcgatttgggcacttaa

SEQ ID NO: 5167 - DNA, 189 bp, Glycine max
  Peptide Sequence Number=SeqID_96852
atggatgatgattgggaggaaacaccacatgctggtataggacatggtgttttcaccaaccatggatacggctccgttctaatcaagaatgccatttcagatcgttcctcagtgtacctattgtatgccatccaacctctcttaatgaatccttactcatccatcatgatgagaagcatcgatccttga

SEQ ID NO: 5168 - DNA, 213 bp, Glycine max
  Peptide Sequence Number=SeqID_96853
atgactgcattagaggatatagaaaggcatgtattgacatatggagaaaggaagccactggagaggttcttaaatgcagtagtagatggaatcactttgaatgatatcactaaaatttctcggaagattatttccccacctctcactatggcatcatatggggatgcaatgtctttgccttgcagtattcccaggaagttccatgcaaaatga

SEQ ID NO: 5169 - DNA, 177 bp, Glycine max
  Peptide Sequence Number=SeqID_96854
atggtgcagtacgtgcaagaagctagcaagcaaattaacacatggagaggtggtgggtggattggcaatggtcctaggaagcaagtgaggagtggaagagagagaggaagcccttctcttgaggtagaacaagtaaaacaagagaaagagaatgatggagaagagtattggaattga

SEQ ID NO: 5170 - DNA, 1350 bp, Glycine max
  Peptide Sequence Number=SeqID_96855
atggagatggttaacatattgtggatgcatgaggacatcataagtgtagttgatgtggtttttgaatggttctcaagccaccacctcagtgtcgctctaggctctgcctctgctttcgctcgcaatgccctctcccttcctttatgttttggtttctactggtttcccgatgggaattacccgtattaccctcaacttggaccgtcgccttctttgtcgcgtcctcctctgacatcaccatctcatcgcgtctccacctgggacttcctcaactttttcgataacttcgacaatggttacccgagttacccgcctcggttcgggtcgagtgtgagcaaccccgattcgaaggaagtgagggagagggaagggattctggagtttgaggatgaagcagaacacaaaatgatgaaaaagaaaaataaggagtttgttttattgaagaaggagaagaaaaatatgggagaggacaagggttttggtgttggagttagggatttcggggagggcccttcgaataccaaaacggtgtcgttgcagcaggtgaatagcagcgaggggagctccaaggcggtgaggtttcacgatggcaatgataatggttccgtcaagaaagagatcaacagcatccccaacactgttgcttccgaagagcacggtgcaaagaaaggggttagtttcaagattgacgaagcaattgtcatgacaatggataatgactcttctgttttgagcagcatcaccactttgtctgtgcatggcaccaaggatcttcgtaaggatgagtttgtggcagcgtcgaattttgggaaagaggttgcgttattgcttgaggtttacaaaccgccttatcgatcgagggttcctgcacttagaggtgatgttgactctagcaagatggaagttggtggaacccggaagaaaaagaagtataagaaaatggttcagggcaacatggaaagttcaagttctgactttgcaaagccttcttttccagcaaagaaaagggtacaggtgtcgcaaaatcttctttcagaaactccaatgaagaatttgaaaattggagactctctgagtgaaattaacaaagagaaagagggaacggaaaaggtcctagtcaaggaaagtgaaaggcccctccaaagtgaaaaagataatcctgttctttcacctttcttttggtcgagagaggaaaacaatggtaaaatgttaagtcaacaaaccgatgaggatcaaattattgatgactcaacaccaaatcctccttcattcagtgatctcaaggactccgatgatgaaatccattctaatgtcgatctaatggtaagtgttggattaacaaacaagtag

SEQ ID NO: 5171 - DNA, 400 bp, Glycine max
  Peptide Sequence Number=SeqID_96856
ggtcagccttgacttggttgagatgttgttcgccaagggagaccctggtattgcggccctttatgacaaactcctagtgtcagaggaactgtggccatttggcaagcgattaatgtctatgtttgaagaaaccaagagccttctcctccaggttgctggacacaaaaatctccttgaaggagacccctacttgaagcaaatacttcgacttcacgattcgcacattacaacccttaatgtcttgcaagcctacacattgaagcgatttcgtgatcctgactaccatccagcagttgagcttgtgaaattcaaacctacaagtgattatgctcctggtatggaggatacccgtattttgacaatgaaaggtattgttgttggcatgcaaaacactggttaa

SEQ ID NO: 5172 - DNA, 884 bp, Glycine max
  Peptide Sequence Number=SeqID_96857
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgccaaagctgcacagcaaatcgcagaaacaaccacggttttaaatggtggggtgagtactgcaaagacgatttcagcggccaaaatcatacagactaacggatttcagcaaatcccgaatacacagatcacgctttctaacggcacactgaaacagaacacaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 5173 - DNA, 365 bp, Glycine max
  Peptide Sequence Number=SeqID_96858
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagaattctgattttgcacattctgaaaacatggcacaacctccacctcgtgagaggactctaagggaaatggctgcacctgatttcacctatgaaagcttgtgcatccaataccctgatgaggatgtcccatatgttcttaaaactggactgattcatttgcttccaaa

SEQ ID NO: 5174 - DNA, 174 bp, Glycine max
  Peptide Sequence Number=SeqID_96859
atgcaggaaatggctccgaaaaagctttccgcaaagagatctaggagagacgctgtggctgaagggaccagtgccgcccccgagtttgatagtcaccgtttccggagcgtcgtgcaccagcagcgcttcgaggccatcaaaggatggtcgttccatagagagagacgcgtctaa

SEQ ID NO: 5175 - DNA, 954 bp, Glycine max
  Peptide Sequence Number=SeqID_96860
atgggatcaagtcaaaagccttcacttaaaaagaggttctatccagtcaaggtcaagagcctagggatcaccagtctaaaagagttagggcagttgatgggtcagctccagcgacaagcttttcgtaaagcttacggtaaaatctgggacctagccatggtagaagtctccacagaggccattgcctccctcgcccagtattatgatcagccgttgaggtgcttcatctttggggacttccaactatcaccaatggtggaagaatttgaagagatcttaggatgcgagtgggccccgttcatagatattctcgcactgttgattttcgggggagtcctctttccgaatgtggatgggttggtggacctggcagcgatcgacgcttttctcgcctatcacaaccacaaggaaagcccagttgtcgctatgctagccgacctatatgacaccttcgaccgaagatgcccgtctatccgctacaaggtcaccgctcgtgcgtcgaaaaaggaaaggcgaattgggaccaactcttggctagcatggagggacgaaggaagaatcaggattgtatcttcatgcgaaggatgtccaaatgttccctggatgggaacatggggttgtattaattataatcccgtcctcgccataagacagcttggctaccccatgagaggagcgccattagacgaaagcatcacacctttcattacatggggtttcagtgaccccaatgcaaaggatagagagcttaggggaagcagtaatgggatcatcggtagctatcataagtggctgagagtccggacacaaggattggattggctcccaaatctaaagactgtgagagacaatgaggttaaagcttcggaagaaagtgatgaggtgcaagcgctaaaggcaaagcttgaaagagcccgggtagtcaaagagaagttcaagtccatagccatcaaa

SEQ ID NO: 5176 - DNA, 363 bp, Glycine max
  Peptide Sequence Number=SeqID_96861
atgttggagttaagtcgtatagcttctcacctactatggctaggaccttttatggcagatattggtgcacaaacccccttcttctatattttcagagaaagagaattaatatatgatctatttgaagctgcgacgggaagtaataaattggggtttatcaggacccatgcttcgggcttccggaatacaatgggattccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccgcggagtccatatga

SEQ ID NO: 5177 - DNA, 276 bp, Glycine max
  Peptide Sequence Number=SeqID_96862
atggatccacgggcgccccaacagacagctgtaggggggattaatatccaagatgtcttcccgtcgaaggcacgaaccaccattgaactcggctttaagtgggaagcattgaatggtaatttctccaaagtgctcttaggcatcacgtttaaactggaaccattatcgatgagcaccttggctacgatatggtccatacacttgactgatacgtgtaaagccttattatgccctctcccctcggcgaggatttcttcttcggcgaaggcaagataa

SEQ ID NO: 5178 - DNA, 606 bp, Glycine max
  Peptide Sequence Number=SeqID_96863
atgcttgaaagttttcaacaacaagatcaaatgtcagttctggaattgtacatagaaaaggatgtggctggtggttctatgtttcattctgcaaattctcttacatcatgtgaaaataatttatctaataatgaagcgcaaccgccaagaaatgtgagcaatttacatggtgatgaagatgatgattatcttgggtctaactcatatgtggaagagtctttagacgaagatgatagtattgacggcatatctgatacagacgatgaagtcaccaacatgattcaaccagtaagaattgttcacccagcacaaggtgtacaaggaattcaaaatccattttggaatgatgctttccattataataatatcaattggagtcatcctgatgaggaggacatttgtggtttggagatgtcatcgagttttaaagttggccaagaattatatgttggcatggattttgatagtaaagatgcggtcaagaatgtagtcaaacaatatgttatgaaggtgcatcaaagtttcaaagtggttgaaagcaaatcgaacaagcatgatcagagaagatccatcaataaaagtttctttgattcaagagaggattaa

SEQ ID NO: 5179 - DNA, 312 bp, Glycine max
  Peptide Sequence Number=SeqID_96864
atgttagtttgtttgacaggttataggagagcattatggttcaagacaaatttgtgtagaagcaaagaatttgactttgatgttttgatgatgccatatgatcgtgatgatttgatgccttatgaaaatgtgcttctcaagtttaattcaagacaaaaattcaagaatacaagatacaacattaggaagatctctagtgttttaggaagggaattccaaattgaaactacaaaaggtttggccaagaaatttaagcaaaaatgtctttttcaagagatttactctctggtaatcgattaccagaggatgtaa

SEQ ID NO: 5180 - DNA, 1068 bp, Glycine max
  Peptide Sequence Number=SeqID_96865
atgggttcaaatgtacgagatcttgtagcacttaccaacgaggccctatcgattagtattatacaaaaaaaatccatcatagacactaatataattagatctgttcttcatagacaaacttgggatttccgatctcaggtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaaagattgcagtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattggtttaa

SEQ ID NO: 5181 - DNA, 192 bp, Glycine max
  Peptide Sequence Number=SeqID_96866
atggcgccaaaaacttgttcgaacccagcaagtgtactagatcgcgcaagtaatataaaatgcctaatcctgatcaagcatcatcctcagattcctcttgttggacaaaaatctaccagaaccgcattaagacaaacatacaaacaattaggttaccgtaccccgatccctcgtgataatacgataaactag

SEQ ID NO: 5182 - DNA, 663 bp, Glycine max
  Peptide Sequence Number=SeqID_96867
atggctacctcaccaaaagaaacttcatctcctggttcaccctctgtaccatcatctccatcatccaccaaagcaccatcaaaccaggaacaacctgaattcaatatccaacctatacaaatgattcctggtccagcccctgttcctgaaaaactggtccccaaaagacaacagggagtgaagatttttgaaaaccctagccttgcaacaagtcctagggaagtagacacggagatggataagaagatccgcagtattgtgagtagcattctgaaaaatgcttctgtccctgatgctgataaagatgttccaacatcttccaccccaaatgctgaagtcctctcttcatccagcaaagagagatcaacagaggaagaggatcaagccacagaggagacccctgcaccacgggcaccagaacctgctccaggtgacctcattgacctagaagaagtagaatctgatgaggaacctgtcgcaacctacccttcggcgggagggcgacgcgagactcgcgggatgcgtgttcctcgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 5183 - DNA, 244 bp, Glycine max
  Peptide Sequence Number=SeqID_96868
ggaacaaaagctggtaccgggccccccctcgaggtcgacggtatcgataagcttgatatcctcaggaattctcacattaccaaacatttggcgagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctgggc

SEQ ID NO: 5184 - DNA, 663 bp, Glycine max
  Peptide Sequence Number=SeqID_96869
atggtcattacacttgatggtgcccatgttcgatacgttggatgttgtgtatgttcgtggggggcgaagtgcactgaccttgtcggatggcccattcgtgggggacaagcgtggttaaagaatctaagcatttctgaggggatgcttaggcgctttaattggtctatggtctttggcacttgctttgggccacgttcatacatcgtatgtagtgtatgttcatggggggtggagtgcattgaccttgtcggatggcccattcgtgcgggacaagcgttattaaagaatctaagcatttctgaggggatacttaggcgctttaattggtccatggtctttggcacttgctttgggccacgttcatacatcgtatgtagtgtatgttcatggggggtggagtgcactgaccttgtcggatggcccattcatgggggacaagcgttattaaagaatctaagcatttctgaggggatgcttaggcgctttaattggtccatgggaacttctttgggccccaagctgatcacctatgggggggcagttacgtgcacaaccgggtggtctcgacgaactctgcatggttttcaaagtgagagtgtcgtgtggacacgcttaggctatttcctgggatttggttgttggtacgtaccacattgcatctga

SEQ ID NO: 5185 - DNA, 333 bp, Glycine max
  Peptide Sequence Number=SeqID_96870
atggaatatgaggggatggtctccccaggctccaataccactggggtccccagaaatgcgttgagggtgtctgcatcgaactttatcaagttccctttcactctcacctgctttggttatgcctctccacaggaagctccttttacaataaaggaagggaatcaagagaaattgcttgcttacacaggaggggggatgtctgctccacctcttggcacctcacaatcactcaaaagctccttaatctctctaaaagttgagatcttggctccttactctgcttcttcattctctgcagtccacactcagaggctctctgtggtctcactctga

SEQ ID NO: 5186 - DNA, 237 bp, Glycine max
  Peptide Sequence Number=SeqID_96871
atgaaagagtgcaaaaatacaagtggtgaggatgcctccttcacctctaggatatcacaatcactcacaaactcatctcaagctctcaaactggctcttgcttcaagctctggtggccttgttcgtgctcgtgcgcttagcgcatcggtgcgcttagcgaacctgtacaacttatcttcttctggattcttcctcgtgcttagcccaggagtgttgcgcttagcgaatgcttgctaa

SEQ ID NO: 5187 - DNA, 792 bp, Glycine max
  misc_feature (5)..(5): n is a, c, g, or t
  Peptide Sequence Number=SeqID_96872
agganacacgtcctcgccttcagaggactacacgtcctcgccttcagagggctacacgtcctcgccttcagaggactacacgtcctcgcctttagagggctacacgccctcgcctttagaggactacacgccctcgccttcagaggactacacgtccttgccttcagaggactacacgtcctcaccttcagagggctacatgtccttgccttcagaggactacacgtcctcaccttgaaaggactgcacgtccttgtctttagagggctacacgtcctcgccttcagtggactacatgtcctcgccttcagagggctgcacatcctcgccttcagagggcatcacgccctcgccttgagagggctgcaagtccttgctttcagagggatgcatgtcctcgcctttagagaactgcacatcctcgccttcagagggctgcacgcccttaccttcagaggactacacgtcctcgccttcagaggactacatgtcatcaccttcacagaactacatgtccttgccttcaaaggacaacacgtcctcgcgttcagaggactgcacatcctcgtctttagaggactacacgccctcgccttcagaggactacacgttctcgtttttagagggctacacgccctcgccttcagaggactacacgccctcgccttcagagggctacacgtcctcgccttcaatgggctgtacaccctcgtttttagagggttacgcgtcctcactttcagtgggctccacatctgcaccttaagagaatttaaggtcctctacccctaa

SEQ ID NO: 5188 - DNA, 399 bp, Glycine max
  Peptide Sequence Number=SeqID_96873
gatgtgcgcaaaaaggcacaggccatccagaagcagaacactgccccccacgttttgtctcgtgggggttatgactatttggagcagaagctcctggctgagaagacgaagaagaaactggaggaatctgcacagtcaggaagcgttgatggcgtcatcgaccctccatccccggattcctttgaggagcaggccacacagggacccttcatcccccatggacgtcaggatgttctcaccgctgctattggacgtccagagcaccctggacgtgtttgtgctgttggagccggtgtcaccaccaagcaatactttggatcagctccacggacgtcccgcagctcttcctccctgcctcccgaagaattgcagcagttgacccagcaaatctgggactag

SEQ ID NO: 5189 - DNA, 321 bp, Glycine max
  Peptide Sequence Number=SeqID_96874
atgtctaaccaaaagagcatggagtctgcaattaagaatctggaagttcaggtgggccagcttgcaaagcagttagttgaaagaccatccagcaactttacaacaaacacggagaaaaatcctaaggaagagtgtaaagctgtgatgactaaaagtagaatggcgattcaagccgaggaaagtagagttgatcagaaggtggagggatttaaacattggctggctgatgaactggcactggaaccaattgatgatttagttgaacttgaagaaattgttgaggaagcagaaggtgatgaagaagaagagacaacaatatga

SEQ ID NO: 5190 - DNA, 129 bp, Glycine max
  Peptide Sequence Number=SeqID_96875
atggataagagctcaaaggtaggagaagatgagtggagagagaaggagataaggagcacgaaattttgtgcctcaattgagcccaaaaatccaagatcaactccaagattctccagtaagtgtggttag

SEQ ID NO: 5191 - DNA, 195 bp, Glycine max
  Peptide Sequence Number=SeqID_96876
atggatcagcctggagaggaaaagaagttgcaactaaagctcggactcatgagtgttgagatcaaaagtgaatccacaaataagagcttcaaggtcaatggacaccggctgaaaccattcctcacaaatccctgcttagtggatgtagtggtggaggagacctccttacttcaccttacttctcttccgccatga

SEQ ID NO: 5192 - DNA, 615 bp, Glycine max
  Peptide Sequence Number=SeqID_96877
atgaaaagagaaaaacatgcctcctatagtagtcataactcttgcaagagcctaagtgaagaatttcgtgactattatgaaggaaggcataggtcacatcttagacctcactcccatagaagagaaaaggaaagaaagcctcaagaggctaacattaacctcccatacttccatggaaaggacaatgtagaggctaacttagtttgggaaataagggtagagcaacaacttaaaaagaagtctacatcaaaattttatggctctcactcttatccaaagaaagaccaaggtcaaggcatcttaggggtgacaccttctaagcccaaaggtgataaggggaagacaatagaaaaccatgcccctaagactagtgtgctagagaagactagctctataaagtgctttaaatgtcttggaagaggacacattacttctcaatgcctcactacaaaaaccatgattatgaggagccaagacatttatagtagccaagatgaggctactacgtcaccttcctctagtgaaagtgaagaagcaaaaggggaagaatctagtgaagaaatctacccccaagaagaaggacaacctttaatggttaaggaggagtgtacggag

SEQ ID NO: 5193 - DNA, 639 bp, Glycine max
  Peptide Sequence Number=SeqID_96878
atggctaagagactccaggaagattgggccagggatgcaggagaaagccctaggtggcgtctccaatcacctttcctcctcctcctccatttcgctgccattgatcttcaagaagcaaaggtctccattgatgaagaagatccaaggactacaagctctacatggagctacattagatctatctataacttctcgaagacttatgtaatcgattacacaaatgcgcttcatgatgaatcaagattgattcaaagaagttttgatgataacaaaggtgatgacaaaaagctcaaagatttaatcaagaacacttcaaggttcaagaggaaatttgatttcaagaatcaagaatcaagattcaaggttcaagcttccaagaatcaagatcaagatttaagactcaagattcaagaatcaagagaagaattaatcaggataaggtacatctacttgagtttgactgagaacaagagagggtacatctcttgtggatcagttctagtggaggatacatccactaggttgttcaaagagaacaagggagggtacatcccttgtggatctttgcttgtaaaaggatttttacaaggttggaaaagaaatctcaaggaccgcaggtcgcttagggactggatgtag

SEQ ID NO: 5194 - DNA, 451 bp, Glycine max
  Peptide Sequence Number=SeqID_96879
atggcagaatcgtcaaagaagcgaaagggatcatcctccaccaccgctgttgctggccattgccgccacgaaccatctgaagcacccacagcaccaattcatccttccttatcatctccaagatcatctactctattttcttcagatgatcaacgtctacggtacaactctcaattttcttctaggatcatcttagaccctaagtacctagacactgatttctttaatgatgagacatttgactattatcaagtgtttcaaaactctggattggttgattttatgtccttaaaattttcttactatcctaaactcgttaaagtcttttacagcaatttaaaaattcaggatggtgcaccttttgagggcaccattgttgatgactggaagtttgattattctagtcatgatgctcgtcgtatggtttgtaatgaccaggctgaaatgaccg

SEQ ID NO: 5195 - DNA, 309 bp, Glycine max
  Peptide Sequence Number=SeqID_96880
atgttcattcatactcaagtgctcaaaaaggttgtctcagaacaattgtcaggagttaagaactcaagatttcttaaagcccatatacattattgcaacctacccttcggcgggagggcgacacgaggctcatgggtgcgtcttccaaggaaggaaaatgtgcgaagttgccaccaaggtcgacaaaagcgggtgttttgctcctacatatcctcaattgcgatgaggaactcagacctacgtagttctttaaaaggaaataaagttatgcggggtgttgattttagacttttaaatggttcgttttaa

SEQ ID NO: 5196 - DNA, 204 bp, Glycine max
  Peptide Sequence Number=SeqID_96881
atggagatgataagaaaggatgaattggtgttgtgggtgcttcagatggtctgtggcggcgatggccagcaggaagtggtggcacaaaggaaggaggctggctgcgcagcgccactagatttcgtgagtatttatagaagaggacgtgatgtaatcgattacaagggtgttgcccttgctcctaggtatcctcaggtgcgatga

SEQ ID NO: 5197 - DNA, 96 bp, Glycine max
  Peptide Sequence Number=SeqID_96882
atggagttgccagagaagaaaagcagcagtggtgaaggtgtttgggaggttgaagaggttggaagtaactcttgttatagagtgaaccaatattaa

SEQ ID NO: 5198 - DNA, 90 bp, Glycine max
  Peptide Sequence Number=SeqID_96883
atgtgggcattcatgaagcagggggtggatgctgtcagtggcatcagcgagatagctggtgccgccaataattgtgacgagacaaaatag

SEQ ID NO: 5199 - DNA, 135 bp, Glycine max
  Peptide Sequence Number=SeqID_96884
atggtcagaggtcgagacaaggtacttatggacggacgcaaggagaggctagggtcacgaccaataggtcgtcatcctttgcctagcccgggacaaatggaaagcgccactgcaaagcagcctagtatcctttaa

SEQ ID NO: 5200 - DNA, 492 bp, Glycine max
  Peptide Sequence Number=SeqID_96885
atgagacttgttcattgtcttataatttctctgtctcaaagctgctgcgctttggttggcacttggcaaggggagttgataaatagattacgcctaaggttgatgctcaagtgccagactgggtgcaacaacatacgtggattcatgggattcaaattcccatcacgctgtgggttatttggagggctaggaataaaagtatttttgaggaggagatggggacaactactcagtgacatgcgcaagtgtagtctcttgtgcattatactaaaagttgtgtttgtggaacatgttaatttgcatgagcaaagcagatggatttgctgggtgagacctcctttaagggcggtgacattgaaggtagatggtagcatgatgggtagccctcctagggcagggtttggaggactttgtggggttcaccatggaagctttcttgtgggcttatatggtcatattggagggcaagagatcttatatgctgagatttaa

SEQ ID NO: 5201 - DNA, 291 bp, Glycine max
  Peptide Sequence Number=SeqID_96886
atggaggccatgaaagagcaaatggccgcaatgatggaggccatgatgagcatgaagaagataatggaagtcaatccgattacaattgccgctaccagcactgttgctaaggtgaacccgacatccccattcgacatcaaccaaatgaatcatccaacctcagatatggtaggcaaagatttgggaagtacgggcagcccccatgatgtgcaaattcaaaacgagcacactttcccgccatatggcttgcctctcaactatacgccacctaatgtggtgcactcccaatga

SEQ ID NO: 5202 - DNA, 217 bp, Glycine max
  Peptide Sequence Number=SeqID_96887
gagaaaagagggaggtggttgccgcccagctcgcccaggcgagctgggttgcttccaccagaaggcaccgccttttgttggaatcccctggaaggcccaaattgcgcaacaatgcttcttttcgacttccggaatgtcgcagaactttacggattacctaacgatgggtgttaagtacctcgaggcggtcaagcgaaggttgcatgccaccaaataa

SEQ ID NO: 5203 - DNA, 231 bp, Glycine max
  Peptide Sequence Number=SeqID_96888
atgaaagcaaaatgcaaccaaaggtggcttgggggagcaaaaaccgtgagtcccgggttgctcgcccaggcgagcttagcttgcccaagcgagctaacctgccatttttcttttggcgccatcatgagcatggccctctacgggccggcgttcgcttactcgaacccactccaggatactaggctgccttgcaacggcattttccgcttgtccagagccgggaagggatga

SEQ ID NO: 5204 - DNA, 264 bp, Glycine max
  Peptide Sequence Number=SeqID_96889
atgcagggttaccttatggttacccgcacctttcgtcaaccaggggaaaacgagcccgttgacgcacaacgactaacattgtctcctgcaccttttgtcgtcctgacccgtgaagccaggtttttactctcgtcgttcggaaacattcaagcccaacgacgcacaggattcttctctgcttggcagagaagaacgagtgcaatggcaaagggaagtgtcgtggttgtccaactttttcgttttcaagacactgaagtttgttga

SEQ ID NO: 5205 - DNA, 337 bp, Glycine max
  Peptide Sequence Number=SeqID_96890
atgtcagtgactccatcctgttctttgactaaaaaaggtatctctttctctactgctctcctaagttccaaacctgattccaaagctccatggatcatcgattttggagcctctaaccatatgacaaactattcaaaattgttttccacatatagtccttgtgcatgtcacaaaaaggagttgagttcggggaggatgattggcagttctaaggaggttgatggtctctatctctttgaagatgagtatggtcctaaggagaaactccagaaaaattgtctcaattcaattttgattcgtgaagatcaagaaataatgctatggcattatcggctag

SEQ ID NO: 5206 - DNA, 330 bp, Glycine max
  Peptide Sequence Number=SeqID_96891
atggataaatttggtatctttgtccctcatcctctcacaaacacatctttgcttattcaactttcaccggaatgtgggtgcaagccattggtctctttgctcaagcgacctgcgctcctgagtttggacttccaagaccgttcaatcaaaaattacttgtgctacacatttggtgagggtgtcgtaaaacgacaaccctacactggggcaatgaggggtaccgtgcatgagcctcaagcgaacctaggggcagatcaaaagttctcacccgtcgatgtttttaaacaaaaaaacgggggacaaaccctggcatttcaatggattgattaa

SEQ ID NO: 5207 - DNA, 219 bp, Glycine max
  Peptide Sequence Number=SeqID_96892
atgcctataggttcgacctcccaaaaaagtggagctgatattgaggaggaggaaccaacagatttgaggtcaaatcctcttcaattgggaggggataattcaatcctccctaggaagggaccaatcaccaaatccataagcaagaggcaccaagaggattgggctagagctgctaaagaaggccctagggttctcatgaaccttagggaagatttctaa

SEQ ID NO: 5208 - DNA, 138 bp, Glycine max
  Peptide Sequence Number=SeqID_96893
atggccaaggtgctcattgataatggttccagtttaaacgtaatgcccaaaaacactttggagaaattaccgtttaatgcttcccacctaaagccaagttccaaggtggttcgtgccttcgacagcacctgccgagag

SEQ ID NO: 5209 - DNA, 453 bp, Glycine max
  Peptide Sequence Number=SeqID_96894
atgcactttccggtaatccacttccgcgtaaaaagagtaattacaaattttggaaaaaggaactgtggaaaagggtcaacaagggccgaaagggacgagtcgagggtggaaggaatgatattagaggacaagttgaaggcttgtcaaaggtcgaagaggagcttaaccgaacagttgagtaggacggaagagaacatgtgggctatcattggccagtataaagaaaagctaaatctagctgctatccatgagcaaaggctagaagacgagcatgcaaaagtatcagtcttgcaagcggaaagggaagcaagggagagagtgatagattcattacatagaaaagctatgatgtggatggataggttcactttcactttgaatggaagtcaagaacttccaagactgttagccaaagccaaggcaatggcagacgtgtactcgtctcccgaggag

SEQ ID NO: 5210 - DNA, 189 bp, Glycine max
  Peptide Sequence Number=SeqID_96895
gatttagaagcagcagcaaccccagaagaagaacttcaatcttccaaggcatcttctagttttcctattgctgggcattctcatatagaacctgttgaagatacaatcatggttgaagagccaagaagagtaaccctagaggattattcaagttctaatgtgccacaatttttcaccagcattgcctaa

SEQ ID NO: 5211 - DNA, 216 bp, Glycine max
  Peptide Sequence Number=SeqID_96896
atgaacatcaggccgcaaacataccgccaccacctcgacaggccgatccaactaggtcactgggcgtggagcgttatctacagcatttggttcgccagcaggtggccaaccaccggttccgccccttttgcgtgccctactccggagcagtttgggggtgaggttgcatggcttggagactggcccgatgcccaggcaggggaggagcctgcatga

SEQ ID NO: 5212 - DNA, 207 bp, Glycine max
  Peptide Sequence Number=SeqID_96897
atgtggaaggatgggtggatgacaatcaagattgatcttgagaaggcctatgcttcgcttaaatgggaatttttccatgatactttggctgactttttctgcctaaataacaatggggaactcatttggggatgcatgtctggtgcaaagagaattataagcaattgggcttggattcgaaattgggttgaatcggcttggacttga

SEQ ID NO: 5213 - DNA, 655 bp, Glycine max
  Peptide Sequence Number=SeqID_96898
atgggatcgagtcaggcgccttcgcttaaaaagaggttctatcaagtcaaggtcaagagcctaggagtcaccagtctgaaagagttagggcagttgatggatcagctccagcgacaagcttttcgtaaagtttacggtaagatctgggacctagccatggcagaggtctccaccaaggtcattgcctccctcgcccaatattatgacttgctgttcaggtgcttcacctttggggacttccagctatcacccacggtggaagagtttgaagaaatcctgggatgccctctggggggaaggaaatcatacctcttcttgggattctatccctctttagctaaaatttctaaaatagtccaaatctcgacgcaggaattagaccatagaaagcaagtcaaaaatggggtggttggaataccaaggaaatgtttggaagcaaaagcaagagtcttggcaggtaaaggcgaatgggccccgttcatggacatcctcgcacttttgatcttcggaggggtcctctttccaaatgtggatgggttggtggaccaggcagcgatcaacgcttttctcgcctttcataaccgcaaggaaagcctggttgtcgctatcttagccgatctatatgacaccttcgaccgaagatgtgaaaagagca

SEQ ID NO: 5214 - DNA, 266 bp, Glycine max
  Peptide Sequence Number=SeqID_96899
gcacgcctccaatagatcaagagagtgaatgtcaaatgtttgatcatttagctatgattgtggtgggtgctatggtggtggttgctcttctaatgatggaagaaggtctggctagaataccacaaccagtggatgtagggtcaaatccaaagtgggtggtgaaggccacaacagatgcatcaaataaggaagaggtccttcaaggtgaccgagcctatgctctctttcttccagtgcaagctccttgtgatctatttgtgaactag

SEQ ID NO: 5215 - DNA, 327 bp, Glycine max
  Peptide Sequence Number=SeqID_96900
ttaccctcaccgtcagaggactacacgtcctcaccttcagagggctacacactctcgccttcagaggactgcacgtcctcaccttcgtagggctacacgccctcacctttagaggactacacgtcctcgccaacagagggctgcacgccctcaccttgaaaggactacacgtcctcatcttgaaaggactacacgtcctcgccaaaagagggctgcacgccctcaccttgagaggactacacgtcctcaccatcagagggctgcacgccctcacctccagaggactacatgtcctcgccttgagagggctacacgccctcacattgg

SEQ ID NO: 5216 - DNA, 387 bp, Glycine max
  Peptide Sequence Number=SeqID_96901
atgacaagatggaggtttatagccaaccccatatgttgcaaccatgtcacaaaattttgcaaaagctggatttttaataacattgaatggaatggcacttgtgtacctgtcgcaacctacacttcggcgggagggcgacgcgtgactcgcgggatgcgtgttccacgaaaggaatacgcgcggagtcgccaccaacgtttatttgtgagaaacgtcggaaaaaccgaaggaaaccggtcaaaaaggaaaattctaagttcgggagttgtatttacgcttgaggaaggtgatcattttaaggcgttggaccttgaaaatgatccattttacttagtaagaaacagaaatgataaactttcaaaatcctatttttgtggacaagcttga

SEQ ID NO: 5217 - DNA, 337 bp, Glycine max
  Peptide Sequence Number=SeqID_96902
atgactaggggcaatctaggtgatttacaaccgtttgatcctgaaatagatagaacctttcatagattacttaggcatagtgtgcatcctatgcattttgagcattctgagtattttgttagtggtgattctgaacattctgattttgagcattcgactactaattttcatactgagaacatggctcagcctccacctcgtgagaggactcttagggagatggctgcacgtgattttacttatgaaagcttgtgcattcaatatcctgatgaggatgttccatatgttctcaagattggactaatacatttgctgcccaagtttcatggtcttgcag

SEQ ID NO: 5218 - DNA, 1338 bp, Glycine max
  Peptide Sequence Number=SeqID_96903
atggtgattgaggaggatcccagatattgggacttgttgtcatctgcactgtcagttggttggcttgatattgtggtgaaaatgctgcggttgcatggatcttaccaattagatcagctcagtaatcgggagttggaaaatggacttgtagaggctgttgctgttcttatttccaaaatgccccgcatgcgtcctgaatctgttggaaagttaggtgaatgctataaatccaaacctgacttcatcaaggcctgggaaaaatggaggtcacaaattacaaaactggattgcagtcgattctggattcaatgtgataatcaacaaactcgtgagggcttgagaaacttgctacaaattatgctgggtaacactgagagtctctgcatggctacatgttattggattgaattatatatttctcatttcctgtacataaggccatttacaatgggaatagaaagcatgtataatttggcccagaaatgcatccagttgaaaccacgatctagtacccataggttgtcagtacttatgattggaattcttgaagaaaataccgaggttgttttagctgagtgttccagagaatttggcccttggttggtggcacatgccatagaactgttgactgcagggagtgagcaagcagagattcttctgcatgaggagcgttataacttggggggaatcagcatagtggaactacatcggcttgtatatgctcaaattctatcgtcacatgcattgacctggcaaactgagagtaaggatgaaacggatgtctcgtacacaggatttagtatgagcaagagaccaaaacagcctatgccaaatgaaagttttttttatgagattgctcctatatatttaacatcatgcatgaagcaaggaatgggcttgttagagaatttattgtacaggcaatctgctcaacataatgatgtgttgcttaagaacattgagatatgccgtttgtatgagcttgatcatattagttcaaatatcatgaagattgctggagtacatcactggaagcatggccataagggtgctggagtattctggcttcaacaagcccaagacgcaagttgtcttgataagattgcccaacagttatttgattctgttggaaagtctatatctgatgaaagcttcaagcaatgggaaggcatgattgaactattgggttctgaatctaagcctgctgggggacttgaatttttgcacaagtatagggatttcaagaaatcccttcagaaggtatctagtggaaaatcaactgatgcagcaaggcaagctgtaggctccctcatactggtattacacacacctttgtga

SEQ ID NO: 5219 - DNA, 273 bp, Glycine max
  Peptide Sequence Number=SeqID_96904
atggcttgcacccacattccagtggaagcaaagataattagaccttgcacttatgcttcagggccctacaatgttcaatggaatgccccagggctcctccatgataagcacacgttgcgttcgagtcgtatcctcggagaaatggagataagggagcaagttagcataggacaccataattggggtgaattctacaggctttttgctgcaaaattccttccttggtcagtgttttggtttctgctaaaagtgatgtttagcattggttgtgtg

SEQ ID NO: 5220 - DNA, 273 bp, Glycine max
  Peptide Sequence Number=SeqID_96905
ggtacatcctttgtggtacaagtagaggatacatctacttgggttgttgtgactgagaacaagagagggtacatctcttgtggatcagttctggtggagggactttacaaggttgaaaagaaatctcaaggaccacaggtcgcttggggactagatgtaggcacggtgaagcctcatttcgagttttcctcttttgatgatacgttgtcgctggtagtccctatcgccataatgtttgatatcaaagaggatgatatctctagaaacctttga

SEQ ID NO: 5221 - DNA, 414 bp, Glycine max
  Peptide Sequence Number=SeqID_96906
atgcagagttcaaaacgcgatgtctaccttggagcctacttaaatggcgaacactggcaaatggtggtcattctgccgaaggaaaaccttgttgtctggttttgttccttgcataacaggccagacaactaccttaagggaataattaacagtactttgaaagaacttgatgatactccacagcctaaatccaaggctgccgctaggtggattgtcgttaagtgtaatagacaaaaaggaagcactaagtacggctattacatcatgcactggatgtccaccatcatcttaggaagtttgaggaataactgggaagcgtattttaacgatgccagaccattggagccagagagattaaaggcgcttcgcatccagtgggcacaatattatcttcgacctagagatcaaacttag

SEQ ID NO: 5222 - DNA, 387 bp, Glycine max
  Peptide Sequence Number=SeqID_96907
atgccgatctctccctgcggaaggatcgtgcccacaagacacccagtggacccggagaagtccaacaggaccctagggtctccagctttcgttacgggcctctatcagtcctacaaggtgcccattccccccagcaaggtcatgtcatcgcgacatagggatcgtgcccacaagacacccagtggacccgaagaagtccaacagggtcttggagttgccacctctgattacgagcctctatcagttctacggagtgtctgtcgcccccagcaaggtcatcaggcccccctactaatcgagctttcgtcaagaagtactgcacccccaggcaagcgcagggcgagacaccacagtagcgctactaggaggcaacctagtaccttttaa

SEQ ID NO: 5223 - DNA, 206 bp, Glycine max
  Peptide Sequence Number=SeqID_96908
gctcatgagaaccctagggccttctcttgcatctctggcccaatctactttgagtcttctatccaatgcccttctggggtaggattgcatcactcctcaacccgccctctgcaaccgctgcatttctcagtaggggggccgcctccggcagtggaagggagagtgaaacttgatctcatcgaagagagattaagggctattgaagg

SEQ ID NO: 5224 - DNA, 444 bp, Glycine max
  Peptide Sequence Number=SeqID_96909
atgaattttgcagcgagaaagcctgtagaattcatcccaattccagtgtcctatgctgacttgctcccatatctacttgataattcaatggtagccataaccctagccaaggttcatcaacctccatttctccgagaatacgacttgaacgcaacgtgtgcttgtcacagagacgccccggggcgttccattgagcattgtagggctctgaagcgtaaggtgcaaggtctaattgatatgggctggctgaaatttgaggagaatcgcgtgattttcaactttcaccggaagtgggtgcaagccattggtctgtttgctcaagcgacctgtgctcctgagtttggacttccaagaccgttcaatcagagattactcgtcttgcgtgttggtggggctgccgtaaaacaacaaataaagttcaaaacaaataagtttcagaattaa

SEQ ID NO: 5225 - DNA, 297 bp, Glycine max
  Peptide Sequence Number=SeqID_96910
atggttgagcaatttaatgaatgggtagcctcgccatggactcaacctcctcttcacagggaagacgaagatcccgccgctcaggtaccccatcagctggaggatgagtcatcagagtcttccactcctgatcccttgatcaggaagaggagggtagttgtaactcaggaagctgcagccacctctgaaaagtctcttgaagtcactctagagcctccagcaccagtggcagataccacttctcaagcaccagtggcacacacaacaaataagtttagccgtgagactgtggtttga

SEQ ID NO: 5226 - DNA, 131 bp, Glycine max
  Peptide Sequence Number=SeqID_96911
gaggcttccggactatggaaagctaaatcctctgttggatcttccctggtcattcaatagtggaaactggtctgattctaaagtccttgatagtacgggactaagttgttgtgctatcacgaggaattggg

SEQ ID NO: 5227 - DNA, 468 bp, Glycine max
  Peptide Sequence Number=SeqID_96912
atgccaaagaatcaagagtcaagcaaaatccaaagatttaagaatcaagcttcaagtttcaagattcaagattcaagattcaagaatcaagattcaagtatcaagatcaagattcaagactcaagattcaagaatcaagaatcaagagaagactcaatcaagataagtattaaaaaaaagttttccaaaacattaagtaacacaagaagttttcacaaaatcattaccaaagagttttactctctggtaatcgattaccagaagagggtacatctacttgggaattgttatactgagaacaagatagggtacatctcttgtagattagttcaagtggagggtacatccacttggtttttcaaagagaacaagggaggggacatcccttgtggatctttggcttgtaaaggattttacaaggttggaagaaatctcaagaaccgcaggttgcttggggactggatgtag

SEQ ID NO: 5228 - DNA, 433 bp, Glycine max
  Peptide Sequence Number=SeqID_96913
gttcatttccagctgggatgaccttaagagggtgttcttggagaaattcttccctgcatctaggaccactgtcatcagaaaagacattttaagcatcagcaacctggagaggagtatgattgatgctaccagtggtggagttcttggtgatatgactcctactgaggctaggaatctgattgagaagatggcttccaactcccaacaattcagtgcaagaaatgatgctattatccttagaggagtccatgaggtggccacggattcatcttcatctgctaaaaataaaaagcttgaggaaaaacttgatgccttggtcaacctagtaactcagcttgccatgaatcagaaatctgcatctgcacctgttgcaagagtctgtggtttatgttcttctgcagatcaccatatagatctcagtccttctttgtag

SEQ ID NO: 5229 - DNA, 115 bp, Glycine max
  Peptide Sequence Number=SeqID_96914
atgaccacattggcctctgcttatcaatcaaacttagggtctccaaatgacgaggtacggataactggaaggtgtttccacatgctaccggactcttgggtcatgatagcaaaag

SEQ ID NO: 5230 - DNA, 264 bp, Glycine max
  Peptide Sequence Number=SeqID_96915
atgggggataagcttcatcgtcgagagggaaacagcccgggatcaccagctaaggcccctaaatgtcaacctttcgaactgctcgtgatccaaaggaggtacgggggcaagagacaacctggtgaactgaaacatcttagtagccagacccggaaaagaaagcaaaagcgattcccgagcgtgcgagcgaaatgggagcgcctaaggaccgaacggttgtgggagataacaaaagaatcgggtagggagagcgttccgccttag

SEQ ID NO: 5231 - DNA, 201 bp, Glycine max
  Peptide Sequence Number=SeqID_96916
atgggaggtatactagaagtcgtatctaatccttggaggtttatgctagaaaactggttgtgtgactcagatctagataatcctactagaatggattgggtcctaactgagaaggaccttcttgctgattcacactcagattgtcttgaggcttctattctggatgagaatgagtttctcttattgaaggggcaggtctag

SEQ ID NO: 5232 - DNA, 216 bp, Glycine max
  Peptide Sequence Number=SeqID_96917
tcagatagaatcgaactttcgattgattcgggtacttggaatcctatggatgaagacatggctgttcaaacaggtactggtcaactaaatggtattcctgtagctattggaattatggattttcagtttatggggggcagtatgggatccgcagtaggtgagaaaatcacccgtttggtagaatatgctactaatcaacttttacctcttattctg

SEQ ID NO: 5233 - DNA, 284 bp, Glycine max
  Peptide Sequence Number=SeqID_96918
atggacatcgccgacctgcgcctgttcctggccatcgccgaagcgggcagcatcaccgccggcgcggcacaggcaaacctggcattgggttcagccagtgagcgcctgcgcacgatcgaagccgatgccggtaccccgctgttgaaccggcacccacgcggcgtcagcctgaccgaagccggcgccgccctcgcccaccatgcacggctgatcctgcagcagcaggcacagctgcgtggcgaactgcaggcgttcgcgcatggcgcgcgcgggcacctgcacct

SEQ ID NO: 5234 - DNA, 426 bp, Glycine max
  Peptide Sequence Number=SeqID_96919
atgcaaatcttcatagaggctatagatttaaacatctggaaaaccattgaaatcggtccttacatccctactatggtaacaggaaatgcaactatagaaaaacctagggaacaatgggatgaagaagaaaggaaaatggtacaatataacttaaaggccaaaaatataattacatctgcattaggcatggatgaatattttagagtatcaaactgcaagaatgcaaaagaaatgtgggacaccttacaagaacacgaaatggaactcataaaactaaatcaacatgaagaaaatgacaagaaaaagaaagaaattgcacttaaagcttcatcttcaattcaagaagaaagtgataaagaagacttgaatgaaataaaagaagatgatgatttcagtttcttcataaagagattcaataaatcctaa

SEQ ID NO: 5235 - DNA, 420 bp, Glycine max
  Peptide Sequence Number=SeqID_96920
atgtacatccaagaactaagtgtggcttcgattaattacgagatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 5236 - DNA, 137 bp, Glycine max
  Peptide Sequence Number=SeqID_96921
cgctaggaaataacattcatggggctccgaaaaaatgtggagaatggaggattgccttgagggtccgcactaagacaatcatgaaacatagctccaaactcgaaggtggagggcacatgaacaacgctgggcaataa

SEQ ID NO: 5237 - DNA, 253 bp, Glycine max
  Peptide Sequence Number=SeqID_96922
atggaactcatgagactaaatcaacatgaagaaaatgacaagaaaaagaaaggaatcacacttaaagcttcatcttcaattcaagaaggaagtgataaagaagacttgaatgcaatagaggaagatgatgatttcaatttcttcataaagagaatcaataaattcctaagaaacaaaggaaatcaaagaagatcaaacttcaaaccaaagaaaagaggagaagattcatcttctgttccaaagtgttatgaat

SEQ ID NO: 5238 - DNA, 99 bp, Glycine max
  Peptide Sequence Number=SeqID_96923
atgggtgttcgtcttcttggtatcagaaaggcatcatttgctgcaaaccaagcatcttcaaaagttgtggatatcccaaagggttaccttgcagtctat

SEQ ID NO: 5239 - DNA, 588 bp, Glycine max
  Peptide Sequence Number=SeqID_96924
atgcggataaccataaggtgtctctatatgtcatcggacttaccgtctctggatgataaaggtgcagatgacgatgtcaatctctgcatgtcaacgggctcgcttgcctctagctggcaaaaggtgcagataactgtaaggcatctccgcatgtcattggacttgtcgtctctggatgacaaaggtgaagatgacgatgttagtttctgtgtgtcaactggctcgcttgcctctagcagacaaaaggtgcgaataatcgtaaggcatctctgcatgtcatcagacttgccatctctggatgacaaaggtgtagatgacgatgtgcggataaccataaggtatctccgcatgtcatcgaactcgccgtctctggatgaaaaaggtgcagatgacgacgtgtggataaccataaggcattttcgcatgtcatcggacttcccgtctttggatgacaaaggtgcagatgacgatgtgcggataaccataaggtatctccgcatgtcatcggactcgccgtctctggatgataaaggttcagatgatgacattaatctctacgtgtcaacgggcttgcttgcctctagctga

SEQ ID NO: 5240 - DNA, 525 bp, Glycine max
  Peptide Sequence Number=SeqID_96925
atggctgcaccagacaataatgatccaagaaacatggtttccatttcaaggattatgtttgtgcatgcaaagcttgtgcaacctcagagggttttaaccgtttcaaatttggataggaagctttacaactacatgactccttatgtgtccaagttcctaatgaaggcatatgtgaactatagagatttggatttgggaatgaacaagaagaacaacacaaagcattccaccactcctagtttcaagtatgaggccaaaagacaagaagtgcaagacctgggaatgaggcactatgttgctggagccattggggtggttgctacaaatttgttatggctggggttcgaggacatgagacattatgttctgtacataaccttggaggtagaagcaacaattgcatcagtaaaggaggagattacagatagaaaatgtgaattgatccatgtgaatgacctcttaagcagggtcattgaggcacaagaaaaatgcccgaagctaatgttagaaaaactagaactctag

SEQ ID NO: 5241 - DNA, 1050 bp, Glycine max
  Peptide Sequence Number=SeqID_96926
atggatgtaccctccaatgtgttaagacaaagatctcgggctgttaaacctttgatgctttgtgaatggggatacaaaagaattctcaagcaggagaagggagacacaaaagaattcaggcggttagtccttggcgaattctgtttggcaaagggagaagagaatgaaaagatgaatagcacaagttttcaagacgtttctgtgagcgatttcgtgaacattcttcaccgttcttcatcgttcttcgtcgttctttggtcttcaaccgtcgccagtctgaaagagttaggacagttgatgggtcagttccaacaacaagcttttcgcaaagcttacggtaagatctgggacctagccatggcagaggtctccacagaggccattgcctccctcgcccaatattatgaccagccgttgaggaaatgtttggaagcaaaagtaagagtcttggtaggtaaaggcgaatgggccccgttcgtagacatcctcgcacttttgatcttcggaggagtcccctttccaaatgtggatgggttagtggaccaggcagcaattgacgcttttctcgcctttcatgaccgcaaggaaagcccggtcgtcgctatcttagccgatctatatgacaacttcgaccgaagatgtgaaaataatagtacaaggattgtttgttgtactctggccctctacgtatggttggtttcacaccttttctgccaagaagtgagatatgcttgcctgctagaaggccattgctcatgcacagagaaaaaagaggcaagttgggaccgactcttagcaagcaaagatggagcatctgtcaactggttcccccgatggaaagaaggaagaaccggggttcttatttcgtgcagaggatttccaaattttcccttgatggggacaaggggttgcattaattacaatcccatcctcgccataagacaactgggctacactatgagaggggcaccattagaggaagacctcacacctactattgcacaaggtttcaatagcaccaacgcggaggcacttcagaaggtccactag

SEQ ID NO: 5242 - DNA, 264 bp, Glycine max
  Peptide Sequence Number=SeqID_96927
atgaagaacggggaaaagagcaaggttgttgctgcccagctcgcccaggcgagctgggttgcttccaccagaaggcaccgccttctgttggaacaccctggaaggcccaaaacattacggattgcgcgacaatgctccctttcgacttccggcatgccgcagaacttcacggattacctaacaatgggtgttaagtacctcgaagaggtcaagcaaaggttgcaggccatcaaacaatggtccccagacgaaattagggtatga

SEQ ID NO: 5243 - DNA, 1218 bp, Glycine max
  Peptide Sequence Number=SeqID_96928
atggttaagactaaaggattaggccgtgcgttatgtagggttggtgccagaggtctggggagaggaagggatcgcgatgatactgacagtgcagaggcagaggctattgcagccggggatgagcccatggtagatgctgccgcacaggacaccggtgcagagactgacgcacaggataccgatgcagagactgacggggatgagcctatgggatttcctggtggacccagggacccatcagtgcttacagagtatgctgaccatgttgcgggcagcgtatggtctggacaggaacgtcctgagttgaagttatgctcccatgggaggaaggtgcataacttgggtaggcctattcctgcaattgaggacatggttgctaggacaggattaagtcctttgattgcatgttcgatagacatcggtgatcggggatttatatcctcttttgtggagaggtggcaccgggaaacttctagtttccatcttcctgagggggaggtgtcgatcacgctggacgatgtcgtgtctcttctccattggcctatcattggcacattccatgacttccagcctctgcgcaccgacgaggcggtggtgctgttggttgagttactgatggtctcagcagagacagctgttgctcgcgattatcttctacatcttttgggttgcactctttttgctaataagagtgcaacccatgttcatgtctcacacttacaggcgttccgtgacctcactcttgctgggtggtatgcatggggagctgcaggcctcgtccttatgtacgatcagcttaatgatgccattgcggagtccaatgttgatttagactacgacgaggtgtcaccatgtgcgtgtcggtggattgtaacaaagaagactgtgaagaagagggttatgtgccagttaggctacgtccagtgcattcctgcacaccctgtccattcgtgggtgtcatatgatgacgtggacgatacttggacgcactactcagaccatctggaggcagcaggtgatctatgtgttgtgccaagtgagtgtgcacctgactacatgaactgtcatatccctcatgaggcagcactggcatcgacacatgcggatcctgatgcaaacgagcccagacatgcagtggaggcttgccatgcgatcgcggaggcattggagcaacatctaaatgcgccaggcacatccacacatgaagaggtcatctaa

SEQ ID NO: 5244 - DNA, 342 bp, Glycine max
  Peptide Sequence Number=SeqID_96929
atgatgtcctttaatggtgattttccaccatggagatgcagcggaagacaaaggagaagaggtgagaggaagcgccatccactagggaataagccatgtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 5245 - DNA, 328 bp, Glycine max
  Peptide Sequence Number=SeqID_96930
atgactagaggcaatccatctgacttacaaccctttgatcctgagatagataggacatttcatagattagttaggcatcattttgtaccttttgaccatcctgagcattctgttattggtgattttgaacatcctgattttgagcattataattttgaacattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcag

SEQ ID NO: 5246 - DNA, 345 bp, Glycine max
  Peptide Sequence Number=SeqID_96931
atggtaaagtgtcttgtgaagttgcaaactaaatttcgagaagatccaacggttaacgaaggctgggcagcatttctaccgaggcagcttcatgcttcctctagaagcttcattaagaggcttctagcacactccagatatcttctcaaagatcccaacggtcagatcatggaaaggtgttttgtgaagttgcagaccaaatttcgagaagatccaacggttaatgaaggctgggaagcgtttttaccgaagcagcttcatgtagctttctctagaagcttcattaagaggcttcctcgtggcttctttgagaagctttctcaagagacttctttgagaagctag

SEQ ID NO: 5247 - DNA, 156 bp, Glycine max
  Peptide Sequence Number=SeqID_96932
atggtggagctcatgaatctggatgttctatccctaatgaagagcaaattgcacatgacgttaattatatggggaatcagcctagaggcaatttcaatacaaagactagggtggttcatcttcaaggccacaacagcagatgccaagtctctatga

SEQ ID NO: 5248 - DNA, 621 bp, Glycine max
  Peptide Sequence Number=SeqID_96933
atgcatatcagggcaagattttacccagccgctgcaaggagacgaatgtggatcatgctcaccaacatatggataacgttgctacttagcaaccttcttcccaacgaccaccactctgatctccccctgccgaagtgtcagctggtttatgccatcatgacatacggatcgcgcccgcaagacacccagtggacccgaagaagtccaacagggccctggggttctagctctgattacgggcctctatcagttctacggagtgaccaccactctgatctccccctgccaaagtgtcagctgggatcccgcccacaagacactcagtggacccaaagaagttcaatagggtcctggggttctagctttgattacgggcctctgtcgactcatcgccaccacctccagaatccacctcagctcatctacaaaggctggaacgttgcctatgacatgtggccgaccaataggcgaccaaccacccgggcagaagcgttactaggaggcaacctagaattggctatgaagaagctccccacgaagcggtccaggaagggcatcattgaagaggattccagtctggccccacaagccgacacaggctttgacaaacatagattctag

SEQ ID NO: 5249 - DNA, 486 bp, Glycine max
  Peptide Sequence Number=SeqID_96934
atggtgaaagttggaacctcttacgtgccgatcaacgtctcattttcgccaaaagttggcccagggcttcccggtatcaacagggacaccaggatttatttattctgcgaagtgatcttccgtcacaggtggtatgatggtgtttttgaggtgctccagtggcttctgtttctatcagctgtccctcctgttcagctactgacggggtgggtgcgtaaacggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 5250 - DNA, 294 bp, Glycine max
  Peptide Sequence Number=SeqID_96935
atgacaaaaactgtttgtacggataaccgcttgggtatctccgcacgtcacctgacttcacgggtcaggatgacagaaaccgtttgtatggataaacgcttgggtatctccatacgtcacctgacttcacgggtcaagatgacagaaagcacggaagagaacataatcacttgtgtatctccgcatgtcgtcggactcacgggtcacgatagcaaaaggtggggtggtcgacaaaagcgaggcttttgctcctacgtatcctccatttgtgatgaggaactcatacctacgtag

SEQ ID NO: 5251 - DNA, 409 bp, Glycine max
  Peptide Sequence Number=SeqID_96936
gaatttacaagatagtggaactctcaagcgggttgcttggggactggacgtaggcacaagggtgcgttgcggtggttggcggcggcaaacaaggtacgcaaaaggtggtggctatgttgcggatatggacgaagatgagtggatgtatgaaataatgtctgaacgagcggatatggattatgaaaatgaagaagcatgtggtgcgaatgaaccacatgttgattgtttggatgcgtttaatacttctcaggatgctttatggtgggctcgatccgttgttcatgaaaatggatttgtggcggtgattttaaggaaaaaagaatttatcagaagagacactgggactaggaaatgggggtgtcccttcaagcttcgttgcaagccagtggttggaggagaaggctggatg

SEQ ID NO: 5252 - DNA, 1125 bp, Glycine max
  Peptide Sequence Number=SeqID_96937
atggaatcaaatcaaatgccttcacttaaaaagaggttctatcaagttaaggtcaagagcctagggaccaccagtctaaaagagttagggcagttcatgggtcagctccagcggcatgcttttcgcaaaacttacggtaaaatatgggacctagccatggtagaagtctccacagaggccattgcctccctcgcccagtattatgatcggtcgttgaggtgctttacctttgggaacttccagctatcacctatggaagaagaatttgaagaaatcctaggatgtcctctagggggaaaaagaccatacctcttctcagggttctatccctcatttgctagaatttccaagatagtccaaatctcggcgcaagaattagaccacaaaaagcaagtcgaaaatggggtggttggaataccgagaaaatatttggaggcaaaagcaagaatcttggcaggtaaagacgagtgggccctgttcatagatattctcgcattgttgatcttcggaggagtcctctttccgaatgtggatgggttggtggacctagcagcgatcgacgcttttctcgcctatcataaccacaaggaaaacccggttgtcgctatgctagccgacctatatgacaccttcgaccgaagatgcgagaagagcagtacaaggattgtttgctgtactccagctctttatgtatggttggtttcgcacctttttcgccaagaggtaaggcatgcttgcccgctagaaagtcaccgctcatgcacagagaaaggaggggcaaattgggaccaactcttatcaagcaaagaaggagcgtctgtcaactggttccctcgatggaaagaaggaagaaacggagttcttatttcatgcggaggatttccaaatgttcacttgatggggacgagaggttgcatcatttacaatcctgttcttcctataaggcaacttggttaccctatgagaagggcaccactagaggaagagctcgcacctgtcatttcgcgaggtttctataataccaacatggaaacacttcataaggtccacaaggcatgggaggtggtgcaaaagaaggacaaagaactcaggggcagtaacaatgggcccatcggtggctactag

SEQ ID NO: 5253 - DNA, 450 bp, Glycine max
  Peptide Sequence Number=SeqID_96938
atgatgtgggtgcggatcctgctgctgatcattctgacctgcctgcttatcttcatgtggcggatccccgtgccagtaaattcgaccgttttcgagcacaggcgcgcctggttaaaggttaaacgattgttacctttacccactccgttgcgcgtcgtgagtaacactgtttcatttaggcacaaaccgatgaccgcaactgcacagcagcttgaatatctgaaaaacagcatcaaaagcatccaggactatccaaaacctggcattcttttccgtgatgtcaccagcttgctggaagacccgaaagcgtacgcgctcagcattgaactgctggtcgagcgttataaaaacgccgggatcaccaaagtagtaggtactgaagcccgctggcttcctgtttggcgcaccggttgcgctggcgatgggcgttgggtttgtgccagtgcgtaa

SEQ ID NO: 5254 - DNA, 498 bp, Glycine max
  Peptide Sequence Number=SeqID_96939
atgccgacacctatcatcggcctgcggcggcttgccaagggtcgccagggaacagcattcatgatggacgcggggcgcccgccggcagccgcgggcggcggctgccgggaacagcaggatcaggccaggtgccttgtccagcaggccggccagctgggccttgcccaccgcaccgatctgctcgccgaccttctcgccgtccttgaacacgaccaggtacggaatcgaacgcacgtggtacttggcggccagcgcacgattgtggtcaacgttgaccttggcgatcttggcgcggccctggtaggcatcggccagctcgtccagcgccggggcgatcatcttgcaggggccacaccactcggcccagaaatcgaccagcaccggttccttggaattcagcactgcgctatcaaagtcggcgtcgccgacatgtacaaccttgtcgctcatcttggtttctcgtcttggattgcacccggccaagccggaggtgggtga

SEQ ID NO: 5255 - DNA, 144 bp, Glycine max
  Peptide Sequence Number=SeqID_96940
atgagaccatacaaggttttgatgatgcgaagacaaaagcaacataagttttatttcaagtccaaatcaagaccaagaaaacaaagatcaagaagaaagctaagtcttagtctatctttattaaaagagtctcttagtgattga

SEQ ID NO: 5256 - DNA, 528 bp, Glycine max
  Peptide Sequence Number=SeqID_96941
atggtggaagaccaggaaaacgtctactactacctgacggtgatgaacgaaaactacccgcagcctggcctgaccgccggcgacgaggaaggcatcatcaagggcatgtacaagctcaagtcgcacggcaagggcaagaaccgcgtgcagctgatgggctcgggcacgatcctgcgcgaagtcatggcggcccaggaactgctggaagccgactggggcgtggcctcggacctgtggagcgtcaccagcttcaccgaactgcgccgcaacggcctggacgccgagcgccacaacatgctgcaccccgacgagaagaagccgcaggtggcctacgtcacggaacagctggccaagacggaaggcccgatcatcgcgtcgaccgactacatgaagctgtttgcggaccagatccgtccgttcgtgcccaagggccgcgaatacaaggtgctgggcaccgacggtttcggccgttcggatttccgcgccaagctgcgcgagcacttcgaagtggaccgccacttcgtcgtg

SEQ ID NO: 5257 - DNA, 705 bp, Glycine max
  Peptide Sequence Number=SeqID_96942
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacacagtactgcgatgagtggcaggcggggcgtaatttttttaaggcagttattggtgcctagaaatattttatctgattaa

SEQ ID NO: 5258 - DNA, 483 bp, Glycine max
  Peptide Sequence Number=SeqID_96943
atggcatcgagaaaaagagctagaacagaggacatcccttcatcatccactccagctcctccgtcagtaaccataggacaagatgtccaaagctcacaaactttagtcccgatgctacaaagcttatttcgaggacagtttattatcatgcacaacctgcaagagttggctcataacaggccaatcatacctatggagcattttcttgagcaagtagcctggcctgaagctcaacttccattggtgatacccaatgaggctgctccacctgagcccacacctgtgcaggttgatccagggccagctaacccacaatctccagtggtgaatccaccgtcttctcctaagcatgaagcggctgcccctcctgattcaccagttggagaaacagctgaccctcctgcttccccaattggaggaattgccgatctttctgattcgttatctggagaagctgttgctctcactgattccccaatttag

SEQ ID NO: 5259 - DNA, 453 bp, Glycine max
  Peptide Sequence Number=SeqID_96944
atgttaatgggtaatgatcaattctcgtgtgttggcccgattgagttattatgcaccattggtagaacaccggatgatatattaaacttacttcaagccactataacctctacttatgatgtcctgcgatattacaatggaaggtggaacatgtcacgccaacacgactttgtcggtcattatgagtattcagacaaagttatcaaatttgaaattattgagctgaaaattgacgatgacatgctaaaggtcttagtacagtctaactactggaaacaatttgggccaatagaaattttagctgtttttagtaaacagacaaatttgtataacgctgcattctacctatgtacggagtgggccactgctttgcctgagaatgacaatgtgtattccacaacaacaccactggtggtaaaggataatagtctcgtaacaaaacctgttacataa

SEQ ID NO: 5260 - DNA, 477 bp, Glycine max
  Peptide Sequence Number=SeqID_96945
atggcggaaccatcgaaaaagcagaaaggaacttcgagtcagagtcagcagcattccgggtcacaggaagccccaattcctccttccattccctctggatcattattcttatcagaggaacaacttcgcaccaaccaagcggatatgaccggaagacttcttgctggttcattggcttttgagagccgcatcctccattaccttattgttcgcatcttactccctagatcttcaaaccttgctctggtttctgaagaagatctcattgtcatgtgggcctttcataaaggtttacaaattgattgggcacaccttgttagatatcgcatgcataaggcattgcgattgaatgccccattgccttatcctcatcttgttaccctttttccttcaagactttcaacattccctcttgatttctggaacctttatgttccaatcaagagatccattccttatagggcgctccattcatag

SEQ ID NO: 5261 - DNA, 180 bp, Glycine max
  Peptide Sequence Number=SeqID_96946
atgtggaaagcttaccatgtagagattggaacacatcatcgaaagtatcccaaaaggaatgtgttcggttctgtaagtgcaagaaagaaaaggactacctatataagcatgaagtttagccgcttcaagaagctgggacttggctttgatatgcttatgaaggatagggacacaggctag

SEQ ID NO: 5262 - DNA, 258 bp, Glycine max
  Peptide Sequence Number=SeqID_96947
atggggaagaggaagccggagctaggttttgaagatcagaaaattgattttgatttgtttgttgaagacaagcttgctccaaaacacaatgtttgcttacaggtaatggaaggagatcaagaggttctgaaacctcgcgctaagctcatatttgttcatgcactatgccgtgagtctcaagcgcttagcgcccaaccgttgcatctgaggctgatttggtccgctaagatggcagaggatgagctaagccaactttaa

SEQ ID NO: 5263 - DNA, 420 bp, Glycine max
  Peptide Sequence Number=SeqID_96948
atgccaatctccccctacagatgtatcagttgggatcgcgcccacaagacacccagtggacccgaagaagtccaacagggccctggggtttccagctctggttacgggcctctgtcagtcctacagggtgcccgttcccccagcaaggaatcgcacccacaaagacacccagtggacccggagaagtccaatagggccctggggtttctaactctggttacgggcctttgtagtcctacagggtgcctgttccccccggcaaggtcacgtcatcatgacatagggatcacgcccgcaagacacccagtggaccccaagaagtccaacaaggtcttggagttgccaagctctaattacaggcctctgtcagttctacggagtgtctgtcgcccccagcaaggtcatcaagccccctactaa

SEQ ID NO: 5264 - DNA, 438 bp, Glycine max
  Peptide Sequence Number=SeqID_96949
atgcctcctgaagacctacaacagctgacccaaaaaattagggaccaactgcaggagtcgatcacagaaaaagtgactcagcagctgatggcatccttcagccagatacagtcccaactccaaccacagatgcaatcacagggacttgcactgcctccggagcctgaggttggtcccttaggtgctcgtgtcagcacaaaggagagttgtgttgatccctcagggaatgatccagagacgagtaacttagacaaatgcgggttgtacattgaagaaaatctttcccgcttggttgccttaggaagactttatgagggatccatagcggttcacaacatttctttgttgcatggacaagtcaaggttggtgtggagatgattaaagatgcagaggctcccatttcggtacccactgacgaggttaccttagtggggtag

SEQ ID NO: 5265 - DNA, 541 bp, Glycine max
  Peptide Sequence Number=SeqID_96950
ggcttaccatctggccccagtgctgcaatgataccgcgagacccacgctcaccggctccagatttatcacgcaaagaacagtgcagccagccggaaggccgagcgcagaagtggtcctgcaaggcgtttttccataggctccgccccagcatcacaaaaatcgacgctcaagtcagaggtggcgaaacccgacaggactataaagatacccgttcccagatacgtggtgtccgccttcgtcgtttcggtatggcgctttctcatgctcacgtgttcccaacgatcaaggcgagttacatgatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttg

SEQ ID NO: 5266 - DNA, 309 bp, Glycine max
  Peptide Sequence Number=SeqID_96951
atgacttttgagaaaaccaagttaagagttataactcttaactttttcttcaaaactgttcactgtcttgaatcaatcacttgggcttttggcatcatcaaaatttctaggttcatcatcatgaagcttgcttctacaacgatgaacttgctaagcgagcgtgctgcactaagcgagttcatcaaaattcattgcagatatgcgtttccagaggaacttgctaagctcacctaccacactaagcgagttcatcttgtgaggatgaatactcatcctcctattgaaatccttgtggctaagcgaggctga

SEQ ID NO: 5267 - DNA, 429 bp, Glycine max
  Peptide Sequence Number=SeqID_96952
atgggtaaagcagaggaggtgcaagagcagatgaaggccgacatgaaggccatgaaagagcaaatggccacaatggtggaggccatgataagcatgaagaagataatggaagccaatgcggttacagttgccgctaccagcactgttgctgaggtgaacccaatgcccccatctggcctcaagcaaatgaatcatccaacctcatatatgaaatgggagaagttggatcatctagaggaaaggctcagggccattgaaggaagcgaagattatgcctttgctagcctagaagagttgttcctagtacccaatatcatcacccctcccaagttcaaggtgctggactttgacaagtacaaggggactacttgccccaagaactatctaaagatgtattgttggaagatggagggcatacgcaaaagatga

SEQ ID NO: 5268 - DNA, 799 bp, Glycine max
  Peptide Sequence Number=SeqID_96953
tccaaatctcggcacaggaattagaccacagaaagcaagtaaaaagtggggtggttgggagtaccgagaagatgtttggaggcaaaggcaagaaatcttggcaggtagaggtgaatgggccccgttcatagacatccttgcacttttgatctttggaggagtcctctttccaaatgtggatgggttggtggacctagcagcgatcgacgcttttctcgcctatcacaaccacaaggaaaacccagttgtcgctatattagccgatctatatgacaccttcgaccgaagatgtgagaagagcagtgcaaggattgtttgctatactccagcgctctatttatggttggtttcgcacctttttcaccaagagcaagcaaagaaagagcatctgtcaactggttccctcgttggaaagaaggaagaaccggggggttgcatcagttacaatcccattcttgctataagacaacttggctgccctatgagaggggcaccactagaggaagagctcgcacctactattgcacggggtttcaataacaccaacgtgaaggcgcttcaaaaggtccgcaaggcgtgggagatggtgcaaaagaaggacaaggaactcagaggcagtaacaactgggcccatcggcggctacctttgagaaccactaaaggggtggaagttgaggcactagaggaagatgaagaggtgcaggcccttagggcagaactcgagcaagcccaatcagtcaaagaacggttcaaatcagcagctcttaagatccgaaaggagaatgccaaactgagagac

SEQ ID NO: 5269 - DNA, 180 bp, Glycine max
  Peptide Sequence Number=SeqID_96954
atggtggaaaaccttcacggatttgctcacgaaaacgtctccgaagacctcccttcgcctatttataggaaaagaggggaggaggttgccgcccagctcacccaggcgatctgggttgcttcctccttaagtaacccaacttccaaaatgttctggaagagcctagattcgaaaatttga

SEQ ID NO: 5270 - DNA, 210 bp, Glycine max
  Peptide Sequence Number=SeqID_96955
gccaagtttgatatcccagaagccctagatgcaaagaaaaaggaccaacataaagaagatccttctgtcagatatggctttgatgcacagatatgggaggaatttgcgacaacccgcaaaacccctagttggcagggtcgtcatgatatacttaacacgaccataggaagaccagatcatggaggtcgtgttcgtgtagctgggtctggg

SEQ ID NO: 5271 - DNA, 324 bp, Glycine max
  Peptide Sequence Number=SeqID_96956
atggctccgaaaaagctttccacgaaaaggtctagaaaggaggctgcgggggaaggctccagtaccgccttggaatttgatagtcaccggttttggagcgccgagcaccaacagcgcttcgaggccatcaaagggtggtcgttccacagagagaggcgcgcccaactcagggaagatgagtatacgaactttcaggaggagatagctcacagacgttggacgtcgctggtaactcccatggctaagtttgaccctgagatagtcctagaattctacgctaattcttggcccatagaggagggagtgcgagacatgcacgcctag

SEQ ID NO: 5272 - DNA, 320 bp, Glycine max
  Peptide Sequence Number=SeqID_96957
cgcgccttatgcgctaaagcctgagtgtcattctgatgaggctgagctaagcacgacatgctacgctaagctccaactctcttcgattttgaaaattgtagacttagacattgtggtgcctcgaaagctactactgaagaggaatgtggtagtttattgcaccgagtttgacgagttcaagaaggaacttgagataagacattgggatgagaagttgactgattttgctgacagtagtatagacattgccattatgaaggaattttacaccaacctctatgaccccgaggataaatcacctaagcaagtgagggtgagag

SEQ ID NO: 5273 - DNA, 267 bp, Glycine max
  Peptide Sequence Number=SeqID_96958
atgatggcacatcaaaaccccccatacttagccttttgcactcctgggcaaaatgaaacaaagaacaaaatccaaggatatcaaagagagacaaacaaaaacattcacatatttctcaatgaacatcaaggaatgaaaggaatggcacatgaggatcagaagtcttttaaggttgtaatggggccaaggacaaggtatggaaaaataaggaataagtggctaaatcccaaaggaatagaggagcaatggggaataagtgcatattaa

SEQ ID NO: 5274 - DNA, 996 bp, Glycine max
  Peptide Sequence Number=SeqID_96959
atggaccaatcacgattgatcttggaagatgaattgaaggcttgctcgaggtccaaaagaagtttgtctcagcggttatgcaagacagagaccaacttgttagctattatcaccaagtaccaagaagaactaaatctagccacggcccacgagcatagagtggcggacgagtatgcccaagtgtacgaggaaaaggaggctagaggaagggtgatcgactcgctacatcaagaggcaacgatgtggatggaccgatttgcccttaccttgaacgggagtcaagagcttccccgactactagccaaggccaaggcaatggcagacacctactccgcccccgaggagatccacgaacttctcggctattggaaaaacaccataactaaacgcgccccaaggcatccctatcacaccagatccaaatctagaacgatgggtgatcaagagaagacacaggaacagatgaaaaccgacatgtcggctatgaaagaacaaatggcttccatgatggaggccatgttaggaatgaggcaactcatggagaaaaacatgaccaccgttgccatcattagttcagctgccgaagcagacccaactctcctagctactgcgcatcatcctcccccaaatactgtaggacgaggaaggagcacactggggcacaacaacaacccccatttgggatacaaccgggtggcttacccttatggattgctgcctaattacacgccgccagtcatgcaagatgatgcgggtcatatctcttcccccatccttgaaggggagcctcctcgacagcctgacgaggtccacgaagatcatcaagagtatgcccaaagggatgtcgagttctaccccccgatccccgtcgaaagggtcggcacccaacactttgcctcagcccaacctcacagcacaaccaataatcttgtccacggaaggaccacccccggcgaccgaagaagaagaaactcgatctcctcgaggagagattga

SEQ ID NO: 5275 - DNA, 402 bp, Glycine max
  Peptide Sequence Number=SeqID_96960
atgaccggaaggcttcttgccggttcattggtttttgagagccgcatccttcattaccttattgtgaggtatcttacttccaagatcttcaaaccttgcacaggcgcttcagtcattgcatcctttggttatcaaaaagagcatgatggctcttgggtgaaaaagggtgctcgacatgttgatgaagaaggacatggtggagaagattcatctcttcttcaaaagattttggataggttcgatggtcttcaaacctttgttggtgaaaggtttgatactatggagttacaagtggacatgcgcttcaatgagatggagtcaagaatcaccaaggtcgaagaagatgtttcttatattcgttcaagctttgatctaccaccaccgccgccaccatcatcttag

SEQ ID NO: 5276 - DNA, 93 bp, Glycine max
  Peptide Sequence Number=SeqID_96961
atggcggccaccggtggtcttgggtggtggaaaataagcgggcttgtcgcgctaagccgaagttcacttcttgtgcttagcacaagaatttag

SEQ ID NO: 5277 - DNA, 111 bp, Glycine max
  Peptide Sequence Number=SeqID_96962
atgtcactttatgggttttataggcgctttatcaaggattttagcaaggtggcccttccactatccaatctgctgcaaaaggaggtggagtttgattttgatgaccggtga

SEQ ID NO: 5278 - DNA, 426 bp, Glycine max
  Peptide Sequence Number=SeqID_96963
atgtataaggcattgcgattgaatgctccattgccttatcctcatcttgttaggctgggccttcaacacttcaacatccctcttgattttgaaccctatgttccaatcaagagatccttccttataggcgcttcagtcatagcatcctttggttatcaaaaagagcatgatggctcttgggtgaagaagggtgctcgaaatattggtgaagaaggacatgatggagaagattcatctcttctttcagagataatggacaggtttgatggtattcaaacctttgttggtgaaaggtttgacactttggaattacaagtggatatgcgcttcaatgaaatggagtcaagaatcacaaaggttgaagaagatgtgtcttacattcgttcaagcttcgatcttccaccaccgccgccaccatcatcttag

SEQ ID NO: 5279 - DNA, 1710 bp, Glycine max
  Peptide Sequence Number=SeqID_96964
atggctattggaagaccggagcattatggtctgtatgtggggatgggacaggggttacaattagccagtactttggtccagcatcacgaagaatggcgaagagaggctgaacaagaaaacataaaaagagaggaggcgtggatgaggagggtagaagaggaaaaacaatgcactatggacacatttaaaggacaaatacaacaagctatcaagttggagttgtcacaaattgcatcacaacattcagccccactccagccacatgatatacaactattagcagcaaggcgtcggctgcatgtaactaccgagaactccaacaaattagtggcagtgggcaaacagtgcgacacttttggcaccatccacaacatgccctattctgatgatgttgttcgggtgagtgtggtcgaagttattgtcagtgatgctgaggttccaatccctacatcagaaataaagtttctgaaagaagctttagggagttttgttccatggccaacacatttggtcaaacccatgttgcctgaggatgtcagctcaccattgaagactgttgaggaggaaaaggcagctgtcgtggttgatccattgggagagttggtgaagaacttgttcgagatttaccaaaggcctgttggggtgtcatgggatggcgctaaatttgggatcaataatgtcaaagatggcttcttcatcacacacgctgatgtgagtgagataattttaggtgacaagtgtttgaacatctccattctacagttatggcttattgcaagcataggttatggagcattgtatgggttccttgaacttcagtgtatccacaatgcaaacactagacgtcaagagtgtgaaaattacattggaagatgggcccatctgcagctgctcgtattgtgcccaggtgacaatctagtggtttggttttgttctttgctaaagaagcctgatgcttccattaagggtgtagtaaacagtgcaatgaaatcagtcagcaaaactgcagagggaaagccacctcagcatgggcctcagtggattgaagcaaagagtcatgttcaaacaggaaactacgagtgtggatactatgttatgcattggatatggtgcatcgtaagtgctggattgaaggatgaatggattcacctacctgacgagattaaaaaaggagctacttcttttgaaggagtagaagcaaagctatggcagggtggtggtgacaaggactacaaggaggcacccccagctcctttgtttgaacttggtgagctcaaatcatggtccttctacagagctggaattgctgagtttgtggcaactttcttgttcctctacattaccatcttaactgtcatgggtgtcaacaagtcaccctccaagtgtgcctttgttggcattcaaggcattgttggatggggacacatcaacctagttgtgacctttggtctatttttggcaaggaagttgtccctcacacttggttttgcatattctgctgcacatttctacgacgatcaccgcgacgacaccgtagtagaactgagtgtctcttacgacggtcatgggacaagaccgtcctcattctacgacggtcttttcgacacaaccgtcgtagaatatatcaaagactacgacggtctctgggagcagactgtcgtagaattcgaccatgatctaagacgggcagctacacaggatcgtcgtaca

SEQ ID NO: 5280 - DNA, 345 bp, Glycine max
  Peptide Sequence Number=SeqID_96965
atggtagccataaccctagccaaggttcctcaacctccatttttccgaggatacaactcgaatgcaacatgtgcttatcatggaggagtcccggggcattgcattgagcattgtatgaccttgaaacataagcgacctgtgttcctgagtttgacttccaagtttgttcaatcagaaattgctcgttctacacgtttggtgagagtgctaacatatacctcagagccctacactggggcaatgagaggcaccgtgcataagcctcaagcgaacctaggggcagatcagaagttcttacccggtaggtcgaaagggcagcctaagcaaaaattagggttgatataa

SEQ ID NO: 5281 - DNA, 1875 bp, Glycine max
  Peptide Sequence Number=SeqID_96966
atggataaagatgctaattcaaaaatccaactccctcctggatttagattccacccttctgatgaggagctaattgttcactatctgagaaacaaagtgacatcatcaccctttcctacttcattcatagcagaaatagatctttacaactataatccatgggagctcccaagcaaagctttgtttagggaggatgagtggtatttctttactcctagagacaggaagtatcccaatggagtgaggcctaatagagcagctgcttctggttattggaaggctattgggactgacaaacccattttcacttcctgtgggataaagagcattgttgtcaagaaggcactcgtgttctacaagggtcgtccaccaaagggatcgaaaaccgattggatcatgcatgagtatagattgcatgattccacaatctccaattccaagcaaggagggtccatgagatattgtaaagtcaccaccgaagaggagactctgaaatcaatgatggcatcgctggaagaagaaatggatgaagaagaagaagttgaatcgtcaccggttccaccgatgcagaagaaagcacaaccgaagaagaaagcggttatcggtgatgacgtggagacggtggaggtgcaaaagcctgtggagaagaggaacattccaaatattttgaatctcgaggaaggtgagtttctggaagagtgtaggtggttccttctcggtaagaaggttgaggttgcagtttcaacggctagaagagtgagtagattggtggataatgaaatcgttcatttcaattttccgtgtcggagttaccccagtaagtctcagtggattgttcgagcgtcaaccaagtgttatggagaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggctaatccagatgaagcttcagcgttgcctttgatcaagcgaagaaagggtggtgagcccattgtagagcaaaataatgatgaacaagctcttttagagtcagctttgactaaacttgttggagctgcaaaaatctacaacctaaggatagagaacttagtgtttcaacttcaatttttatcttcaaacttatctctagtgtctcttgttatcaatccttttgcgtcttatatgtctttaggagaaggcttaccagatgagctaaccactatgaaatttgattctttgggatccagtgatgttgatgctttgacatttacttcactatatctccagataatagagcttcttgtagatgtatgggacgacttgttgcctgcaaaaaggttgtatgctcagggaatgggaaaattggaattcaaactgggaaagcttgataggagggttaaagaattgataagtaggttgagtactctatatttacgtgttgaatctatgcttaaagaaagttcagctttgccatccaattccgtagttgaacttgggaaagtattcagtagcacttctatcaatggagcttcctgcagaaagggatggatactgagagtgcagaaagaaatctacatccctgctggtcagcctacactatgcaatagaaggacaatttatgtgaacatctttactggagaagtgtcaaaaaagcttcctaaggcaatgcagatggcaagaggaattctagcaaatgcaatgggacttggaaagattgttatgacaattgctttgatactccgtaccgcaggcaggggtaactcggaaaaccaagatgtggagaatggagaatgggtaagtactaataagtaa

SEQ ID NO: 5282 - DNA, 264 bp, Glycine max
  Peptide Sequence Number=SeqID_96967
atggacgaagggctaactggccacttgatccaacacatcaaagcaaatcctgcccgcctggttgccctggggagagtttatgagggttccactgttgttcataacactcctttgttgcctggccaagtaaaggtgggtgtagaggaagttaaagatccagatgctcccgttcttgtacccactgatgaggtttccttagtgaggcaggcaattcacaccttccttgcttggctgacacatttggtcaagtctttatcacatcaa

SEQ ID NO: 5283 - DNA, 1063 bp, Glycine max
  Peptide Sequence Number=SeqID_96968
atggctactcctactgctcaatactcagtgtcttatcctagtcttgcgcagtctccagttaatgctacagcagtcgctactgctatcggtactgaaaattgttacaccgttgattctcatgatcaacctgaagcagctgcaactgaatcacaaaattcaccacaacatgttgctagatcagtcaatgttcatcctatgattactagaggcaaagatggcatagttcagccaacaattcatccatccttgcttcttgttgatgctgaacctaaatttgtgaaacaagctcctcaagactccaagtggcattctgctattactgatgggtggctaaggattttaagtcagaacacggtccttcgaatgacgacacccccaccatcacctacacaggccgagattccttctgatgggacgtctaggaaaactagacaagccactcgactaagaaggttgacagcaagaacattggatcaaccaagggcaatagttagtgtcaatccagccactggtagaggatcaggacctcacaaggataagtttcacagttatcttggagttgtggcacgagacaagattccaattgttcactctacctggaatgatgtaccagaaacactgaagaacatgatatgggatggcatatttgggatacagaaaaaggcacaggagattcaaaaatacaatgactctctacacttgttgtctaggggagggtatgagctgctagaaaaaaaattaatggctgaaaaaaggaagatacgagaagaacaagcagcatttactgaggacccttcattgttcctcccatcgtccccaatttctagacacgagaagtggaagagtgcgtgcacaaaacaatatggtcagatgacatctcaagccgccaaagaaatagctgacaaaattgactctttggaagagcaaagcatacagggcagcattgtgccttcaggacgtgacgatattttgaacatggctattggaagaccggagcattatggtcttgtatgtggggatgggacaggggttacaattagccagtactttggtccagcatcac

SEQ ID NO: 5284 - DNA, 735 bp, Glycine max
  Peptide Sequence Number=SeqID_96969
atgtaccactgtgtgttttctgtgcaggattcgtttgaggagcaggccacacaggaatcgttcgtcccccatggacgtcaggatgttctcgctgctgctattggacgtccagagcaccctggacgtgtccatgctgctggagccagtgtcaccatcaaacaatactttggatcggccccacggacgtcccgcagcgcttcctccctgcctcctaatgaattacagcagttgacccaacagatcagggaccggctaaaggagtccatcacagagaaagtgacgaggcaggtcatggcatccttcagccacatgcagtcccagcttcagtcgcagatgcaatctcagggacttgcagtgcctcttgagcctctggttggtccctccggtcctcgagtagttgtgtctccggcaaaaccacctccgaagcctgatccggaggtcgatgatccgctttatctgatgacattgaccatcccagagcttttcttgaggccttatcaggttagatgggatgccaccgtgttcggggtctttaatccagatttccccctcaacataaagcacgaagacctcttcgaaatcgcacacggtggtcaatgtctcagcatatcagtgttacagttgtggattctgcatctcactgaaacatgtatgagagtgaggaattctaatatctatggattcctcgagccacagtccattcagaggtctgggcaatcacagtttgagtcttaa

SEQ ID NO: 5285 - DNA, 579 bp, Glycine max
  Peptide Sequence Number=SeqID_96970
atgaggaaatgggcccttgcagccgatcaggatggtgtggacgacactgtttgtgaaaaatacgacataagcaaggaaaaatgggctcagttttgccagactcgcagagacccttcttgggagaaaaaggcacaggccatccagaaatggaacacttccccccacgttttgtctcgtgtgggttatgaatatttggagcagaagctcctggttgagaagaccaagaagcagttggaggaagctgcacagtcaggaagcgttgatggcgtcatcgaccctccatcccccgtcatacgccacgtgaagtggaaaatggcccgcaccaagaaaacaggggagatgacgactgaggccgcaaaggaaatcgctgagaagatcgattgctttgaggagcaagcgacacagggatccttcgtcccccgtggacgtcaggatgttctcaccgctgctattggacgtccagagcaccctgaacgtgtctgtgctgctggagccggtgtcaccatcaaccaatacttcggatcaactccacggacgtcccgcagctcttcctccctgcctcctgaagaattacagtaa

SEQ ID NO: 5286 - DNA, 249 bp, Glycine max
  Peptide Sequence Number=SeqID_96971
acttatcaaggtaatccttgtggcgtctaccctgacttatcttccttcactggaagtggcgtctacccggacttatcttccttcaccggaagtggcgtctaccctgacttatcttccttcactggaaatggcatcatccaaaacctccgtagcctgtatcaaacgatccgctcctactcaggttcacatcagcctggcccaaccctaaaagccctaatgatcaatgatgattatgcactttatctttga

SEQ ID NO: 5287 - DNA, 333 bp, Glycine max
  Peptide Sequence Number=SeqID_96972
atggcacaacctccaccctgtgagagcactctaagggaaatggctgcacctgatttcacctacgaaagcttgtgtatccaatactctaatgaggatatcccatattttcttaaaactggactgatccatttgcttccaaagtttcatggcctagcaggtgaagacccgcacaaacatcttaaagaattccatattgtttgctccaccatgaaacccccagatggccaggaggatcacatatttctgaaggcctttcctcattctttagagggagtggcaaaggactggctttattacctttctccacggtccatcacgagctcgatgacctaa

SEQ ID NO: 5288 - DNA, 366 bp, Glycine max
  Peptide Sequence Number=SeqID_96973
atgatgatttggaaacaacgtgcaaaattagtcatggccacagccaggtgggcactcaagcatcccgtttatggcattgtgatactacggttgggaatttacacaaacaaacccaacgtttccaaattatgttctttcatcagctcaatgaatccatccattcttatctcggttattcaggaaaataaactcttagcgtcagtcccttgtttccagaagatatgtttgctatctacgaatgatttatgcttcctaaccataacatgccgaccttcgagcatttcatttctaaacgaccatatagaggaaacactgggtccaacagagataggagaaaatcactcaaagtgtatcaatctcacacag

SEQ ID NO: 5289 - DNA, 493 bp, Glycine max
  Peptide Sequence Number=SeqID_96974
atgggtgaagtagaggaggtacaagagcaaatggccacaatgatggaggccatgatgagcatgaagaagataatggaagccaatgcggtcacagttgccgctaccagcactgttgctaaggtgaacccgatgccctcatctggcctcaaccaaatgaatcatccaaccttaaatatggtaggcaaagatttgggaagtagggacggcccccatgatgtgcaaattcaaaataagtacaccttcccgccatatggctcgcctcccaaggaggatgccaataacttcgctcccatactcattgaaagccaacaacctcaaactaatcatgcacatgtctctcaaaccgtggaggagacacatgaaattgcccaccacaatccagctaactctgagccttgcctcggatatgccactgaagggcaagcagttggtgatatacccctgcaaaacactttggagggcccacaaccacaccccttggattccacaatgg

SEQ ID NO: 5290 - DNA, 564 bp, Glycine max
  Peptide Sequence Number=SeqID_96975
atgtggaccaccacgggggaggagcttgccacccagctcgcccaggcgagcaaggttgcttcctccagaagcaacagccttctggaggaagaatctggaaggcccaactttcgaagaagttacggaaactcacggattgcgcaaaaacacccttttttgatttccgccacattacggaatttcacggatcgcaatagccttcttccctttgatttccgacacgtctcgggacttcatttattgtgcaacaaaggacgccaagaactttcaattggtgctgcccaaagacaaactcctgccccgctgacagccttgaatgctcaggctcgacccaattccaatgacaaatctcggcatggacaaaaccctgcacaatcaactcaacgcactggcactcgcaaaccttttctcggctgctgtcagtggtgcaacatcaaaggtcatgttctctctcagtgcaaaaccttccagcagcagcatcctagtgtcccaccgccacctcgtaactctctggctcacactggacaggttcaggtcaatactgcaactgccggcccatcgtaa

SEQ ID NO: 5291 - DNA, 516 bp, Glycine max
  Peptide Sequence Number=SeqID_96976
atgcaattaccgcaagagcccttgaacaagagaccaagagggctcgcaaggaagagtattgccggaacaaatttcgcggagctctatggggtagcaatagtgaactcaagttgcgaagggaagaaagggaccagtcgcgagcacatagcatggtccaaaagaagcttgtctcagcgtttatgcgagacagagaccaacatgttagctatcgtcgccaagtaccaagaagagttaggtctagccacggcccacgagcatagaatcgcggatgagtatgcccaagtgtatgcggaaaaagaggctagaggaagggtgatcgactctttacaccaagaggcaaccatgtggatggatcggtttgctcttaccttgaacgggagtcaagaacttccccgattgttagccaaggccaaggcaatggcagacacctactccgcccccgaagagattcatgggcttctcggctattgtcagcatatgatagacttaatggcccacataattagaaatcgttag

SEQ ID NO: 5292 - DNA, 294 bp, Glycine max
  Peptide Sequence Number=SeqID_96977
atggggggtgtagtgaccatgatggatatccctgatagggaaaatatagtgtttctcatgaggggaaatacttgtacttggggacatgtcactcagtttggaactcccttgagactcaggctggtcaccatggggggagttgcctatgcacgacaggatgaccttgacacttgctacctaattttcctaagtgagagtgttgcatggacacgtttaggctatttcctgacgaatagtaccatattgcctttgagagttgagatcaagtgcatgcatcatactgaacatgattga

SEQ ID NO: 5293 - DNA, 168 bp, Glycine max
  Peptide Sequence Number=SeqID_96978
atggatgaatttgacatccttgtctctctcatcctctcacaaacacatctttgcttattcaacttccaccggaatgttgtgaaaacaatgatggatacctcagagccctacactggggcaatgaggggcatcatgcatgaacctcaagtgaacctaggggcggattaa

SEQ ID NO: 5294 - DNA, 374 bp, Glycine max
  Peptide Sequence Number=SeqID_96979
gtatgccgcctaccaggcaccctctagacctagataagtctaacaaggccttgggttttccagcattgatcacgggtctctgccagtcgttcggggttcccgtcacacctagtaaggcggccaaccaccgagcgcacgtgcagacccatgactgtctctaccagctcagcctcagtctgcagagccaggatttcgctccttttccgtgccctactccagatcagtttaggacagaggtcacatggcccgaagattggcctgaggcccaggcaggggaggcgcccgcagaggctcccggcgatgcagatgaggcctgcatggacgaggagatgacagacttactctatttcttgggagggaacggagccacatga

SEQ ID NO: 5295 - DNA, 102 bp, Glycine max
  Peptide Sequence Number=SeqID_96980
atgcaggttgaaccaagaaacattgatgaagctttgtgcgatgaacaatggttgatggcaatgcatgaagagctaaatcagtttaagagaaatgaagtgtga

SEQ ID NO: 5296 - DNA, 429 bp, Glycine max
  misc_feature (334)..(334): n is a, c, g, or t
  Peptide Sequence Number=SeqID_96981
atggtagtcatagatttgggaagtacaggcgacccccatgatgtgcaaattcaaaacgagcactccttcccgccatatggcttgcctcccaactatacaccacccaatgtggcgtacactcccgatgaggatgtcaataactccgctctcatactcattgagagccgacaacctcatcatgcatgtgtctctcaacccatgggggagacatatgaaataccccaccacaatgtagccgacttcgagccttgcctcggatatgccactgaagggcatgcagttggtggtatacccctgcaaaacactttggagggccctcaatttcacccccaancacaaaccttgcattccacagcgggtaaaatccctcctcttatggaagaaatgggaaaagttggatcatctagaggaaacgctcagggccattga

SEQ ID NO: 5297 - DNA, 369 bp, Glycine max
  Peptide Sequence Number=SeqID_96982
atgtgtcacctaactgcatatgtttgtgtttactacaacgatcaaatctacaacactaatgagggcaccacctttgttagtaacaacacaaaaactttcatggtcaacaaggccataacctttacacagttgcttgaactttttcaccaaaaactaaacattgaaccacaacaacatatccaatgtctccacttttggggccccatatttgagttaggacaatgttatatgtacacatcttttattcaacgagatgatgctgatgttcgaaaaatgttcaacattttttacaacaacccactactaccgcttgtggagttatttgccataatctatgacaataataaccccaccaagcatccaacatga

SEQ ID NO: 5298 - DNA, 468 bp, Glycine max
  Peptide Sequence Number=SeqID_96983
atgtctaaccaaaagagcaccgagtctgcaattaagaatctggaagtccaggtggtccagcttgcaaagcaattagctgaaagacaatccaacagctttacagcaaacatagagaaaaatcctaaagaagagttcaaagttgtgatgactagaagcagaatggcgattcaagcggaggaaagtagagttgatcagaaggtggaggaatttaaacaacagttggctgatgaaccagcgctggaaccagttgatgatttagttgaacttgaagaaattgttgagaaagcaaaaggtgatgaagaagaagagacaccaataagagactgtcaagagaaaataaagaagaaggaagaaaaagaaaaagaaataaaagaagaagaagaaaaagaaaaaaagttgaaaaatgaaaacaaaaagagaaggttgttgagattgagaagaaaaagggcaagagtaaggctaacatag

SEQ ID NO: 5299 - DNA, 270 bp, Glycine max
  Peptide Sequence Number=SeqID_96984
atgaataggaaccctggggcaaatggagagaatgagaaggagggaggaacccatgttgtgattgccagtcctacatggccaaatgtcccaccagctcaacaatgtcaatactcagccaatatcagcccttctcattacccaccaccctatcagccaagaacactcaatcatccacaaaggccacccctaaatcatccaataccttacaccacccttaacacaaaccgtaacaccaaccagggaaggaattttgcaacaaaaagcctgtag

SEQ ID NO: 5300 - DNA, 285 bp, Glycine max
  Peptide Sequence Number=SeqID_96985
atggcctctaggaagaggaaatctactgcctctagaccccaggagccctatgacaccactagattcatatctgagggcgcctgggagaaatatgcacagaacgttcactcctggaacatccttccagagaggaaccctgatggtcacatagatgttgccctggtcaaggagttttatgcaaacttatatgacccagaggataaattaccaaggagcgccctggaagctcttgaggaaggacctcaccactttggcgcaaacctagagcgtcctatcctattctaa

SEQ ID NO: 5301 - DNA, 564 bp, Glycine max
  Peptide Sequence Number=SeqID_96986
atgccaatctccccctgcagatggatcgcgcccacaagacgccctgtggacccgaagaagtccaacaaggccctggggtttccagctctggttacgggcctctgtcagtcctacagggtgcccgtccccccagcgaggtcatgccattgtgacatagggatcgcgcccacaagacacctagtggacccgaagaagtccaacagggccctggggtttccagctctggttacgggcctctgtcagtcctatagggttcccgttcccctagcaaggtcatgccatcgtgacataggaatcgcacccacaaagacacccagtggacccggagaagtccaacagggccctgggtttccagctctggttacgggcctctgtagtcctacagggtgctcgttccccccggcaaggtcacgtcatcatgacatagggatcgcgcccgcaaaacacccagtggacccgaagaagtccaacaaggtcttggaattgccaagctctaattacgggcctctgtcagttctacagagtgcctgtcgcccccagcaaggtcatcaggccccctactaa

SEQ ID NO: 5302 - DNA, 192 bp, Glycine max
  Peptide Sequence Number=SeqID_96987
tgtaatagacaaaaaggaagcacagagtgcagctattacgtcatgcactggatgtccacgataatcttaggaactttctggaataattgggaaacgtattttaatgaagttagaccgtttgaagtagagagattcaaggcgcttcacatccaatggacactgtattatccaaaagttagaaatcaaacatag

SEQ ID NO: 5303 - DNA, 414 bp, Glycine max
  Peptide Sequence Number=SeqID_96988
atgcatccagcctttggttggattaaggtgaatacaaatggagttgcaaggggctctccaggtcttgcggctaatgtgggtttgtttagagatgatcaggggaattttctgggaggatttgcattgtgtcataccctaatttcgtccggggacctttgctcgatgacgtgcgaccattctttggtcctcgtgaggtgcttggcacccatcattaggcaatttgtgaaattccaggacatgccgaaaaaccaaaaaaatattgatgcacaatcccacccaggcccacttgggccctctggaatattcctccagaaggcagttgcttctggaggaagcaaccctgctcgcctgggcgagctgagctcgcctgggcgagctgggcggcaaccacctcccctattttgctataaatag

SEQ ID NO: 5304 - DNA, 1184 bp, Glycine max
  Peptide Sequence Number=SeqID_96989
actcggtgagtgataaacgtgcagagactaacgtcgtcttcttcgccctttgtcattcaggagcagagagtcgagtgataaacacacagagacaaattatggtcattctttgccctttgtcattcagatttcgcaagtcgagtgataaacgcgcagagaaaaattatggtcattctgcgccctttgtcattcagagacaagacaaattatggtcattctgcgctttgccacccaggctcggtcgtgtcggaggacacacagagacaaattatggccattatgcgccttgtgtcaaccaagaggaacgaattcgacagtatcaggatgatgcgtcggcactgctcactttcaaaatttttgtaggttccgcggcggggagattcaccggccgaatgacaagtaaagaggggcaactgtcataccctaattttgtccggggaccatccgttgttgggatgcgaccctcgtttgaccacttcgaggggggtgcaaatagcaaccaggccctcttgggccttccaggaagttctccagaaggcactgccttctggaggaagcaacctagctcgcctgggcgagctgggtgggaagcttctccttcctctataaataggggaaggagggaagaacaaaaatgttcaaccctcctgattttcaaccgttcttcgtcgttcttcgttcgttcttcgtcgttcttcggtcttcaaccgacacacccgcgagccctcccgccgaagggtaggttgcgacatgtcacaacctgccctctggcgggggcacgaaaaggcctctcgtacggaccaaaggtgcgtcttccgtcgaagaataacgcgcggaatcgccaccaacgtttattcgaggaaaacgtcggaaaaaccaaaatggaaaaggtcgaaggtttgcgtattttgaaaatgagggttccggagttgtttatgcacggggaaggggaggagcttgccacccagctcgcccaggcgagctggtggcttaagcctgaagtaacatgctcgcccaggatcacaagatggattgatgaaggggaagaaagaatcaaagctataggggagaatagtttgcagtatgttataattgatatgactgagaagatggtgcttgacaaacctttggacaacttaagtgttgaaggtagtattgctcctggtcttactaggtcgcagtga

SEQ ID NO: 5305 - DNA, 288 bp, Glycine max
  Peptide Sequence Number=SeqID_96990
atggcaaaaatacccctggtgttttttttcattataaaagccttttttttcctgcgcttcacacaactgtcatttttgttcgctgtttttgtggttttcgtgcggcattgtctctggtttgttggtgaaggtgcgttgtggtggtcggcggtggcaaacgagatggacgaagatgagtggatgtatgaaataatgtctgaacaagcggatatggattatgaaaatgaagaagcatgtggtgtgaatgaaccacatgttgattgcttggatgcgttcaatatttctcag

SEQ ID NO: 5306 - DNA, 813 bp, Glycine max
  Peptide Sequence Number=SeqID_96991
atgctggatgatgtggcgtcactgcttcatcttccgatcataggcgccttccataacttcgagcctctgcatgtggacgaggcagtgattatgttggtggagttgctagaggtctcgcatgaagaggctagagctgagactgcacagtgtcatggggcatacacacgcctatcgtggctatgggatatttatcagaggagatgcgaggcccgacattggattgttgcaactcgtgcgtatctcctacatttggttggttgcactcttttcgctaataagagtgcaacacagacacatatagatgcactgacgatccctgacgtatgctggatgccttatggtgaccaccgaggagttagggcgtttgacctcatttcatgctttcagggtgagtttaaatggggtcccgttgtggatatggacgacaggtggatgcattactcggaccatctagtagctgcaggacaaatttgtcttgtgcctggccagtgtgcaacaaattacattgactggttcttcgggatatctcatccgttcatcacacccacacaggcaactgatcctcctagacatccacttgtcccacagcatgagaaatacatggagccagatatcccggaggttccaatggcaccagaagatgcttgcgaagcggtcacagaaaggttggagcgtgtactcaacctaaagatggtcactgcaggcacaaagttacatgacatcatggaagactgtttgaggatcactaggggtgtcacctcatatggaaatgtgtatgttagggcacaacgaagacaacgcatggatcagtga

SEQ ID NO: 5307 - DNA, 1443 bp, Glycine max
  Peptide Sequence Number=SeqID_96992
atggaaagtgttgttattgacgctatagaggaggatgctatcatttgggatgagaagtcctcaggagagtatacaaccaaatctgcctataagtgcctcattgacactcctccagaattattcattcatgatgttgatgagtggatttttcagaatcttagagctcctcaagaaacaactcatcacaatatctcaagtcttcctagtcgtatggtgtgttggtctcctccggttgattttgattacaaactcaacactgatagaagctccttaggcaatccgagtcaggctggaattgacagattgattcgtgataatttggggttgcagattgcgtgggataagggtgttacaagcatcatttgtgaatatgactccaagcttgttgtggacatgatttcccttggaggtaaagcttgtgcgaatcttcttgctaggaatggatcttcttcttttgataagttagttattttcgataaatgtccctttttcatcaatgtggctttgttgtcagatgtttgtgtcactcttcatgatggctacacccccttgtttggggaccataatttggccatccatagagatggcaaatcagttcacctttcacttgatgaaagaacaggttctggatttgtgtctcatgacctttaccttcacgggtatttcagtgcctcgatcaagctgcctgctgattacactgctggagttgtggttgcattttatatgtcaaatggtgaaatgttccagaacaaccatgatgagatagactttgagtttttggggaacattagaggcaaagactggaggattcagacaaatgtttatggcaatggaagcaccagcattggtagagaggaaagatatggcttatggtttgatcctgctgaggatttccatcagtacagtattctttggacagattctaagatcatattttatgtggataatgttcctattagggaagttaaaagaacagaatctatgggaggagatttcccctcaaagccaatgaccatgtatgctaccatatgggatgcatctgattgggcaaccaatggaggcaaatacagggtaaattacaagtatgcaccctatgttgctgagttctctgacctgatcctgcatggttgtgcagttgatcccatagagcatgtggccaagtgtgaaagtgcccaaggttctgagaaagttccctctggtgtcaccccagtacaaataaccaaaatgagaaacttcaggttgaagcacatggcttactcttactgctatgacacagttagatacaaagtccctccaccagagtgtgtcatcaaccaccaagaagctgaaaggcttagaaaatttgatcccgtcactttcggcaacggccagcgccaccgtgggaaacgacaccaccatagtagtaaaggaagccaggaagagattactgcttcttcattttaa

SEQ ID NO: 5308 - DNA, 390 bp, Glycine max
  Peptide Sequence Number=SeqID_96993
atgaataaaaaaccttatagaagaaccccaaactccaatgttcctccaccacagcctagaccacaactccaaaccccaacactcctctgccgtggcctagaccataaccccaaaccccaacgctccttttgccacaccccaaaccccaatgtcatcaatgaccacacccactctggccccaacaaaattcatacaaagcctcaaggaaaatgcaagaaaggggcgtatattaaaagctttttgtcaacaggctatcatgtagtttcaatttcaacacttatacgcatacaggcattgttagggtcccaatatctgaagttcacaagtattgtacatttaggtgctcggtcaactgtcatggttttctccttgaaaaaggcaccttcttga

SEQ ID NO: 5309 - DNA, 478 bp, Glycine max
  Peptide Sequence Number=SeqID_96994
tgtttgccaggaaacacagcagctagaggctgaggaactagcgacggaactcggtcgaagtgagatcagacaatttggtgatgttgtggacgacggacgggtcgagcttggcatgcagcctcgctctatggaggttggacttgaagacgccgaagcgacggttgtgctcctccttggtcacatacttcttcccgaacttcgccttgaagctcgtgaagtggtgctcctcgttaagaaggtggtcctcatcctccttctctgttgcttcactgacggcatccggcaccacctgacgaatcaggatgtcatcagtggtgctggtcacgacggcaaagaggaggaggaggagggccaagaggaaggagtagcgagccataagggaagtcaaaagggggaatggattggagagggagaggaggcaggacttggccatggtgaggaaagtgatagacatttacgaacaggagtgagtgagtga

SEQ ID NO: 5310 - DNA, 711 bp, Glycine max
  Peptide Sequence Number=SeqID_96995
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccaggcggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 5311 - DNA, 264 bp, Glycine max
  Peptide Sequence Number=SeqID_96996
atgaaacaaaaaggaaaaagaaagaaagaccgcaaaggtcgacatgttatagttaagaagtataaatcattcgtaaagagcaaacgtatcttctggaaacaagggactgatgctaagagtttattttccggaatgaaccgagataaggatggggaatcctcattctttcccccgaagcaaaggacagcggaatctcctcaagggagagcgaatagaatgctaaaacccgatttcccaaagaaagggatggggaaggagaagtga

SEQ ID NO: 5312 - DNA, 279 bp, Glycine max
  Peptide Sequence Number=SeqID_96997
atggaggagtttgatgcgcaggtggcctggccaggagcccagccttctccttctggagggggtggggcctccacaacccaggagcttgctcctaaggagccagcagcagtgcaagggatttccatagatcagatacctgagccatctcttgcacttgttcctgaggagacccagccatctacaccagtcacggagccagagcagcctatccaggattcatcagcagctccagcattggatcttaatgaagatcagccacaggatgagcaggacatttaa

SEQ ID NO: 5313 - DNA, 339 bp, Glycine max
  Peptide Sequence Number=SeqID_96998
atgtgggacaatgtgggtgttgagggagcggttttcgaaagccttttttttagtactccttcctctccaaattcatcaaagcctcctccgagtcgaagaagcaattgtagctccaatccatccacgacaatctcaagaaaaagccattttttgagtctagggtttcgagcagggatagggacagcgatagaagtagaagatgaagcaaaaccagagaaaaacttaggaaaaggagcagaagcggagatagatacaaggaaacgtgatggcgaagcaggagtagagaaagacaaaaggatagtgaaagacggagacggaaaattgcgttattttccttaa

SEQ ID NO: 5314 - DNA, 297 bp, Glycine max
  Peptide Sequence Number=SeqID_96999
cgagcattcgctaagcacgacactcctgggctaagcgcgaggaagaatccagaagaagatgagctgtacaagttcactaagcgcaccacttcagttcatccgctaagcgagaaaggcgcactaagccaaaaatcactaacgtgcgctaagcggtccatacggagtttggattgggattcagagctttgcatgtctagggtttctagagagagaaaggtccaagttctagagagttttgagagattttgccgtgtgaagatcagcagagaccagagcttgaagcaggagccggtttga

SEQ ID NO: 5315 - DNA, 969 bp, Glycine max
  Peptide Sequence Number=SeqID_97000
atggagcagctccagttgcaagcttttcgcaaagcttacggtaaaatctgggacctagccatggtagaagtctccacagaggccatttcctccctcgcccagtattatgatcagccgttgaggtgcttcacctttggggacttcgagctatcacccatggtcgaagaatttgaagagatcctaggatgtcctctagggggaaggagaccatacctcttctcagggttctatccctcattagctagaatttccaagatagtccaaatctcggcgcaggaattagaccacaggaagcaagtcaaaaatggggtggttggaataccgagaaaatatttggaggcaaaagcaagaatcttgacaagtaaaggtgaatgggcctcgttcatagacgttctcgcactgttgatcttcggaggagtcctctttccgaaatgtggatggccgacctatatgataccttcgaccgaagatgtgagaagagcagtacgaggattgtttgttgtactccagctctttatgtatggttggtttcacacctttttcgccaagagcaaagaaggagcatctgtcaactggttccctcgatggaaggaaggaagaatcggagttcttatttcgtgcgggggatttctgaatgttcccttgatggggatgaggggttgcatcacttacaatcccgttcttgctataaggcaacttggctaccctatgagaagggcaccactagaggaagagctcgcacctgtcatttcacgagggtttagtgagaccaacatggagacgcttcggaaggtccacaaagcatgggaagtggtacaaaagaaggacaaagagctcagaggcagtaacaatgggcctattggtggctaccgtgagtgtttaaaagcccacgtgcaaggtttggattggctcccaagtctgagaaccgctaaaagggaggaggttgaggcaccgaaggaagacgaagag

SEQ ID NO: 5316 - DNA, 477 bp, Glycine max
  Peptide Sequence Number=SeqID_97001
atgtcgatatattacgggactcaatcacacacccgagataaaagttattgtcttttgaatttgctcagagcatcagcattcaatttcgagcgtttcgatatattacgggactcaatcggacatacttgtaaaacgttattgtcgtttgaatttgctcagagcttcgatattcaatttcgagcgtctcgatatattacgggactcaatccgacatccgagttaaaaagcatcaacattcaatttcgtgctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaaggtattagcacctcacacgtccgtcccaagggacgacagcctttaa

SEQ ID NO: 5317 - DNA, 348 bp, Glycine max
  Peptide Sequence Number=SeqID_97002
atggatcacttagcgcgcataagtggcttttggcttagcgctagtcttctcgctcagcatggaggattgcaggcgaaagaccaaggtcaaggcatcttaggggcgacaccttctaaacccaaagatgataaggggaagacaatagtaaagcaaccccttaaggctagtatgcaagagaagactagctccatgaagtgctttaaatgtcttggaagaggacacgttacttctcaatgccctaagaaaaccatgattatgaggggccaagacatttatagtagccaagatgaggctactacttcaccttcctctagtgaccgtgaagaagccccagcgggacgactatag

SEQ ID NO: 5318 - DNA, 557 bp, Glycine max
  Peptide Sequence Number=SeqID_97003
atggcttccatgatggatgccatgttaggaatgagacaactcatggagaataacgtggccaccgctgtcgctgttagttcggctgccgaagcagacccaactctcccagctaccacgcatcatcctctcccaaacgtggtaggacgagaaaagagcacattggggcacatcagcaacccccatttgggatacaaccgggtggcttacccttatggattaccacctaattacacgccaccagtcatgcatgatgacgcgggtcatgtcccttcccccgtccttgaaggggagcctcctcgacagtcggacgaggttcacgaagagcatagagagtatgctcatggagacatcgatttttaccccctaatccccgtcgaggggccggcgcccaacacattgcctcaatccaacctcccagcacaaccaatattcttgtctacagaaggaccacccccggaagtggaagaaagaaggaaactcgatctcatcgaagagagattgagagctattgaaggctttggcgactatccgttcacggacttggcagatctttgctt

SEQ ID NO: 5319 - DNA, 297 bp, Glycine max
  Peptide Sequence Number=SeqID_97004
atgatgattggatgtggaattacttggatgttgtggaagcttgggaggattgatggggacccagtgttgaaagaaacgaggataagggctacgtgggagtacgtgagctcagttgaaagtgggcaacaggggatggtgggtttatatgtgatttgtggatgtggagaattgttttgcaccatcgcccgaccgccacctagtaccacatgtgatggagtggtacctggagatatgtcgcgggggtcaggagaccttggggacgtcaggtggggtgctattgcccaaaaccaagcttga

SEQ ID NO: 5320 - DNA, 210 bp, Glycine max
  Peptide Sequence Number=SeqID_97005
atggtgaaatatagagcaaataataggctgagcaccctagtattcttagagggagaaaaagtaatcgcacaaagacagtacaaatggaggcttcaatctcttctcattctctctaacgtttgggaaccctatcagagcaaccagaggaagaaattgaggaatcctaggaacttgctaaagatgccgctatcgctttcagtagacacgtga

SEQ ID NO: 5321 - DNA, 267 bp, Glycine max
  Peptide Sequence Number=SeqID_97006
atgttaacgtcatcacgtcggctcggcggctcctcaccagaatctcacttctggcatccttctgctgccattctactctcacgaacaatgttcgtgatcatcacaggactgcacagaatgatgcatgcacctgactcaactctcagatgcaatgtggtacgtaccaacaacaaccaaatctcaggaaatagcctaagcgtgttcacacgacactctcacttaggaaaccatgcagagttcgtcgagaccactcgattgtgcacgtaa

SEQ ID NO: 5322 - DNA, 516 bp, Glycine max
  Peptide Sequence Number=SeqID_97007
atgggcccagtttgccagactcgcagagacccttcttgggaggatatgtgcaaaaagaagctcctggctgagaagaggaagaagaagatggaggaagctgcacagttaggaagcgttgatggcatcatcaaccctccatccccggtcagacgccacatgaagtggaagatggcccgcacgaagaaaaaaggggagatgacgactaaggccgcaaaggaaatcgctgagaagatcgattcctttgaggagcatgcgacacagggatccttcgttccccatggacgtcaggatgttctcaccgctactattggacgtctagagcaccctgcacgtgtccgtgctgctggagccggtgtcaccattaagcaatactttggatcggctccacggacatcccgcagctcttcctccctgcctcctgaagaattgcagcagctgacccagcaaatcagggaccaactagaggagtccatcacagaaaaagtgacgcggcagctcatggcattcttcagctag

SEQ ID NO: 5323 - DNA, 177 bp, Glycine max
  Peptide Sequence Number=SeqID_97008
atggtagtaggaaatgcacctatagaaaaacctagggaacaatgggatgaagaggaaagaagaagggtacaatataacttaaaggctaaaaatataattacctctgcattaggagtgaatgaatactttagagtctcaaattctaagaatacaaaagaaatgtgggatacattacaa

SEQ ID NO: 5324 - DNA, 349 bp, Glycine max
  Peptide Sequence Number=SeqID_97009
gccacaacaacaagggccgagtctctatgacagaacaacgaagctgaaagagactcttgctctgttcatgcaagtatccatgtccaatcaaaagagcaccgagccagccatcaagaatctagaagtccaggtgggacaattggcaaaacaactggcagaccgaccgtcaagcagctttggagccaacacagagaagaatcctaaggaggagtgcaaggctgttatgactagaagcaaaatggtgagcatgaatgaaggagaggagaggataggtgcagaaaaacaacagctggtgactgagccaacaattgacccagtggtggaacctttgagtgagactaaggaataa

SEQ ID NO: 5325 - DNA, 495 bp, Glycine max
  Peptide Sequence Number=SeqID_97010
atgctgacgcggatgagtattcacgtggctcagctaatcgctgatgccatctatatatttgcaggactctgccagtcgttcggagtccctgtcgcacctagcaaggtgattcggccgcccatcacccgagcttttattgagaagtattgcacgcagagacaggtccagggggatgctccgcaggccgcagacgcgccgccacctcatcaggccggtccagccggattgtttgatacggagcagtatttgcggcatttggttcgccagcaggcggccaaccaccgggcacatagccagggttttacttcttttccgtgccctactccggaccagttcagggcagaggtcgcatggcctggagattggcctgaggcccgggcaggagaggcaccaacagaggcaccagcagaggctcccgacgaggcagatgaggcccgcgaggacgaggagatgaccgatttacttgatttcttaggaggaagcggggccacatga

SEQ ID NO: 5326 - DNA, 1308 bp, Glycine max
  Peptide Sequence Number=SeqID_97011
atggaaggggcgtggctgggcagtgacctggtcgatcagggtaaagaccgtcttaaccgtttaggttatttcgaaaccgtcgataccgatacccagcgcgtgccgggtagcccggatcaggtcgatgtcgtttacaaggtgaaagagcgtaacaccggtagcctgaacttcggtatcggttacggtaccgaaagcggcgtcagcttccaggcaggcgttcagcaggataactggttaggcaccggctactctgttggcattaacgggaccaagaacgattaccagacctatgctgaactgtcggtcaccaacccgtatttcaccgtagatggcgtgagcctcggcggccgcatcttctataacgacttcgatgcgaacgacgcggatctgtctgactataccaacaaaagctatggtacagacgtaactctcggcttcccgatcaacgaatacaactcgctgcgcgcaggtttaggttacgttcataactccctgtccaatatgcagccgcaggtggcgatgtggcgttacctgaattcgatggggcagtacccggataccaccaacgacaataactcgtttagcgccgacgacttcaccttcaactatggttggacgtacaaccgcctcgaccgcggctacttcccgactgaaggttcgcgtgtcaacctgaacggtaaagtcactattccgggctctgataacgaatactacaaagtgacgctggatactgcgacctatgtaccgatcgatgacgatcatcagtgggtcgtgcttggtcgtacgcgcttcggttacggtgatggactcggcggcaaagagatgccgttctatgagaacttctatgccggtggttcaagtaccgttcgcggcttccagtcgaatacgattggtccgaaagcggtttatctcccttcaactaccagtcgtgatgactatgatacggaatgtgcgagcactgaaagcgcgccttgtaaatcggacgatgcggtgggcggtaacgccatggcggtcgccagccttgagctgattaccccaacgccgtttatcagcgataaatacgctaactcggtgcgtacttccgtgtttatggatatggggaccgtctgggatactaactgggattccacgaagtacggtggctaccctgattacagcgatccaagcaacattcgtatgtctgcgggtatcgcggtacagtggatgtcgccgttggggccgttggtcttctcctacgcccaaccgtttaaaaagtacgatggagacaaagccgagcagttccagtttaacattggtaaaacctggtaa

SEQ ID NO: 5327 - DNA, 87 bp, Glycine max
  Peptide Sequence Number=SeqID_97012
atgaatacgaggcatagtgcgttcaagcttgcaaaatcacacctatttggtactcgaatgggcaccggagttgaagtttggaagtaa

SEQ ID NO: 5328 - DNA, 423 bp, Glycine max
  Peptide Sequence Number=SeqID_97013
atgcataagaagaagaaaaagaagaagcaggaagttgagtccttgcacaacatagatagcaccattaaatttggagtgagggaagctgatggaaagcatgttagttctaggaaccctagaattgagaaaggttttgatgcaagcaatgtatggaatgagttggaagcggttgatgcctctgtgaagatattatatcctactatccaggctggtgtagataccgttgagatagaatggcttctgaagactgttgaggaattatgtgcgggtgccgagaagctttcacaaggaaatgatcttcttgcaaagggagtagatgggttttttgaagccgttatgactagtcgtgatactttgctcagctctgtgaggtttgataaaactgtaaatgatcgttccccaggccgtaacagagacatgtag

SEQ ID NO: 5329 - DNA, 459 bp, Glycine max
  Peptide Sequence Number=SeqID_97014
atggtagaggttcccttgagtgcattcacaaagctaaatccatggactttcagcaactcagacattcatgaggatcctcagacctttgtagatgagggatggtataagaccatgcgccttgtgggaccaacaagatcacctcttttagcatggtatgagtttgtcaagttgttcctagcttactttttgcctcaaagtgttagagacagcagagcacgagagtttgagacacttgtgcagacagatcagatgtcaatggagtataatatccaattcatggagattgcagcacatggtgacatgccttatgatcaagccctgaatagggctttaactattgaggccatcgttgtggaggttttagagatgatactaatctacatcgacgagaccaacatggaggacgactaccataggtcactcaagctagccaggctgctagtacaacccatagtcggg

SEQ ID NO: 5330 - DNA, 531 bp, Glycine max
  Peptide Sequence Number=SeqID_97015
atgggtgaccaagaggagacacaggaacagatgaaagccgacatgtcggctttgaaagagcaaatggcttccatgatggaggccatgttagggatgagacaactcatggagaataacatggccaccactgccgctgttagttcagctgccgaagcagacccaactctcccagctaccgcacaccatcctctcccaaatgcgataggacgagaagggagtaaactagggcatatcagcaacccccatttgggatacaaccaggtggcttacccttatggactaccacctaattacatgccaccagtcatgcatgatgacgcaggtcatgtccctcccctcgtccttgaaggggagcctcctcgacagtcagacgaggttcacgaggatcatagagagtatgcccaagtggacgtcgatttctacccctcggttcccgtcgagggtccagctcccaacgtactgccccaacccaacctcccagcacaaccgatattcttgtccacagagggaccaccctcgacggcgaaataa

SEQ ID NO: 5331 - DNA, 471 bp, Glycine max
  Peptide Sequence Number=SeqID_97016
atggtttaccatggccatggtgaaatttaccatgaccattgtcggatggttggcactgttatagagggcagttatgcttttatcatggttgtgctacttaccatgttcgtgattgattcaaggagttttgatgataacaaagatgatgacaaaaagctcaaaagtcaagatcacttcatgataacaaagatgatgacattcaagaatgagttcaagattgagtcaagaacacttcaaggatcaagaggaaatttgattcaaggatcaagaggaaatttgatttcaagaatcaagaatcaaaacaagagagggtacatctcttgtggatcagttctagtggagggtacatccactaggttgttcaaagagaacaagggagggtacatccctcgtggatctttgcttgtaaaggattttacaaggttgaaaagaaatctcaaggaccacaggtcgcttggggactggatgtag

SEQ ID NO: 5332 - DNA, 132 bp, Glycine max
  Peptide Sequence Number=SeqID_97017
atggagaacaagcaatttttgattgaacaaacttggagatcaactcaggagcacagtaatggcataaacctggaaatcctaatgagtcattggagacatctaacaacaaccttcaaattgccccatgaatag

SEQ ID NO: 5333 - DNA, 165 bp, Glycine max
  Peptide Sequence Number=SeqID_97018
atggggaagaagatgaagggtttgagagatgagggtgggttattgaaaagaagggaattaggagaaaggaggggggtcttgggtagtttttccactatagcctctgggatcatgaacataatttcgaagcatcaacacatggaaaactgggtgaacactcgatag

SEQ ID NO: 5334 - DNA, 381 bp, Glycine max
  Peptide Sequence Number=SeqID_97019
atggcttgcacccacattccagtgggagcaaagatctttcaaaattgccccgtgtgtggcacctctggtcaatgtcaggacttacacgtgattctcctcaaatttcagctagcccgcatcaatttagaccttgcaccttacgcttcagggccctacaatgctcaatggaattccccggggcttctccatgacaggcacatgttgcgttcgagtcgtattctcggagaaatggaggttgatgaaccttgtgatgcaagctccattggagcttgtaggcctaggatcttcttcatcaatggattcctttgcttcttggaagataaatggcagcggaatggagaaggaagagagagaggagatgccacttcaaggagaagatga

SEQ ID NO: 5335 - DNA, 159 bp, Glycine max
  Peptide Sequence Number=SeqID_97020
atggtgatgtcggtaacgatggccgcggcaccggcgcttgctaatcccgggaacgcgccagccaaagcgataacggcggcggcaagggccagcgtaagaattacggcaaaccggatcacgtcgatagtgatatcagctataccaccgctcgcgcgctag

SEQ ID NO: 5336 - DNA, 383 bp, Glycine max
  Peptide Sequence Number=SeqID_97021
gttgcactctttttgctaacaagagtgcaaccaatgttcatgttgtgtttttggaggcccttcgtgacctcagtcagaccgagaggtacgcctggggagtagctgcgctggtccatatgtacgaccacctcaacaatgcttctatcaacaccagtcgacagcttggcggttacatcatgctgctgcagtgttggatatatgaggtctttccctcggtcgtggagtccactgctgatccagactatgacgaggattcaccgcacgcctgtaggtggattgctacgaagacgaccgtgaagagcatacttacaccggcgtacagggagcgcctgtatcgactccggattccgaatgtttgttggatcccatataaggagcactga

SEQ ID NO: 5337 - DNA, 306 bp, Glycine max
  Peptide Sequence Number=SeqID_97022
atggtcattttgcgccctttgtcattcaggagcagcgagtcgagtgataaacgcgcaaagacaaattatggtcattctggatcagcgagtcgagtgataaacgcgcagagacaaattatggtcattttgcgccctttgtcattcaggagcagtgagtcgagtggtgggcggagacaaattatggtcattccacacaccttttcatcatccaaaggcgattgtgtccaatggcacgcagagacaaattatggttccgctggcggggagattgaccggccaaatggtgtttcgctcgaacgaaattag

SEQ ID NO: 5338 - DNA, 818 bp, Glycine max
  Peptide Sequence Number=SeqID_97023
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaccgattgataatgatatcggggccagcgaagctgatcaggatgatccgaatgcttatattgctcgctggcaagcggcaggcttaaatcaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 5339 - DNA, 273 bp, Glycine max
  Peptide Sequence Number=SeqID_97024
atggtggaaagttggacctcttacgtgccgatcaacgtctcatttcgccaaaagttggcccagggcttcccggtatcaacaggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 5340 - DNA, 188 bp, Glycine max
  Peptide Sequence Number=SeqID_97025
atggacgctcatccgtgtcaggatgacatacaccagctgacacttcggcagagggaggtcagagttatgatcgctgggcaggacgttgctgagcaacaatgtcatccacatctgggtcaaggtggtcatgctggtgcgcatgatccgcacccgcctcccggcagcagtccgggcaaaatctggaccgg

SEQ ID NO: 5341 - DNA, 398 bp, Glycine max
  Peptide Sequence Number=SeqID_97026
gactacacgtcctcgccttgagaggactacatgtcctcgccttgagaggactacatgtcctcgccatcagagaactacatgtcctcgccatgagaggactacacgtcctcgccttgagaggactgggactacacgtcctcgccttgaaggactacgcgtcctcaccatcagagggctgcacgccctcacctccagaggactatacgtcctcgccttgagagggctacacgccctcaccttggggctcgccctgagaggactacacgtcctcgccatcagagggctgcacgccctcaccttcagaggactacacgtcctcgccttcagaggactgcatgtcctcaccttcagaaggctacacgccctcgcctttagagggctacgcgtcctcactttca

SEQ ID NO: 5342 - DNA, 969 bp, Glycine max
  Peptide Sequence Number=SeqID_97027
atgccgcaacgcgaattgtccgtgctggcctcggggtacaccttcctggagggactgcgctggcgcgacgggcgcctgtgggcatcggacttctatacaggcaaggtcatcgccgtcgacctggagggccgggtggaagtcatctgccgggtcctggagcagccgtccggcctggggtggctgccggacggacgcctgctgatttcctccatgaaggaccgcaagctgctgcggcgcgagcccgacggccggctggtcacgcattgcgacctgtccgccctgaccggcggaccggtcaacgacatggtggtcgacgagctgggccgtgcctacgtgggcaatttcggtttcgacctgatggccggcgagcctttcgccaccaccaccctggtgcgggtggatccggacggggtggcccaggtggtggcggacggattgtggtttcccaacggttccttcatcacccccgacggcaagaccctgatcgtcaatgagaccttcggcaaccggatctcggaattcgacatcctggcggacggggcgctggggccgcggcgcgactgggcccacttcggcgccctgccggagtcggacgacctgtcggtgctgatcgaagcgtcggccatcgggccggacggcggcgcgctggacgccgagggcgcgctgtgggtggccgacgcgatcggcaagcgcatcgtgcggctggcgcgcggcggcgagattctggaacaaatcgataccggcgaactgggcatctttgcgaccgccctgggcgggccggacggcaagacgctgttcatggcggcggcgcccgatttcatcgaggccaaaccgccgcgcccggcccgaagggcggatcctggtgacgcgggtggacgtgccgcgcgccggccgcccctagcggcgggcctgcttatgggggaggcgcacggccgcggctcgggcggccggtttagtcctggcggatag

SEQ ID NO: 5343 - DNA, 72 bp, Glycine max
  Peptide Sequence Number=SeqID_97028
atgttcaatcgagacgaagagcccaacttctcgttctactggcagtctgaccccaccaggtattatgagtga

SEQ ID NO: 5344 - DNA, 339 bp, Glycine max
  Peptide Sequence Number=SeqID_97029
atgagaaaaactctagatgaggttcactgttatcaagcaagtcggagacccagcatgaccacagattcacctccactccttatgttcccatggacccggatcaaaaatggcctaactctcttaaacaagtccccagtggagttgccaactgtcgcaacctatcctttggcgggagggcgacgcgagcctcactggtgcgtcttccaagggaggaaaatgcacaaaatcgccaccaacgtttatttgagggaaaacgtcaaaaaaaccggaaaggtgtggtctacgaactttaatcgtgaaaggttcggtagttgtttttacgcacggggaaggtattag

SEQ ID NO: 5345 - DNA, 198 bp, Glycine max
  Peptide Sequence Number=SeqID_97030
atgctccaaccatatgggatcagcataggcttaaaggaacactcaaacccggtgactcccaaggcctacactctgaagagtccgtcagggtctctccctcctgattcaggacctcacactcgtgtcttagacatgtacaacatattgcgctacaatttaggaacctacaccatctctttaacactagttcctaaatag

SEQ ID NO: 5346 - DNA, 150 bp, Glycine max
  Peptide Sequence Number=SeqID_97031
atgcctgcagataatttaattttcgtggaacctaatgatgatgcacaatctaaggaagaccttgatgatgatgatggagatggagatggtgatgaaagtgatgatattcatggagatgatccaattagaggattggacatgcttctttga

SEQ ID NO: 5347 - DNA, 311 bp, Glycine max
  Peptide Sequence Number=SeqID_97032
atggaggtgttggtggctagctttgacatgaagctttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 5348 - DNA, 398 bp, Glycine max
  Peptide Sequence Number=SeqID_97033
gtatgtcacctaccaggcaccctctagacctagataagtctaacagggccctggggtttccagcattgatcatgggtctctgccagtcattcggggttcccatcacacctagtaaatattgcacgcctagtcaggcacagggtgatgcaccacaggccgcaggcgcgccgccaccacctcatcaggctgacccaactgggtcatttgacacggaacggtatttacagcacttggttcgccagcaggcagccaaccacagggggcaggtgcagatacatatgtgtctctaccagcccagcatcagtcaacagagccagggtttcgctccttttgcgtgccctactccagatcagttcagggctgaggttgcatggcccggatattggcctgaggcctag

SEQ ID NO: 5349 - DNA, 198 bp, Glycine max
  Peptide Sequence Number=SeqID_97034
atgccgattagccgcaatgttcataaagaagatgaacattcaacaacatggatgaacttgcttagtcttttcgctaagccaatctgtcggcttagcgagccatccgctgagcgcaccactcttgagactaagcgcaaggaagaatctggaagaaggatgagctggacacatgcgctaagtgagagctcatcttgctag

SEQ ID NO: 5350 - DNA, 165 bp, Glycine max
  Peptide Sequence Number=SeqID_97035
atggaaggaggagcttcaccaccagagagtgccttggataagaagctaagaaaggaagctccaatggaggaaaagaatgagatagagctatggttcaacccagtaatccaagatcaagattctccactaagtgtgcttaggtatcatgagtcatgtaaagcatga

SEQ ID NO: 5351 - DNA, 336 bp, Glycine max
  Peptide Sequence Number=SeqID_97036
atggcggacaaaacttgtggttacgtgagcatgaactactaccaatatatagatgttgtttacacaaatgagcatatcttaaaagtttactccgcacaatggtggcctcttaggaatgaagtggcaattcctccttctgatgacgcatggacacttatccctgacccaactacaattcgtgcgaaaggtcgaccaaaatcaacaaggataaggaatgagatggattggctcgaaccatctgagcaccgacaaaaatgtagtagatgtggagcagaagggcacaataggcgtcgatgtccaatgcaatctgaccatgggagttgttcatttaattga

SEQ ID NO: 5352 - DNA, 153 bp, Glycine max
  Peptide Sequence Number=SeqID_97037
atggaggttatcgctgcaagggaggaagacctggagacgaaaaaaaagctgcaacgggaaaaagaactgcaatctgatttgcagatctcaagaggaaaaggaaactccactgcatgtagcgatacgggggaatatgatttcaaaattcaatga

SEQ ID NO: 5353 - DNA, 186 bp, Glycine max
  Peptide Sequence Number=SeqID_97038
atgatgaggagtattcagatgcaagaagtcatggaagaaggcgaagagattgtaggcctaggatcttcttcatcaatggattcctttgcttcttggaagatgaatggcagcggaatggagaaggaagagagagaggagacgccacttcaaggagaagatgagtctagaagaagctcaccgccatag

SEQ ID NO: 5354 - DNA, 186 bp, Glycine max
  Peptide Sequence Number=SeqID_97039
atggttatttatagaaaaagccatttggggcaggggcagcttgcccaggcgagctggttgcttcatcctgaaggtatcagctcgcccaggcgagctggttacttaaggctgaaggaactgacaaacaacatcaaaaccctatgtgaccccttggctttgcattgtaaccagtgccaaacaccgtaa

SEQ ID NO: 5355 - DNA, 534 bp, Glycine max
  Peptide Sequence Number=SeqID_97040
atgcatgatgcaatcaagaaacaagccaaagtgagtttgctctgtgtccccaattcaagaaccaaatggaaaggatccaaaagtccacttctagtgacaactcccaaggtgacaatgcatcaccaaaagaggaaaacgctagatgaggcttcactattatcaagcgagtcggagacccagcatgaccatagatcaaccttcactccctatggctcacatagacccgggtatcagctcgccaaggcgagctggttgcttaaggctgaaggtgcaaccagctcgtctaatgatcctttgcatgggattggaggtcttatgacaaggtccaagactaagaggataaagcaatcattgcaaggcctgattctaatgatcaaagagaaagaaaaccaatgtgaattaagggttgctcctaattgggtcactttcctgcaaattgatgaagattctttgaagccaacttcaagaatcactaagaagcatccatgggttgagttgatcaattttggtggactattaacattggttgattag

SEQ ID NO: 5356 - DNA, 395 bp, Glycine max
  Peptide Sequence Number=SeqID_97041
gtagccgtgtctccgacaaaaccacctcaaaagccgaatccagaggtcgatgatccgctttatctgatgagatcgaccatcccagagcttttcttgaggccttaccaggttatatgggatgccactgtgtttggggtctttaatttagacttcccgctctacataaagcacaaaaacctctcaatcgcacacggtggtcaatgtctcagcatatcagtgttacaactgcatctgactgaaacaagtatgcaagtggggaattctgatatttatggattcctcgagccacagcccattctgaggtctgggcaatcgcagtttgagactgaaagttacataaagagttggatgcaaagttcaaaacacgatgtctatcttggagcctacctgaatgg

SEQ ID NO: 5357 - DNA, 204 bp, Glycine max
  Peptide Sequence Number=SeqID_97042
atggccggtagcgggcaacagatgcactgccaccacctcttgagttcacctcagctcatccataaaaaggttagagcgttgcttacgacccatgaccgaccaataggcgaccaagtccaaagccaaaggacgcacctagttgctcatgatcctgggaatttaaataaaacaagcgcaagctcggaaggtagaaaaataccttag

SEQ ID NO: 5358 - DNA, 195 bp, Glycine max
  Peptide Sequence Number=SeqID_97043
atggtctctggtaatcgattaccaagggagtgtaatcgattaccaggcttgaaaacgaggcttagaaatggaactggaaaattatggaggcctctggtaattgattaccagtctgtgcaatcgattacacagaggaataggccactagtaatcgattaccaaatcgtgatggcggcgcagctaatccatgattga

SEQ ID NO: 5359 - DNA, 100 bp, Glycine max
  Peptide Sequence Number=SeqID_97044
gtgtccggccttatgcggagatccagaggaaagggtttctggcattatgcggagatccgaggaaaggtttccgaccttatgcggagatccagaggaaagg

SEQ ID NO: 5360 - DNA, 339 bp, Glycine max
  Peptide Sequence Number=SeqID_97045
atgaaaattcaacggttaacgaaaccgggatcatggttttaccaagacagttttgggtttctgcgggaaattaagaggctacaatgcgaaggtttttcctataagctcaaacatgattttgaaattcccaacagtgaaaatgctcagaattgggttgtgaaccttgtgtttcaatttcacgacgatccaacggtgaataagtctgagatcgtcatttttctgagacagggatgtctaactgattatccttcagaacgacagtttgatgaatgcctgaagaagttcaaaatggcttactcaccttggccaatgtttgttgactatgtcaaggaaacatag

SEQ ID NO: 5361 - DNA, 147 bp, Glycine max
  Peptide Sequence Number=SeqID_97046
atgcccggcttgagtaccgacatcatgcaacatagattacctctgaaccccgagtgttccctagtaaagcaaaagctgtggaggatgaagcctgagatgtccttgaaaataaaagaaaagcctaaattactaaacctcgatccctag

SEQ ID NO: 5362 - DNA, 696 bp, Glycine max
  Peptide Sequence Number=SeqID_97047
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccatatggacaacttcttcgccccgttttcaccatgggcaaatattatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 5363 - DNA, 171 bp, Glycine max
  Peptide Sequence Number=SeqID_97048
atggtttccgcggcttccatggcttccgtaaaatttccaaaaaccttggaaaatccaagccgaggtgcttccataacgcttccgagacattccgtaagcgattttgtggaaattcttcatcgttcttcaccgttcttcgttcgttcttcatcgttctttgatcttcaaccg

SEQ ID NO: 5364 - DNA, 748 bp, Glycine max
  Peptide Sequence Number=SeqID_97049
gctgctgtggtgtttcgccctgcgccttcctggagacgcagtacttcttgatgaaagctcgattagtagggggcctgatgcccttgctggaggtgacaggcccgtaaccagagctggaaaccctagggccctgttggactattccgggtccactgggtgtcttgtgggtgcgatccctgcaaacaatagatgggggagattggcattgcggtcgctgggcagaatattgctaagtagcaatgtcatctatatctatgtaagagtggtcatgttggtgcgcatgatccacactcgtctctttgcagcgcacgggaccttaaattctcttaaggtgtggatgtggagcacactgaaaatgaggacgcgtagccctctaaaggtgagggcgtgcagtcctctgagggtgaggacatgcagtcctctgaaggcgaggacgtgcagtcctctgaagccctacgaaggtgaggacgcgcagtcctctgaaggtgaggacgtgcagtcctctaaggtgaggacgcatagtcctctgaaggtgaggacgtgtagtcctctgatggtgaggacgtgtagtcctctaaaggtgagggcgtgtagccctacgaaggtgagggagtgcagccctctgaaggcgagggcatgtagccctctcaaggcgagggcgtgtagccctctcaaggcgaggacgtgtagtcctctggaggtgagggtgtgcagccctctgatggtgaggacgtatagtcctctgaag

SEQ ID NO: 5365 - DNA, 243 bp, Glycine max
  Peptide Sequence Number=SeqID_97050
atggcatcgagaaaaagggccagagcagatgacatcccttcatcatccactccagctcctccatcaacaacaacaggactggatgtccagagctcccaaaccttagtccctatgctacagagcttattccaaggacaggttattatcatgcacaacttgcgagaattggctcaccaaaggccaattatgactatggagcagttccttgagcaagtagcatggcctggagctctaccttcaatg

SEQ ID NO: 5366 - DNA, 399 bp, Glycine max
  Peptide Sequence Number=SeqID_97051
atggagaggagtataattgatgctgccagtggtggagctcttggtgatatgacccctgctgaggctaggaatttgattgagaagatggcttccaactcccaacaattcagtgtaagaaatgatgctattgtccttagaggagtccatgaggtggccacaaattcatcttcacctactgaaaataaaaagcttgaaggaaaacttgatgccttggtcaacctagtaacccaacttgccatgtatcagaaatctacacctgttgcaagagtctgtggtctatgttcttctgcagatcaccatacagacctttgcccttctgtgcagcaacctggagcaattgaacagcctgaagcttatgctacaaacatctacaatagatctcctcaacctcagcagtga

SEQ ID NO: 5367 - DNA, 348 bp, Glycine max
  misc_feature (19)..(19): n is a, c, g, or t
  misc_feature (69)..(69): n is a, c, g, or t
  Peptide Sequence Number=SeqID_97052
atgactggagatgcatcanattttacacatatctctccaaagaaaagcgggcatgtaacatatggtgancacaacaaaggtagaatccttggagtgggtaaaatagatatacttggacattatttattacacataaaagtgattcattccaagcatttagaaaacttgctaaagtcatacaaaacaagaaaaatctcaagattgcatccattagaagtgatcatgggggtgaatttgaaaataaagattttgaattattttgtgagtggaaatggtattgaacataattctttcggcaccaaaactcaacttgaaaatggagttgttgagaggaaagcacaaccgtag

SEQ ID NO: 5368 - DNA, 393 bp, Glycine max
  Peptide Sequence Number=SeqID_97053
atgggttttcacccaacaaaactcaatttcgtgcctagcgatgcggatgaggcgccactcgatgtttccatttgcctgcatgcctttggtattgtggggtgtggttcgtttagatcgaattcctgcagcccgggggatccactagttctagagcggccgccaccgcggtggagctccaattcgccctatagtgagtcgtattacaattcactggccgtcgggggtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcattaa

SEQ ID NO: 5369 - DNA, 1194 bp, Glycine max
  Peptide Sequence Number=SeqID_97054
gcgaaagtcttggcaagtcaaggcgaatgggccccgttcatggacatcctgacacttttgatcttcggggtggtcctctttccaaatgtggatgggttggtggaccgggcagcgattgatgcttttctcgcctttcatgaccgcaaggaaagcccggttgtcgctatcttatccgatctatatgacaccttcgaccgaagatgtgagaagaacagtgcaaggatcatttgttgtacaccagccctctacgtatggttggtttcacaccttttgcgccaagagggagcgtctgttaattggttcccccgatggaaagaaggaagaaccaggattcttatttcgtgcagaggatttccaaatgttcccttgatggggacaatgggttgcattaattacaatcccatcctcaccatgaaacaacttggctaccctatgagaggggcaccattagaggaaggcctcacacctattattgcacgaggtttcaatagcaccaatgcgggggtacttcagaaggttcataaggcatgggagttggtgcaaaagaaggacaaggaacttagaggcagtagcaacgggcccatcggcggctaccaaaggtggttgaaagcctacacacaaggtctcgattggctcccgaatttgagaaccactaaagggatggaggttgaaactccagaagaagacgaagagatacaagccctcaagatagaactcgagaaagcccaaacagtcaaaaaaaagttcaagttagtagctgttaggatccaaaaggagaacgctgaactaagagacgtcaatatagccaccaccaaggccttagaacaagagaccaagagggcccgggctctgtggggtagtaacagcgagcttaagctccgaagagaggaaagggaccaatcgcgagtcgacagtttgatcttgaaggatgaattgagggtttgcctaaggtctaagaggagcttgtctcagcggttatgcgagacagaaaccaacatgttagccatcatcagcaagtaccaagaagagttaaatctagccacgacccacgagcacaaagtagaggacgaatatgcccgagtgtacgcagaaaaggaggctagaggaagggtgattgactcgttacataaagaagcaacaatgtggatggaccgatttgctcttactttgaacgggagtcaagaacttccctga

SEQ ID NO: 5370 - DNA, 291 bp, Glycine max
  Peptide Sequence Number=SeqID_97055
atgaaaaagaggctaagttttgaattgcaaaatgtagcagttgggctaagctcaacaattgggctaagcgcatatccaccactaagtgcagcttcagtgcgcttagcacaaaggagaatctggcagagcatcaacatcaaagccgcggtacaactttctacagcttttgcacaccttttaggacagcgtgcagaatggccagggcacagaattccagagcagccacaggcctatttagggaaaagagccctagaagcagaaaagaggagcagcttgtgcattgaagcctag

SEQ ID NO: 5371 - DNA, 1072 bp, Glycine max
  Peptide Sequence Number=SeqID_97056
atgcagcagattgccgccaagctgcaccgcgctgtagtcgaggtcaaatccgtagccgtaatcgctaaagctgcggtcgcttttgtatttcagattcgagccgatgtagcgcaggaacatctcaccgccattacccgccggacgcgtctgctcgtgacgcagttcgccgagacgcttgtgcaggtcatcgataatcgcggcggtgtaataggcgaggccaaccgctgtcgctgtcctcgcacacgtagtagtttgccagccggtagtcccagtaattgttgccgctgccgctcagcaggcgctgcgccggatcgctgctgcccggcgcgaagctgtacagccgctgttctggccagcgttgccgcccacctgcgccagcgaaatgccttcgttgccctcaatgccgccgttgcggttgagatcggtgagcgccgcgctgcttgccgcatcaagcctgacgttaagcagcgtggtgccgctggcgttaccgctgacgttgatgtggtcggtgaactggttgctcagcgcgccgccgtcattcaggcgggtcaccagattcgcctgaccgcccatcgacgccagcgagccgttgatgtccagcgtattgcccggcgaaccgctgccattggtgagatccagcgtgccgctgttattcacctgcagcgaatccgctgtgccgcccgccagcgtgggatgcacgttgtcaccggcatacagcgtcgagcgcccatcaatgttgatgctgctgtgcgccagctgcagattgtcggtcagcgtccagcggctatccgcgaagttaatgatgctccagccgctgccgaggttaacgcctttgctcaggtcatccgcgctgaagctgccgccgcgcgccgtaatctggtcaaaggtcaggctgttaccggtgccgttgccgctggtgagatggtaagtagtgctgagatcgacgccgctgacgtcggcaaaattgttgttgtctgcgcccatggtcaggctgccgttgagcgtgccgccggtccagcggaacgtatcgctgccgccaccaggattaatgtcgcccagcacgtcaccctgg

SEQ ID NO: 5372 - DNA, 168 bp, Glycine max
  Peptide Sequence Number=SeqID_97057
atggcagcagaatggagatggaagaaagatgattggagacgccacttcaaggagaagatgagtcaagaagaaactcaccaccataggaagccatacccattaatccaacctcaagtccaagattctacactaagtgtgcttaggtgtcatgaggcatgtaaagcatga

SEQ ID NO: 5373 - DNA, 186 bp, Glycine max
  Peptide Sequence Number=SeqID_97058
atgccgaatcccttgaaacagccatgcaccatttttcttgttagcattgctgcgttttgtacaaaaggtgcagttctggtgtgttttctactgcaattggtgctctatgcttgtgatgcatgtcaagtaacccctaagccactaacgtttgacatcgaagctgtaacatggatcgaagttggatga

SEQ ID NO: 5374 - DNA, 367 bp, Glycine max
  Peptide Sequence Number=SeqID_97059
ctccagcaaccccagttcttttgggtccctccgcttagagctcaaagcctttcatgtctatgttgcagagcctacaccagggccaactcctgattatgtagaacttgcaggatgtggtccaatagtgaccagttatgagcgtggaggagtttctaaaaaagcgggtgaggcctccgtagcccaggaacctcagccagaccaagaggatgactcttctgaagccactcccactccacctaagccatttatttttgaggatgatccagtgaccgcagagggtactcagctggcatctccagcaagcactcatgcactggacttgaacaaggaggccatggatcatgacccaccaccaccacaggactag

SEQ ID NO: 5375 - DNA, 174 bp, Glycine max
  Peptide Sequence Number=SeqID_97060
atgaactcgctaagtcggcatgccgcgctaactaagccagctagtctcgctaagcgagccagtctcgctaagccaccatgcctctttagcttgaataagcctgggctaagcgagtcagtctcgttaagccgaaggcactttagtgttctgaaatcttgttcatgcgctaagtga

SEQ ID NO: 5376 - DNA, 312 bp, Glycine max
  Peptide Sequence Number=SeqID_97061
atggagacttgccccgcggtggaagagttacttcaacggctcatcgattgggggcagctcgaagtgtccgagggagatagggaagaaccacagatttgcatgcagtcggaagaaaggaaggttcccccaacccccaaagccctagtaatatgtttcactagaaatgtgactggctccaggtccaagtaccccccgacagtgcccaagccaacgccgttttcctatcaaagcaataaggtcgttccatggaagtatacccctcccgcttttggagaaagagctgcaaccgaggttgactccttgtcagccaag

SEQ ID NO: 5377 - DNA, 957 bp, Glycine max
  Peptide Sequence Number=SeqID_97062
atgcaatcccagtttcagtcacagatgcaatcacacatacttgcactgcctccggagcttaaggttggtccgtcagctgctcgtgtcaacacaaaagagagttgtgttgatccctcaaggaatgatccaaacatgagtgactcagacaaatgtaggttatacatagaagaaaatcctcctcgcctggttgccctaggaagagtttatgacggatccacaaccattcacaacatccctttgttgcattatcaagtgaaggtcggtgttgagaaggttaaagatacagatgctccctttcctgtacccactgatgaggttatatgggatgctaccgtgttcggggtgtttaatcaagactttccgttgtacataaagcacgaagatctatctcaaatagcacacggtggtcaatgtctcagcatctctattatacagttgtggattctgcatttgactgagacaagtatgcgagcggggaattctgatgtgtatggattcctcgagccacagtccatccaaagatctgggcaatcgcaatttgaatcaaaaaggtacatgaagaactggatgcagaattcaaaacgtgatgtctacctaggagcctacttgaatgggccagacaactaccttaaaggaataattaacaggttagtgttgtttttcaatatatttgcattagcattactcaacaacatcaatattttaatgttccttgtattcaacaatgctttgaaaggacttgatgatactccacaacctaaatccaaggttggtgctaggtggattgttgttaaatgtattagacaaaaaggaagtactagatgtggctattacgtgatgcactggatgtccactataatcttagaaagtttcaagaataattgggaaacgaccattggaagcatagagattgaaggcgtttcgcatccagtgggcacaatattatctcaaagttag

SEQ ID NO: 5378 - DNA, 252 bp, Glycine max
  Peptide Sequence Number=SeqID_97063
atgtcaggattcacaagcgattctcctcaaatttcagccagcccacatcaattagactttgcaccttacgcttcgaggtcatatagtgcccaatggaatgcctcgaggcttctccttgacaagcacacgttgcgttcgagttgtatcctcggaaaaatggagtttgaggaaccttggctgaggttatggctaccattgaactatcgagtaactatgggagcaagtcatcataggataccggaattagggtga

SEQ ID NO: 5379 - DNA, 342 bp, Glycine max
  Peptide Sequence Number=SeqID_97064
atgtcgtttaaagagtcgacaccgctttgcacaagaatcggttctttgtatggatggacagaagggctcagccagacccggttcaattcgttttttgcgggaataccaggttcaagttcaagggaagagaaaagaaagcgtaactctttgttgtcctcttactcttttagcctgccttgtggaggtctctcgggtgtctacggcggatccgatcagtctcgtgaagaagtcttttccgatcttccactaagaaagcaagtaggcgacgcgaatctatggtttctatgtttcaatcgggtaccaattgcttggatgcgtttgaaagcctcgagattactttaa

SEQ ID NO: 5380 - DNA, 156 bp, Glycine max
  Peptide Sequence Number=SeqID_97065
atggctgaagaagatgagatggccacaatgatggaggccatgatgagcatgaagaagataatggaagtcaatgcggctgcagttgccactatcagcactgtttctggggtggaccctgtagcgacctgcctcgtcactatgatatcaacactctaa

SEQ ID NO: 5381 - DNA, 291 bp, Glycine max
  Peptide Sequence Number=SeqID_97066
atgtctcttgccactctctttgggaaacttcgagaacatgaaatggaacttatgagactcaatcaacatgaagaaaatgacaaaaagaagaaaggaattgcactcaaagcctcatcttctattcatgaagaaagtgacaaagaggaattgaatgaacataacaatatagaagaagatgatgatttcagcctctttgaaatcgaagaagataaaacttcagtcgaaagaggaaaggagaagattcctcctcagttccaaaatgctatgaatgcgatcaacctgggcacctaa

SEQ ID NO: 5382 - DNA, 605 bp, Glycine max
  Peptide Sequence Number=SeqID_97067
atggttgatgttgccggccttggcgtgttcgtggctggggcgcaccacgtaattgacgcccacgctggcggcaaactcgcgaaactcctcgcgcgtgccgtcatcaagaatatagatgttgagtttatcctgcggccagtcgatacccagcgcagcatagatggtgggtttgaccacgctgagcggctcgttgtaggtcggcaccagaatatcgacgctgggccagctggcgatctccggcggcatggagaccggctggcggttgagcggccacagcgtctggaaatagcccagcaccagtaccgtccacgcgtaggtttccgcgccaatcaacagcaggccaaacgtcaggctgagcggatcgtcccagttaagggtttccgtatagcgccaccacagatagcggcaggagatggtgagcgacagcacgatcagcatgatggtcaccagccggcccggcatacggcgcaccagcatggccagcgcccacagcagcagcacaaacacaaactgcgtggtgatatcaaacggctgcgagatgcacagcagcgccagcaggctggcggcgatcgccactacgatgaacagcaactgacgcacgcgcc

SEQ ID NO: 5383 - DNA, 396 bp, Glycine max
  Peptide Sequence Number=SeqID_97068
atgggtgaagtagaggaggtgcaaaagcagatgaaggccgacatggaggccatgaaagagcaaatggccacaatgatggaggccatgatgagcctgaagaagataatggaagccaatgtggttgcagttgccgctaccagcgttgttgctaaggtgaacctgatgcccccatctggcctcaaccaaatgaatcatccaacctcagctatggtaggcaaagatttgggaaatgatgacaaaggtgatgaacaaaaagctcaaagatcaaagaacaactcaagtgaatcaaagaacatctcaagtgaatcaagaacaagtcaaaagttcaagaatcaagaagaattcaagattcatgatctcaagaatcaagattcaagactcaagattcaagaatga

SEQ ID NO: 5384 - DNA, 249 bp, Glycine max
  Peptide Sequence Number=SeqID_97069
atgactgtgagaatatttccattggatttaatgatgaaatatgcacaatttcagttgagcttagctcatcagtgggctaagcgtgcatccatcgctaagcgcagtttcagcatgcttagcgcgacagaagaatctggcagggcatcaatagcaaggtcgtgcgccaagcacgaggtcagtgtgctaagcgcaacagttgtcttcagccaggctcaacgcacgactcgcgctaaagctcaaacgtcatga

SEQ ID NO: 5385 - DNA, 474 bp, Glycine max
  Peptide Sequence Number=SeqID_97070
atgagtgatggattttgcggtactcatttgcagatcatggttaggaccagaggattaggtcgtgccttaggtcaggtcactggcagaggtgtgggcagaggagatcgtgatgattccgatgatgctccacagcgtcgacgacctactgcatccgcatggaggcagcgagttgctgtgactgcggatcacgtcgatgagccagtcatccctgcaccagatgttcaggatgacccgatggaggcaccagctactgtagaggacattcctacggacacaggcgcagaggctgctgaggatgagcatcagggatttccgggtggtccgagcgacccatccgtgttgaccctgtatgcggatcacgttgcttgcagcgtatggacgggagatgagcgtcctgaattgaagctatcctctcatgggaggaaggttcacagtttaggtaggcctgtccctgccattgagggactattggtg

SEQ ID NO: 5386 - DNA, 906 bp, Glycine max
  Peptide Sequence Number=SeqID_97071
atgagtggcgcgccagtgaataatctgtttctgtatcgctttcggcagttcaagagcgaaaaacagccgtttcggctcggacatgatagagactcgcctttcgtgtcctcattgccggttgccgcaattcttcccgaacttctttccgccctgcagcaggcgccgcaggtgttgcttaatgcgcctaccggcgcgggtaaatccacctggctgccgctacagatcctcgccgacggcaacattgatggccggattatactgctggagccacggcggctggcggcacgtaacgtcgctcagcgtctggcggagctactgggagaaaaaccgggagaaacgataggctaccggatgcgcgctgaaagctgcgtagggccaaatacccgcctggaagtggtcaccgaagggatcttaacccgcactttgcagcacgatccggaactttccggcgtggggctagtgatcctcgatgaatttcatgaacgtagcctgcaggccgatctggcgctggcgttgttgctggacgtccagcaggggctgcgtgacgatctcaagttgctaatcatgtcggcgacgttggataacgatcgtctgcagcgcctgttgccggaggcgccggtggtggtttccgaagggcgcgcgttcccggttgaacgtcgctttgcgccgctggcgagccatcagcgttttgccgaagcggtagcgatcgccgccgcggatttgctgcgtgaggagcagggctcaatgctgttattcctgcccggcgttggcgaaattcagcgcgtacaggaacaattgagcgagcgtgtagccagcgatgtgctgttatgcccgttatacggcgcgctgccgctgagcgaacagcgtaaagcgattctcccggcgcctgccgggatgcgcaaagtg

SEQ ID NO: 5387 - DNA, 1044 bp, Glycine max
  Peptide Sequence Number=SeqID_97072
aggactacacgtcctcgctttcggagggctacacggcctcgcctttagaggactatacgtccttgccatcagaagactacacgtcctcgccttcaaaggacatcacgtcctcaccttcagagggttacacaccctcatcttcagaggactatacatcctcccctttagtgggctacatgcccttgcctttagaggactacacgtcctcgccttcagaggactacacgtcctcaccgttggagggctacacgccctcgcctttagaggactacacgtcctcgccattagaggactgcacgtcctcgcctttgtagggctacacgccctcaccttcagaggactacacatcctcacctctagagtactacttgtcctcgcctttagaggactgcacgccctcacctttaaagggcgacacgtcctcaacttcagagtgctgcacgccctcgcctttagagggctacgtgtcctctctttcaaagggctccatatctgcaccttaagagaatttaagctactatgcataccggggcaagatttcacccgtgccgctgcaaagagacaagtgcggatcgtgcgcaccaacatgaccacttttgcacagatatgtatgacattgctacttagcaacattctgcccagcgaccgtaatgccgatctccccctgcggaagggtcgcgcccacaagacacccagtggacccggagaagtccaacagggccctggggtttccagctcaggttacgggcctctatcagtcctacagggtgcccgtactccccggcaaggatacccaatggacccaaagaagtccaacagggtcctggggcttccagctctgattacgggcctctgtcagttctacggagtgcgcgttacccccagcaaggtcatcaggcctcctactaaccgagctttcatcaagaagtattgcgcccccaggcaggcagagggcaagacaccacaacagcctggggatggccagcaacaggcaacaaatgcaccgtcgccacctccagagcccctcagctcatccataaaaag

SEQ ID NO: 5388 - DNA, 276 bp, Glycine max
  Peptide Sequence Number=SeqID_97073
atgaagacaaaagctcgtagcagaatcactgacaatatagtaagtgaaattaagccagaggctccataccaagatgatgagcttgtagggcttcaagaagtgttggaacttgaccctgatgtcattaatgaatctcttgcgaatgttgatggaggtggagaagagatagatgcaaatttactcaaacaactagacttggttgaaccagacgaggatgaatgcatgttaagtgagaaagacattgaaagtgattttgatgatacatatacttcttag

SEQ ID NO: 5389 - DNA, 270 bp, Glycine max
  Peptide Sequence Number=SeqID_97074
atggagagaagccataacttcaacaatgggaagagatctcaagatgtttctccaacacttaaatgctataagtgtaatcaacccggtcacataaaggcaaactgcctctcaaatgagtcatggcccgagaagaatgagaagaaaagctataaagaaagaagatccaagaaggcgtatattgcttgggatgacaatgactcatccgatggttcagagaaggagatcaaccttctatccaaggactatgaaagcgatgagaatgactcttaa

SEQ ID NO: 5390 - DNA, 207 bp, Glycine max
  Peptide Sequence Number=SeqID_97075
atgtttgttgactatgtcaatcaaacatggataatcccccacaaagaaaaatttgttaaagccgggatgaatgagattatgcacttagggaacacaacaacaaacaaggttgaatctactcattgggctttaaaaagactactacaaaatagtcatagaaacctatgtagtgtttgggaagccatgaacaacatgatcacggtgtaa

SEQ ID NO: 5391 - DNA, 411 bp, Glycine max
  Peptide Sequence Number=SeqID_97076
atggggtacattcagaccgttcctccgccaccgattcatgattcgttgacagatcatgtggtgcctacaggggagctctgtgtagttcctgggcaggtggccccagactacatggagtggacactgttgagccgagacttgcgtccccctcccactcatgatgatgacttcgtcgagccacctgtcgccgaggttccagtcgcgtcaaatctccctacgcattttgtggttgattgcacagcatgtatcaggattggaaggattgctgagcatttggagcgggtcatcaacctcaggatggtgactgaagggactgacttatatgatatcatggatctttgtctgaggatagctagagatgacgacccagatgacagtcttaggccgcgacagagaccccgcatagattaa

SEQ ID NO: 5392 - DNA, 168 bp, Glycine max
  Peptide Sequence Number=SeqID_97077
atgtcgactcatcacatcctggggttgaagaaggtcccaagggttcggttgttcgccgattcaagtggtacggagaactgcgaggagccaaccctagtacgagaggactgggttgggccaacctatggtgtaccggttgttatgccaatagcagcgccgggctgctaa

SEQ ID NO: 5393 - DNA, 366 bp, Glycine max
  Peptide Sequence Number=SeqID_97078
atggcccctcccatggtcaaaagggaaatgattaccatgatggtagataccttgccggtgttttactatgagaaattagtgggctacatgccttccagcttcgtggacttggtatttgccggggaaagaattgaagtaggtttgaagagagggaagttcgattacgtctcctccacaagtaccaacgctaggaggatcgaagcaactggggaaaaaggaaggaaggagatacccatgccgtcacttcagcgcctgcatagatcaagccactcagacctctcacggtacccatcagtactcgcaacatcacccgagcttctcagctcgtgccggggactctcccaactcagcacccataaaagctag

SEQ ID NO: 5394 - DNA, 147 bp, Glycine max
  Peptide Sequence Number=SeqID_97079
atgacgaagaacgaacgaagaacggttgaaaatcttcgtgaaatcacccacggaaatgaaaataggggaggagcttgccacccagctcgcctaggcgagctaggttgcttcctccagaagcaaccgccttctggaggaacatcctag

SEQ ID NO: 5395 - DNA, 177 bp, Glycine max
  Peptide Sequence Number=SeqID_97080
gggtgtggatagataaggatctagcttctcaaagaagcctcttgagtgtcgcaacatgccccttttgcgggcgggcaaaggcgaggctcacgggtgcattttccaaaggaggaaagatgcgcggagtcgccaccaacgtttatttgtggaaaatgtcgggaaaaccaaaggaaaccg

SEQ ID NO: 5396 - DNA, 189 bp, Glycine max
  Peptide Sequence Number=SeqID_97081
atggagactttacagaagtatgttggcttggagggattttgggaacccggtgctgagaggaacgaggagaagaactacatacacgtacatgagctcaaattaaaggtgggcaactggggatggtgtgcttatgcatgggcttgtggaaatggaatatttgctttgtgccattgcccgaccgcgacttag

SEQ ID NO: 5397 - DNA, 387 bp, Glycine max
  Peptide Sequence Number=SeqID_97082
atgtttaagcagggaatgacaaccaaagcttcaagaccacaaatagaacttatgagactaaatcaacatgaagaaaatgacaagaaaaagaaaggaattgcacttaaagcctcatcttcttctattcatgaggaaaatgacaaagaagattcaaatgaaaagaacttagaagaagatgatgatttcagtctctttgtgaagagattcaataaatttcttagaaacaaaggaaatcaaaggagatcaaacttcaatccaaagaagaaaggagaagattcctccttagttccaaaatgctatgaatgcgatcaacctgggtacttgagatttgattgtcctgtctttaaaagaagaatgaaaaatccaacaagaaaaattcaaaggtaa

SEQ ID NO: 5398 - DNA, 309 bp, Glycine max
  Peptide Sequence Number=SeqID_97083
atggagagatttgaggaattaaggatgtcactacttgttgatgggttaaccaaggcgactatggataagtggatggatataacggacatggtacatgtcattgcatcaaggattgacttaacacttttttcgcatgtacaacaagtttatttaaaagaacattgtcccttaccacctgtagcattgttatggtctagcaattgtcatccgcaggcgaagtcgtggccaaatccatatattagcagaatgcagcattacaagagcttcgtgatgttcaagagagactatgttgacataaatgatgattga

SEQ ID NO: 5399 - DNA, 186 bp, Glycine max
  Peptide Sequence Number=SeqID_97084
atgcacccgaagataacaagcccaaagctcagcctcgggctaaacaagccaagacctccaagccttaatccgaaccagagtacttcgaagacaagcgcaacttgtgcacgctataccttcctctcttctggtatggagctcttacataggataagtgatgaagaacccctcaaattgcctctatga

SEQ ID NO: 5400 - DNA, 177 bp, Glycine max
  Peptide Sequence Number=SeqID_97085
atgtgtgagacaattaataaatggaatgctgagcttttggcaaaggcaaataaggagaagatacttgaggaaaagatgttgcagatgatggagaatcatgatcaccaaaatggaacagatcaccatgttaatgatgctcaggttgatcatcctcatgacatggaaaatgatcattga

SEQ ID NO: 5401 - DNA, 231 bp, Glycine max
  Peptide Sequence Number=SeqID_97086
atggctactgtcagaacttcaccgtcagacgaagctatctctgacgatagggccaaccccagttcactttcatcggaaaaaatttcctctaaggaccctagcatactccccctactatttctacacctacaagaatggagaaggaagaaagattattggagacgccacttcaaggagaagatgagtcaagaagaagctcaccaccataagaagccatggataagagcttga

SEQ ID NO: 5402 - DNA, 660 bp, Glycine max
  Peptide Sequence Number=SeqID_97087
ctatgccagaaatggatacggccaacactttgctgatacagtggcgacacaacgagaggaaggaaggagtagaaattggagggacgcctcagatgtttattcattctacttcacatatttcttggaagacatgaaggaaaaggacttatggttggagttcaagaagtggggtgatgtcagggaggtgttcattgcaaagaacaagaataggaatggactaaaactacatgcgaatctcccaaaacatggaagggagtggaagatgaaagagaagaccagcaacaattatcagcacaagaagtggccactcaaggagaacctagtggataccgagacatgcgcagatgctaagaatgacctcccactcgccgatccaactagctatacccatggaatagaggacatggttcgacaatgcttggatatcaagccaaggtaccttggtgatgacatggtgttactcatgagcctcactgatactagagcagaagaaatatgcaaggaagaagccaaaaatagatcgtcaatgtttcattcactggagaaatggaacctaaacctgaaacctgtcttcagcatcaagaagatcgtgacagggattggggaagtggtggacattgatgatgatgttgaagacattcaccctcggacagagcacga

SEQ ID NO: 5403 - DNA, 590 bp, Glycine max
  Peptide Sequence Number=SeqID_97088
tgaagcgtgagtggttttgctttggtgggcatgcattgatgaagtgcagtgtcagtggtcggcgagggcgcgggggagttccggcagaggggacacgtggcgctcgtcttgagccactcgtcgacgcactccgcgtggaagcagtggcggcactccggaacgcaccgtatcgtctccttgggaagatactcgctcaagcaaatcgcgcacgggccctggtcgttgggcctgggcaggcgcttgctctctccgatcacgatcttgggcccgtagcaggcctcgatggcgggcttctccaagcccaggaccacaacaccaggcccatccgacgcgtcacgaaaactgctgttattattgttgttgtttctttggtgagtgttgatgttgtggttgtggcggcgagtgatgatgctgccgttggctttgatacggacgcaggcgtaggaggcgagcatgatggtggagatcaggaccaggatgctcacggcgatggcaatgccgtagccgaggcccccgccagctgtggcggtgggggcggagggtggcagagccgccgtggacatgaagggaagagagagagagggaattga

SEQ ID NO: 5404 - DNA, 483 bp, Glycine max
  Peptide Sequence Number=SeqID_97089
atgaaggccaaaatagatgagccaaagcgttcgtctcctagggaggaaacgagtggagtcgtcaccaacgtttatttgaggaaaatgttagaaaaaccaaaaagagacaagggtgttgcccttgctcctacgtatcctcagaaaaagagattgacgatgatagatggagaagatgaatgtggacaaaacaacaaagggggacccctaaaggtgcatagatcacattcaaatcttaaaaacaaaactaaccgatggtcgcataaaggacaccaaacaaggaatgatgtagggattggtcacagtcatgattcggcaaaaggtcactttggggcagttgcagctcacccaggcgagctcaaacttaaccctgcagtactatttggtggcccaggcaagccagatgctagcctgggcgagctgggtcaagaaaaatcaagcaaagacccttttgcccccttccttggtatccttttgtattattga

SEQ ID NO: 5405 - DNA, 732 bp, Glycine max
  Peptide Sequence Number=SeqID_97090
atgtctgaagtagatgaggtgcaagagcggatgaaggccgacatggaggccatgaaagaacagatgggcacaatgatggaggccatgatgaccatgaagaagataatggaggtcaatgcggctgcagttgccactgtcagcgctatttctggggtggacccgactcccccatctggcctcaacctaataaatcatccaaccacgaatacaggcgacccccattttgtgcaagtccagaacaagcagattttcttgccatatggtttgcctccaaactctactccacccaatgagaatgtcaataactccactcctatactcattaagagccaacaacctcaatctgatcatgcacatgtctctcaacccatgggggagacacatgaaatgcctcaccacaatctagccgacttcgagccttgcctcggatatgccattgaaggacaaaaagtttgtggtatacccttgcacaacactttggagggccctgagtatcacccacaaccacacctcttgcattccataatgggtaaaaaccctcatgctatggcagaactgggaaagttggatcatctagaggaaaggctcagggccattaaaggaggtggagattatgcctttgctaacctagaagagtttttcctagtacccaatatcatcacccctcccaagttcaaggtgtcagactttgacaagtataaggggactacttgcccagaaccatctaaagat

SEQ ID NO: 5406 - DNA, 258 bp, Glycine max
  Peptide Sequence Number=SeqID_97091
atggtggggtacgtaccttcaagctttgtggatttggtcttcgccggcaaaaggatcgaagcaggtctgaaaagaggcaaatgtgatcatcctgctttgatcaatgagaaaactggggcaaatgaagaggatgagaatgaggaaagaacccatgttgtggctgccattcctacatggccaaacttcccaccagcccaacaatgtcatcgctcagccaatattggcccttctcattacccaccacccagtcatccataa

SEQ ID NO: 5407 - DNA, 195 bp, Glycine max
  Peptide Sequence Number=SeqID_97092
atgaagaaacaacaatggaagagaagcggaagacaaaggaaaagaggtgagaggaggcgtcatccattaaggaataagccatggaagaaggagcttcaccaccaagatgagccttggataagaagtttggagaggatgcttcaatggaggaaaagaaagagggagagaaagagagaggggggagcacgaaattga

SEQ ID NO: 5408 - DNA, 942 bp, Glycine max
  Peptide Sequence Number=SeqID_97093
atgggaaatcatcactcccgcaagcttgaacgaccagcttacaggagtcctcaaggttttctagcttcacctagcgctgggtcatacacggggatacaacctcccatctccgctgccgccagctctcaccgcacccccggaagcataatgggggaggatcatagtaaccagaattggctccccggcagccgcaaaaggtcgtgcccttctatgagggtgaaaagtgcccccactagttcgatgcgaagtcctcacccctccgaggaggaggactcgctatcagaggcacctcaacgagtatccttatacgaggaactgcctatcgagatgacctctcgatccatgatgggttgctcacacgagcccgcagaattagtgccacccagtccaatggcggaattggatagaagtacctttggaagttggaggaagaagaaagggaaaccgaaagccataaagcacaagagcaagcaaggaagcaagaagacaatgaacaatggcccaaattcaaacgttcgggagcttgacaagccacatcgacttgcaattctcacactcgtcaaggttgtcacacctgacacaggacaatactcgtccatacttggaggcttgacaaactcgtcaccctttgcttgtcaagactactgccccgaacatcaaacaaacttcttcgacacgggacaatatctttcagtgctaggaaacatttttcacccgcaagctagctcaaagcttgaggggcttatgtactgtccaagacccacaaaatctacgtggcatcctacttggcaatcagagacacgtgttaaccttccatgtcagccctgctacaggagcgcaaatgtgtttgaatattttatctattggcaggtttcatcaaaccactccacacgacttgctcacacactcagcacacaacaacaattaatatttaatatttaa

SEQ ID NO: 5409 - DNA, 270 bp, Glycine max
  Peptide Sequence Number=SeqID_97094
atgacgttgggctcagcgacacaggaatgtcgcttagcggaaaatgctaggttacagtgtctgcaaagttggcttagctggcaaggacccgtgctaagcctaaggcttagtgaacagggccactcagctcagcagatgccgcaaggaatttcgcttggcgcaggagatccttggcttagcgggcggccaatcaataaaaaacttttactaagttacccgggcttagcaaatcagcctcgcttagccacaggtactgtaccaggtggatga

SEQ ID NO: 5410 - DNA, 1524 bp, Glycine max
  Peptide Sequence Number=SeqID_97095
atgaggttgtctccccgcataggacctaacatgagtgttaggtcatccttgtctaccccagccattgctggctatgagtggctagcgctaggtgaagctagcgaaccccgaggactcttatgtttgtttgaggtcctgggtgtcattctacccttgatcgcttttaagtgtgctttgctggagcacttgaatgtggccccttccaagcttcacccgaatagttgggcgatggtgcgagcttttgaaattttgtgtccttttttcaatgtccggcctagtgtgtcggtcatcttattcttctttcaaataaaattgttaggcaagattggatgggtctccttgaacaatgtgtccaagaagctgttcgagtttgaatcaaacgtatttcaccatatcaaggaccatttgtttaaggtcctggctactaatgtcgtggctgatggaatgccactgatgtttaatagggacggagagcctcgcttcccattctactggcagtcttatcccactaggttcaagtcgtatgatgaggatttgttgacccttgtggagagagtcaacaaagcgattttggagcagctaccggcctcgttggatgtgtgggtcatccaatctcttccttcggtgattgatcctctcgctaccttggatggtattacgaatgacttctcttggaggcgactcgtgatgcaggtcgaacctgtagttgggaccatgccactgtctgttgctactccatccattggagaagggggccaaactgctggtgaggttggtcctgttgttgttgttgctgaggtcgcccccagtgctctttcctctgcgttggtaaagaggaagatggatgatgttgttcagccgttgggccgcaagaagtcgaaggaccctatgagcctccgctccctgaggcaggctgccatcgaggctcctattgctgccattgttgttgcgaatcctgctccttcacctcctcctatggcttttgttcaagaggctaagtctgttatggtgttgtcgtccactattgcggcccctttattaagtgccggtgaggcgaccactggtgctctcccaatgctgcctccttcttcatcgactctagtggccctccctgatgttgttttggcgagtatggcatcgccttcttcatccccgcatctccctcgatcatttgaatttggcaattatgaaggagaatggactgcgacaccaataggcggtgcaaaagtttatatccttggaggcggaggtcgccaagtggagggctactgctcggactttgtggctgagaagatggacctggatggcaaagtgaagagcatggtggcagagaaggacgagcttaccaagagaattactaacttagaggcccaaattagggagtcagagtccaaattgaaggagtccgagttgcgggctgtcaaggaaagggaggccagcaaggagctcgaggaagagctgattttgtacaagaaaaagatcatggagcaatatgagaaaggctttctaaaggtcattaggtag

SEQ ID NO: 5411 - DNA, 164 bp, Glycine max
  Peptide Sequence Number=SeqID_97096
atgatgacaacaaaagatgatgacaaaggtgatgaacataaagctcaaagatcaaagaacaactcaagtgaatcaagaacaagagttcaagaatcaagaaggattcaagatctcaagaatcaagatcaagattcaagaatgaagaaaagactcaatcaagataa

SEQ ID NO: 5412 - DNA, 1569 bp, Glycine max
  Peptide Sequence Number=SeqID_97097
atgtgttttgatggtcacaggaggaggaaatggaaagctgcaacgcaatccactaccaacaaagcaaaccagacacttcaaatactcacaacacgatggatggttaagacaaagagacaccttggtgtcctcgtcgatggcggaattgagatcggagaagagatcgaagcagaggagtgggaactccaaatcgacactccaaattggcagtttggggttaggtcgaggcagatatcactaatcctatacccgtccccacccttgttttgggttatcgaggaaatcttgaatccaacctcaaacccggtcaacaaggaggagattgatgcagaagagagggctgttgatgaaggtcagggtgctgcggagcaaagtgatgatgccagtgaccgtggtggtcttgtaaagagtagaatgacgcagagtcatctcaggtttgatttcaacctgattaaaggtcttgtcttgcctaaccagtgtggggataggtcggctgacttgctaagttcctcctctgatgattatgaggaggcagaccttgggttttgcaaaaatgtgtaccaagggcgaaccttaggttttggagatgtgagtaccaagggcgcgctaagcgagctagtcccgctcagcccccaatggcctctaggaagaggaaagccacaacatcctagccctaggagccctatgataccacgagattcacttctaaggggacctgggaacgcagaactggcacaaggccttgacccagagttctactcgaacctgtatgatccagaagataaatctccaaaattggttcgagttagggggaagatgatcaagttcgatgccgttttcctgaatgccttcctggagaaaccatcgattatccagccaggggagcagggcgccctaaaagctccagaggaaggatctgacgacactagcccagacatggatcatgaagatggacatggacgtgggctcgattatctcaagccagatctcacagatggcctaaagaactgttggaacctggatgatcccacgatcgtatttccagggacctgcaaggctcgggctcgaggatctgaaggctcatcttcttctgcttcccttgctcctgcttctacacctctagctccttctgctccagctccaccaccatcaacattagttccagcacccttcagcacctccatgcagagctcagacgttctagtgccgatgttgcaaagcctccaccatgacttatgcctagtgatgctaagtattcacaacttggctcagcatcggcccatcatgagcatggaggaatttacaactcaagagcctcagctagagccttggcctcagccgaaggccactccagagaccaccccgcagacttcttcagttactacaccaggggtagaggtctcagatgaggagtatggcgctgcagatatagattatgtagcagatatggtagtagcgcaaaacacttgggatccatggcctgttacagctaaggatatccctcagccagcccaggatgctccctccttacctcaggatgagcccacagcagcacaggaagagccatga

SEQ ID NO: 5413 - DNA, 822 bp, Glycine max
  Peptide Sequence Number=SeqID_97098
atggctcaaggaatctcaatgagaggtgtacctaggagcttacttaaatcagggtcattggcaacttgtagtactgtgtcctgcgaccaatatgttgatcctgctattattataagcagtgcaatgaagacaacaaacacaactaaggatggtacaaataatcaaggaactcctaagtggattgaagtcaagagccatgctcaaagtggagggtatgagtgtggctattacgtgatgcattggatgtggagcatcgttagtgggggtttaaagaatgattggagcatgagccatgttcaaagtggagggtatgagtgtggctattacgtgatgcattggatgtggaacattgttagtgggggtttaaagaatgattggagcatgtggtttcttgatggaacgacgttagacaacgaaacaattacaacaattcgtcagaaatgggcaatgacaaataaagttgggaaagaaattttccaaagggctggagaactcaatgtgagtaagttgcaaggagctgctggtcaaaactatgtgaattgggctgcaaaaatggttgttgaaatggaaactggggtcccttgggtgatgtgcaaggaagatgatgcaccagatctaatgataaacacctgcaatggcttctattgtcataaatttactccaaatagaccctataagcctatgatttggacaaaggcttggagtggctggtttacagaatttggaggtccaattcacaaaagacctgtccaggatttggcatttacaactgctagatttataaaacatgccatgcaaataaggaaacggatctatgattga

SEQ ID NO: 5414 - DNA, 663 bp, Glycine max
  Peptide Sequence Number=SeqID_97099
atgaaggatcaagagctcttaaagaaactatcttcacatttaactttaaaatctaacaatataagttggttttacttatatgatgacgtgcaagctaatgcagatgaaaatcctccaagatcaaaacccgtggacaacaatatggggaaggattttgagagaaatttggctttggtatacaaagagggaccagaccacataaccacaaacactgagaccttcgaggaaagagatagaaaacaaagtggaagaaacaagggaatgggaggggagggagaaaaacatagtttcttacaaaaggccttcatgaaaggaattggccaatctcattcaacagacaagaggaagatatcaccccctaaaaagatgacaagcataagaacaaaacaactcatgttgatcttaatgcaaacttttattatgcagcttaccaagtgcatatgtgcaaatggaaatcctgcttacgtgactataaagatagacaaccagaagtttgcaaaaaccagccaagaaataaaccgtgtgtggaaccaaacttttcagattcactatgctcatccagctgattcatgcatcaccattacgctgaaaacatcgcgttcttccgtattaggaaaattccatattcagactcagcaactattgaagaaaggagaacattaa

SEQ ID NO: 5415 - DNA, 517 bp, Glycine max
  Peptide Sequence Number=SeqID_97100
atggctccacctaaagaaattgcgaccatcatttaccacaatggttacattgtagacgatccatttcaaggatcaataggcgcgatggaaacaattctccagaatccacaattgaattctgttgaattctatgctgttaatgagcttattcctcaaccacaatcatcgtctccacaaccctcatgtccacaactacaactaccgcctccacaacagttaccgtacaacaacatagacctcaataatccagtatcttcatacaacaaccttgaatcacaagacccctttgacatttatacttcgtacacacaaatattatccgagaatgattctttttttcatggccaacaaacctcctttgaccaacaaaaccatccttcatccccgtttacgccaccttcacactatcacaaacgcaaacatcaaaccgagatgaacatcccattgctaacgaagatcccattatacgatttcatgatgaaaacatggatgattttactgaggatgaggatcaaca

SEQ ID NO: 5416 - DNA, 783 bp, Glycine max
  Peptide Sequence Number=SeqID_97101
atgaatgttcaaggattaaaaacaagattcaatgaaagtataggggctaagaacatattttacctatcttttatgatgtgcaacgggaagtttgacgactcagtagaatttcgagtagaagggagagggacaagatacgagacacttgaactttccgcagttgtgagacaaggactaggagactgtcatggagatgatggagttgacttgtttgggatagaagtagatggaactaccagggagtttgacaaggaaatctatcgtttcatttgcaaaggattggattggactcttaaaaagtggggagagggtggtgatggatttttcaatgaaatccttaatgggtttctttctcccaggtttaaagctccctacccaccaactccatcagattttgttcatttggttaaagataatgatgattccttggttcttgatgaagatgaaatagttgatgagacttcaagtcgaaatgaagaccagtttcctctgatttcaagtccaaaacaatctgggtctagaatctcaaattcaaattctgaagataaggctgctgaatttcctcttcctaatgaatggtttagatttgggattattcctgcaggttcaactgatgcaattgtaatctgtacaactggaactcgagaccctattacttctgcattgcatattgtccttggtaaaagggtgcaccttgacatagctcaagttgtacggtggaaaagaactcctaaatctgaggttgagcctcatgtgcgctatgcagcttccttttcagggtaa

SEQ ID NO: 5417 - DNA, 879 bp, Glycine max
  Peptide Sequence Number=SeqID_97102
atgtcggttgtacaaaaaccgatatctaaccccaacgtcgtttcaacactcctcgcaaacccttccctcagtgtggtttgtgaagccggtgccccagggtttggtggaagcccaggaaatgcggctatagttgatgaggagcaggttgttggagttagtgtaggcggtggggtggacttgaatgagttcaatggaggaaacgagaagagaatcagtggcgaagtcgtagaagcaggaggcaaagaggtcatagtaggtgcctttgcgggcggtggattctggccaaggagcgcaccggttgaagatgacgatggaggagagtgcgacattgaaggagggacggatgaacttggcgtcgtagttgttgtagacaatgaatgtgcagagaaggtagtgagaaggagaagggagggaagggaaggtgtagcaatttatcttgtcggagaaggagggaaggaagaagtggagtgttttcgcggaggggagagggaattggagaggcttggagacgatggcagaggagccactagagatgaagtcgtcagagagccatgtagtgttgaaggagtcagtggatttggtggaagttccacagttgatgtgttcttaccatacaagtttactgccaatgatggaaaaatgaaactaaaagctatgattcattcagatatccaccctcatatatcaaaaggaaagattaaaagcaaaaatgatccaaaaaatatcaaaaatataaataaagaagatttttggcatcagacccaagtccactctagcaactatagaaagagagtcaaacgcaagtccactccaacagctataaaaagagagtcaaggcaaggagaaaagacaccaccccgaaggctcaaagctctctaa

SEQ ID NO: 5418 - DNA, 194 bp, Glycine max
  Peptide Sequence Number=SeqID_97103
atgttgaatccaactcaacttcaggccaaagaagagaaggttcaagcagctgatgactcactcagcgaggcagacccgctcagcgagtggcatccgcttagcgaggcatccagctcgattagcggatgggaaaccctagaagaggataagtcagagatgtgcttgcccagcatgcagctagcccgcctagtgag

SEQ ID NO: 5419 - DNA, 213 bp, Glycine max
  Peptide Sequence Number=SeqID_97104
accaaagaagagaatgttcaagcagctgatgactcgctcagcgaggcaaaccctctcagcgagtggcatccgcttagcgaggcatccaactcgcttagcggatgggaaaccctagaagacgataagtcagagatgtgctcacccagtgcacagctagctcgcccaacgaggtcgttgtctcttctcgcgctcagcgcgcccactctcgcttag

SEQ ID NO: 5420 - DNA, 321 bp, Glycine max
  Peptide Sequence Number=SeqID_97105
atggcgtccaatgattctgatttgcagatgaagatcatatatggcgatgtcggttacatactcgaagatacatatccgaatccgcttcgatccaatcctacttactcagttgttaagttgttgttcacaaggatagaccaagaggtgaacattgtcaacgtgcagagcctcagcaaaagagtctctggcccaatcttcttagagtcttctatccaatgcccttggagggtaggattgcatcattccctcccccatgaaaagtatttgacctcaaatccagaggttcttgaaactctgggcttcttccccaaacacctgtaa

SEQ ID NO: 5421 - DNA, 237 bp, Glycine max
  Peptide Sequence Number=SeqID_97106
atggggcttaagaatcaaggaagtcacttagtacattatgtaagccaccaagggaatcaaggagctgaaaagaaatttatgaagaagcatgataaaggcaaagggccattaaagataaatgaagactctttgcaaatccagcaaaaggtatcaaaggacaataattgccaattttgtgggaaatatggacatttccaaaaggattgccaaaagcgtaagtcttggttgaaaagaaag

SEQ ID NO: 5422 - DNA, 840 bp, Glycine max
  Peptide Sequence Number=SeqID_97107
atgttgcacatagcatatggactagagaggaaggttgagaaatttgggaggccaattcctaagattgaagggatagtcgctgccacaggattaactcctttgatcgcgtgttcagtagtcaccggcaatccaggagttatatccgcttttgtcaagaggtggcacaaggagactagcagcttccatcttccagtaggagagctgaccatcacactgaatgatgtggcgtcacttctccatctgccgatcacaggcgccttccacagcttcaagcctctacatgtggatgaggcagtcatcatgttggtggagttgcttgagatctcgggtgaggaggctagagctgagacttgttggatatatgagcactttcccagtgtgcatgacaacgtcactgatgatggctacgatgagacgtccccacgtgcctatcggtggcttactacgatggcttatatgaagggattaacagcatcgtcgtactggacacgtatagatgctttgacgatcactgacgtccgcttagatggggtttcaggagattacatggagtggttcttcttgatatctcatccgttcatcacacccacacaggcaggtgatcaacccagacatccacatgtcccacagcatgaggcatacgtggagccaaatatcccggaggatgcctgtgaagcgatggcagaaaggttggagcgtgtgctcaacctaaggatggtcactgaaggcacagagttacatgagatcatggaaaaccgcctcaggatcgctatgggtgtcacctcagatggaaatgtgtatgttagggtgcgacgaagatggcacacagatcattcatag

SEQ ID NO: 5423 - DNA, 429 bp, Glycine max
  Peptide Sequence Number=SeqID_97108
atgttaaaacatgttgaaatttcacaactcgcgcactcgaaaaccctgctgcactttttcttctctttctcctcccacccgaaatctgccagaaaccgctcggtcgacacccacattgccccacattcatttcaatactgtcggaaaccgctcgctggaacccacataacctcctatcgaagaaaagtagaagaaaaccctacattgctattggaactgtgggtcgaagaaaaccctagactgctcttggaacagtcgtggttgattgtgctttacgtggttttcaagcttgacgagagttacacgccgagcaaagtttccatccttgccggtgatggttttcacaacttgaaggagattaagaccgtggaactcgtgaagccaactgggtgggtatatctatccttgtatggagctgatcctaggtaa

SEQ ID NO: 5424 - DNA, 843 bp, Glycine max
  Peptide Sequence Number=SeqID_97109
atgtacccagttggaaaaatagatgattctagaataattggggaacaagggagggtgtgcagaatttttaagttcatttgtgatgcaatttttcgctttttattacttccaaggttcttgttcttgatgaatatgacaccagtttgcccctttgtcaaagctgctcgccccgatgataacaatgcctctaagaaatctggcgaaaactctatgaaacatcaggctgagtctgagagtaaggtgaagaaagaggttaatgactcagctagtacctcaccaaagtgcccttttggatatgattcacagtcgtttaagattggtcctcttagctgtacggtgtgccaagcacttttatttgacaccagcaaatgtgtaccttgttctcatgttttctgcaaagcatgcatatcgcgctttaaggactgcccgttatgtggggctgatattgtgaagatcgagcctgatgctaatcttcaaggtgtagttgatcgctttattgaaggtcatgctaggatcaaaaggtctgttagtgcagacaaaggagaagaagcagcagagagtaaacaggtcatatatgaggatgtgtctttggaaagaggttctttcttggtgcaacaggctatgagggcattccgtgctcagaatttagaaagtgccaaatcaagactcaacttctgtgcagaagacattcgtgatcagttagaaaaagttggtaacacttcagagttatgttcacagctaggagcagtcttggatattatttgtgtaaaaggtttgtgcttaaagaaaaatgaagaaattttgaacaactataatatatctgtcgcgagtctcactgattga

SEQ ID NO: 5425 - DNA, 421 bp, Glycine max
  Peptide Sequence Number=SeqID_97110
cgcgtcttccggaattcttccggaagaaccacttcttccggaaacttccggaagaaccacttcttctggaaacttccggaagaaccttttccggaaagtttccggaagacgtttggttacttccggaagtacacttcttccggaaaaggttcttccggaacttccggaagaacccctaacgggtcttccggaagactccgccgtcgaccttttccgccatttttttcggcgtactctcgtcttctcccctctcgtcttctatcctaaggttactaccctaaggctgttcgcggagaagaagcttggctcgtggtgtcgcgaagaagacgaaagcttggctcgcggtgtcacggaggatcaacaggaatggaagaagaaaagaagcagcagtggtcttccgagaagaggagcgcgtttttaa

SEQ ID NO: 5426 - DNA, 613 bp, Glycine max
  Peptide Sequence Number=SeqID_97111
atgaagaagggagttgctacgtgcacccagcattattgctggggcacccaacaaatagtgaagtggcgaaactgcccttcatcaattattcttccggaagaatacccacaaactacttccggaagaacgtcatccggaatgtttccggaagaaggttcttctggaatatttgaagatttggtgatcccgtgttccgtatttgaagttttgtcagtggctgttcttcctatttcgtcggaggtccggaatgaccacgtccggaagaccttcttccggaagttactaagacccattccggaagaaggtcttccaaaagtgttttccggaagcacttcttccggaataggcctcagtaacttccggaagaccttcttccggaatatggacgaagatcaatggaggtatgactttgcgatgtcacaagaagttcatatggattatgattatgataatcaagaagaatgtggggtgaatgaaccacatgtcgattgttcaaatgcttttaatacatctcaggtattcgctactcgagatgatgttttgcaatgggctcgaacagttgcccatgaaaatggatttgttgcagtgattatgagatctgacacagagaccg

SEQ ID NO: 5427 - DNA, 522 bp, Glycine max
  Peptide Sequence Number=SeqID_97112
atgagtgatatagaggagatacaggaacagatgaaggccgacatggaggccatgcaagagcaaatgaccacaatgatggaagccatgattagtatgagaaaaatgatggaggtcaatacgactacagttgttgccgcaagtaccaccactgaggtggacccgactcacccatctggcctcaatcaattaagtcgtctagtcccagacatggtaggtcaatggggcaaagtattgggaagtatgggcggccctcattttgcacaagtccagagcaagcatccgttcccaccgtatggcctgcctcccaactatgcaccacccaatattgtacatgtgctctatgagaacatcgaccactccgctcctataccccttgagagccaacaacctcagtttgggcatgcacatggctctcaacccatgggggagacacatgaagtaccccgagaccacactctggccgactttgagccttaccccggatatgccatcgaggggcaaacatttggtggaataccctag

SEQ ID NO: 5428 - DNA, 498 bp, Glycine max
  Peptide Sequence Number=SeqID_97113
atggagaggagtatgattgatgctgccagtggtggagcacttggtgatataacccctgccgaggctaggaatttgattgagaagatggcttccaactcccaacaattcagtgcaagaaatgatgctattgtccttagaggagtccatgaggtgaccatgaattcatcttcatctactgaaaataaaaagcttgagggaaaacttgatgccttggtcaacctagtaactcagattgccatgaatcagaaatctgcacctgttgcaagagtctgtggtctatgttcttctgcagatcaccatacagatctttgtccttctttgcagcaatctggagtcaatgagaaacctgaagcttatgctgcaaacatttataatagaccccctcggcagcaaaaccaacaacagcagaataattatgatctttcatgcaacagatacaatccaggttggacaaatcatccaaatctgagatgggcaagtcctccaaaacaacaatag

SEQ ID NO: 5429 - DNA, 615 bp, Glycine max
  Peptide Sequence Number=SeqID_97114
atgactaggggaaatccaggtgatttacagccctttgatcctgaaatagatagaacctttcatagattagttaggcatagtgtgcatcctggtcattttgtgcattttgagcattttgagtattctgttgttggtgattctgaatattctgattttgagcattcgactactaattttcatactgagaacatggctcaacccccaccttgtgagaggactcttagggagatggctgcacctgatttcacttatgaaggcttgtgcattcaatatcttgatgagggtgttccatatgttctcaagactggactaatacatttgctgcccaagtttcatggtcttgcaggtgaagatcctcataagcatcttaaggagttccatattgtttgttccaccatgaagccccctgacgtccaagaagatcatatctttctaaaggcttttcctcattctctggagggagtggcaaaagattggctatactaccttgctcccaggtccattttcagttgggatgaccttaagagtgtgaatgtatgtatacatgattttgatgatgtcaaagaagaatctaacaaggctgcttcaaatgataagcatttgcttcaagaataa

SEQ ID NO: 5430 - DNA, 225 bp, Glycine max
  Peptide Sequence Number=SeqID_97115
atgtggtcatctgcaccctttccggagatgtcagcatcttccagtagagactattttagtctcacaccgctttcaaaagaactacgtcaggtttttactctcgtcgtccggagacattcaagcccgacgacgcacgagattcttctctgctgggcggggacgatcaagtttgatagcgtgtggaaacgtcatggttatcccattttatcgctttcaagacactga

SEQ ID NO: 5431 - DNA, 414 bp, Glycine max
  Peptide Sequence Number=SeqID_97116
atggcagttgcaacttgccatgaattcgccaatggcaattgcaacttgccttttggcctgaaaaagcttacaacacctctgccatctgccacctgcaaaaagtctggaaaagctggcctacgaatggaactcgccagtttgactggcgtcagcagcagcaaactcgccagtgccactggtggtttgcttgcaccatgcatggggttacgtccaaaagtgcccccttgggcttttgtaattgcacgttacccaggtacagcctcacggtacagggttttgttcttcgcaatctcacggtacagggaggttcgtgcttgcaagttgcaaggtgctcaaggtggtgactttcagtttgttggtgttcatgtagaagcaaatgcctttggtgttttgatgatgatcatgatgatttga

SEQ ID NO: 5432 - DNA, 573 bp, Glycine max
  Peptide Sequence Number=SeqID_97117
atggcaagtactttgtctactccttcgagtgacgctacgtcaattgtggcacctgttattggtagccaatatgagttatatgcccgttcaatgcctccaagtgttgttggccaaattggtttgccaaatatgactccgtttatacctccctctagaaggtcaatcatgacaaaggagcctcaacctgaagtcactatagctgatttgatgaacatgaagaaaatggttgaagaattaacaatagacttcatagaaaggttcataaaagctggaagtcattgttcagtacaatttccagaagtagagtgtgcagccatggcaactaggaatatgcattctaggttgaaagaaaaattagtggctcaagagacgaggatctcattggttaatgttgatgaggataatgtggaggcccttgaaaaggaagttgaaatcatggttgttgagatattacaagggaaaacttattcatgtctggccttggagccaacaaagaataaaggtgttgctggggatgaaaattttgagtacgattttgatatatcaaaagcatatcaattttcgaccatttga

SEQ ID NO: 5433 - DNA, 388 bp, Glycine max
  Peptide Sequence Number=SeqID_97118
atggcagaatcatctaagaagaaaaaggttcaacttcaaccaccaccgctacagaccaacgccgccacgacacttctggcttctgagaaggatttgattctattgtgggcccttcaaagtggttgtcaaattgactgggcccatcttgtctggtaccgtatacataaggcattacgggaaaatgcatctcttccatatccccaaccatttgctgctattgcatcctttggatatcagaaggatatggatgatcagagggtgcggaaacaagaccttccacctactgttcccgatgaacgtacgccctcaccaccgccacaaagggattcctcgtcttcactactgcatgatgctctcactgaactttgggatctttgggcctttctag

SEQ ID NO: 5434 - DNA, 453 bp, Glycine max
  Peptide Sequence Number=SeqID_97119
atggaccgcatgaagaaaacacgtcaaatgacgtctgaggccacaaaggaaattgcaaacaagattgcctcacaaggaagctttgtcgcccatggacgtcaagatatactgactgttgccattgagcgaccagagcaccctagttgtgtctatgctactggagccggttctcagatgcaatcacagggactcgcactacctcttgaagctgaggttggtccttctactgctcgtgtcagcacaaaggagaattgtgtcaatccatcaggtcctccccgactcattgctcttgaaagagtttatgaggggtcaacgatcatccacaacgttcttttgggcaatgatcaagtgaaggtcagcgttgaggaagtccaagatgcagatgctcgcgttcctgtacccactcaagaggttgagttagtggggcagacacttaacacctttcttgcttag

SEQ ID NO: 5435 - DNA, 159 bp, Glycine max
  Peptide Sequence Number=SeqID_97120
atggggcatgaaatcaataggaaatcgatgtatttggattcagaatgggatgttgaacaagggccaactccagagtcttcgtcttctaagtgcaagtcttcagtagccattagggttgagcatcggtcggtttggtcgaattcaagcccaaaatattga

SEQ ID NO: 5436 - DNA, 276 bp, Glycine max
  Peptide Sequence Number=SeqID_97121
atggctgcggagttagagcaacagacagtggagctatcctccctcgtcacacgccccgctaacgataagtcctccgattcgagactgtttgatgaacttgcggaacttgatgtggtggcttgcaattctatgatcatggggcttgctaagtgtggggaggctcatggaggcattggagcttttccgcaaaatgtagtgacaaagggtttagccaagtcaatttacaatggtgagtctgttaggtgcttgtgctcacttaggagcacttcaacatag

SEQ ID NO: 5437 - DNA, 438 bp, Glycine max
  Peptide Sequence Number=SeqID_97122
atggctacaccacccagctctcctcctcctcctactggtgcagcatcacagttgccatctaccttgaagcggacaagaaaagcaacacggctaagatcattggcgactagaccagttggggcagagagaccgctggtccatgtcgatcctgtgactgggaagggcgacggtccccacataaagaagttaagaacatatttggggatcgtcgctcatgataaggtcgatgtcacatacgagaattggaaacaagtccctgctaatcagaaggatttgatatgggaggatattcaactgaatttgatatccctgaaatgggcactttcagccgacaaggaaagtgtcgatgacactgtatgcgaaaagtacgacattagcaaggagaagtggacccaattttgtcagacccgtaggcatatggctgagacaagtatgtga

SEQ ID NO: 5438 - DNA, 2409 bp, Glycine max
  Peptide Sequence Number=SeqID_97123
atggcatttgcgatgatgcagagtggtagcagtgatgatagtagcagaagcgtaaagagaggggacatagtgtgggtcagagtccacttccctcacaaatggcgccccgcactcgttctctcttcccgcgacaacctcggcgtccaagtcaccttctccttctccgaaaacgacgccgtttcgccctcgcccaccttcttcgtcgagtccgaggttgtccccttcgaggaggcactcccttctctcatctcccgccgcaaccttgacgcgccgccgcttcactccgcgctccggttgttgggcctgagggtcctttccgggctgcggtgccactgcataacgggccgggcccaggcccaacaacaaccggcccgcgagttcgatacggttggggttttgggttttgttttggacgccgccgtttcgccgtgggtggagcccgcgcattttgcacacgccgttagggttgttgcccaggttcacgcttttcgaagctattgctctgtaaagcacaggaaaatgtacaaacaaaataaaaaagcaggtgataatgtgaagctgcttccaagttcatctttgagtcagaaggtgcacaaagttactcaagaatctgttgccttggaatccaaggaaaaatgtctgatcgtatccaaaaatagggagacaaatataactattggtgatataaagagattgaactcaacagttccactttgggaaggaaattctgcacgcttgtttgagaataaaaatttgattatttcacagaatcttgtgcactctcgtgctatagatccactttacatggtgcgagaaagcctaaaatctgcaaggcagagctttctgggattcaaaaatatatcagaccagggcatagttgatatctgctttgaagacttttctaatatgagtagaactcacatctcagttccttctaattttatgattcatttgagaaactacattgataaaagaaaagacaatgcactggggctttgctggagattgcctgacaaagaaaccattatataccttaacaggaggaaaagaaggcgactagataaatcagcttcatgtaatgattttcctcagattagtgaagttcaagaaagtgaaaggtgtgcagatatctcaacacataccacacctagtatctcagacattaagatgcttgaacccgaaggaagtatccagaaagaccatcaggcctcaacatacgtttgtgaaactagtatgaatttcactgaggagtttcacaaagtggattcaaaaagaattcaaagctgtgaatcattgtctaacttagtgcatcacttccattctgataagtgtgaggttgatggtagtgaagcaaaagctaaaggtatgttaggatctgactcatctgtttaccaagaaaggctgcacatgtgttgcaatcgtgatacaacacctctcaattcgaaaaggtctgcaaaatatatcttaaaactcaccagacctaggatctcagacattaagatgcttgaacaagaaggaagtatccagaaacaccatcaggcctcaacatctatttgtgaaactagtatgaacttcattgatgaggttcagaaagcagattcgaaaagaagtcaaacttgcgaaccagtgtctaatttagtgcatcccttccattctgataagtgtgaggttgatgctaatgcagcaaaagttaaaggtacgttagaatctgattcgtctgtttaccaggaaaggctgcaaatgagttgcaatagtgttacaacacctctcaagtcaaaaaggtctgcaagaacagaaatatcttctggggattgtttggtggagggtaaggattgctacgaaggtgttgcttctcattcgatattcaattcaaatgttagacagctatcaaaaacccatgttcccttttctcctaaagctttgcttatgaagttccccaagaatttcaacctaccatccaaggaacagttagtaaagaagtttagtgtatttggctcagtagattcctatagaacaagggtcttttgctacgccggctcagctcaggtgtcttttttacaagaagctgatgcagttgctgcatttaaatatgccaaaaaaaaggccttgtttggcaaggctaatgtccggttttggcttgacccatttgagcacaaaagaagaggattcaacccatcaagtaaacaaacaggacaaccactgaaatcttgtttgaaaaattccaattccttgagtaaggaaaacaggaagaaacatcacagagtaagatttacaatatctgctcccttgcccccatcaacaagtaatcaaacaggaccaccattgaaatcttgtttgaaaaattccaattccttgagtaaggaaaacaggaagaaaaatcacagagtaagatttactatagaaacttag

SEQ ID NO: 5439 - DNA, 252 bp, Glycine max
  Peptide Sequence Number=SeqID_97124
atgatgcttggcaggtctttgacatccatattgtggggtatgatttctgatcgctatggtagaaaacctgttatcattatagggattatcactgtgtatgcttatgctactgaaattttcagagaagaggagcaggctcttggactctcaacagtggttgctgcttggggagtaggtttagtcattggtccagcattgggaggttatttggctcagaaaaagccatggattttgtacatggacataaagtga

SEQ ID NO: 5440 - DNA, 1728 bp, Glycine max
  Peptide Sequence Number=SeqID_97125
atgggtgttgaaatcgagggaaagatcctcccagatgccgaacgggatggtgatacccaaatgacctctgataggggtggtatggaattcgatcaacaaggccttgatgaagggattaccggaattctaccagatggtatgcagcatggtctgcctgaattgaagcaagctacgattgaaaaattggactcttctgaagggcttgttaatgagacactgaccctcgggaagtggttcaatgcgggaaagagtgaccgtcacgacattggaaacactggtcttgctcctgtgatccgtaagtatagtaaattggtggccgagcaaatactagcaccatttatggatagcagtggtgatagtgtgcaattcgcaaacgaatccacgcaaatccttctgattggagggaatgggtcagtctacaatagtcttgatcttggattgctcgggttcaactcctttgccggaaatgatgtgccccaagtacttcaattgtctctgggagaacaaacatttggagcgtttgagcaaggtttcgctgtagacttggatgtcgtcaaagaatacagcggtgaacttgcacaagaatggttgaaggagtgcattcatcatggcctaaaaagtttaagcttggagaaccaagaggcatggtcgagatcatccaagagctcatcgatcgtcgacatcgaaaagcgatctttcacggaggttgatgtgatagacgatcttttgaggaggtggaaggtgagtcggtgtctagaagatgggagcaaatttggtaaggatagcttcaatggtgggtatcggaagatgcttaacctatggggccgaaacgtttgtaggcccagaagcaatgttaacgtgaagctccacaaattggcccaaatgggtgaatcacatagtaaaagtgatagctatcacatgacaaagttgccgacaatccagaaaatagccattgccgaccatttcacgcaagggggaagtgtcttttgtggcaagattgagaaatttggccacacaaggttggatgaagttatgcgtgcttccgataaagacgccgcccttgcagtggtgggtggagctccatttgtcttcgcagttgtaacagaggcccttctcccgacgaaaagccattttgtcgggagtgcgttgaacaaaaggggccttgggtctggggagatgggctgcaacgcctattcttccggggagagattagagataaagcaactgaggaggaagtccgatggtgcgattgacgagtcgttcgaactctgtcaaacattctttcacggactcgtgatgagaaagcttgaagagagcacccttggggtcgtcgtaaaacgaagggccgtctatgtagaacaaggcgacgatgatgtgttcttcgttaggagtaccttggtaataaaaaaattgggagatcttgaagatccatcccatcggatcgtgaccgtcgaaacggggaatgttgagtttgacgtgaggtcgttgtgggagatggtaaggggaagtcagagtggatacggtgttagaatgtttgtcgaacaaggaatcgtggtggagggtcaagcacaagatggccttcaaacgatccgtggtcgtcttgcgggtggtatggactcaatgtccacccccaggctaggtgtcatatccaggcttagtgccactcccatgcttagtgggatcccaggcttagtgccacccaagtctctgggttattccccggcttag

SEQ ID NO: 5441 - DNA, 321 bp, Glycine max
  Peptide Sequence Number=SeqID_97126
atggaaccgcccactaagcaatcttccaaccatcatatcattcttcaggtaggcattaggattacattgacaactcccacatttacagccgttaatactcatgtggtatccatggcagctgctaccaatcaaccaaattttatcctggaagattgcatagatggtgaggaagaagttccaaataccatggctccaatactagagatgacgacacatgtcttgtctaccgtacgtcatcaaataaagatgagggctgatgatatcatgcaacaactttcgaaacaattaggtgatattgtgcaaacccatggtcatgaatga

SEQ ID NO: 5442 - DNA, 203 bp, Glycine max
  Peptide Sequence Number=SeqID_97127
gtgttgctgtcattgcatcctttggttatcaaaaagagcatgatggctcttgggtgaaaaagggtgctcgacctgttgatgaagaaggacatgtgggcatgcgcttcaatgagatggagtcaagaatcaccaaggtcgaagaagatgtttcttatattcgtacaagcattgatctaccaccaccgccaccgccatcatcttag

SEQ ID NO: 5443 - DNA, 972 bp, Glycine max
  Peptide Sequence Number=SeqID_97128
atggccacatccactgcgatgtcaaggccggaaacattctcatcgattcacgcagcaccgtcaagcttgacgactttggtgtctctgcctgcctctttgattcgggtgaccgccaacgcacacgtaatacatttgtcggaacaccttgctggatggcatccgagagctgacatatggtcatttggtataaccgccttggagcttgcacatggtcatgcccctttctcaaaatttccaccaatgaaggtacttctcatgactctgcaaaatgcaccccctggccttgactacgaaagggataagaagttcagtaagccttactattttcaggttttgcctccatctgttcgcatggttaagtctgttgcttcaaatttccttttggaatggttgttccaacacgagcatgaacaccgccaatggtctgctgcaatttctcttggattaatcgctagttgccttcatgtaacaaatcataaagagagatatcataacatcacaggatttcttgaggatgtgaagtggcttcaaacagtcaccaaactgccaattctggtgaagggtgtgctgactgctgaggacatattgcctattggagaaaatttgtggctgaatattactctcctcgtgcaaagaaacggtggtgcttgtcattatatagcaatgttgggcatcatgcacttggtgtttcccccccaagcagctatggatgccttaatctttgctaatattcaaatatttaatcatgcattcaaaatgatgcatggtagtgtgacatatgtggttctaaatctggaaggggatttgactgttagactgccaatgttaacagttctgaagcttcacagttgtgatggcatcactacagcctcaatgactgcaatatctcacagtaatatgttggaggatgctgctaaattgataattaaggctattgagtatatgaagttttctggttgtgggttttcctga

SEQ ID NO: 5444 - DNA, 1086 bp, Glycine max
  Peptide Sequence Number=SeqID_97129
atggaggggcagaggagactttcagacagaggttccatggagtgtaatcttgggatatatgaatacaaggaggatcgcgacgaaactgcaaccgtgactgggaccgcaattcaaaactttggttacaatcttggctctttttgtctcatgggctctgtttttggcctgattctgatggtattttcctgggtgtcgtttacatttccgggatccaatgctcaggagggtgtcaaatcagctcatgttcttgacctcatcataagagatcacacgttcaaggcattggacaagaactttaggacagcaataccacaatcagtgagcttaccagcaaatctttcaggcattggaattgatgctgtgaggttcagatgtggcagtttgagaaggtatggtgcacacctaaaggaattccatcttggtactggtgtaactgtgcatccatgtattgagagggtcatgttgataagacaaaacatggggtacaattggtcttctatatactatgctaactatgatctctctgggtaccagcttgtgtctccaattgtgggactcctagcttacaatgctgatgaagatgcaaagtcaagcaacccttttcagcttgggattgtggctggagaaacgcctatgacaattgacttcaccaatgccacaaagatgaaccaagatggggtcaagcccttgtgtgctagctttgaaggtgatgggagaatgacactagcaaaagcaccaaacccttcaacaccacttgtttgtgttgcaaagaggcatggccattttggcttggttgtggagtactcgccgccggatcagttcaggaataagcccttaagtaggtggaaagtggcggttgggagcactattggtgccgctttgggtgcttttcttttaggccttcttcttgtggcaatgcttgttagggtgaagaagagatcaagaatagtggagatggagaggagagcctatgaagaagaagcccttcaggtttcaatggttggacatgtgagagctcctactgcacccggcactcgaaccacacccgtaattgagcatgagtatatacctcatcatcctcgttga

SEQ ID NO: 5445 - DNA, 123 bp, Glycine max
  Peptide Sequence Number=SeqID_97130
atgatcccgaaaatagccagaatggctagcggtacagcgtgccccgcaggtggagcagggtggccagaatggctagcgaacagggcaagtaccgcaggtggccatggctatactcgtggatga

SEQ ID NO: 5446 - DNA, 399 bp, Glycine max
  Peptide Sequence Number=SeqID_97131
atgcaatcacagggactcgcactgcctcctgagccagaggttggtccttcagctgctcgtgtagcacaaaggagagttgtgttgatccctcaaggaacgaccaagacacgggggtccataaccgttcataacatccatttgtgtcatgatcaagtcaaggttggtgttgaggaagttagagatgcagatgcttccattcctgtactcactcaacaggttcagttagtgggacagacacttaacacctttgttacttggccgacacatcttgtgaagcgtttatcagaacagggagctatgggatcggacaaacctacagataggccggatcatgatgtcaatgatcctctatatcttatgacattgaccatcccacaactttttctaaatccattgcag

SEQ ID NO: 5447 - DNA, 282 bp, Glycine max
  Peptide Sequence Number=SeqID_97132
atgaggtgtgcaggtttacaaagcactaagtattgtagactgtcgcaacctacccttttgcgggcgagcgaggcgaggctcacgggtgcgtcttccaaaggaggaaaatgcatggagtcgccaccaacatttatttgtggaaaacgtcgaaaaaaccgaaggaaaccggtcatgaagaatattccaaattcgggagttgtatttatgtttaaggaaggtcgacaaaagcggggctcttgctcttacgtaccctccattgaagaggaaatcagacctacgtag

SEQ ID NO: 5448 - DNA, 1134 bp, Glycine max
  Peptide Sequence Number=SeqID_97133
atgggtcaattcatgagatcatggtcatctcaagagggtcgtggtcaaatcatgagggtcgtggtcaaccacgagggtcatagtcaatccataatcacccaaggttttatcatcacttccgaccatagccatggtggattcaccacaactgttcttgctaatacacctcactcaagcattaaattctgggcacttgagagagttgtcctcgtagttaagacctcgggcttaggcaaggacatgagcgaggtcacctccatgcttaagcgcggtgttctgggatggcccgtactaagacaaccgctcaaaagaaagcccttccccaaaagaaatagaggctccaaggcagtgggggatcaaagagcggcagatggaactagttatgagttctattcgaatacctaccatcctatggaagatgaagatgtagttcttgagtggtacaacactatttgcaacatttgcatcttgtatgacacacgtgtcattaacacctatttggcaatgtcttctccaaagtcagaccttaacaaggatgttgcctaccttatctatgctattattgctgggatgtccatgaatattggttacatcatctccaagaagattaaggagtttgtgctctcggccaacaccacaaaccctacacgcaaggagtataggttgattggccttcatggatccccctatgataccattcgacgacccatcaaccaacagttcatccttgataacagcgcactagcatcccttgacgccttgatgagggagatgcgagccactatagcagctaaaaaccatgccattggcatgccactgcccaaggaagtgggcatgaggctgcataggagggaagtagggatagcagcagtggaaaccagattaaggcagactcttcctcagatgaggaggagctctaagggagattcattacagccaacaaccatgccattacacatggctatggattcattgaaagggttcacaccctccatatcaatacggttatggattcattcaaaagggttcaccctccacaccactactggagttggaggagctacacaagaggatgttgcccaaaagagtagtggggataatgcaaactcttctttagacaaggctgagtcatag

SEQ ID NO: 5449 - DNA, 297 bp, Glycine max
  Peptide Sequence Number=SeqID_97134
atggagcatccacaaaggatattcacttggatcaatagctactactacaattacacagtggaggaagaagggtgcctctacaagaataagtccatcctagtgcatgctcgacatcaagttggaggaggactacaaactggtagcccaactgtaaacgaggctctacctagtgatgacggaagaagtggttccaaagaaaggagacataatcatggtaaagaatgcaaagaacaagctcatccccaccataatcgtcatagggtggaggatgtgcgtcaattacagaaagctgaataa

SEQ ID NO: 5450 - DNA, 588 bp, Glycine max
  Peptide Sequence Number=SeqID_97135
atggacatgtttggatggattattgtccagataaaaaatctcaacccaaaggtagcactacactccatgctcctcgccctacggcctggttcagaaatgaggtctgaaagattggacaaaagtgtgataagagataaggaggtcgagcgagatagaggcaccaccagtaaagacacaagtgacaacctccgcaagaacatgaaaatgaggttgcctatcaaatcaaaggacatcaaaatcaattgtatcaaccaaccatccccacgaagtcttcctcctatcactttcactgatagagacttcaagggtatcaaccctattaaccaagacgaccccatggttgtctccatcgtaattgctaacttcatggtgtctaaggtcctcattgaccagtggctaagtgcgaggaagaatccagaagaagatgagctgtcaggttcgctgagcgcaccgctccaggtcatcaagtgcaccccttcagctcatccgctaagcgagagaagtgcgctaagccaaaatccacttatgcgcgctaagcgattaagatttgtgctaagcacgcgagcacggaccaacccacctatttaa

SEQ ID NO: 5451 - DNA, 135 bp, Glycine max
  Peptide Sequence Number=SeqID_97136
atgtcgaccacaaacgatttggaaaccaggacatttgtagtcgtgagaggggaaaggacaaaggaaaagaagggaaagtccaaggaatccaaggaatacaaagattgggatagaggaaggcaagattatgaataa

SEQ ID NO: 5452 - DNA, 348 bp, Glycine max
  Peptide Sequence Number=SeqID_97137
atgtatcctctcttgttctcagttacaacaacccaagtagatgtaccctctacttgtaccacaaaggatgtaccctccaatgtgttaagacaaagttctcaggcggttagtccttcgaaactttgtgaaggggaaacaaaagaattctcaggcgaaaactttagaaagctttttgcgaaggaagaagaagaagaagaagaagaagaagaagaagaagaagaagaagaaaaagttcaaagagattcaaaggttgtaaaagaatatgtggaaaagttgtttgtaaaggttgtaagtattgtaagtgctgtaagtgttcttcaaatgcaaatcaaggtattgcttttatag

SEQ ID NO: 5453 - DNA, 128 bp, Glycine max
  Peptide Sequence Number=SeqID_97138
atggctgattcagaaatttgtaaacagatttacactccacaacaataccacaaagaaattaggaggaaaaggcctcaatataaacctcccaatagacaaccctctaggaaaaagaattcaactcgtag

SEQ ID NO: 5454 - DNA, 525 bp, Glycine max
  Peptide Sequence Number=SeqID_97139
atggtgggtctcatggtatttttccgcttagggcattacgccaacattcctttctctcatcataagacctactcatgctgtgacgtaaaagctgaagacgctgttgattatgaagatattgatgaagagtatgatggtccagagacagaagctgccaatgaagaagactatttattgccaaaaaaagaatttttctctgctgaagcctctgtatgtttggaatccaaagcttctgtctttgatgatgaaaattatgatgaagattctgaaaaggagcaagactttgtgaatgacgattgtaaagttgataacatccctttagctggggagcagaaagagagttttgtggatgcatctaaagaagagagttcacttgaacatgaattacatgttgactcaccgcagactgaagaattggatgctgatgtacaaaagcttgaggaggtgatcggagagttaagcccaaggtgtggaaagtttatgagaggaaaaatagaaggcagaaaaggagtgatgaggtggtag

SEQ ID NO: 5455 - DNA, 840 bp, Glycine max
  Peptide Sequence Number=SeqID_97140
atggaagcggaagtgtctgcgctggagagtgaggtggctaaccttaaggtgacgttagctgagatgcgtgcccaggctgcggcagatcaagagcgacttgtttgtttgctcacacagagcaaggacaccggaggttccgaggagatggacaaaatcatccaggatgaagactcgagtaattctggttcgtttgacatgcagtggttgttacaaaagctgcatgggggtgctcttgatgaatttcggcaaccagtgaagaagaacacctgcacaaaacttaaggtcaacctggctcagttttgtatggatggtcacactatccatttcttcaaagctctattggatgaggatgatcaactgacttgggagaagttgaaagatgccggtagcgttgaggagtacattcacgatttcaagaggcttgtggcgcaggtgacatggttactagacgaacaatatatggggtgttttgtccatggtctgcgagacggaatcaaaggccgtgtgagaagtttgaagacattgggtcccatttctcgatctcacctattgaacttggcaagggcagtggagatcgaattgcaagaaacacgacccagctggagtgggtctcgtttttctgggtcacgctggtctggagggggtcctttccatccgagccatcaatgcccagactgccatctgcgcattatgatcacggaggaagatgagggggatgacggagagccctacacaacatttcctccagcatatttctatacagacagaaggaataaggggcaagaggtggaagtattggtggctggcggtaacatggtctatttggaagctcagaaatag

SEQ ID NO: 5456 - DNA, 192 bp, Glycine max
  Peptide Sequence Number=SeqID_97141
atgggtatgaatgaagcagctgaagatgcacatgctagtgaggcttgtcaaccaatagccgaaaggttggagcggttgctcaacctaaggataatcattgaaggcacagagacatacgatgtcatggaggactgcctgcggatcgctagaggtgtcactgcagatgacaatgtatatgtgcggttgcgatga

SEQ ID NO: 5457 - DNA, 831 bp, Glycine max
  Peptide Sequence Number=SeqID_97142
atggctaccaatagaagatggaaaatatggtggttggcagctacaaagtcaatttggaagcttagaaatgatatggtttttcataatcagacctttgttatctctaagctggtggataatgcaattttcctcacttggtcttggctgaaagggagggaaagggatttcaatgtaccttttcaacaatggtcttcagctatgtctatagcttttaaaacggaacagtgcctcggcctattggtgagcgaagtagggtttccggcgaatcagtggttatggttgatcggagattcgagaattgagttgcagcttgttgttgccgcacggtcttatttatttattttgaaagcgagatcgtttattgagagaggggttatgctatggtgtgggtggttttattcgactccgtgggcgtataatcttcctccgttgatgggaatgcagcaatggacggtcagagttttcgctggagagaacagtagagaaattttgaaggatgagcgattcacggtttttctggtgttcgactttggcaacttgtggattggtgcaccgtgcacccttgcggtctacaatataaaggagtctatcctttaccttgccctgcgtcttcatggtggaggatgtcgggttgtcgccgacaatagtgaggaatttgttgacaatggtgattgggtttttggtgtcaacattgtagaggacaatgagcttgatgcagtcaaggtaggtgatgatagatttcatggcaatggcaacaaagaaaagggtggtgtctttggacaccaatgcaaccatgacgagggaggttgtgcaaaaattatgtcatcgtga

SEQ ID NO: 5458 - DNA, 255 bp, Glycine max
  Peptide Sequence Number=SeqID_97143
atggctgctgttggagtttcgtctggtgtggtttcatacggatcatatgatccgtatgcgttatatgatccgtggaagcagccaatagcagcgccgccaaagaagaaccagcaagaagacgaaggcgcaggggcgtggtcgcgaatgaagaagacgaacacgcaaggagggagagcgaaagcagcgtacggaaggctactagcattttctttagcttctagcacctttgttgtcgctgcaacaaaatctgattaa

SEQ ID NO: 5459 - DNA, 1056 bp, Glycine max
  Peptide Sequence Number=SeqID_97144
atggaagacgcacccgcgagccctgcgtcgccttcccgccgaagggaagagcttgaggctagactatctcaagctaggtctgatgttgcatcaagtgttgaattgcaacctcctcctcccctagccattcctaagccctctagcgaggaaggaggtcagcctgaagccagagtcgaccctcctcgagctttcgaagctggtgaggatgaagttgtcgaggttacaccccacgttcttccacctacaacaaccaagaggaagcgtaatgaaggggctggggggtctgctcaacacaagaagtcaacggtccccttcagtcttcgggcttggaagcaggctaccagctcccaaggtcaaccttcagcccccttgcctactcaagttgttgttgcttccgtgactgtttctgattcttttgtgcctcattctctgcctattcagacagttcctgtcccttcttccattagttcggtcgctgtcttagtgaacctgcctcgtccttccccggccttgccaccttcagcttcagctgtcttgccttcgacaatgcctttttcttcttcgcgtccaagtgtctcactagaccatgagaatggccaatggcacaaagagacacatagtaagattacttccttggaggctgagcatcccaaagtggccaacgctattgtcgcacttgctaaagtcatcaggtccaactaccaattgtcgtcccgggtagacgatgtttatgttaaacttatgagcacaagactggatggtgccgaggtgtttagacattgtaaagacttgttgaaagaaaagaatgatttggcaagcaaggtggaatgtgcagctgagttaaagaaagagcttaatgcgatagaagccgtggagcagcacgagaaggggtttttcaaggctgttaggcaagccgagttcttcattgagggtcttgacttaagtctttttgacccgtttaaggatgtgaaggacggtgaactacttgacgaggaagagattgttgatgggaaggaggacatcgacgacgaagaagacgatggggacaatgtttag

SEQ ID NO: 5460 - DNA, 604 bp, Glycine max
  Peptide Sequence Number=SeqID_97145
atggaggtcgacctgcctttaggttggaaaccgctcaacctagagcgctatgacggaactactgatttagatgaacatctggattggtacggaggactccatccctggtccattgacagcttcaacacccttgtcgaacagtttggttcccagtatgcgacgagccggttacaccatctaacatctgtagccttggctagtttacgccaagtagatacttcgcaaatttatggacagttcattgatagtctatgcaagaaacctcctagcagcatggataagcaacacgagcgagctaaaggtaatattcagatggaagaaatgtcaaggttcagaaatgaagtccaacagggaccgaatagagaagagagggagataaaggcatcatccacaaaggcatggacgtcaacctcagcaagagcaggaagacgaactgacacaattcaaccacactatggaccactccttggttatgccggagagagtgtggaaaccagaggttatgtagacctaatgaccacctttggtcagggcaagctctcaggaagtttcattgtaaggaaaatgtttaatgagcttggagccattgtctctacaccacact

SEQ ID NO: 5461 - DNA, 207 bp, Glycine max
  Peptide Sequence Number=SeqID_97146
atggagatgcagcagaagataaaggagaagaggctaaaaccctatattactataatggccaaaatacacggccaaaaagaagaaaaacctattctaatatttacaaataagagtggacccaaccttggctcatgggttcagaaatttaccctggggttcatgagaaccataggaccttctttagccactctagtccaatcctcttag

SEQ ID NO: 5462 - DNA, 624 bp, Glycine max
  Peptide Sequence Number=SeqID_97147
atggacagggcgaggttagtctatgatctggtgaccaagatggacatggatgtgagatctttcatttcaggccagatttctcaaatggcccagtccaactcctcttggcttggcttccctgtcctcatcactgctttatgcatcgctagaggagtcatcccagactcgttgacctttgagtccctcaaccctgccattaatttggcttatatcaggaagaattgttggaacccagatgatcctacgattacctttctggggacccgcaatgctagggctcgaggaccctcagacgcttctgctccttcttcttctgccccctctgctccagcttctacattagcaccaccagctcccactcctacacctccaacaccctccagcacctccgctcaaagctcagacgccatggtgccgatgctgtggcctgaccaggagtctatccttctcctttgggggaaggctgaggtagaggttaaggagacacttgaagacacccctgttgccacaccgattgaggccactaagaaaggagacgacactgcagatgccaattacgatacatcattgccagctcaggatgctctctcctcacctcatgacgaccctacaccgggacaggat

SEQ ID NO: 5463 - DNA, 2050 bp, Glycine max
  Peptide Sequence Number=SeqID_97148
atgaagttctctcatgacatagtctgcctgttggcagttcaggcatttgagcagggatgctggggtcatccagtttggttcctcctcttcttcggccataattttctcaatgtctatagtgggagtttggagcgtcccttggatgatagtcttgaggtgaccggtctttttggtgcaagccagtttggagagcaagtcttctctggtgttgctctcctaggggacttcgaggataatacatgccctgcttggattcgctgtccacgtagaggttccactagtctggggaaggctgagcaaacgattgcgttagctactaagaggtataaaagtaggcatacttctgccctgggttggctcaggactggcggtgtggcaagtgagctttgggagaagcctagacagggatgtcagtctaccattcaacttttggatttcctagatattggtaggactgcgcatctccaatatagctgtgcatttgttgggattggcttttcttcctcgacttgggatcatgaagccgaggaacttgcctccatcgaccctgaaagtgcatttttccaggttgatgcgtatgtcgtatttgcggatttctctgaatccctcttccaaaactgccatgtgttgggatatgctatgggatttgacgaacatgtcgtcgacgcagaactcaacatttcgtccgatcagctgtttaaagatttggtccatcaatctctggcgtccaagaagcttagtacttggaaaccagatgctccattgactatcctatcaatgttgggcaaagggtatgcatctttgggacatgtcgtgctaagatcggacatcaattatgcgtctgtgctcatggttggtgaggtccctgctgagttgcgtagactacctagaagtgtcgttgcgcgaatctacatcgaatatatcatccaggcttgcttggtagacggtcagggttcagacttaagacctttcgcccaggctcatgacttaagtaccaccacccgctgtggggatttctgtgtagcactatcgtgcctgcttttgatcttccttggcagtcatgatctctcacgtcaaggtggggaacttcatcttcagatgcagtgtggagacgatggctctaagctcattgagcgttttcctaatttcgatgaggaccttggacaccatgaatttggcgattatgatggagacaaccatgaagtccttaggttgatatccttgaagtctctatcggtgaaagtgattatgggggttgttgctggcgtctttgatggtggtgtctccatcttcctcgatcttctactttgtctctttttttgtcgacatcgtggtgtctgtggtgctcctcttggtgtcctccgggtcttgcttccattgcatgactattcgaccttttcacaaactgggctaggtacccaaccttattttgtcatgtataaccttggcatgagaggaagtgaaaaaggtagttttatgggtacctctgggttgaaggcctccttaaggattatagtgcgattggctgttagggtcggtcttggtacctccttctctcttatcgcgcttttgtccaacttgttggatctcgtttcttcacttggacatctcttccatctggatgtagcctttagctcattcgcacaactcatccatgctactagggggtatgtcgacttccatgatgcggtcgacaaaggggtgttgacgagtagttcgcccttcaggacggtgtatatgggagagactaggatcaacttaagtgttgactgtgtatcggggctttctgagctccttctcatggtgtcgctccatctctgcaatgaagttttgagttgttggagagtatcggtaaccgtcatggttgctagaggaggattggagcctttgaaagaggtctcatgtctaaggtcggaacaggtgctaaccatgggtggaaaagagagggtggacgcagctaaggttttgggtgttcctatatggatgactcagatgacctgggttggtgacccaaaagatgttgaagaactctttttgatggttggctctg

SEQ ID NO: 5464 - DNA, 867 bp, Glycine max
  Peptide Sequence Number=SeqID_97149
atggttaggaccagaggattaggttgtgccttaggtcacgttactggcagaggtgtgggtcgaggagatcgtgatgattccgatgatgctccgcagcgtcgaaggcctactgcatccgcacggaggcagcgagtccctgtgactgcggtgcacaatgagccagtggtccatgcgccagatgtagaggctgacatatttccagatgacccgatggcaccaactgatgtagaggacactggggcagacattcctgcagacacaggcgcgcaggctgctgaggatgagcatgagggattttcgggtggtccgagcgacccatccgtgctgacccgtgctgggacaggactaagtcctctgatcgcgtgttcggtagacactggcgatcagggacttttgtcctcgtttgtcgagcggtggcaccgggagacgtctagtttccatctccctgtgggagagctcacgatcacgctggacgacatctcctcacttctgcatctgcccgtggttggtgacttgcacgcctttcagcccttgcacgtggatgatgcggtatgtgatatatatgagcgtcgatgccaggcaggtcattggacaactgcggctcgcgcatatcttctgcatcttctgggttgcactctgtttgctaacaagagtgcaaccaatgtgtatgttgtgtatttggaggcccttcgtgacctcagtcagactgggaggtacgcctggggagtggctgctctgtgctggatttacgagcactttctctcagtcgtggagtccactgttgatcaggactacgacgaggattcctcgcgtgtcggtttgttttataggtgttgtctatcaaaaacaccaaattacatgcgttaa

SEQ ID NO: 5465 - DNA, 807 bp, Glycine max
  Peptide Sequence Number=SeqID_97150
atgctccaaccatatgggatcaacataggcttaaaggagcactcaaaccgtgtgacccccaaggcctacactttgaagagtccgtcagggcctctccctcctgattcaggttgcactctttttgctaacaagagtgcaacacacgtgcatgtggtgttcttgggcgcttttcgagacctcagtcagagtggaagctacgcatggggagatgtcgccctagtgcatatgtacgataatttgaatgatgcttgtaagagtgacaacagacaacttgctggatatatcacactattacaaatttatgagcatttttcatctattgctaaggcttttatggatgaagactatgatgaaagacatatccgatggggtcctgttgttgtcatacaccgaccagagaagatttgtgttgtgcttggacaatgtgcaccggactacttggactggttctacatgatttcgcatccattcatgaggtcgacacaacccggggatccacccaaacatccacctgtcatgcaagatgaaacgtatgttgaaccagatatgcctcagtactcgatggcagcaacagctatggaggaaacacctgtccatgcaccttctgatatggagcatcctagacatgcagaggcttgccaagcaatagttgaaaggttggagcggttgctcaacctaaggataatgactggaggcacagaaacatacaatgtcatgcaagactgcctaaggattgctagaggtgtcactatggatcacaatgtatatgtgcggtcgcgacaaaggcgatgcacggatcacgcatga

SEQ ID NO: 5466 - DNA, 294 bp, Glycine max
  Peptide Sequence Number=SeqID_97151
atgggtaccgatgaggatgttgaaagggcccagagagtgacagagtatttggaatatttatgcaagtggggttgttgggcacttaaaatattcaggactcaggagtatggaattagcttcgatagttggagaggtagaagagagtcaggggtctacgttcaggaaaagactttcatgtttatgtgcatggatagtgatggaactgttgtattgatggaccctgacacattggatcaaattgaagtttccaaggacttgttcaacaaggattgcttatatctacgaggtggataa

SEQ ID NO: 5467 - DNA, 534 bp, Glycine max
  Peptide Sequence Number=SeqID_97152
atggttggtgtgccagttatacgtattcctctacgctcacacccgatcgatgttccacgagctcaaacgttgtttcttgaagaagacggtctcacaagtgaatccaattgttatctggccttgaacgttggcatccttgacatgaatcttgaaatagtacatgaggcgctgggtaggagcaggcttgtttgcctgaatgacactgacattgtggccgtgaaggttgacgctgcctgtgatgactcctttaacaccatcacgaggggcctcacgaagcacctaagagcaatcagcgcggcagaagttgttcccctgtccgaaggggacatcgatggtggtgatgtggatgcatgcggtcgatggtgtgagaaggtgttggtggttttgaaaggtggtggtgttgtggaaagctgtgataatgatggtgttgaggaatgtggcgttgtttcgagttccgaagatgagtttgtgcgtgagagagatagacaaagggattcactcgtagagttaaataatttcaaaagcattccatga

SEQ ID NO: 5468 - DNA, 297 bp, Glycine max
  Peptide Sequence Number=SeqID_97153
atggtgattttccaccatggagatgcagcagaagataaaggagaagagcacttagacaatgaaggaaagctggagttgctgcacatgatgtccaacgttatgtcaaggaatgagatcgggctgcacaatgcacaatgcaagataaaagtcaactgcagaagtgaagttgcagggggatcccagagtcgacaatgtcctgacatcctgcccgagaatactggagttgctgtacaatgcaagataaaagtcaagtgcagaagtgaagctgcaggtcgatgtctagaggatgtcccctga

SEQ ID NO: 5469 - DNA, 477 bp, Glycine max
  Peptide Sequence Number=SeqID_97154
atgaccaagagcaaggacaaggatccacttgaaggacttggaggacctatgacaagggttagagaaaggaaagcaaaggaagctcttcaacaagtgttgtccatactatttgaatgcaagcccaagtttcaaggagaaaagtccaaggaatctccccaaggtattctgacacatctaaagcctacaatgttcaactcaagagctatagttgtagaagaatccatccatgttaagttcaatgatggtttaacaactgataagaaaatatcatatcttgaggacaattttgcatatatgcagattggttcgtatgttgcacccaagaaatttgttaactaccaccctcaaggtcaaatcattggagatcaaattgaaggagttagaaccagatcagcatttaaagatcttgcatcttatgctttcgtgtcagaaatagaacctaagacgatagatgaagcactgatagatgataggtag

SEQ ID NO: 5470 - DNA, 342 bp, Glycine max
  Peptide Sequence Number=SeqID_97155
gtgatggagaaagagcttgggacgttggaaatggttttggaagaaagaaggagaagaaatgacatttttccaaagctacttggactacaaggctcaaaacgcacaagtgaggttgcgttgaggaagtggataattgacaaagatacattaaggtgtaatgggcggagagcatgggtaactcacaggcctcactttgctactcttgaagggctccgagactatgcttttttgagttgggagatgaggggttggtatacaatgtatctatatgtagtgatcgcacccgactgtcatccagatgatttttgtaagaccatcaagacctggaaggattggtggtag

SEQ ID NO: 5471 - DNA, 105 bp, Glycine max
  Peptide Sequence Number=SeqID_97156
atgggtttgggaaaagttaagagtgggatggttaaaacttcaagaaagcttagaattgaaatgattattttttggcacaactgctgttttggcttaaatggatga

SEQ ID NO: 5472 - DNA, 213 bp, Glycine max
  Peptide Sequence Number=SeqID_97157
atgttgttgaccaaaaacgcaaatttgttgaccattatttgtcagattcataaagctcagcaagttagaatcatggttaggaccagaggattaggtcgtgccttaggtcaggtcactcgcagaggtgtgggcagaggagatcatgatgatccgatgatgctccacagtgtcgacgacctactacatccgcacgaaggcagcgagtcgctgtga

SEQ ID NO: 5473 - DNA, 708 bp, Glycine max
  Peptide Sequence Number=SeqID_97158
atgaaacttcccttttaccctgaattggttaaagttttttattcaaactttgaaattcaagaagattccttgattttcaaagtctatgggattaggatggtcatagaccagtcccttttctttgatctcactcaattatcaagtgatggcgtaccatttgagggtttacttgatgatgagtggaagtttaatttctctgtatctgatgcccgccggatggtttgcaccaaccaagtggatataaccggaagacttcttgccggttcattggcatttgaatgccgcatcatgaactacttgattatgcgcatccttctccctagatcttccaaccttgcacaggtgtttgaggaagatttgataatcatgtgggttttcttaaccggtcgtcaaatcgactgggcccatcttccctttgtcaaagtcaagagatccttctctataggtgcaaatgtagtttcctccttcggttactgcaaagaaagggatggctcttgggtaaagaagaatgctccaatacaagctgctgaagatcgctctccatcaccacattctcagagagatgactcttcatctcttttgcacagtattcttgaaaggtttgatggacttcaaacctatgtagactcaaggatcacaaaggttgaagaagatgtcaccatcattcgcgactgccttgatttacctccaccaccaccatcagtttag

SEQ ID NO: 5474 - DNA, 267 bp, Glycine max
  Peptide Sequence Number=SeqID_97159
atgtcacaggcgagggcaattaattttgaagccaacagtgacggtgaatcctccgatggctctgatgattggcttgcggcagagctccatttgcaccaccgggttgctctcaaagtccttcacattgttggacaaactttgaacacacattgggatccctcacccttgtgttcaatgattctccaagagacaacccgtctcttgattacaattctcacaatccaagagacaaccagtctcttgattacaactgactttctgagatga

SEQ ID NO: 5475 - DNA, 735 bp, Glycine max
  Peptide Sequence Number=SeqID_97160
atggaggtggtaagtggtatttccagtatgtacctgaaataccatcatcatgagttcatgatcaaaagggacttcacttttcaactcatgacaatgataagcaaacccctccatctctcaagcaacaattttgaaacttccagaggaaaaatcgtgctgttcggaagccttgaggcaacaaccttcaatctgctaccaatgaaggctaaactgggaactggagctccagtccagagctattcaagctcagcctcaacattcactaagttcactaacttgtcacatgcttccaatttccaaatagggaataacacattaacaccattcaaaatctgctttcaaaaggaatcaaaagcaatttcaatattaggacataccactcaatccccatacccgtgcaacatagggcttattggaagaaataccaataccagaattcaaaacataaaatgggaactcactactcagcttcagcctcgcaagacaaatcctgacctcgcaaacatatccaaaacttctattggagaccaatatctcgaaaccctgacaacgaggtgcatgcgcaaaacaaaccaaaaggcaggcacatattccaccataccgtatgttctctatcatttacttgggcaaataatcaaacacgcggtgcgcagtgaacgcaacagagggacaatgctaatcagagagttaataagcaacgaaacacaagtgggcttagtaaatggaacgaaatga

SEQ ID NO: 5476 - DNA, 297 bp, Glycine max
  Peptide Sequence Number=SeqID_97161
atgactagtagccagcatttgatttacaaagctgtaatcgattaccatgagcatgtaatcgattaccaatggtacattctttgtggcacaagtagagggtacatctacttgggttgttatactgagatcaagagagggtacatctcttatggatcagttcaagtggaggatacatccacttggttgttcaaagagaacaagagagggtacatcccttgtggatctttggcttgtaaaggattttacaaggttgaaagaaatctcaagaaccgttggttgcttggggactggatgtag

SEQ ID NO: 5477 - DNA, 141 bp, Glycine max
  Peptide Sequence Number=SeqID_97162
atgatgcgcttagcgaatgtactctcgcttagcccaattcagatcgaattgaattgggctaagctcgcccatggccagcttagcgagccaatcaccttgagatgcagagaacaaccccccaatatctatgactcattataa

SEQ ID NO: 5478 - DNA, 480 bp, Glycine max
  Peptide Sequence Number=SeqID_97163
atggattccatagacgtggtcgtcaacatcgaaaatatcattggagaggaagagagagattgtggtggttgggaggaacaaatctggggaagaagagaaagaaggaaaataataaagcactattgccaattgacatttgaggaggggagtaggactaccatcgtgttcgacgaccggcaagtgcatcggatcgcgcaagtgagcagtggtgggtgcgaaggtagatgggcaacgtgttggtcttcctattgggcgactgatgctactaatgatgttctctacctaacaacgttcctgtgttctatgttgtctcctggactgctaaaccctgatatctcctgcatgtttagcctaatcctagccaagcgtcatcctcagattcctcttgttggactaaacttgaccagaactgcattaagacatacataccaacaactaggttatcgtaccctgatcccttgtgaaaatatgataaactag

SEQ ID NO: 5479 - DNA, 696 bp, Glycine max
  Peptide Sequence Number=SeqID_97164
atgcctgattttattcttgaagcaacagggcctaaagaaccaacaacaatactggatcgaatgacagtcaaaagaaggggacaagctgtcacaaaagtcttggttcaatggaaacatcaacttccagaggatgcaacttgggagttctattatgacttgaagaggagtccaatccatcagcagatagaaaagggggctgtagaggtcgtcctcgtcagagaagatggttcggagatgcaaaccatcagaatggaattgggggagggcactggaattcgagatcaacaactcagaaagagaaatgggttatggaaagggcaaattgggtttttcaactctcattaccaacctcactgccgctcaactccattccatcgtgaccctcttttgaaacggcatatcccgatcccatcttcttcattgatcaacagtcaccacgtcgacgaggaagttcccagcgacaccgtggaggaacttgtctttgtgggttcgtcgaagttgtcgttagaggtgccccctctgcccataacacacggtgacgcgcaagcggtgtggttgtcgttgcgaccagtatcggcgtcggagttctcggccaagcttctccctctggtgacgaaacacgtggcggtgccagtggttttgccggaggtgtttcacattgaccacccacactaccgccaccgccacggccactga

SEQ ID NO: 5480 - DNA, 650 bp, Glycine max
  Peptide Sequence Number=SeqID_97165
atggccaaaacttcatcctatgggagaggtcagttcgcatcttcctccaaggaaaaggaaaggaaaggtatatctcggaacttcatgtattatgacactgcaaaggagatatgggatgttgtgaaggagacatactcaaatattgacaacacttttgccatattcgagatcaagagcctactccatgacctgcaacagggagaaaaattagtcactgaatttttcaacaccttgagtagatactggcagcaattgatacctacgaagtgtcgtaacctacccttcggctggagggcaaggcgagacttgaggaaaagggttcgggagttctttacccgcgaggaaggggacttggttgatttgcagcttgcttgggtgagctccaacgagcaagctggagcttgcccagtaaatgcagatgacattgatagtctctgcgagacaacaaactatgatagtcttcgaaaagtaaaggtagatgacattgatagtctctacaagacaaaagatattgatagtcttcgaaaagtaaaggcgaatgacaatgatagtctctacaacacaaaagactctgatagtctttggaaagtaaaggagcagatgaccttgattgtctctgcaagacaacagactatggtagtctctgaaaa

SEQ ID NO: 5481 - DNA, 236 bp, Glycine max
  Peptide Sequence Number=SeqID_97166
atgacattgatagtctctgcgagacaacaaactatgatagtcttcgaaaagtaaaggtagatgacattgatagtctctacaagacaaaagatattgatagtcttcgaaaagtaaaggcgaatgacaatgatagtctctacaacacaaaagactctgatagtctttggaaagtaaaggagcagatgaccttgattgtctctgcaagacaacagactatggtagtctctgaaaagtaa

SEQ ID NO: 5482 - DNA, 171 bp, Glycine max
  Peptide Sequence Number=SeqID_97167
atgaaagcgaaagtgcacaatggaggcttggggctgctgccaagggtgacccccgaagggggatccctcctcctcttcttggcaccttacaattactcaaacactctcaactggctccttgctgttgcttcctcctctgagctcccctttcgtgcaaggctcactctctga

SEQ ID NO: 5483 - DNA, 297 bp, Glycine max
  Peptide Sequence Number=SeqID_97168
atggaggctagccagtgcattcctggtaagggctttgttctgaacgctgagggccaaccatggaagctcctcagaaagaatcttactaccttggcccagacatggagtgtcttgtcttactccaacctagatcctacctcccacacctcagacttgaatatggacagagctaggaaaaccaggtccacagcagctggtgttcctttttcttttgcaccagcagctgacatcccttcatcttctactttagattctaagttgcagagtttgtttgagggacagatgctcattatgtaa

SEQ ID NO: 5484 - DNA, 414 bp, Glycine max
  Peptide Sequence Number=SeqID_97169
atgactcaatcggacatccgagtaaaaagggactcaatcagacatccgagtaaaaagatattgtcgcttgaatttgctaggagcttcattttcaatttcgagcttctcgatttacaaagggactcaatcgcacatccgagtaaaaagttattgtcgtttgaattggctcagagcttcaacattcaatttcgagcgatctcgatatattacgggactcaatcagacatccgagtaaaaagttattgtcgtttgattggctcagagcttcaacattcaatttcgaccattcgatatattacgggactcaatcagaatccgagtaaaaagttattgttgtttgaattggctcagagcttcaaaattcaatttcgagcgtctcgatatgtgacgagagtcaatcagacatccgagtaa

SEQ ID NO: 5485 - DNA, 264 bp, Glycine max
  Peptide Sequence Number=SeqID_97170
atggcggcacagctaatccatgatcgagtggagatggagtgcctagaggaagcttgggagaccctcgaaggcaacacgaggtgccgatttcggggcaccattcgattcacggctacttctttggtgcatccagatgaacctgcacggacgcttcagcgcacggtggagtggacagctccttggattagttttgtatattttttagggtgggtgtatctaggactgactgttagccaccactgtggacacctttgctctggatga

SEQ ID NO: 5486 - DNA, 447 bp, Glycine max
  Peptide Sequence Number=SeqID_97171
atggagaggggttaccactactggaaaacacaaatgcaaatcgtcattgaggcaattgacttaaacatttgggaagccatagaaataagaccttatgtacccactgtggtggctggaaatacaacaatagaaaagcctagggaaaattggagtgaggaagaaagaagacgagtacaatataacttcaaagccaaaaacataattacttcttggataaatactttaactcatgagtatgaattgtttaggatgaagacaaatgaaagaagaatattcccaaacgaggatctcataaataaagtgttaagatgtctaagtagaaattggcaaccaaaggaacatgagatggagttgcaaagactaaatcaacatgaagaaaacgacaaaaggaagaagggaatagcactcaaagcttcatcttctattcaggaagaaagtgactcatga

SEQ ID NO: 5487 - DNA, 120 bp, Glycine max
  Peptide Sequence Number=SeqID_97172
atggcagaactcagagattcggaaggtttcgccggaaataatggaagcaaggaagaagaagaagggtttcagaagcagagaagaagaaaggtttcggggtttaggaagcaaagaagatga

SEQ ID NO: 5488 - DNA, 694 bp, Glycine max
  Peptide Sequence Number=SeqID_97173
atgacccatcagttaaaatctcgcgacatcatcgcgctgggctttatgaccttcgcgctgttcgttggcgcaggcaacattatcttccctccgatggttggcttacaggccggcgaacacgtctggaccgcagccattggcttcctgattaccgccgtgggtttgccggtgctaacggtagtcgcgctggcgaaagtcggcggcggcgttgagcgtctgagctcgccaatcggcaaagttgcgggcattctgctggccgtggtgtgctacctggcggttgggccgctgttcgcgaccccgcgtaccgcaaccgtttcatttgaagtggggattgctccactgaccggcgacggcgcgctgccgctgcttatctatagcgttatctatttcgcgctggtgattctggtttccctctatccgggcaaactgctggataccgtcggcaatttcctggcgccgctgaaaattatcgccctggtcgtgctcgcggtggctgcggttatctggccggctggcccgattagcgacgcgatggaagcctatcgtaccgcgccgttctctaatggtttcgtcaatggttatctgaccatggacacgctgggggcgatggtctttggtatcgttatcgtcaatgccgcgcgttcccgcggcgttagcgaagcccgattgctgacccgatacaccgtctgggctg

SEQ ID NO: 5489 - DNA, 622 bp, Glycine max
  Peptide Sequence Number=SeqID_97174
tcaaggtgcaccttttgagggcaccattgttgatgactggaaatttgattattctagtcatgatgctcgtcgaatggtctgcaatgaccaggttgaaatgaccgcacaagcctctgaggaggatttgattctgatgtgggcttttctcaccggtcgtcagatcgactgggcccatttggttcggtaccgaatgcataaggcattacgggccaatgcacctctaccttatccacagttgataactttgtttctacgtcattttcaaattccgcttgatgatgagccattttttcaagtcaagcgttcctttgcaattggtgctggtgttgtgacttcctttggttaccgtaaggatcagaatggtcaatggctgaagaaagacgcactccctcctcaagatgagcgtactccttcacctcctcctcagcgtgaagattcagcactcctgaatgaagtccttaccgaattacgaggtcttcgttcttatgttggtgaacgtttcgactcattggatacacgctttgccgtcatggatattcgcctcacacaagttgaagatgtctcctttatccgtacttgctttgatccaccaccaccgcctccatcatcctctagattaatt

SEQ ID NO: 5490 - DNA, 927 bp, Glycine max
  Peptide Sequence Number=SeqID_97175
atggccaagtttgatccagacgtagtcctcgaattatatgccaatgcttggccaacagaggagggcgtgcgtgatatgaggtcctgggtgaggggtcagtggatcccgtttgatgcagatgctatcggccagctcctgggatatcctttagtgctggaagagggccaggagtgcgagtatggccagaggaggaaccggtctgatgggttcgatgaggaggccatcgcccagttactatgtataccggggcaagattttgcccagactgctgccgggagacgagtgcggatcatgcgcaccaacatgaccaccctgactcagatatggatgactttgctgctcagcaacatcctgcccagcgatcataattccgacctccccctgccgaagtgtcagctggtgtatgccatcctgacacggatgagcattcatgtggctcagttaatcgctgatgccatctatatatttgcaggtatggcgcctaccaggcacctctggacccggataagtccaacagggcctggatttcccgccttgatcacaggactctaccagtcgttcggcgtccccgtcgcacctagcaaggtgattcggccgcccatcacccgagcttttattgagaagtactgcacgcagagacaggtccaaggtgatgcaccacaagccgcggacgcgccgccacctcatcaggctggtccagtcggatcgtttgatacggagcagtatttgcggcatttgatgagtctcagcctgcagagccagggatttacttcttttccgtgccctactccggaccagttcagggcaaaggcaggagaggcaccagcagaggcaccagcagaggctcccgacgaggcagatgaggcccgcgacgacgaggagatgaccgatttacttgatttcttaggagggagcggggccacatga

SEQ ID NO: 5491 - DNA, 435 bp, Glycine max
  Peptide Sequence Number=SeqID_97176
atggaagcatgtttagcagtaggagacctgttgcaacaaatgatagaccaaggccggctggaagttggcgatgaggggggtgaagagcagcacatatgcatgcaatccgcatatgaggaaggtcttagagagcctaaaccttttgtgatacatttcaccagggatgcaactccccaaacgcctcgacacccctcagtagttagacctattccatttccatacaaaaacagccacgcagttccgtggaggtatgcgcatccaagcgaaaggaaggaaggagccaccgacattagctctctgtcagccaaagtaaccaatatcatggggctgagcggcatgacccgcagcagtcgcgtattcgcaccccctgacctgccaacacagctcgcaaacgctaaagggaaggcaaggatgaccgaaggacaaaatgtcaaa

SEQ ID NO: 5492 - DNA, 777 bp, Glycine max
  Peptide Sequence Number=SeqID_97177
atggaggaaccatcaaagaagcacaaaggttcttcgagtagaagccaagggcactccgaggctcaggatattccaattccttcctccatttcctcctcctcattgttctcatcggaagaaaaatgtatacggtacacaaacctcttctcctctcgttctatcattgaccctaagttcatagatatggatttattttctgatgagagtttcgaatgcattcaagcatttcaaaactcaaatctcattccctttatgtctttgaaattgcctgtgtattctgaattggtaaaagctttttattctaaccttgaaattcaagaaagtgcattagacgatgattggaagtttgatttttctgtacatgatgcccgccggttggtttgcaccaaccaagcggatatgaccggaaggctgcttgccggttcattggctcttgaaagccgcatccttcactatcttattgtttgtattttacttccaagatcttcaaaccttgcacaggtttatgaagaagatcttatagtcatgtgggcttttcataccggccgacaaattgattgggcaatgtgtaaggcattgcgattaaatgctcctttaccatatccacatttagtcactcttttcctccaacatttcaacatccctcttgattatgaaccttatgttccaatcaagagatctttcttgatcggtgctgctgtggttgcatcctttggttactgcaaagagcgtgatggctcttgggtaaaaaagggtgctcaaccaaatgatgattga

SEQ ID NO: 5493 - DNA, 216 bp, Glycine max
  Peptide Sequence Number=SeqID_97178
atggagatggagatgataacaatgatagtggacacattatcggtgttctactatgagaagatggtgggttacatgccttcaagcttcgcagatttagtgtttgttagcgaaaggatcgaagtgggtctaagaagaggaaattttgattatcctactgtgatgaataggaagcttggggaaaatggagagaataagaaggagggaggaatgttgtga

SEQ ID NO: 5494 - DNA, 270 bp, Glycine max
  Peptide Sequence Number=SeqID_97179
atgtatatattgcctactttcgaaaacaggccccgacgggtgcagagaaacgcgaggaattggaaccagagaagtggcatgcaaactgaggcagaatttcagcatccaaaagttgagccggttcaagtgatagaggtgtcatcctctgaagaggatcttgaagaggacccagaggagttacctcctgaacctgttgtggatgcccttgacttcccagaggatgatgaggacccactccctaatgttgattctccagaggatgttatataa

SEQ ID NO: 5495 - DNA, 637 bp, Glycine max
  Peptide Sequence Number=SeqID_97180
gaaggaagaatcaagattctatcttcatgcgaaggatgtccaaatgttcccttgatgggaacaaggggttgtattaattataatctcgttctcgccataagacagcttggctaccccatgagaggagcgccattagacgaaagcatcacgcctttcatcgcacggggttttagtgaccacaacgcgagggacagagagcttaggggaagcagtaatgggaccatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacggcgagactgaagggaatatgtgggccgtcatcgatgagtgcaaagagaagctaaatctagcggcgactcacgagcaaaggctagaggatgagagtcaagaacttccccgattgctagccaaggccaaagcaatggcggacacctactccgcccccaagaagatccacggaattctcagctatt

SEQ ID NO: 5496 - DNA, 492 bp, Glycine max
  Peptide Sequence Number=SeqID_97181
atggtctcggggtacttcatgtgtctcccccatgggttgagcgccatgtatatgaccagattggggttgttggctctcaatgggtatgagagcggagttgtcgacattctcatctggagcgtgtgcaacattgggtggtgtatagttgggaggcaagccatatggtgggaagggatgcttgctctggacctatacaaaataggggtcacccgtccttcccaatgcttcgcccccctgacctaccatattcgggattggacgacttgcttgattgacgccagatgggtgagtcgggtccacctcagtggcagtatttgcagtaatgattgtagccatgttgacctccataatttttctcatactcatcatggcttccatcattatggtcatttgctctttcatggcctccatgtcggccttcatctgctcttgcacctcctctatttcactcatcactctagctttggcatacgttcggtaagggcaccataa

SEQ ID NO: 5497 - DNA, 408 bp, Glycine max
  Peptide Sequence Number=SeqID_97182
atgaaggagtgttcatggttggatatgttggcaagaataagaggcttatacctcagagcaattttaaggcaagatatcagcttctttgacaaggaaaccaatactggtgaggttgttggaaggatgtcaggtgacacacttcttattcaagaagccctgggagagaaggtaggaaaattcatacagtgtgtggcatgttttttaggaggtttagtcatagcattcatcaagggttggcttctaacccttgtccttctatcttgcattccacctcttgtcatctctggttccatgatgagctttgcttttgaaaagttggcatcccgtggacaagcagcttattctgaagcagcaactgtagtagagcgcacaattggttcaattcgacaagtatgccaatcttcataa

SEQ ID NO: 5498 - DNA, 363 bp, Glycine max
  Peptide Sequence Number=SeqID_97183
atgcggaggaactcgcctgcctcctctagcgatacttctttcttgccacaaccgtcctttttctccgaaagacctttcactggaatattctcgttcggagtggggattattttgtcattttgttcttcctctatttttggcttccctttaacatttgaggtttgtgtcggcaggtcagggggtgagaacacgctaccgctgcgggtcacgtcgctcagccccgtgatattggttaccttggccgacaacgagctgatgtcgggggcttcttccttcctttcgcttggaggcgcatacctccacggaactgcgtttaactaccgaggggtatcggggcgtatggggagctacatctcttggtga

SEQ ID NO: 5499 - DNA, 394 bp, Glycine max
  Peptide Sequence Number=SeqID_97184
cgctgttcatgtgtcctccaccttcgagtttggagctatgtttcatgattgcctaagtgcggaccctcaaggcaatcctccattctccccctttttcggagccccaggaatgtcattgtctagcgctgttcatgtgtcctccattatcaagcgcggagcctctggtgactgggaaatatgttcttctgttgttttccggatcgaaggagtagagacgagaatcgtcatcacggaaagggcaggatggacgaaatcagtgtcttatctttgctttcctcttatctccgatgagagatgtttggcaccctttgttgcacaatatgtgaagtcccgagacgtgccgaaaatcaaaaggaagcaggcttacgcgatccgtgaaaattccgtgatgtga

SEQ ID NO: 5500 - DNA, 201 bp, Glycine max
  Peptide Sequence Number=SeqID_97185
gttggtgttaaggaggttaaagatgcagaggctctcgttcctgtacccactgacgaggttaccttagtgggacagacagttaacaccttccttgcttggtcgacacatcttgtgaagcgtttatcagaacaggcagctgtgtctccagcaacgaaacctccagaaagcccggatgaagaggtcgatgatccctgtacctga

SEQ ID NO: 5501 - DNA, 315 bp, Glycine max
  Peptide Sequence Number=SeqID_97186
atggagagtaacgcggacaccgccgccgctgccgccatcgcattccgagcattgtgggacaagggagaaacacaccgaggcatcctcctcaacttcctgacagggcccacgaggatccttgagagcgcgctcatggggacgttgaatcctactctctgtttcccgcttgggggccagcgcccaacacactaccttaacccaacatcatgggagtgcctcaaacccacccaatgcagccaatgcttctgcccatgggagggccacccccggcagcggaaggaaaggaaaaactcgatctcatcgaaaagagattga

SEQ ID NO: 5502 - DNA, 156 bp, Glycine max
  Peptide Sequence Number=SeqID_97187
atgtgggatgggaaagcggtttttggaagttcagaaggcaatctgatagcaaagagtttaagcacgaatacaaaatgtgcaggggtggcccagataacatttgcagcattaaataaatttgttgaagttggattgaattccccgaagtcagtatag

SEQ ID NO: 5503 - DNA, 2106 bp, Glycine max
  Peptide Sequence Number=SeqID_97188
atggtgagagctttcgaaattttgtgccccttctttaacatctggcctagtgtgtcggtcttcttgtacttcttccagatgaaactggcaggaaagattgattgggtctccttgaacagcatgtccaagaagttgtttcaatttgactcgaacatcttttgttgtttcaaggaccatttcttcaaggtcctagactcgagtgtcgtggttaatggtttgccactgatgcttaacaaggacggggaacctcgcttctattctactggcaggttgatcccaccaggccatcttggagcaactatcggccttgttgggcgtgtgaaccattttgtctcttccctggcaagtgatctcctcactgccttggacgatgggactatgccaccgtctattgtcactcccactaaaaggggtcaacctactgttgaggttggccttgctgttgttagtactgttgagattgctcccagtgccacttcctctgtattggctaagaggaagtgggatgatagtgctgggctgcaagctgtagggttgacgcctagtgcggttcaccctttggttgtgcaagatgtgcctttagcttcaacaactgttgaggctcttgctgttgtgattgtttacaaggtcactcttcttgttgtcgaagtgagtgcaccagctgctttggttggttctgctgtggcgccctcgtcaaccatcgctgcatctttattgagtgttggtgtagtgacaaccaatgcccctgtggcacctcctccttcctcttcggctccaatggtccctccttccactgcattggcttcactttccacttcttctcacccccatgtttccctggatcacatctacactttcaatgatgctaattccttatgggccatggggtcagttgggttccagtatgccacaaatttttccaaggtcttccttcaatggagtcttgcaatccttgaagaaaatgggcagcgacatcaagagatgttgagcaaagtgacatttttggaggccgaagttgccaaatggagggcgaatgcttgcactatttggaaagtagagcgccctaaggtagctagtgccaccattgcttttgatgaggctgggaggtcaaaccaccaactatcttctaaagttggtagtgtgttgggtggggatgttgtggtagagaaggacgagcttgccaagaagtccatgctggagaagttcgagctatgggctgctagagagagggaggtcagtaagaagcttaaggaggagctactcattttcaagaaagaggtcgtggagcaatatgaaaaaggcttcaacaagcatgacgaagacaatattgctgctgaagaggaggccggtgagaaggagcagggtactgagtttatgatattcggtgagtgcactttgtcttcttctgcgctttcaacagctgctggcggcgtggttcttgggcccgttcttcttctacagtgttggcggcatggtggtggtgatcttcaccttgactttgcgtgttcttcttctgttggtgctgctccatcgaggtcaaggcctacaacatcaacacataggcaatgggaagctgcccctgttgccgaggatgagcttgtgatagctggggatgagccaatggtagctgcagacaagcctatggtagttgtagataagtttgtggtagatgcggatgcacatggaccttgtgcagaggctgctacaaatgagcccgagggatttccaggtggatcgagcgatccatcagtgcttactgagtatgttgagcatgttgcagccaacatatggacaggagaggaacgtcctgaattgaagttatcctctcatgggaggaaggtgcagaaattaggtaggcctattcctataattgaggggctagttgttgggacaggactaagtcctttgatcgcatgttcagtagacactggcgatcggggacttatatcctcgtttgtggagagttggcacatggagactagtagtttccatcttcccatgggggaggttaccatcaccctagacgacgtggtgtctcttcttcatcttcccattgttggcgacttccataccttccagcctctacacgtcgacgaggcgggttga

SEQ ID NO: 5504 - DNA, 1111 bp, Glycine max
  Peptide Sequence Number=SeqID_97189
atgatatactctaattttggcgtgtttggggtaatccatttggcggtgtccctgggcctcattctggcggtggacaagtttctgaagcaagcgttcgtggctgctgcaatcaagttcccgagcgcgttgtttggtatgttttgcatattctcggttctgattattctcgactccaccgtgcccgccgccgccacggcgttcgtgagcttcttcgtgcccgcgtttatgtttatacagagatggctccctctgttctatgttccttctctggtggtcttgccccttgccgtcaaagatattcccgctgcctccggagccaaaattggcctcattttagttggaggatggctggctacattttgtgttgctggttacgcggctatcgcagttagaaaagctgtgaaaacggaattggtagaagctgagcctatgggaaagcctgctccattttccttgaaatgtggacatggactgcttgttaggctacatggttggctctgggtaagtattttcctttacactgctgcttatacacgcggaaaattgctttttccgatgtatgggatttctgatgaaaaaccattgaaaaaaagagtgttcttgtacacatggttgccaccaaatgtgaagaaggtcttccatcctataatttgctgtgcattatctgcagatctgacagcatttgcttttgggtatttttccaggtcagggcttgaacctgtgcttggtatggttacaagacacgcagctgagattttcacctctgtcatcatctcaaccttattctcactgtactcaacagcctttgttggacgtcttgttcaattagaaccatctttaactgtgtccattctacccagatgtatcacagtggcattggccctcagcattgtatccttgtttgacggtgccaattcatctctcacagcagctgtggttgtattaactggtctggttggagcaaattttgtgcaagcaacactcgataaactcagttttcgagatccaattgctcggggaatagcaactgcttctaggcttggaacagcagctttgtctgccaaggaacctgaggctctcccattttgtgccattgcatatgctctgaatg

SEQ ID NO: 5505 - DNA, 585 bp, Glycine max
  Peptide Sequence Number=SeqID_97190
atggataagagcttaaagaaggagaagatgaggggagggagaaggagagaaggagcacgacattttgtgcctcaaatgagtaaccgtgacgaatatagatactctctagcaactccaaaattgcattacggtgatggagtgacaccacgaggaggagttaagaaagctaaatggcgacgagcactctacccacacattgccagagcacacttaaggggaatcacacccccgatgcacagtcaacactcaagatcatccaagtctctcccacaagcattgtcctgttggacggactactcatcaacacccttcgtcgaccaaatcgtggaagccaacatacccctaggttggaaatcactcaacctagaacggtatgataggaccaccaatccaaatgaacatttggatgttttcctcacccatgcaaatctgtacaccaatgacgattcaatcttgtgtcgtgtcttcccaacgtccctcaaatgggcaacattgacctggtacgttggacttcctccaaggtccatcaacagcttcgacactcttcttgagcgcaatatgcaaccagtcagtcacatcatatga

SEQ ID NO: 5506 - DNA, 243 bp, Glycine max
  Peptide Sequence Number=SeqID_97191
atggacataaaagaaaatgttgaggtaaccttgatctttgaacgaccatttatgctcaccactaaatatgttgttgacataaagaatggccttggatcttcttcatcaatggagtcctttgcttctttaagttcaatggcagcggaatggagaaggaagaaatatgattggagacgccacttcaaggagaagatcagtcaaacacaagctcaccaccataggaagccatggataagagcttga

SEQ ID NO: 5507 - DNA, 273 bp, Glycine max
  Peptide Sequence Number=SeqID_97192
atggaaaccatatcgaaacgctttgagcaactcgatgtttgtggcaaagtacatttgaagtcaaatctgcgagaaattgcttatcctgatatgaactcaatgtgtcctcctccagaaaaggttaccatggacaagtggatgaaaattacggatatgggatatgtcattgcttcacgatacaacgtgatcattgtttctctttcacgacaacaaagcatgacatttttcctcttagaagttagctgccaccatattcttctatgcatcgtgtaa

SEQ ID NO: 5508 - DNA, 214 bp, Glycine max
  Peptide Sequence Number=SeqID_97193
atgtggcgcgtctccacagactaccaagaagcatcgtttcagactgaaacaccaagttccttggtcacttttggagaacactatggggatgcacaagctaaagttgagtatgtgaaaagattacgtgagcaagtgaaggctcaaattgcaaagaagaatgaaagctatgctaaggaagccaacaagaacaagaagaaagtggtactgggcccag

SEQ ID NO: 5509 - DNA, 443 bp, Glycine max
  Peptide Sequence Number=SeqID_97194
atgaaggcctcattggaagaacaaacaagacagggtagctttgtcccccatggtcgtgaagacatacttaacactgccatcaggcaactggatcatggaggccgtgttcgtgcagcggggtctggggtcacaataactcaatactttggcaaggcagcacatggctccagttgctcatcagcctccatcagccaagtacagttggctgaaataataggaagcctacaggaacagtggaaaaatgatatacaagtattgaaacatgagttgaaggaacaaataatacttgagatgttgcaaaggggatcgccgatctcagcacctattcagccagatatacatgtgttaggagcaagagtgagcacaaaagggagcaatgcggagactgctgtcaacccatctccacctaatcatgttgctcctgtcaaacccactatggggtt

SEQ ID NO: 5510 - DNA, 114 bp, Glycine max
  Peptide Sequence Number=SeqID_97195
atgatgcaaacttaccctccaagggcattggatagaagactccaagaagattgggccaaagatgtaagagaaggcactagggttctcatgagccttaggggcaccatattgtag

SEQ ID NO: 5511 - DNA, 1080 bp, Glycine max
  Peptide Sequence Number=SeqID_97196
atgctatgtttaaccctctccacctgcctgtccctaaacaccctggcagctacacttttacccttgtcaccggcacaactgaaacagatgcaggtgcaatggggccatttgcgggcagagcaaagcggactatccgccagctacccggctgaggtggtattgccgccaacacaaacgcgtgtggtgacagcgccacaaggcggattgattacacgtttaagcgtaagtatgggcgatactgtcaaacagggccaagtcatcggccagctcagcagcccggacctggtggtcttgcaaagcggctttctacaaagcgacacccaggcccgcttgcacgaacaagcgctgaaacgcgaccaggagctattcaaagacggcattatttcccaacgccgcatgcaggaaacacaaagtgcttacgaaaccagccaggcactgatgcacgagcgcaaacagaccctgaaactggcaggcatgagtgatgctcaagtccagcaactttcgcaaaagcgcaatatgcaaaacggtgtggcgatcatcgcccccatcagcggacaaatcatggaacagcaacagcaagtcggcgcacgtgtcgatatgtccatgcctatctacaccatcagcaatcccaaacccctgtggctgatgatacagatgccgattgcgcaagcgcagcaactgagcccgggcgcaatggtacgtttacccaagcagaacctgacggccaaggtagatactgtgttacggcagttgaataaaaataaccagaccacccaggtaagggcttctattagcgaaggtgcagaacagctgtccgttgggcaagtggtcgatgtggcactggttgagcacacggcgcaaggtagttttagcctacccagagcagccgtcgccagacaaggggaacaagcagtgatctttgtgcaacaagcaaaaggcgtcgccgtcaccccggtaaaagtggtgcttgaacaagatcagcagttaaccgtgcaagggtcactgaatggtaacgagatgattgccgttcagggcgtagctgcattgaagggccattggcttggcctgggtggggagtag

SEQ ID NO: 5512 - DNA, 282 bp, Glycine max
  Peptide Sequence Number=SeqID_97197
atgttaccagcacttgctgccagtgtttgttgccaagcagcaaatcttttgactgtttgtgcagcagctgaggcatggattgaagctctcaaggccagcgagaaggaaatactgatggaaacaaaaatagctcaaagagaactcaaagaatcaaaattggagcaagagctggaggtttacaccaaagagaagatgctttcaagaaaagttagtagtaatgaggagcttgacaattggccaagaaaacgcgagaacacttcatccaagaacttcatagtttaa

SEQ ID NO: 5513 - DNA, 289 bp, Glycine max
  Peptide Sequence Number=SeqID_97198
tcactcagtccattatgcaagccaccaagggaatcaaggagctggaaagaaatgtgtgaagaagcatgataaaagcaaagggtcattaaagatcaatgacactcttatgcaaatccaaaagaaggcatcaaagagaaataattgtcatttctgtgggaaatatggacacttccaagcccaaagcgcaagtcttggttcgaaaagaaagggattccttatgatccaaaccataatctcaaatgagaaattcatcttcatggggaatagagtgaaagctccaatggaagca

SEQ ID NO: 5514 - DNA, 402 bp, Glycine max
  Peptide Sequence Number=SeqID_97199
atggccaaaggttcccttgatggaacaaggggttgtattaatgataatcccgtcctcgccataagacagcttggctacctcatgagaggagtgccatcagacgaaagcatcacgcctttcatcgcacggggtttcagtgaccacaacgcaagggtactccaaggagttcgcaaggcatgtgatccgactgtgagagacgatgagattaaagcttcggaagaaagtgatgaggtacaagccctaaaggcagagcttgaaagagcctgggtagtcgaagagaagttcaagtccatagccatcaaagaatcatcacgagtcaaaggcatgatctccgaagaggtgaaaggaatcatcacgggtcaaaggcatgatcttgaaggacgagctaaaggcttgctttag

SEQ ID NO: 5515 - DNA, 357 bp, Glycine max
  Peptide Sequence Number=SeqID_97200
atgtctgattcaggcgcatcacatatcgacacactcgaaattaaacaccggaagatcgcgagaaattcgaatggtcataagttttcacacagaggtccgaatcaggcgcataatatatcgagacgctcaaaattgagcaacggaagctctcgagaaattcaaatggtcataacttttcaaacggatgtccatattcaggtggataacatatcgagacgctcgaaaattatcaaaggaagctcactagaaattcaaatggtcataacttatctcacggatgtcagattcaggtggataacatatcgagacgctcgaaaattatcaaaggaagctcacgagaaattcaaatggtcataa

SEQ ID NO: 5516 - DNA, 180 bp, Glycine max
  Peptide Sequence Number=SeqID_97201
atggtgatcagcctgggctacaagggagttcccaaactgagtgacacaccccctagtacaagtagtcctcctcacaaggaactacaaggacatccgacaaggtcaatgcacccccccatgaacatacacaacatacgacgtatgaacatgagcaccatcaagtacaaagaccatggatga

SEQ ID NO: 5517 - DNA, 546 bp, Glycine max
  Peptide Sequence Number=SeqID_97202
atgatgaatccagatattctttcacaagaatattggaaaaatgaagtagcctatcttgtagctgctaatgggaaatttttcagaagacttagtaacacatggatcaaattcaaaagagaattgaagcctttttcagaaattacaaggctcttctctttagcagaagccccgctagaagttggagagtttaaacaaaagatttcctccggatgtgcagacagtcatgaagatttcaaccatccatatcttttatggaaaaacaaagaatactttgttgatctaccaattcgattaaatgaagatatcaatccaacaaaagcaacccatcaggatgacacctttagatctacaagcagccatacaagaatgccaagatctactaagccaagaagaacagacgataacagtcaaggaactcaagaagatgcccaaaatcccccagccttgaagattcctggaacaggtcagaggatattacaaactgatgcaagtgatcattattggagagctatcatgatagaacaggaaggagagaagaattattag

SEQ ID NO: 5518 - DNA, 426 bp, Glycine max
  Peptide Sequence Number=SeqID_97203
atggaagccaatgcggttgcagttgccgctaccagggctgttgctaaggtgaacccgatgcccccatctgatctcaaccaaatgaatcatccaacctcaggtatggtgggcaaagatttgggaagtacgagcggcccccattatgcgcaaattcaaaacaagcatgccttcccaccatatggcttgcatcccaactatacaccacccaatgtggcatacactcccaaggaggatgtcaataactccactcccacactcattgaaagccaacaacctcaatctgatcatgcacatgtctctcaacccatgggggagacacatggaatgccccaccacaatctagccgactttgagccttgcctcggatatgccactgaaggaaatgggaaagttgggtcatctaaaggaaaggctcagggccattga

SEQ ID NO: 5519 - DNA, 431 bp, Glycine max
  Peptide Sequence Number=SeqID_97204
atggcgcctaccaggcaccctttggatccagataagtccaacagggccctgggatttcccgcgctgatcacaggactctgccagtcgtttggagtccccgttacgcctaccaaggtgattcggccgcccatcacccgggcttttattgaaaagtactgcacccagagacaggctcagggggatgctgcacaggccgcgggcgcgccaccaccacctcatcaggctggcccggctgggtcatttgacatggagcagtatttacggcatttggttcgccagcaggcagccagccaccgggcacatgcagaggtcgcatggcccagggattggcccgaggcccagacaggagaggcacccccaaaggcccccgacgatggagaggaggcccacgaggacgaggagatggccgatttgcttgacttcttgggagg

SEQ ID NO: 5520 - DNA, 612 bp, Glycine max
  Peptide Sequence Number=SeqID_97205
atgggatcaagtcaggcgccctggcttaaaaagaggttctatcaagtcaagatcaagagcctaggagtcaccagtctaaaagagttaggacagttgatgggtcaactccagcgaaaagcctttcacaaggcctattgtaagatatgggacctaactatggcagagttaacacccacggtagaagagtttgaagagatcttgggatgccctcttggaggaaggaaaccgtatcttttctcagggttctatccctccttggctagaatttccaaaatagtcaaaatctcggcacaggaactggatcaggggaagcaagtcgaaaatgaggtggttggagtaccaaggaaatgtttggaagcaaaggcgagaaccttggcaagtcaagacgaatgggctccgttcatggatgtcctggcactcttgatcttcggagtggtcctctttccaaatatggatgggttggttgacctggcagcaattgatgcttttctcgcctttcacgaccgcaaggaaagcccggttgtcattatcttagccgatctatatgacacattcgaccgaagatgtgagaagaatagtgcaaggattgtttgctgtaccccggccctctac

SEQ ID NO: 5521 - DNA, 207 bp, Glycine max
  Peptide Sequence Number=SeqID_97206
atggaagcaaaagcgcaaaaatggtggcctaggggtgaaaatccgggtgcttgcccaggcataagtatggctctctacgggtcagcattcgcttactcgaaaccccttaaggctgcttcccagcggcgctttccacttgtcaagagctgggcatgggacgacgatctatcgatcgtgatcctagcctctacttgcgtccgtccttaa

SEQ ID NO: 5522 - DNA, 540 bp, Glycine max
  Peptide Sequence Number=SeqID_97207
atgtcttgcctagtgatcatgattccgaccatcctctgccgaagtgtcagtatgccacccaccaggcaccctctagacccggataagtctaacagggccctggggttttcggcattgatcacgggtctctgccaatcattcggggttcccatcactcctagtaaggtgatccaaccgtcgatcacccgggccttcattgagaagtattgcacacctaggcaggcgcagggtgatgcacctcaggccgcagacgcactgcctcctcctcatcaggcagatcccgctgggtcactaggcatagagcgttatctacagcacttggttcgccagcaggtggccaaccaccgggggcagggttttgctcctttcgcgtgccctactctagatcagtttagggctgaggtcgcatggcccggagattggcccgaggcccatgcaggggaggcacctgcaggagctcccagcgatgcagaagaggcccgtatggatgaggagatgacgaacttgctcgatttcttgggaggaagcggagccacgtga

SEQ ID NO: 5523 - DNA, 870 bp, Glycine max
  Peptide Sequence Number=SeqID_97208
atggcagaatcatcaaagaaacgtagggttcatccacctccacttcggcttcgagagctcatcattccgggagccaccagcgcatccacagcaccaattccaccctccttatcctcttccacactgttttcttccgaagaacagcagaaacggtactcaaaccttttctcatctcgttccactatcgaccctaagttcatagatatggaattcttttctgctgaaagttttgattgcattcaagcatttcagaacttaggtctcatacctttcatgtcattacaattgcctgtttatcctgaattggttaaagctttttattgtaaccttgaaattcaggaaagaactttgatttctgaggtttttgggataaaaatggtcattgaccaatcccttttccataacttaacccaattgtccagtgatggtgtaccatttgaaggtacaatgaatgacgattggaaatttgatttctctgcacatgatgcccgccagttggtttgcaccaaccatgcggatatgactggacgtcttcttgccggttcattggcttttgaaagccgcatccttcattatctcattgtgcgtattttgcttccaagatcttccaaccttgcccaggtttctgaggaagatcttgttatcatgtgggcctttcatactgggcgtcaacttgactgggcacacttagtcagatatcgcatgcataaggcattgcgattaaatgctccatttccatatccacaccttgtcactctctttctttgccattttcaaattcctcttgattttgaaccttatgttccaatcaagagatcctttttatttggtgctgctgtgattgcctcttggttaccgcaaagagcatga

SEQ ID NO: 5524 - DNA, 261 bp, Glycine max
  Peptide Sequence Number=SeqID_97209
aaagggtggaagttgtttgacttagaaacaaaagagatttttgtctctcgagatgttgagtttgttgagaccaagtatccgttttctattgatgttattaccagaaaagatgttcctcctaaaaattggagttgtaaagaaattgttgatgatatgactgatggtatagaagaaacgaatcacacaggaggtattgaagaaagtggtgatatgacaatggatgatagatggggtgagctagatgcgggattcgatgaacaa

SEQ ID NO: 5525 - DNA, 834 bp, Glycine max
  Peptide Sequence Number=SeqID_97210
atggaatcaagcaatgtgaagaacaagtcaagtggaaaaagaaagatgtctagtgaggacacaagaagttacttcgcatggaacttggaaatggagcgtgtgctagctgatgtgcttagagatcaaagaaatttgggcaataaaggtggtggaaattggaaagcagtagcatataataatgttaagaatcgttttaagctttggagaacatggtatggaattgtgagtgtcattcttagtcaaagtggatttgactgggatagcataaagtacatgattaccgttgaaaatgaaattgcatggagtgaatatgttaagtcacatgaagaggccaaacaatttcgattcaaagtcattcctaattgggatgatattgttgacctatgtgcaaaggatagagctattggactcggagcagaaaatgcattagatgcagatgatatcatgagcaaagaaacaaatgaagaggaagcaattcatagtgtgagttttgacttagagggatcaagttctgccacgagaaaaaacattcgtccaagtaagagtggagagaaagaagggatgattttctcaatgaaagaagtagccgagtcattgaaagaatttgttgaagtgactaagaagaagatggagaacaaaaaaaagatggagataaaagaagctcaagaagtggtacatgaagtggtgagtgagctagataatatacctaattttaatggtgcacttagacatagagcaattgattggttgacagaaaatcccattaagtttgcgattataaaagctctttcattggatgagaaagaggattacatcttatcttttatgccttga

SEQ ID NO: 5526 - DNA, 408 bp, Glycine max
  Peptide Sequence Number=SeqID_97211
aagtactttcctgattctaaaactgctaaagggaaggcaacaatttcttcatttcatcaattccctgatgagtctctgagtgaagcacttgagaggaagataaaattgaagactcctgaggaagcaatggagctgattgaaaacatggcttctagtgatcacgccatctttgatgcaagctccattggagcttgtaggcctaggatcatcttcatcaatggattcctttgcttcttggaagatgaatcgcagcggaatggagaaaggaagagagagaggagacgccacatcaaggagaagatgagtctagaagcagctcaccaccataggaggccatggataagagcttggaggaagaaggagatgaatgaggggagggagagaagagcacgaaattttgtgctctaa

SEQ ID NO: 5527 - DNA, 78 bp, Glycine max
  Peptide Sequence Number=SeqID_97212
atggacacccgtctccgtgtgattggtgatcccatgaatagagttcaacgggggtgggggtcacaacccactctttga

SEQ ID NO: 5528 - DNA, 324 bp, Glycine max
  Peptide Sequence Number=SeqID_97213
atgagaggaaaagaaacagagttggtttacaacgggaatgctcccagagaagcatatgcaacaattctgcattcagctcatgtttacgtttgtggggctatagctgtggcacaaagcatccgcaagtctggatcaactcgagaccttgtaatacttgttgatgagacaatcagcagctatcacagaagtggtctggaagcagcagatctgcattcaagtgcagccaccatactcgaatgcaagtcacaagcattattctttgatttgaaggtgcatagccaatcgtttccaaatgctaaggaagatagaggagccagccactga

SEQ ID NO: 5529 - DNA, 201 bp, Glycine max
  Peptide Sequence Number=SeqID_97214
atgaggaatctggaagggaatctgtcacgcaggcacgcgcttagcgcgtcatcagctcgctcagcgagtcttttgtcaccatccaggcttagcgcgagtttggcgctgagcaaaaattcacttactcgcgctatgcgcgtcatcgaggagcttccatgctatggaaggctaaatcctcagttggggattcttgctgagtaa

SEQ ID NO: 5530 - DNA, 312 bp, Glycine max
  Peptide Sequence Number=SeqID_97215
atggtagctttggatctcacaataagcatgttggcactcatagttgttgttttttctcttggcttgtggagtggtgttcaaggtgcggctcaagctccatgctacttcgtttttggtgattctttggttgataatgggaacaacaaccagctccaatctttgggtagggctgattacttgacttatgggattgacttccctggtggacctttaggaaggttttccaatgggaaaaccacttttgatgcaattgggtggacgtggctaaggtggactcctggacttcgcatgtcagctgagaatgacctttga

SEQ ID NO: 5531 - DNA, 342 bp, Glycine max
  Peptide Sequence Number=SeqID_97216
atggtttctaaaattggatatgtgctaaattttgccgagccagagactttgctttcagctactctgatacatgtgacaatcccggttatagcacgtggcctattgaaacatgagtccaaagtatctgtccttcattgtaggccaattttctctagcgagttcataaatacagacaagaacaagatggagaggtttctccatgttgggcatttttcagttgcttcaatctatgcaccaattttatttcctcctcttcctatgataatcctaaagagagatggagacaatgctgcccctgcagtggctgctgttggctcactgaaaacttttgataatccttaa

SEQ ID NO: 5532 - DNA, 594 bp, Glycine max
  Peptide Sequence Number=SeqID_97217
atggtgacaccacgaaggtcccctccacagtcagatgataatacgaagccacaacctaagaagacaagacagagcacacgtcttagaaggctgactttaagaactcgagaaaagatcccgattgtccacagcaattggaaaaatgtgccgaaaactctaaaggacatggtatggggggaaattttggcaaaatttgatatccctgaagccgaaaaggccaagaaaaaggtaatgtccacagtgggcactagatggaggaaatttaagtcttcactaaccactaaatatgtctatgatgacacacaaggcaaacagatagaaaatgcttcagtcaaatatggtatggataagcaaacttgggataaatttgttgcaagtcgcaagaccccagattggcaggactcgttagaagagcagacgacacagggtagttttgttccctatggtcgggatgacatcttgaatacggccattgtcaaaccggaacatccaagtcgagttcgtgcagcgggatctggtatgacccttactcaattttatggtagggcaacacgtacctcaagtagttcctcagcaacactaatgcagcaatag

SEQ ID NO: 5533 - DNA, 210 bp, Glycine max
  Peptide Sequence Number=SeqID_97218
atgtgttgggcagagttttctgcctctgccctgttttcttggtttaggcttggaggggttgatggggacccggtgttgagaggaacgaggataagggctatgtgggagtacgtgagctcagttgaaggggggcaactgggaatggtgggttcatgtttgatttgtgaaagtgggagagttgatttgcgtcatcgcccgatcgccacctag

SEQ ID NO: 5534 - DNA, 438 bp, Glycine max
  Peptide Sequence Number=SeqID_97219
atggatgacgttgctgctcagcaacatcctgcccagcgatcacaattccgacctccctctgccgaagtgtcagctggtctctgccagtcgttcggggttcctgtcacacctagtaaggtgattcgactgccgatcacccgagctttcatagaaaagtattgcacgcctagacaggcgcagggtggcgacccgcaggccccagacgcactgccgccacctcatcaggctgatccagctaggtcatttgacacagagcggtatttatggcatttggtttgccagcaggcggccaaccacagagcacacgtgcagacctatgactgtctctacgagctcagcctcagcctgcagagccagggtttcactccttttccatgccctactccggatcagttcagggcagaggtcgcatggcccggagattggcctgaggcctag

SEQ ID NO: 5535 - DNA, 504 bp, Glycine max
  Peptide Sequence Number=SeqID_97220
atgatgcttggcagctgcaaaggacctacttcatttgaggatatcaggactgttgcgaatatccaatatccaacatatagagaagcatgctttgcaatgggctttctacaagatgacagagaatatgttgaggcaatcaaagaggctaaggactggggcacaactaattatctaaggaaattcttacctatcaatgcagatgaacaaaaaacaatttatcacagaattatccaagttgtcaacaacaatgaaggtggaatgtttttcctatacgaatttggaggcataggaaaaacattcatatggagaacattagcaagttcattgagagcagagaatcaaattgtgattattgttgcttctagcggaataacctctctattagtaccaggaggcagaactgcacattctagatttaaaattcctataccaatttttgaagactcaacatgtaatatccatcaaggcaccgaattagcagaattactgaaccagacagtctaa

SEQ ID NO: 5536 - DNA, 456 bp, Glycine max
  Peptide Sequence Number=SeqID_97221
atgtcttggaagaggacacattacttctcaatgcccaccacaaaaaccatgattatgaggggccaagacatttatagtagccaagatgaggctactacttcaccttcctctagtgaaagtgaaaaagcaaaaggggaagaatctagtgaagcaaactaccccctaagaagaaggacaaccattagtgaaactttccctcttagacaacctccacattttctcttttgtaaaaaggcacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgaatggtgcaaccctcttttgtaaaatcactcgtacacctaacatcttcatg

SEQ ID NO: 5537 - DNA, 471 bp, Glycine max
  Peptide Sequence Number=SeqID_97222
atggggtcaagtcaaacaccttcgcttaaaaagaggttctatcaagtcaaggtcaagagcctagggatcaccagtctaagagagttagggcaattgatgggtcagctccagcgacaagtgtttcgtaaagcttacggtaaaatctgggacctagccatggcagaagtctccacggaggccattgcatccctcgcccagtattatgaccagccgttgaggtgcttcacctttggggactttcagctatctcccatggtggaagaatttgaagagatcctaggatgtcctctagggggaaggaaaccatgcctcttctcagggttctatccctctttagctagaatttctaaaatagtccaaatctcggcgcaagaattagaccacagaaagcaagtcgaaaatggggtggttggaataccaagaaaatgtttggaggcaaaagctagaatcttggcaggtagaggcgaatag

SEQ ID NO: 5538 - DNA, 1152 bp, Glycine max
  Peptide Sequence Number=SeqID_97223
atgtatgattatttgtggggacattcgtcgctgcgggcaaagccagtaatggcgcggcctgcagcagggtttgttccagtgaggggaatgaatttgttggcgtttattgatctcactcacgaaaaaaggttcgcatatgaacatacgctttctgacgctcccgtaatgaggaagacgataatgacgccgtttatgactgaagattttctgttagataccgaatttgcccgccgcctgtaccacgactacgccaaagaccagccaattttcgactaccactgccatttaccgccgcagcaggttgccgaaaattaccgtttcaaaaacctgtatgacatctggctgaaaggtgaccactataaatggcgcgccatgcgtaccaacggcgtggctgagcgcctgtgtaccggcgacgctactgaccgcgagaagtttgacgcctgggcggcgaccgttccgcacaccatcggcaacccgttattccactggacgcaccttgagctccgccgtccgtttggtatcaccggaacattgctctctccagcgaccgcggatgagatctgggatcggtgtaatgcgctgctggcgcaggataacttctccgcgcgcggcatcatgaagcagatgaacgtaaaaatggtgggcaccaccgacgatccgattgacgctctcgaacaccatgcggccatcgccaaagacagcgcgtttgacatcaaagtgttgccaagctggcgcccggataaagcttttaatatcgaacaggccacatttaaggattacatggcgaagctggccgaggtttctgataccgacatccgtcgtttcgcagacctgcaaaccgcgctgaccaaacggctggatcacttcgcggcgcacggctgtaaagtgtctgaccatgcgctggatgtggtgctgttcgcggaatcaaacgaagccgagctggacagcattctggcgcgtcgtctttcccgttcaaaacggcggtgctggtgttcctcggcgcagaatatgcccgtcgcggctgggtacagcagtaccatatcggcgcgctgcgcaataacaaccagcgccagtttacgctgctgggcgcggatgtgggcttcgactccatcaacgaccgtccgctggctgaagcgctgtctaagctgctga

SEQ ID NO: 5539 - DNA, 612 bp, Glycine max
  Peptide Sequence Number=SeqID_97224
atgatgccagacagaaaagccgtcaggcacgctcgctccctggtttatcgggcgaatggccagcgtcgattcctgatgcgaaagcgcgctccaggccagcagcagggcgctgatgaccaccagggcaatcgcggcacaggcaaagcggcgcagggcgagcggcgagataaccatcgacgaccagcgagccaatcagccgaagaccagcagaacaacgggcagcagcatcagcaggacatcagctggtcctcatatttcatgaagaccgggaataagcacccacagcaggccgctcatccagttaaagaactggaagcgtgtgctgctcagcccggaaaggccagcaatggtcggcaacagggtggtgcgcccgctgatgatagtgcgcaggcagatgcgagagccagttctgaacgatccgggtattgcccagccatctgccctggatgtagctcacccagcagccgagactcgcggcgacggtcagtaacagaatggtttgcggaaatgccatcgcccctttggcacacagcacgccgacaagcaccagtaaactgtctccgggcaggaacgcagcaggcagcaaaccgttctcgaggaacaggatcataa

SEQ ID NO: 5540 - DNA, 444 bp, Glycine max
  Peptide Sequence Number=SeqID_97225
gaaaccacatcagcggctgaactttatttgtctgcaattccgggtagataccgcggtattgctgtcgatggagagcatcataaacgtgacgtaagggagcgtgcgcgctggtgccctcaccccaaccctctccctgtggaagagggcgcaaaacaaaaaacggtaaccagggttaccgttttgcttttatcaccgcaactgctgctgacgaatcgtggctttcaccagacgccaggcgctccaggcgccaaagccacgccgcgcccagcggatcagcatattcggatgacgaaccgtccagatagccatcacgctactgccgaccagggcccaggaacgcaggctcaggaaggtgttccagccacgatcaaagcgtcgcgtcgcatcaatccagtcgcgacggctggcagacagatccagccgttgctgctggatctggcttaa

SEQ ID NO: 5541 - DNA, 204 bp, Glycine max
  Peptide Sequence Number=SeqID_97226
atgtcacacacaaatgacttcgttggttactcgttcttaggaaaaaatccaaagaagtttgacattccttccggatgtaccatccatgaactaaaggatttgatcaagcaagttgcacctcatgggatttccccttatggtattcatgaatcacaaatgataatggaaatggaaggtgacatgtctcgatcagaacatgattga

SEQ ID NO: 5542 - DNA, 737 bp, Glycine max
  Peptide Sequence Number=SeqID_97227
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggacaggcagtgggcattcatagatctttgcaatattaaacactcagagaaccagctggtgcgtgtggtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 5543 - DNA, 1171 bp, Glycine max
  Peptide Sequence Number=SeqID_97228
atgatggaagccaaaaaagtgccgcactaccagcgtatcgcccgacagctgaaatcagcgattgagaatggcgagctggccccgggaagccgcctgcccgcgagccgggtttatgcgcaggagcttggcgtgtcgcgggcgacgattgaaaatgcctggggcgagctggtggcccagggctggctggagcgccgcggccaggcgggtacgtttgtcagcgagcgcctaagcccgcggcaggtcacggctcagcgcccgacggcaggcctgggatcctccgcgccgcagccttctcaaatggggctaccggcactggatcttttcccgcgcggggtgtgggcgcgggtgatggggcggcggctacggacgcaatcgcgcttcgacctcgcgcccggcgatccctgcggcgaaccggttctccgtcaggcgattgtcgactatttacgtctgtcgcgcagcatcgagtgccagccggagcaggttgtggttagcggcaactatgcggcctcaatggcgctaattttgcgtaccctcgcgcaaccggggctgcatatgtggatggaggatccgggatatccgttcattcgcccggtggttagcgcggcgggggtcaatatcgatccggtaccgattgaccaacagggaatggatatcgactgggcgcaggcacactttccgcaggcgcgctttgcgctgttgactccagcgcatcaaagcccgctcggcgtggccctatcgctggagaggcgccgccaggtactgcagtgggcggcgcagcgcgatagctggattattgaagatgattacgacagtgaatttcgctatcaggggaaaccgttaccgccgctgaaaagcctcgatgcgccacagcgggtactgtacgccgggtcatttagtaaatcgatgtttcccgcgctgcgcgtcgcgtggctggtggtaccgctgccgttggcggcgcggtttcgccgtcaggctgaattgagccactgtaatgtaccgaccttatggcagcagacgttagcggacttcatcaatgagggacatttctggcgccatctgaaaaaaatgcgcgccagctacgcgttgcgcaggcagtggctggcgctcggcgctgcaggcgcagggttttcaggtagtaccgcagtccggcgggatccaactggtgatggcg

SEQ ID NO: 5544 - DNA, 465 bp, Glycine max
  Peptide Sequence Number=SeqID_97229
atgaattgcgttttcttcatgtgtcctccaccttcgagtttggagccatgtcgtagtgattgcttagtgcaattctccattctcaacctttttcggagccccatgaattgcgttttcgttcatgtgtcctcctccttcgagtttggagctatgcgtagtgattgcttagtgcaattctccattctcaacctttttcggaagcccatgaattgcgttttcattcatgagtcctccaccttcgagtttggagccatgtgtagtgattgcttagtgcaattctccattctaaacctttttcggagccccatgaattgcgttttcgttcatgagtcctccaccttcgagtttggagctatgcgtagtgattgcttagtgcttaattctccattcctcaaccttttttcggagcccatgaattgcgttttcattcatgagtcctaccttcgagtttggagccatgcgtag

SEQ ID NO: 5545 - DNA, 348 bp, Glycine max
  Peptide Sequence Number=SeqID_97230
atgagggttcactgttatcaagtaagtcggagacctagcatgaccacagattcacctccactccttatgttcccatggacccggagttatatgcaagaacgtaagagaaataaaaggaaaccgacaaaagaggaagtcatgatattgcacgagattagaaggcctaactctctaaaaacaatccccagtggagtcgccaactgtcccaacctacccatcggcgggagggcgacgcgtgactcgcgggtgcatcttccaagaaaggaaaatgagcggagtcgccaccaacgttatttcgagaaaaacgtcggaaaaaccggaaaggtgtggtctacgaactttaagtga

SEQ ID NO: 5546 - DNA, 436 bp, Glycine max
  Peptide Sequence Number=SeqID_97231
gatccgttggaggagcaggcctcacagggttcctttgtcgcctatggacgttaggatgtactggctgctaccattgggcgaccagaacacccttgtcgtgtgcatgctactagagccggtgtcatgtcccagtttcaatcgcagatgcaatcacagggactcacactaccgccttagcccaagattggtccttcagcttctcatgtcaacacaaaggagagttgtgttgatccctcagggaatgaccaagacacgggggtccacaaccattcacaacatccctttgtgccatgatcaaatcaaggttggtgttgaggaagttagagatgtagatgctcccattcctatacccactgaagaggttcagttagtagggcagacacttaacaccttcgttgcatggccgacacatcttgtgaagcgtttatcagaatag

SEQ ID NO: 5547 - DNA, 387 bp, Glycine max
  Peptide Sequence Number=SeqID_97232
atgggtgaaacagacgaggtgcaagagcggataaaggccaacttggaggccatgaaagagcaaatggccataatgatggaggccatgatgagtatgaacaagataatggaggtcaatgcagctgcagttgccgctaccagtgtcgttgttgaggtggacttgactcccacatctggcctcaaccaaataaatcatgtcatctcagatatggtagggcagagaggcaaagaattaggaagtacaggcggcccccattttgtgcaagttcaaaacaagcattccttcccaccatatgacttggctcccaaccatacaccgctcaatgttgcacacactcccaatgaggatgtcgacaactctacacccatacctattgagagccaataa

SEQ ID NO: 5548 - DNA, 249 bp, Glycine max
  Peptide Sequence Number=SeqID_97233
atggataaagttgatatctttgtccctcatcctctcacaaacgcatgtttgcttattcaactttcaccggaatgtgagtccacttctcgtgcctacttccagtcctcaagcaacccacttgagattttccactctctttgtaaaactccttctacaaagtctgaaccacacagggacaacccttcccttgtgttcaagaatcctctacaacaagagacccacagtctcttaatcccttttaagaaataa

SEQ ID NO: 5549 - DNA, 459 bp, Glycine max
  Peptide Sequence Number=SeqID_97234
atggataatgaagagggcatgcaggaacagatgaaggctgatctatcggccttaaaagatcaaatggcttccatctcggaggtcatgttaaaactccagaaaaccatagaggataaagccaccgcaaccgcctccagtacagttagggaagcggagccggtgctgcagcccgccttgaatccgggcctagacagaaacacggctgtgttcagtcgaaggtatagtccgcaagcttatccttatggcctacctccggacttcaccccccgtgccactccggaagatttaagccaagcccctacttttgaagggcaactcccaccttatgaagactatcccggacaagacgatggggaaggagatacccatcttggccccctgctccacctcaaagatccatccctacatgaactaccccagccgaacatagtccgccatatcccggcctcacccacaccc

SEQ ID NO: 5550 - DNA, 738 bp, Glycine max
  Peptide Sequence Number=SeqID_97235
cccagaggaatttccatacaagtggatttctaggatttcaaaacaaccaacaatatcaacagcagagacagtggcaaaatcaccctggtaaccaattcaatacagaccagggtggttcatctacaagcccacaacaacagatgccaagtctctatgaccggaccacgaagttggaagagactctagatcaattcatgcaagtgtcaatgtctaaccaaaagagcactgagtctgcaattaagaatctggaagtccaggtgggccagcttgcaaagcaattagctgaaagatcatcaaacagctttatagcaaacacagagaaaaatcctaaagaagaatgtaaagctgttatgacaaggagcagaatggcaacccatgtggatgaaagaaaagttgagaagaagatggaggaacataaacaacagttggcagctgagccgacacttaaatcggttaataatttagttaaacttgaagaaattgttgaggaatcagaaggtgatgaagaagtagagacaccaaaaaccgtgcaaatagaaattttcaaattttcgaatttgggtcttccagaacattttggaagcggggttgcttatggaggaactgtttttggtgaaaaaaattgtttccgtgaagaaaatccaagccgaggtgctttcgtaacgcttctgagacgtttctgtgagcaaatccgtgaaggttttccgtcgttcttcaccgttcttcgttcttcaagag

SEQ ID NO: 5551 - DNA, 513 bp, Glycine max
  Peptide Sequence Number=SeqID_97236
atgattatgaggggccaagacatttatagtagccaagatgaggttactacttcaccttcctctagtgaaagtgaagaaggaaaagtggaggaatctagtgaagagatctacccgcaagaagaagtggaccttttaatggtcagaaggcttctaggaggccaatcttgtgacttgacccaacctcatttttcacagaaggtcataagattagtctctaagttgagccttgttatcactccctatccaaagccttacaaacttcaatggcttaatgaccaaggggagatgatagtcaatcaacaagtgaaagtgccctgctacattggaacatataaggatgagataaccctcacccaccttggaacaaagtttgtgttgcatcctcaaacaccttcacaggtggccaaagatcaactaactatgaaagataaaaagggtgaggaagaaaaactagaaaaacaaaagaaaaacaaggattgtaaggccttgtcttcaaaggccaaggagaagtaa

SEQ ID NO: 5552 - DNA, 234 bp, Glycine max
  Peptide Sequence Number=SeqID_97237
atgaaacttgcttctacagagatttccttggtcaaagtagtatggggaagagcttcgggcaaggatgccacctgggagctagagggtcagatgcgtgatgcatatcctaccttattcgataccgcaaccagaggaggagctctagagagcactagagatgccacaattgctaacggagaacgtttgagcgactacatcaaggtaaaggatgagttactcacgcctggggattag

SEQ ID NO: 5553 - DNA, 1506 bp, Glycine max
  Peptide Sequence Number=SeqID_97238
atggtggcggcggtaaaaatgacgatcgtgttgatggtgacgatcgcggtggtgattgttgttgtggtctccaagcataagaaaacacttttgcattgtttgtcactctttatggtctataaagtaatagaaacttatgatacagaaaaaccaagtaaccaagttgtgaacaagatgaagaagaagctttctctttatgcttttttgctcaatttgagtctcttggttcttcttccttacagcaaagccactcaggctgataagcttcaagatttgattctgtctaagagctcgcagaagccacctgtgaccctttcttgggcagaggaagatgcgttgaaaactcattcttctgcatatgttgcatcccaagaggggcaaaaggaagctgacaagattgtcgcattgcctggccaaccctatggggtgaattttgaccaatattcaggctatgtcactgttgatccagaggccggaagagcacttttctattattttgtggagtcttcatataacccttcgactaaacctttagtattgtggctaaatggaggacctggttgttcctcactggggtatggtgcctttgaggaattgggacctttcagaataaactctgatggcaaaacactatatcgcaacaaatatgcttggaatgtagtggcaaatgtgttgttcttagaatcccctgctggagtgggcttttcctactcaaatactatttctgactatgagcattcaggagataagtcaactgcaaaagatgcctatgttttcctgatcaattggctagagaggtttccagagtacaaaacccgcgatttttacataactggagagagctatgctggccattatgtgcctcagcttgcatacactattttggtgaacaataaattcagtcaacaaaatattaacctcaaaggcattgctatagggaatgcttggattgatgatgttacaagtttgaaggggatatatgattacatatggactcatgctttgagctcagatcaaactcatgagttgattgagaagtactgcgatttcacttctgaaaacgtttctgcgatatgtgccaatgcaacaagaacagcctttgaggagaatggaaacatagacccttataacatctatgctccactgtgtcaggactcttctcttaaaaatggatcaactggttctgtaagtaatactcctatatcttggttactaaatttagatgatgtgttcttctacagtggtgatactgattcagttgttccagtcacatcttcaagatattcaatcaacaccctcaagctccctatccaggttccttggcgtccatggtattctggaaatgaggttggaggatatgtggttaaatacaacggtgtgacatttgttacagtaagaggagcgggacatctggttccaagctggcaaccatcgcggactctgactttgatattttcattcctccatggaagcttgcctcctacttcaccatggaagggtttctag

SEQ ID NO: 5554 - DNA, 144 bp, Glycine max
  Peptide Sequence Number=SeqID_97239
atgactgaagcacgtcaaaaggaggggaggagcttgccacccagctcgcccaggcgagctcatctcgcccaagtgagcaaggttgcttcctccagaagcaaccgccttctggaggaagaaactggaaggcccaagtgggcctga

SEQ ID NO: 5555 - DNA, 447 bp, Glycine max
  Peptide Sequence Number=SeqID_97240
tcgggaaacctgtcgtgccagctgcattaatgaatcggccaacgcgcggggagaggcggtttgcgtattgggcgctagcggagtgtatactggcttactatgttctcactgatgagggtggcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacaaacggggcggagatttcctggaagatgccaggaagatacttaacagggaattcgctccaagctggactgtatgcacgaaccccccgttcagtccgaccgctgcgccttatccgtcatgcgccggttaaggctaaactgaaaggacaagttttggtgactgcgctcctccaagccagttacctcg

SEQ ID NO: 5556 - DNA, 165 bp, Glycine max
  Peptide Sequence Number=SeqID_97241
atgccacatcctatcagagcattgtgtcccgacatccttcagcacatgatcatagggagacctgtcagggtcatgatgttttgcgagaatgctccaactatatgggatcagcataggcttaaaggagcactcaacccggtgactgtagacaaaggatcaagctga

SEQ ID NO: 5557 - DNA, 507 bp, Glycine max
  Peptide Sequence Number=SeqID_97242
atggccaaagtttcaaccaccatgaccatcgaaaaatcgatttccggtggaattgccaccagaagaagtccgagaagtcaaattgacctgtacctgagaattagggttcgctatttgggcagaattaggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 5558 - DNA, 252 bp, Glycine max
  Peptide Sequence Number=SeqID_97243
catttcgtttctaaacgaccatttagaggaaacactaggtccaacgaaagtagaagaaaatcactcaaagtgtaccaatctcacacagggcaaggattgacattctcaccctgggtcaaggtttacggtaagttgggattttggctcaaggcttgtagaacggctggacatagtatatgtcagggtttggctagcggttcggggataaaggggatgtcccacattatttccatgatacacatgcaacaatga

SEQ ID NO: 5559 - DNA, 687 bp, Glycine max
  Peptide Sequence Number=SeqID_97244
atggatcctcagatcataggaggtgtctatttgttgacaaaagcaacagtaaagttccctaaggtactccaagttttacgggactttgaacagtgcagcatgtatgcatggggacctgccgtgcttgcttatttatacagagagatgtgcagcgccaacgattacaaaataaaatcaattggaggtatgtgcatcttaatccaaatgtgggcatgggaacactgcacgactttggctccaaagagaactcctcctgtaatagaaaataaaccactcggacgcaggtggctgcgacgtggaaaccaacatattggcaatgatgatctaatagttttccgtcgcaaattggatatcatgaaacgacatgagtttctgtgggagccttacacaacaactgttatgtcgatgttgcctcccatttgtttggttggtagtgtggcgtggcgaaaaacaaagatgtttgtcgacccaaacaatgcaaacacagctacattgggtgaagttgtggagacattgcagtatatggtgtcaccacaagggcggaacacatggacagttgatgatctcgtgccttatgtggagaagataacgattttatccgatgagcaagagaggatcatcgagcctgtggcacatggtccagcatcagagcgtcgatttcccccacaacagtttcacatgctttag

SEQ ID NO: 5560 - DNA, 378 bp, Glycine max
  Peptide Sequence Number=SeqID_97245
atggccatccaggtcctggaagccacgctggtacatgaagcccaggtcgcgcgccggctgcggctcgctggcgccggcggccagtgccttgtccaccagcacatcaacggcctcgcgactgggtgccgagagcgcattgatcacttccgtgtgggtgcgcgcatcggcaatcggcttgttggtgaactgctggaaaaaaggttgggtcagcagcatcacgtagatgctctcgctgatgaccatgccagccgcatcgtcattggtataggttggattgaagctgtagcccagcgcggtgaagaacgccttggacttctccagatcctgcacgggcaggttgacgaagatcatctgcggttgtggtgcactcattggtaa

SEQ ID NO: 5561 - DNA, 408 bp, Glycine max
  Peptide Sequence Number=SeqID_97246
atgggtgaagtagaggaggtacaagacaagatgaaggccgacatggaggccatgaaagagcaaatggccacaatgatggaggccatgatgagcatgaagaagataatggaagccaatgcggttacaattgccgctaccagcactgttgctaaggtgaacccgatgcccccatcttgcctcaaccaaatgaatcatccaaccttagatatggtaggcaaagatttgggaagtagggacggcccccatgatgtgcaaaatcaaaacaagcacgccttcccgccatatggcctgcctcccaactatacaccacccaatctggcgtacactcccaatgaggatgtcaataactccactctcatactcgttgagagccgacaaccccaaactgatcatgcacatgtctcttaa

SEQ ID NO: 5562 - DNA, 63 bp, Glycine max
  Peptide Sequence Number=SeqID_97247
atggagttgtctactgctttgcctgagaataacaattgtttgaccacaacaacgctggaggcg

SEQ ID NO: 5563 - DNA, 372 bp, Glycine max
  Peptide Sequence Number=SeqID_97248
atgcattctgaagctgaaccactagaacatatgaagaaaaaacatacaggccatcaaagtgtgtcactgaagaataagacaggagattcaactgtgctgaagataggagattcgactaaagttgtgataaaacaagacatgaagggaggacagcataaatatgggtttaacaacaacaaatgtgagaagccagagaaggtaagggtggtggatgatgaaactggcgacaaacatgagctgtttgaagtcctaaggattgcatctagatgtgtatttttcaaggtcttcatgtcattccttcatcattcaacgtgttcatgtcattctttcatcattcaacgtcttcatgtcattctttccccgacagtttga

SEQ ID NO: 5564 - DNA, 537 bp, Glycine max
  Peptide Sequence Number=SeqID_97249
caatatggagtcaatgagcaacctgaagcttacgctgcaaacatttataatagacctcctcagcagcaaaaccaaaaacaacagaataattgtgacctttcaagcaatagatacaatccaggttggaggaatcatccaaatttgagatggacaagtcctccacaacaacaacaacttgtccctccttttcagaatgctgctggtccaagcaagccatatgttcctcctccaatacatcagcagtcacaacaaagacaacaagcaactgaggctcctactcaaccttccttagaagagttacaagagacaagagcctccattcagagtctgacaaatcagatgaggcagatggctactcagatgaatcaagctcaatcccaaaattctgacaaattgccttcacaaactgtgcagaatccgaaatatgtgagtgccatcaccttgaggtctgacaaccaaattcaagtgcctccaccagtagcagcacccacacctgaacctgtcaagcttcattctacacctgaaaaaagaggatga

SEQ ID NO: 5565 - DNA, 162 bp, Glycine max
  Peptide Sequence Number=SeqID_97250
gggggggtgcaaatagcaatttcgaaatttgcaatgggcccttcccgaccgctttttgaagggaaaaaggttgatggaggaagccacccagctcgcctgggcgagctaaggtcgcctgggcgagctgggcggcaacctcctccccctttttcctataaatag

SEQ ID NO: 5566 - DNA, 240 bp, Glycine max
  Peptide Sequence Number=SeqID_97251
atgtgcacgtgtgcaatttttggtagccaagatgctttgagtatgcatgaaatggccccgaggaagcttgcctcaaagaggtccaggaaggataaggcggccgaaggaactagttccgctcctgagtatgacagtcaccgctttaggagcgctgtacaccagcagcgcttcgagcccatcaagggatggtcgatttctccgggagcgacgcgtccagctcagggacgacgagtatactga

SEQ ID NO: 5567 - DNA, 207 bp, Glycine max
  Peptide Sequence Number=SeqID_97252
gaagcgctcctcacacgccagacgtcatatcgaagatcgcaacggtcaggtcgtggacatctgtcctgtgaacctccagacaaatttcaagaagattcaacagttagcgaaggatgggcagcatttttatcgagacaacttcatgtagcttccttgagaagcttcattaaaaggcttcctcaagaagctttctcgtggcttctttga

SEQ ID NO: 5568 - DNA, 567 bp, Glycine max
  Peptide Sequence Number=SeqID_97253
atgcagctaccgcaaaagcccttgaacaagaaaccaagagggctcgcaaggaagagcatggccgtgataaattccatggagcgttgtggggcagcaacagagagctcaagcttcgaagggaagagagagaccgatcacgagcacatagcatggtccaaaagaaacttgtctcagcgtttatgcgagacagagactaacatgttagctatgatcaccaagtaccaagaagaactaagtctagccacgacccacgagcatagggtggcggacgagtatgcccaagtatacgcggaaaaggaggctataggaagggtgatcgactcgttacaccaagaggcgaccatgtggatggaccgatttgctcttaccgtgaacgggagtcaagaacttccccgattgctagccaaggccaaagcaatggcggacacctactccgcccccgaggagatccacggacttctcgactattgtcagcatatgatagatttaatggcccatataattaggaaccgcaagggaacttgtattgtcactcagatcttgactagttataaactttttgaataa

SEQ ID NO: 5569 - DNA, 111 bp, Glycine max
  Peptide Sequence Number=SeqID_97254
atggatgacgaggagctgccctcacccgtgaactccgatgtggtacatagggacggatgcaagtggggatggggtcacgaccgaccgatcattgccccttcccggcgctaa

SEQ ID NO: 5570 - DNA, 435 bp, Glycine max
  Peptide Sequence Number=SeqID_97255
atgccacccactaggcaccctctggacccagataagtctaacagggccctggggtttctggcgttgattacgagcctctgccagtcattcggggttcccatcacccctagtaaggtgatccaaccaccgatcactcgggccttcgttgaaaagtattgcacgcctaggcaggcgcagggtgatgcacatcaggccgcagacgctcagccaccacctcatcaggccgatcccgctggatcactaggcatggagcgttatctacagcacttggttcgccagcaggcggccaaccaccgggggcaggtgcagatacatgagtgtcccaatcggagactgaggttgcatgacccggagacttgcccgaagcccaggcaggagaggagcctgcaggatcccccagtgaggcagaggaggctcgtatggatgatgaaatga

SEQ ID NO: 5571 - DNA, 216 bp, Glycine max
  Peptide Sequence Number=SeqID_97256
atgggaagaatcaaaagaattctcagactgtgtcgttttgaattctttgacaagggagaagggagacacaaaagaattcaggcggttagtccttccttcttttggaaaagagagaagaaagacacaaaaagaattcaggcgaaaaccagaaaacttcagaaagcttttggcacaaagaagaagaagaagaagttcaaagagattcaaggcttgtaa

SEQ ID NO: 5572 - DNA, 381 bp, Glycine max
  Peptide Sequence Number=SeqID_97257
atgactagtagaaagcagaatcacaccattaggcagatgggaattcacaatgacaagggctgggaatggaaattttcatggagaagactgctttttgacaatgaaattgatacaaccatcaattttcttagggaggtagaaggacaaagcatacagcaacaacaaactgacatttgggagtggctaggagatccatcagggaattactcaactcgcagcgcttacaatctaatatgtgaggaaattgctggtggtcagaaggaggattggagtatggaactatggaagacaaacatacctaccaaaattgcggtattcgcttggagattatgcaggggcagattgcccacaaaagagaatctgcgtaaaaggcacatgtag

SEQ ID NO: 5573 - DNA, 120 bp, Glycine max
  Peptide Sequence Number=SeqID_97258
atggagaattggcgaacagcgctaggcaatgacattcgcggggctccagactcgaaggcaatcatgaagcatagctccaaactcgaaggtggaggacacatgaacagcgctaggcaatga

SEQ ID NO: 5574 - DNA, 375 bp, Glycine max
  Peptide Sequence Number=SeqID_97259
atgaattgcgttttcgttcctgggtcctccacccacgagttgggagccatgcgtagtgattgcttagtgcaattttccattctcaaccctttttgggagcccatgaattgcgttttcgttcaagcgtcctccacccacgagtttggagccatgcgtagtgattgcttagtgcaattctccattctcaacccttttttggagcccatgaattgcgttttcgttcatgcgtcctccattttcgagtttggagccatgcgtagtgattgcttggtgcaattatccattttcaactatttttcggagacccccagaattgcgttttcgttcatgcgtcctccacccacgagtttggagccatgcgtagtgattgcttag

SEQ ID NO: 5575 - DNA, 264 bp, Glycine max
  Peptide Sequence Number=SeqID_97260
atgcagttcgctccaagctggactgtatgcactaaccccccgttcagtccgaccgctgcgccttatccggtaactatcgtcttgagtccaacccggaaagacatgctaaagcaccactggcagcagccactgccagttacctcggttcaaagagttggtagctcagagaaccttcgaaaaaccgccctgcaaggtggttttttcgttttcagagcaagagattacgcgcagaccaaaacgatctcaagaagatcatcttattaa

SEQ ID NO: 5576 - DNA, 696 bp, Glycine max
  Peptide Sequence Number=SeqID_97261
atggctccgaagaaacactccacgaagaggtctagaagagacgccacaggagaagggtccagtgccgcccccgagtttgatagtcatcgtttccggagtgccgatcaccagcagtgcttcgaggccatcagaggatggtcgttccacagggagaggcgtgaggagatagctcgcagacgttggacatcgctggtgactcccatggccaaatttgaccctgagatagttctggagttctatgctaatgcttggcccacggaggagggaatgcgagacatgcattcatgggaaggccaacagtgtgagttcagccaaaggaggaacagggccgacgggttcgatgaggaagccattgcccagctgttgtgcacaccggggcaggatttcacccggaccgctgcagggaggcgggtgcggatcatgcgcaccagcatgaccactttgacccagacatggatgacactgctgctcaacaatgtcttgcctagcgatcacaactccgatctccctctgcctaagtgccagttggtgtatgccatcgtgaaggttttccaccgttcttcatcgttcttcttcgttcttcagtcttcaaccgtcgaaatgactaataaccaaagtgaaactaaggctaaaatcaactcacaaatcaagcttttgtcatcacctaaaaaccattttaaaggttcaacaccttga

SEQ ID NO: 5577 - DNA, 411 bp, Glycine max
  Peptide Sequence Number=SeqID_97262
gtagagctttcaaggccagagcttgtctccaaggaaagaggtcctgaaacattttgtggaatttttatttgtgcccctgcaattcttgaagcatggccaaaagttcaagtgctggctgattatcctgtaccttctagcatattgttgagttttgattcctctattgaagaccaaacggaagtagctgtagaggtggttcaaaagttgcaaccacgtgaagcatcaacaatgtttattgagaacaagagagggtacatctcttgtggatcagttcaagtggagggtacatccacttggttgttcaaagagaacaaggaagggtacatcccttgtggatctttggcttgtaaaggattttacaaggttgaaagaaatctcaagaaccgttggttgcttggggactggatgtag

SEQ ID NO: 5578 - DNA, 147 bp, Glycine max
  Peptide Sequence Number=SeqID_97263
atgttccctgtattaaacagtgctttgaaagaacttgatgatactccacaacctaaatccaaggctggagctaggtggattgttgttaagtattttaatgatgttagaccattgaaagcaaagagattgaaggcacttcgcatctag

SEQ ID NO: 5579 - DNA, 387 bp, Glycine max
  Peptide Sequence Number=SeqID_97264
atgcattctgagcattctgttgctggtgattctgaacattctaattttgagcattcggctactaattttcatactgggaacatggctcaatctccacctcatgagaggactcttagggagatggctacacctgacttcacttatgaaagcttgtgcattcaatatcctgataaggatgttccatatgttctcaagactggactaatacatttgctgcccaagtttcatggtcttgcagagggagtggcgaaagattggttgtactaccttgctcccaggtccattaccagttgggatgaccttaagagggtgttcttggagaaattcttccctacatctaggaccactgccatcagaaaagacccctccaggcatcaggcaacttag

SEQ ID NO: 5580 - DNA, 297 bp, Glycine max
  Peptide Sequence Number=SeqID_97265
atgaaaagagatagagcttacagttggcatagtcggcggtggtgctgctgccaggggagggggagccgattgggtgaaggaatgagtttgcggcttcggttgttggtcatcgtcactgtgggaggcgaggatgtcaaggccaaggaggtggaggtggagggcatggacattgagggaggtggcaaggagagggaggttgagggtggtgtaggacttgagggtaaagctgaggaggtaagggtcaagggggaggagaagggtggaatgaatggggcggaaaatgaaaatggcttttga

SEQ ID NO: 5581 - DNA, 409 bp, Glycine max
  Peptide Sequence Number=SeqID_97266
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgtatgccgc

SEQ ID NO: 5582 - DNA, 99 bp, Glycine max
  Peptide Sequence Number=SeqID_97267
gtttggaaaaccagaaaacttcagaaagcttttggtacaaagaagaagaagaagttcaaagagattcaaggcttgtatgaaataagtgctcaagattga

SEQ ID NO: 5583 - DNA, 213 bp, Glycine max
  Peptide Sequence Number=SeqID_97268
atgcagagactaacattgtctcctgcaccttttgtcgtcctgacccgtgaagtcagggttaccttatggttacccgcacctttcgtcaaccagggggcaaacgagcccattgacgcgaagagaccgacgtcgtcttctgcaccttttgtcatccagggacagcgagtcaggtggtttttactctcgtcgtctggaaacattcaagcccaatga

SEQ ID NO: 5584 - DNA, 387 bp, Glycine max
  Peptide Sequence Number=SeqID_97269
atgctaaacatccaaaatctcatttgtggttatgagaaaatttcatcagcagattctccttccccgcacgttcgcattttagcgaagaaaacatcgagactatttctagtctcacgagttctagaactacgtaggtctgagttcctcattggaggatacgtaggagcaggagcctcgcttttgtcgaccgcaccgctttttgttaccatgacccaaaagctggtagcccgcggagacaccttacggttatccgcacctcgtcattcagtaaccccaagtgtgattgacgagcggaggccaatgtggtcatctgcgccctttccggaggtgtcagcattttccggtggagactttttcaagtctcacaagttatctagaactacgtag

SEQ ID NO: 5585 - DNA, 162 bp, Glycine max
  Peptide Sequence Number=SeqID_97270
atgactaaagcacgtcaaaagggggggaaaagagggaggtggttgccgcccagctcgcccaagcgagctgggttgcttccaccagaagacaccaccttctgttggaacatcctagaaggcccaagtggggctgattgctatttgcacacccttgtttactaa

SEQ ID NO: 5586 - DNA, 1050 bp, Glycine max
  Peptide Sequence Number=SeqID_97271
atgtcctcgccatcagaggactacacgtccttgacttcagaggactacatgtcctcgctttcagaggactacaagtcctcacctttagaggactacatgtcctcgccttcagaggactataggtcttcgcctttagaggactacacgtcctcaccttcagaatgctacacgccctcgccttcagaggactatacgtccttgccttcatatggatgtacgcaaacgtttagaggactagacatcctcgccctcagagggcttcgtgtcctcatattcagaggaccccatgtcctcgccatcagagggctgcatactctcaccttcagaggactaaacgtcatcaccttcagaggactacatgtcctcaccttcagaggacgacacgtcctccccttaagaggaccacatgtcctcaccatcagagggttgcacgcccttgcctttagaggactacacgtcctcagcttcagagcactacacctcctcccctataaaggactacccatcctcgccttcagaggaatggatgttctcagcatcagagggctactggccgtcaccttcagaggactatatgtcctcgccttcagaggactacacgtcatcaccatcagaggacaacacgtgctcaccatcagagggttccacgccctcgccttcagaggactacccatcctcaccttcagagggctacacgtcctcctattcagaggactacacgtcctcgtcatcagagggttgcacgccctcgcgttcagagggttgcacgcccacgccttcaaagggctacatgtcctcaccttcagaggactacacgtcctcgccttcagagggttgcacgccctccccagcacgggaggactacacgtcctcccctgcagaggactacacgtcctccccaacagaggactacacgtcctcgccttcagaggactacacgtcctcgccttcagaggaatggacgtcctgaccttaagagggctacacgccctcactttcagaggactatacatcctccatttcagagggctacacgccctcgcctttaga

SEQ ID NO: 5587 - DNA, 1107 bp, Glycine max
  Peptide Sequence Number=SeqID_97272
atggtgaaagttggaacctcttacgtgccgatcaacgtctcattttcgccaaaagttggcccagggcttcccggtatcaacagggacaccaggatttatttattctgcgaagtgatcttccgtcacagcttacttataccttcaacctatgatggtgtttttgaggtgctccagtggcttctgtttctatcagctgtccctcctgttcagctactgacggggtggtgcgtaccggcaacaacaccgccggacatcagcgctggcaagctgcgcaactgttgggaagggcgatcggtgcgggcctcttcgctattacgccagctggcgaaagggggatgtgctgcaaaagcgattaagttgggtaacgccagggttttcccagtcacgacgttgaattcgatcagccggtccgaggaagaacccccagtacagagggctcatgcggtcgacgccggtctcgacgcccagcccgctgccgaagaggatgccgaagaacggggcgagcagcgccacggccaggcccagcagcatgcgccagaacccggacggggtgggctccagccgaacccggcgaccgggccggacgggagcgtccgcagcaggcgcggccggggcctgggcgcccgtcgaggccggggcggggggatcgaccggggtcgaggtgcgggggtcgtggtccgtcatgagggtcctcctgagctgtcctcagcggcgggcggcgggctcgtcccgtcctccccgggggcgaactgcttcagagcccccatcaaggggggggaagaccacggtggagttctgatccgcccccagctcgagcagggtctgcagataccgcagctggagcgcagcaggggcctcgccgagggtccgcgccgcgtcccgcagctcctccgaggcctcgagctcgccgtgggcgctgatcaccttggcgcgccgctcccgctcggcctcggcctggcgagccatcgcccgctgcatcagctcggggatctccacgtccttgatctcgacgaccaccacgtccacaccccagggcacggcctgatgggcgatcgactggtagaggtcctcgttgagatccgcgcggtgggcgagcagggtgtcgag

SEQ ID NO: 5588 - DNA, 663 bp, Glycine max
  Peptide Sequence Number=SeqID_97273
atgcggtggcgacctcgcagttcgcgcagaccacgctgcgctcggtcgtcggcccgggcggacctcgacaccctgctcgcccaccgcgcggatctcaacgaggacctctaccagtcgatcgcccatcaggccgtgccctggggtgtggacgtggtggtcgtcgagatcaaggacgtggagatccccgagctgatgcagcgggcgatggctcgccaggccgaggccgagcgggagcggcgcgccaagaccctgctcgagctgggggcggatcagaactccaccgtggtcttccccctgccgatggacatcatcacccccttgatgggggctctgaagcagaggaccctcatgacggaccacgacccccgcacctcgaccccggtcgatccccccgccccggcctcgacgggcgcccaggccccggccgcgcctgctgcggacgctcccgtccggcccggtcgccgggttcggctggagcccaccccgtccgggttctggcgcatgctgctgggcctggccgtggcgctgctcgccccgttcttcggcatcctcttcggcagcgggctgggcgtcgagaccggcgtcgaccgcatgagccctctgtactgggggttcttcctcggaccggctgatcgaattcctgcagcccgggggatccactag

SEQ ID NO: 5589 - DNA, 165 bp, Glycine max
  Peptide Sequence Number=SeqID_97274
atgtctgattcacgtgcatcatatatcgagacccttgaaattgactacggaagctctcggcaaattcaaacggccataacttttgactcgaatgctaaaggcccaagtggagaaggacgaaggcccaagtggagaaggacaaagcccccgagtggagaaggatga

SEQ ID NO: 5590 - DNA, 171 bp, Glycine max
  Peptide Sequence Number=SeqID_97275
atgggggtgcaaatagcacccaggcccacttgggccctccagaatattcctccagaagccgaggcgcttccgaaacgtttccgtaatgttttccgtgaggaatttcgcaaaggtttcgaccgttcttcgacgttcttcattcgttcttcatcgttctttgatcttcaacgg

SEQ ID NO: 5591 - DNA, 294 bp, Glycine max
  Peptide Sequence Number=SeqID_97276
atgcaatcatctcctctttggctttcggaatgctacgaaactttacggattgtgcatcaagacttccttttgacttccggcacgtcacaaaacttcacggattgtgcaacaatgctttcttttgacttccggcacgtcatggaacttcacggattgcctaacgatgggtgccaagtacctcgaagtggtcaaatgagggttgcatcccaacaaacagatggtcctcggacgaaattagggtatgacacattcttacccaatgcatcccccaaatttgggacaaatttaccttga

SEQ ID NO: 5592 - DNA, 297 bp, Glycine max
  Peptide Sequence Number=SeqID_97277
atggatattgatgctgaaaatctcatggactgtgttatggagaaaaacaaccaaaattttcgtttatcaattgatatagtggttatggatgggagaggctgcacggttattactgggaaggaagagtgtacagacttgtcataccctaatttcgtccggggattattacttgatgatatgcaacctttgattggccgcttcaagatacttggcaccctttgttgcacgatatgtaagtttcgagacacgccggaaatcaaagggaagcaaggttacacgatccgtgaaattccgtaa

SEQ ID NO: 5593 - DNA, 405 bp, Glycine max
  Peptide Sequence Number=SeqID_97278
atggtgcaaaagaaggacaaggaactcagaggcagtagcaatgggcccatcggttgctaccataggtggttgaaagcctacacgcaaggtgtggattggctcccgaatttgagaaccactaagggggtggaagttgaagctccgaaggaggacgaagaggttcaggccctcaggacagaactcgagaaagcccaaatagtcaaagaaaagttcaaatcaacaaatattaggattcgaaaggagaacaccgaactgagagacataaatatagccagcaccaaggccttggaacaagagaccaaaagggcccgcagggaagaacatggccagaacaaattccgaggggctctgtggggcattaacaacgagcttaagctccggagagaggaaagggaccaatcacga

SEQ ID NO: 5594 - DNA, 360 bp, Glycine max
  Peptide Sequence Number=SeqID_97279
atgacaccggtaaaccgaaaggcaggaacaggagagcgcacgagggagccgccagggggaaacgctggtatctttatagtcctgtcgggtttcgccaccactgatttgagcgtcagatttcgtgatgcttttcaggggggcggagctatggaaaaacggctttccgtaacggccctggctattcctcttatgaagtggatcgtcgctggctgcaatcgaattcctgcagcccgggggataagccactttctagcgtgccgccacgacgcgagtaggagctcaggacgaggaattcgccctggaatagtgatccgtattcacatattcatgctgcgcccgtcagttttttctctcacatga

SEQ ID NO: 5595 - DNA, 507 bp, Glycine max
  Peptide Sequence Number=SeqID_97280
ggttaatttcgagcttggcgtaatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgtcctgcctttcggtttaccggtgtcatcgctgtatgccgcgtttgtctcattccacgcctgacactcagttccgg

SEQ ID NO: 5596 - DNA, 381 bp, Glycine max
  Peptide Sequence Number=SeqID_97281
atgtctttcctaaggagattcctcatggactgccaccttcaagagacagagaacatcaagttgatctcctccccggagctccattgcctaacaggccaacttacaaaagcaatcctcaagagactcaacgtaaggatgcacatgccaaagttgagtgcaaatgcaaagaagaatgaaagctatgccaagcaagccaacaagaaaaggaaggaagtggtacttgaacccggtgatgatcctggacatttgaggacaaatgttttccaagaaggagggaatgatgagaatcctgaaattggccaaatacaggctaaaggcccaagtggagaagggcgaaggcccaagtggagaaggataaagcccccgagtgaagaaggatga

SEQ ID NO: 5597 - DNA, 183 bp, Glycine max
  Peptide Sequence Number=SeqID_97282
atggcatgccttgccaaagatggtacatcctttgtggtacaagtagagggtacatctacttgggttattgtgactgagaacaagagagggtacatctcttatggatcagttctagtggagggtacattcactaggttgttcaaagagaacaagggagggtacatcccttgtggatctttgctc

SEQ ID NO: 5598 - DNA, 165 bp, Glycine max
  Peptide Sequence Number=SeqID_97283
atgggagctgccaccaatgtttattcgaggaaaacggtagaagaaaccaaaaaagggtctatagattttaagaataagggttcaggagttgtttacgctcggggaagggtgttgcccttgctcctacgtatcctcaagtgcaatgaggaatttaaacttacgtag

SEQ ID NO: 5599 - DNA, 366 bp, Glycine max
  Peptide Sequence Number=SeqID_97284
atggcaaaatcagatgacaatgtgaggtcacaggtgcgtattttggtcaaagaaaggaaggaagagggtgtggaggtgagatgtggtggagcagtaagacaaaatcagttggtggtgtgtgactatgtgaagtcacaggacggggtgagtctagatcttgatgccctcaatggcattgagaaggaggagggcgttgtcgctgagtcgagcgacggtggagacctcgttaggtgccttcctggtctacgaccgcgacatcgtgggtggcacaaaggccaagaacggcagcttgcggatggcaatcggcttcgccttcaaagtcttggagtagctgaattggaactcgagcggcaggcaagagagtag

SEQ ID NO: 5600 - DNA, 291 bp, Glycine max
  Peptide Sequence Number=SeqID_97285
atgaagagaagaagaagaaagaggggaaaaacgaggccgatgcactaccaaattgcgatcataatcgacttctacatcgttcttcgttcgttattcttcgttcgtcatccgggtaatggcgaccctctacccgtcgcgttggagaaaatttgtcctgtgtcatataccaaaagcaagcttcgtgatgatgaatcaagaagttttgatgataacaaagatgatgacaaaaagctcaaaagtcaagaacacttcatgataacaaagatgatgacttcaagaatcaaagaataa

SEQ ID NO: 5601 - DNA, 572 bp, Glycine max
  Peptide Sequence Number=SeqID_97286
gttatgacagagtcactactgttgttctttatgatgctaatggtgcacttgagaatcctatcactcaaaatgatgagattaaagaatatgtagatagcagatatatttctccctgtgaagctacttggagaatttttggttttccaatacatgctagaaaacctgctattgagggattacattttcatctgccaggacaacacaatgttctttacgaagatgatgatgatatagatgatatcctatcaaattcaagcatttcagattcaaaattcttagcttggatgaatagaaacaaatatttttcagaaggtagaaatcttacttattcacaatttgtttccaaattcgtgtacaaccaaaaggctagatcatggaacctcagaaagaaaggcaatacaattggcaggctaatatgggttccaccaaccactggtaaattattttatctaagaatgatgcttactacatgcaaaggacctacttcatttgaggatattagaacagttgaaaatgttctataccctacatatagagaagcatgcttcgcaatgggtttttttgcaagatga

SEQ ID NO: 5602 - DNA, 570 bp, Glycine max
  Peptide Sequence Number=SeqID_97287
atgaagcacttcactgacaccctcatcagtgccaacataggaacaaaagctggtaccgggccccccctcgaggtcgacggtatcgataagcttgatggcggcctgcggcacgtcgtcgacactgttgaggtcggaggcgcgctcagcctcctcacgacccttcgtacggccactcatgcgacccaaggcatatccaactatgccagcacccaaagctgcctggagagcgaagagaccggactcgacttcagaggaattcggctcgaagatcgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 5603 - DNA, 970 bp, Glycine max
  Peptide Sequence Number=SeqID_97288
gaggggagtttggccacaatctgctcaggggtcagttcgcgaccgtcgtcggcgataagcgccagttttcgcaggggtttgcgcttttcgctatcgacaaggaccggcaaccagcaccgtctgcagggcgcgtcctttctcggtcaggacatactcctgccaggcgctgccgtcggaggcgggctgaagccgaaggataccttcgtcaaccagcttttctgaaactcgccaaagcgcgtaaccccgcggagcgcgtcgcgaacaatcagcagcgaccaccagtcaccgatgatatccagcgaacgggcgacggggcaggggctctcttcaagacgggtacgtttcacagcacattctccggtggggcgcaagagacgccggaagggtatcagctggagcaagttttaatcatgagtcgtcataaccttcgcgctccgcttgccaacaacggcagcgtgctggagcagtcgacgccaaagcagtggcctgagtgggaagtgccgggcggtcaactcaccactaaaggcggcgtgctggaagtctatatgggtcattatatgcgcgagtggctggcacagcaggggatgatcaagaccggcgagtgcccgccagcggatgcggtgtatgcctatgccaacagcctgcagcgtaccgtcgccaccgcgcagttctttatcaccggcgccttcccgggctgtgatgtgcctgttcatcaccaggaaaaaatgggcaccatggacccgacctttaacccggtgattaccgataactcccctgaattccgcgacaaagcgctgaaggcgatggaggccgagcggcagaaaatgcagctcgcggaaagctacaagctgctggagcagatgacgaactacgctgagtcgccgtcgtgcaaagagaaaaaggtctgctcgctggcagatgcgaaagataccttcagcgctgattacgaaaaagagccaggcgtttccgg

SEQ ID NO: 5604 - DNA, 816 bp, Glycine max
  Peptide Sequence Number=SeqID_97289
atggctttttcacttaaaggtttaactcattcattggccctcgttagcgcgttgctgctagcgggctgtgggccaaaagatcaggatcctaatcatattaaggtggggattagcgcgggtatcgatcagcaagtctgggcggtggtgcaaaaagtcgctaaacagaaatataaccttgatgttgaagtggtgacttttaatgatttcgttctgcccaatgaggcgctgaataatggcgatctcgatatcaatgctttccagcataaaccctatcttgataaacagatccaggagcgcggctataagctggtagatgtcggtactacttttgtctatccgattgccgcttattcaaagaaaatcaccgctatttcacagcttccggacggcgcccaggtagcggtgcctaatgacccaaccaaccttgggcgttctctgttattgctggagcagcaggggcttatcactctgaaagagggggttggcctgctgccaaccgcgctggatatcgtgaataacccgaagaagctgaaaatcgtcgagattgaagcaccgcagctgacccgtgcgctggatgataaacaggtgaccatggctatcataaataccacgttctccagccagattggcctgtcgccgacgcgcaatggtctgttcatcgaggataaaaattcgccgtacgtcaatattttcgccagccgcgaagataataaagacagcgaaaaagtgaagaatctggtgaaagcctaccagaccgacgaagtcgccaacgccgccgccgaattgtataaaggcgatgcggtgaaaggctggtag

SEQ ID NO: 5605 - DNA, 753 bp, Glycine max
  Peptide Sequence Number=SeqID_97290
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagttccttccttgaattacaaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccacgaagatacttaacagggaa

SEQ ID NO: 5606 - DNA, 711 bp, Glycine max
  Peptide Sequence Number=SeqID_97291
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgtacagcatgatccagaggatattaacctagtgtcataccccctggtcaaaccaaattcaaatctctcatacaaagagacttttgaagtaaacaacaccgttcagaaaaaggcatgtaatgcggagttacaggatttgggcctcattactaatggcccaacatcaaagggagaggaatctgtcctcagcttaaaggtctactctagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 5607 - DNA, 273 bp, Glycine max
  Peptide Sequence Number=SeqID_97292
aatggagccgacatggaggccatgaacgagcaaatggtcgcaatgatggaggccatgatgagcgtgaagaagataatggaagccaatgcggttgcaattgccgctaccagcgttgttgctaaggtgaacccgacgtccccatccggcatcaaccaaatgaatcatccaacctcaaatatgggcaaagcggttggtggtatacccctgcaaaacacttgggagggcccctcagtatcacccacaaccacacccctcacattccacagcaagtaa

SEQ ID NO: 5608 - DNA, 225 bp, Glycine max
  Peptide Sequence Number=SeqID_97293
atgttatacgtgaatccatatcatcaaaacgatcacctacaaagggccgaagatcccaaagtgcatttgcccgtaatgccttatgcatacggtaccggaaaagataggcctagtcaatttgacgaccagtttgaaagacccacaacagaatcaaatcctcctcagaagcctgagcaagatttgttgaacggggaagcaagatatgacacaaaatatagtgcatga

SEQ ID NO: 5609 - DNA, 147 bp, Glycine max
  Peptide Sequence Number=SeqID_97294
atggattatgaaaatgaacaagaatgtggtgtgaatgaaccgcatgttgattgttctgatgcttttaatacttctaaggtgtataaactatctgtgcaaaaagagaaagaaaatcatgcgagagaaatgatgtgtaaaaacaagtag

SEQ ID NO: 5610 - DNA, 760 bp, Glycine max
  Peptide Sequence Number=SeqID_97295
ggctccaagccctaaccttcagaggactacacgtcctcgcctaggacaacacgtcctcgccatcagagtgctgcacgacctcaccttcagaggactacacgtcctcgcgattagagggctgcacgccctcacctttagaggactacacgtcctcgccatcagagggctgcacaccctcgcctttagaggactacaacgtcctcgagccctcacttcagaggactacacggctgcacacgtcctcgccattgagaggagtagcttcacgttcctcgccatcagagggcatgcatgccctcaccttcagaggactacactgtcctcgtcatcagaggactacacgtcctcgcctgtagaggactacactgtcctcgccattagagaggttgtacgccctcacttgcagatgactacacgtcctcaccatcagagggctgcacgccctcagcttcagaggaatacactacctcgccatcgtagggctgcgttccctcaccttccgaggactacacttcctcgccatcagaggattgcccttcctcgccgtcagaggactagcacgccctccttcagaggactacacgtcctcgccatcagagggctgcaagccctcaccttcaaaggactacacgtcctcgtcaatcagagggctgcacacgcctggcctttagaggacttcactgtcctcgccatcagaggctgcacaccctcaccttcaaagggcaatacgtcctcaccatcagagggctgcacgccctaa

SEQ ID NO: 5611 - DNA, 222 bp, Glycine max
  Peptide Sequence Number=SeqID_97296
atgagcctcagcctgcagagccggggttttacttcttttccgtgtcctactccggacctgttcagggcagaggttgcatggcctcgagattggcctgaggcctgggcaggagaggcgccagcagaggcaccagcaggggcttccgacaaggcagatgaggcccgtgaggacgaggagatgaccgatttacttgatttcttaggagggagcggggccacatga

SEQ ID NO: 5612 - DNA, 426 bp, Glycine max
  Peptide Sequence Number=SeqID_97297
atggtggaatgggttatgctcaagcacggattggagcctgggatgggtctaggcaaggacggcctcgggaatgccgacatagtcgatattaggggaaatccgtacaaatatggattggggtatgaacccgggatgccggggaggaggaatgtgccgtcaagacttcgggcggatagggcatggcccggccgcattagccagtgtttcgccagtgccggaatgatgtccgaggaagaggtggccgcagtaggagaggagttccctctagacccgccaaatttcatgcaaccatgccatcccaattcccaagtggggaaccggcgcgtgataagccagtcagaggtctataccgctgattcaatatatgagggtcgattctttggggatcctaacaatgagggtttgacaatcgatttcgatcgagat

SEQ ID NO: 5613 - DNA, 327 bp, Glycine max
  Peptide Sequence Number=SeqID_97298
atgccaccaagcaaagacccaactctcctagctaccgcgcaccatcctcccccaaatgcggtaggacgaggaaggggcacactaaggcacaacagcaacccccatttgggatacaaccgggtggcttacccttatggattgccacctaattacacgctgccagtcatgcaagatgatgcaggtcatgtctcttcccccatccttgaaggggagcctcctcgacagcccgacgaggtccatgaagatcatcaagagtatgcccaaggggatgttgagttctaccccgcgatccccgtcgaggggccggcatccaacactttaccttag

SEQ ID NO: 5614 - DNA, 737 bp, Glycine max
  misc_feature (547)..(547): n is a, c, g, or t
  Peptide Sequence Number=SeqID_97299
atgagtgaagtagaggaggtgcaagagcagatgaaggccaacatggaggccatgaaagagcaaatggccacaatgatggaagccatgataagcatgaagaagataatggaagccaatgcggttgcagttgccgctaccagcactgttgctaaggtaaaaccgatgcccccatctggcctcaaccaaatgaatcatccaacctcagctatggtaggcaaagatttgggaagtgcgggcggcccccattatatgcaaagtcaaaacaagcatgccttcccaccatatggcttgcctcccaactatacaccacccaatgtaacgtacactcccagtgagaatgtcaataactccactcctatactcattgagagccgacaaccccaaactgatcatgcacatgtctctcaacccatgggtgagacacatgaaatgccccaacacaatctagccgactttaagccttgcctcggatatgccactgaagggcaggcaattgatggtatacccctacaaaaccctttggagggccctcagtatcacccccagntacacctcttgcattccacaacaagtaaaaaccctcatgctatggcagaaatgggaaatttggatcatctagaggaaaggctcagggccattaaaggaggtgaagattatgcctttgctaacctagaagagtcgttcctagtacccaatatcatcacccctcccaagttcaaggtgttggactttgacaa

SEQ ID NO: 5615 - DNA, 891 bp, Glycine max
  Peptide Sequence Number=SeqID_97300
atggcatgcaaccttcgcttgaccgattcgaggaacttgatacccatcgttaagcaattcgtgaagtttcgcgacatgtcgggagtcgaaaggaaacattattgcgcaatccgtaaagttccgtggaagcaacctagctcgcctgggcgagctaggtggcaaccacctcccccggcttctggaggaagcaacccaactcgcctggatgagctgggcggcaacctcctccctctttttcttataaaaaggcaaaagggggttgttctaagggtccctgatccccctggctatgcatttcagctcaaatccgtgaaggttttcctccgttcttcaccgttcttcatccgttcttcgttcttcaacgggatgcccgctgggaggaaagaagccgtatctgttttctggattctacccctccattgcaagtgtagaaaaagtggtcaagatcttggcataagagttagaccgagtgaagcaaaacaggaatggggtggtaggtataccaaggcagcgcttggaggaaaggacgggctagtggatttagcaatgatcgacgtttttcttgcttatcaccacaacaaggaaagcccggtcattgctgttttggccaatgcctatgacatattcgacctgagatgcgaaaagactagtagacctgtttgtcccctacaaggtcatcgcatgtgtgccaaaaagggaaaggcaaattgggaggaactcttggcaggatttccaaacatccccttgatgggaacaaggggatgtattaattataatcccatattggccataagacaactaggttaccctatgagaggggtgccgtcgaaagagatcatcgcgcctttcgttgcacagggtttcagtgaaggcaatgcaaaaaggctttag

SEQ ID NO: 5616 - DNA, 240 bp, Glycine max
  Peptide Sequence Number=SeqID_97301
atgcatctatgtgatgaaggtggccttgttggtgcttgtgcgcctagcgcaactatggctcgcttagcgtgcattagtgaatttcagcttagcgcgcgtcttttcactcagtggatggactcaagtggtgtgcttagcgggattagccctcgctcggaaaacatttacagcttatccttcttccagattcttcctcgcgctcagccgcaagagtggtgcgctcagcggatggctcgataa

SEQ ID NO: 5617 - DNA, 711 bp, Glycine max
  Peptide Sequence Number=SeqID_97302
atggacatgcctagaatggctgaagaaaaagcgaaagacaaaaaaagtataggactatctctcaaatccgccataccaactagtgatgatagtgaagaagaagatgtagaaggatcagaggctgaaaatctaactttgtttaaacaacaaaatggagagaagaagtctaggagtcacaacaagaagaatacgacctatatagcatgggaggaaaatgcttcaagcacttcaagtggaagtagtgatgaggaggaagcaaatttgtgcctcatggccaatgaagaagttgatagctatgtaagtgcatttgattctgaatccgatgagaattatgatcaactttttgatgcttttaatgaaatgcatgaggaagcacaaaagttgtctattgctaataacttccttaaaggaaagctaagagataaccttgatgcactcctagcacaacaaaaatgcacatttgataaagctggacctagttacacctttgatgagaaacaaaagtcttttaaaaatttgtttaaatttgtcaaaggttccaacactcctttcacaacatgtcgttattgtatgcataaaggacattcttctatgaattgtatgattaagaagtttggagttcgaaatggaaaatacaagtggattccgaaaggaaccaaaaagccaagcaacaaatgcagtatcttgatagtggatgttcaaggcatatga

SEQ ID NO: 5618 - DNA, 201 bp, Glycine max
  Peptide Sequence Number=SeqID_97303
atgggtggttgtgccatactattacagtcatgggcttggtatcgcatgtctttttttgcaccaagagtcccacgacctgaaacaacttatccactggctaaaagatggagtggtggtagattagaatatagggtcacacctcatggtgacttggtcagatatagatctcgtatagaccacatggaaagccatgaggtataa

SEQ ID NO: 5619 - DNA, 870 bp, Glycine max
  Peptide Sequence Number=SeqID_97304
caaaaacgcaccagttggctgattgtcgcccttgccaccctcctcgccgcgctggccaccttcccgctggcccgcgggctgctggcgccggtcaaacggctggtggaaggcacccataagctggcggcgggcgatttctccacccgcgtcacggtcaccggcggggatgaactgggtcgtctggcgcaggattttaaccagcttgccagtacgcttgagcgtaaccaacagatgcgccgcgatttaatggccgatatttcgcatgaactccgcacgccgctagcggtcctgcgcggtgagctggaggctattcaggacggagtgcgtaaattcaccccggattcgatctcttcgctgcaggcggaagtcggcacgcttaccaagcacggggacgatctgcatcagttgtcgatgtccgatgaaggcgcgttagcctaccagaaagagtcggtggatttaattgcgctgctggaggtcgccgcaggtgcattccgtgaacgcttcgccagccggggtttaaccatcggcgtctcgctgccggataacgctatcgttttcggcgatcgcgatcgtctgatgcagctgttcaataacctgctggaaaacagcctacgctataccgacagcggcggccgcctgcagattgacgccaaacaaaatggtcgcatgttgacgctcgatttcgccgatagcggccccggcgttagcgacgagcagctggcgcggctctgtgagcgtttttatcgcaccgagggctcacgcaaccgggccagcggtggatccggtcttgggctggcaatctgtatgaatatcgtcgccgcccacggcggcagcctgaacgccggtcattcgcctttttggcggggttag

SEQ ID NO: 5620 - DNA, 318 bp, Glycine max
  Peptide Sequence Number=SeqID_97305
atgtatcagtatcctttcgaaggtcatgacactgatatgtctgcaagcgaacattcgtttggtggtgttgcggaaacacatcctcatttttcatggccgaccatgaccccttcgcagcaacatgatgccccaatgacaacacctaatgcccccattagctctgcaatggaatgtgttgatttgcgtcacgagttttctgctgaggctgagcaacaagggcggagacagcgcgcaagaagaaatccaaatcgtcaagcccgaaggtgggatcgaccatgtggcacatcctcacgccatcacagacaccataatgactga

SEQ ID NO: 5621 - DNA, 135 bp, Glycine max
  Peptide Sequence Number=SeqID_97306
gttatgtgggatgctaccgtgtttggggtgtttgatgagaacttccccttgtacataaagcatgaagatctgtctgaaataacacatggtggtcaatgtcttagcatttctgttatacagttgtggattctataa

SEQ ID NO: 5622 - DNA, 281 bp, Glycine max
  Peptide Sequence Number=SeqID_97307
atgggtaccaagtacctcgaagtggtcaaaggagggtcgcatcccaacaacggatggtcccggacgaaattagggtatgacgagcctcataaaggtgcttggcttgctcctgggactaaatctatttggtgttctattccccttaaaggaggtagcccagggggtatctctttgggaaatatatcaccaaattcatgtaagagttcttggacctttgggggtaaggtctcaaatgtaggaattgtagcagtgctaagggatgtttcccttgataggagaag

SEQ ID NO: 5623 - DNA, 603 bp, Glycine max
  Peptide Sequence Number=SeqID_97308
ggtggacccttgggtactagtaccctcaccttccgaggactacacatcctcaccttcagagggctgcacgccctcgcctttagaggactacacgtcctcgccttcaaaggactacacgtcctcgccatcaaaggactacacggctacatgcatgccctcagaggactatgcgtcctcaccttcagagggctacatgccctcgccttcagagggctacacgccctcaccttcagaggactacacgtcctcacctttagaggactacacgtcctcaccatcagaggactacacatcctcgccatcagaggactacacgccctcaccttcagaggactacacgtcctcaccttcagagggttgcacgtcctcgccttcagagggctgcacaccctctcctttagtgggctgcatgccctcgccttcaatggttcagttcttggaccaccccctgatcttggaggagggccaactgggcgagcacaactagaggaggaggctatcgtacaaccactatgcatactggggcaagatttcacttgtgccgttacaaagagacgagtgcggatcatgtgcaccaacatggccactcttacacagatatag

SEQ ID NO: 5624 - DNA, 867 bp, Glycine max
  Peptide Sequence Number=SeqID_97309
atgaactcaccttcagaggactacacgtcctcgccttcagaggacaacatgtcctcgccctcatcttctgaggactacatgtcctcacctttagaggactacacgtcctcgcctttagaggactacacatcctcaccttcagtgggctacacgccctcgccttcaaagggctgcaagccctcaccattagagggctacgcgttctcactctcatttctgggccacccccctgatattggagggcgaccaactgtgcaagcacaaccagagagggaggctatcacgcagctactatgcataccggggcaagatttcacccgtgccgctgcaaagaaacgagtgtggatcatgtgcaccaacatgactactattacacagatatgtatgacattgctacttagcaacattctaccctgcagatgtatcagttggtctgtgtcatcccgacatagggatcgcgaccacaaggcacccagtggacccggaggagtccaacggggccctggggtctccagctttggttacgggcctctgtcagtcctacagggtgctcgttcccccccagcaaggtcacgccattgtgacatagggatcgtgaccacaaggcacccagtggacccggaggagtccaacggggccttggggtctccagctttggttacgggcctctgtcagtcctacggagtggccgttgcccccagcaagttcatcaggccccctattaaccgggctttcatcaagaagtattgcgcccctaggcaggcgcagggcgaaacaccacagaagcctggggagggccgacagcgggcaacagacgcaccgccaccacctctagagttcacctcagctcatccacaaaaaggttag

SEQ ID NO: 5625 - DNA, 369 bp, Glycine max
  Peptide Sequence Number=SeqID_97310
atggtcgagagagagatgatcactatgatggtagacacgttgccagtgttctactatgagaagctagtaggttacatgtcgtccagcttcgcggacctagtgttcgccgggaaaagaatcaaggtaggattgaaaagaggaaagttcgattacgtttccttcacgagtgcgaatgccaaaagaatcgggacaacgggggcaaaaaggaaggaaggagatacccatgctgtctcttcaacgcccgcatgggtcaaacccccgcaggcacctcatggtacccatcagtacgcgcaacatcacccaagcttctcggctcacaccgggaacgcctctagttctgcacctgtgcagcctaaggcacccacctag

SEQ ID NO: 5626 - DNA, 339 bp, Glycine max
  Peptide Sequence Number=SeqID_97311
atgagggttcactataatcaagcaagtcggagacctagcatgaccacaaattcacctccactccttatgttcccacggacccggtggagtcaccaactgtcgcaacctacccttcgacgggagggcgacgtgagactcatgggtgcgtcttccaagaaaggaaaacgtgcggagtcgccaccaacgtttattcgagaaaaacgtcagaaaaaccggaaaaggcgtggtctacgaactataagggtgaaaggttcgggagttgtatttacgcatggggaatgtattagcaccccacacgtccgtcacaagggacgacaacctttaagtgtgcaaatatga

SEQ ID NO: 5627 - DNA, 144 bp, Glycine max
  Peptide Sequence Number=SeqID_97312
actgctgaagggaccaccaccgaaacaacagcaaacggaagaaacaaacaaagcaaacggaagaagaaacaaagcaaacggaagaagaaacaaagcaaacggaagaagaaacaaagaaagcgcagtaaaacacagcctgaagac

SEQ ID NO: 5628 - DNA, 216 bp, Glycine max
  Peptide Sequence Number=SeqID_97313
atggggtttgaaatctaccctgaggttcatgagaaccctagggctttctttagccgctctagcctaatcctcttgaagtcttctatccaatacccttggggggtaggattgcatcaccttctctccttttccttccactcatcttctcctaccttcaatctcttatcgatggcttcctatggtggtgagcttgttcttgactcatcttctccatga

SEQ ID NO: 5629 - DNA, 344 bp, Glycine max
  Peptide Sequence Number=SeqID_97314
atgtcagcatctcccgatagagactattttagtctcgcacatcacaaaagcaagaactactccgatgacatgcggagatacccaagtggttatccgcacaaacgatttctgttaatcctaacccgtgaaactaacgtcgtcttctgcaccctttgtcaatcaggggcaagcaaacccattgacacgcagagacttatgtcttcttccgcgttttctgtcatcctgacccgtgaagtcagcgttgtcttctgcacccattgtcaatcaggggccaatgaactcgttaacacgcagagacttacatcgtcttccgcacattctgtcatcctgacccgtgaagtcag

SEQ ID NO: 5630 - DNA, 438 bp, Glycine max
  Peptide Sequence Number=SeqID_97315
atgcactactacgtacgtatgaatcaagctggggcatccgtctactccaatagagcacaccatatactgtctactacgttagtactactgatgacactacccgacctctatgacgataacagcgtgatgctactacgatggtgcccttccggcttaaccttgaactaccccgcagcttctaaccctctactagttggtggtgactactcccggcctgcagggaacaaagttggaggccagaggatccactcgagcaacaactacgatgctactagcgggattggtgatagaggaggtgggggatgcgacttgaactcatgcactgtggttggccaggcatctactatagatatctatatctactattatatgaatagggcatccggactagcggttactggcaagcgagaagcaccggcacatactactctactatga

SEQ ID NO: 5631 - DNA, 237 bp, Glycine max
  Peptide Sequence Number=SeqID_97316
atggccaatttcatgattctcatcattccctccttcttggaaaacatttgtcctcaaatgtctaggatcatcaccggattcaagtaccacttccttccttttcttgttgacttgcttggcatagctttcattcttctttgcaatttgcaccttcacttggcaatgaagctccggggaggagatcaacttgatgttctatgcctcttgaaggtggtagtccatgaggaatctccttag

SEQ ID NO: 5632 - DNA, 627 bp, Glycine max
  Peptide Sequence Number=SeqID_97317
atgcatgccatcaccttcaaagggctatacgccctcgcctttagaggactacacgtcctcaccttcagagggctacacgccctcgcctttagaggactacacgtcgtcccctttagaggacaacacgtcctagactttagagggctacacgtcctcgccttcagagggctacacgccctctccttcaaagggctacatgttctcgccttcagaggactacacgtcctagccttcagagggctgcacgccctcgccttcagagggctacatgtgctcctcttcagaggactacacgtcctcgccttcagagggttggacgtcctaaccttcatagggctacacgccctcaccttcagaggactatacgtccttcccttgagaggactacacatcctcgccatcagaggactatatgtcctcgtcttcagagggcttcacaccctcaccttcagaggactgcacgtcctccccttcagagggctacgcgccctcgccttcagaggactatatgtcctcaccttcagaaggttgcatgtcgttccttcaaagggcgacacgccctcgcctttagaggactacacgccctcaccttcatggggctacacgtccttaccttcagaggactaa

SEQ ID NO: 5633 - DNA, 642 bp, Glycine max
  Peptide Sequence Number=SeqID_97318
atgcggaggaactcgcctgcctcctctagcgatacttctttcttgccacaaccatcctttttctcagaaagaccttttattggaatatcctcgtccggagccgagatcactttatcattttgttcttccgctatattagccttccctttagtgtttgcgggttgtgttggtaggtcagggggtgcgaacacgcgaccgctgcgggtcatgccgctcagccctgtgatattggttaccttggccgacaacgagctgatgtcggtggcttcttccttcctttcacttggaggtgcatacctccacggaactgcgtggctgttttggtatgaaaacggaataggtctaactaccgaggggtattggggcgcttggggagctgcgtctctggtgaaatataccaccaaaggcttaggatttctaagaccttcctcatctgcggactgcatgcatatgtgctactcttcaccttcatcatcgtcgacttccagccggccttggtctatcatctgttgcaacaggtcgcgtcagggttataccactttgggaaaggaggctggtagatccttccgggagatatcacaaccatccggttggcgacgagggatggcaagaggtcttcgtacgtcattgggatcggggtga

SEQ ID NO: 5634 - DNA, 93 bp, Glycine max
  Peptide Sequence Number=SeqID_97319
atgtaccaaatatcatgcttagcgtgcaaagaaggggtgtctaagctaccagaaccaattgattctgaagatggatctatgttggagatgtaa

SEQ ID NO: 5635 - DNA, 264 bp, Glycine max
  Peptide Sequence Number=SeqID_97320
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaggattttccctctggggtag

SEQ ID NO: 5636 - DNA, 537 bp, Glycine max
  Peptide Sequence Number=SeqID_97321
atgacatggaaatacgatttgttgattgatgttggaaatgcattggcatgtgcatgttgtgtatgttcgtggggggcactatgcactgacctttcagggtctttggcactagcttttggccacgttcatacgttggatgttgtccgcacacctttccgccatccaaagacgatcgagtcctatgggacgcagacacaaattatggtcattttgcaccttttgtcatccagaggcagcgagcccaatgacatgtggagacaaattgtggtcatccgtgcaccttttcgccattcagacacgatcgagtccgatggcacgcagagacaaattatggtcattctgcaccttttgtcatctagaggcgagacaatcaagttcgatagcacgcggagacaaattctggtcatccgcacgcttttgctatctggacagcgagtcgggtggtgggcggagataccttatggtcatccgcacctttcatcgaccgaggggaatgaattcagcagtatcaggatgatgttggtcgttcagtgctga

SEQ ID NO: 5637 - DNA, 381 bp, Glycine max
  Peptide Sequence Number=SeqID_97322
atgaaagccaacaaaacaagaaatgaattgaaagtgtcagattcgaaaacttaccggttgaagaacgaagaacggatgaagaatagcggaaagccttcacggatttgcttatggaaacgtctcggaagcattacggaagcacctcggcttggattttcttcacgaaaacaattttttcacccaaaacagctgaaatgcatagccaagggggaaaaggggggaggaggttgccgcccagctcgcccaggactttacagattatgcaacaatgctctttttgacttccagaatgttgcggatctttacagattgcgcaacaatgcttgttttgatttccggaatgttgtgagactttacggattacacatcgataggtgttaa

SEQ ID NO: 5638 - DNA, 372 bp, Glycine max
  Peptide Sequence Number=SeqID_97323
atgtctcagaaatttacggattccaccgcgatgagtgttaagccttccgaagtgatcaacaatggacagctaaatgctaatgacatacctcacgggacaccgttagggtccattgattatacttttgatcgtatacctttaacggaccttaaatgcttaaccaagactttcactcccggttatggggtcaaccgtttccttttatcagttcctgggccaccccctgatattgaggggcgaccaactgtgctagcacaaccagagagggaggctatcgcgcagctactatgcataccggggcaagatttcacccgtgccgctgtaaagagacgagtgcggatcatgcgcgccaacatgaccactcttacatag

SEQ ID NO: 5639 - DNA, 168 bp, Glycine max
  Peptide Sequence Number=SeqID_97324
gtatttgggcatggaggtgagcttagctattggaggggtgtaagtagcccccctctagcttctcaagccccctttagcttctcaaggaagctttcttcctctagcttccgtaggaagctaccttccttgcttctcaaggaagcttcctacgtgttaagctataaatag

SEQ ID NO: 5640 - DNA, 354 bp, Glycine max
  Peptide Sequence Number=SeqID_97325
atgaaggccgacatggaggccatgaaagagcaaatggccacaatgatggaggccatgatgagcatgaagaagaaaatagaggtcaatgcggctccaattgccgctcccagcattgttgctgagaacaagcgtgccttcccgccatatggcttgcctcctaactatacaccacacaatgttgtgcatactcccgatgagaatgccgacaactctgaacccatatctattgagggccaacaaccccaatctgatcatgcacatgtctctcaacccataggggagacatatgaagtaccccatcacaatctagatgactttgagccttaccttaaatatgccactgaagggcaagca

SEQ ID NO: 5641 - DNA, 685 bp, Glycine max
  Peptide Sequence Number=SeqID_97326
tctaaggaatatggagagatagagtctatatccattgaggacttgattgccaaacaagagaaaaagaagaagattgatgttgcatctaaacctattaggctattcctgatcttctccaagctagacaaggatttgatgaagctagacacaagatctccagactggctcattccatcaaggccatcagttgagtctccacttgttatacccattaatcctaatgtcaatgtcagattctatcttggatttagagtgttaggacttaacattaccttgtatcatccaagaaggattgttatgtcaactatctcttcagcgtctaacgcgctaaaatcaaaagagcttggccttaagggtgaagtatttgacaatactaaggaaaagattcaagatatgaaagacatgaaagaaggattccccaccaataaaccacctctgtttagaggcataaaatatgattactggaaggagcgtatgatagctcactttgaatctattcatatagatctatgggatgtggtggaaaatggacccaaaagagaaaagtctttggctctcaatagccaaaagaacaagaaggcatcatcgtccatagaacacgtatcaagaagttcgtccaaagctcttaaagctaatgatgaatctgaggaagattctgatgaagatgagattgccttcatttcat

SEQ ID NO: 5642 - DNA, 1671 bp, Glycine max
  Peptide Sequence Number=SeqID_97327
atggataatttaaatctgaacaaacatatctccggtcagttcaacgcggagctggagcacattcgtacccaggtgatgatcatgggtggcatggtggagcagcagcttaccgatgccatcaccgcgatgcataaccaggatggcgaactggcacgccgggtgatcgacggtgaccagaaggtcaacatgatggaagtggagatcgatgaagcctgtgtgcgcatcatcgccaagcgtcagcctaccgccagcgacctgcgtctggtgatggcgatcatcaaaaccatttcggagctggaacgcatcggcgacgtggcggagaagatcagccgtaccgcgctggagaagttcggtcagcagcatctgccgctgctggtgagcctcgagtcgctcgggcatcacaccgtgcagatgctgcacgatgtgctggatgccttcgcgcgcatggatctcaacgaagccatcaagatctaccgcgaagacaaaaaggtggataaagagtacgaaggtattgtgcgccagctgatgacctacatgatggaagatccgcgcaccattcccagcgtgctcaccgcgctgttctgcgcgcgcgccatcgagcgcatcggtgaccgctgccagaacatctgcgaaattatcttctatttcgtgaaaggtcaggatttccgtcacgcagtgcgcttgatttctgcctgttctcaacctgccgctctctttatacttggcgcacatttttctgccaggtgctgttttatgtcctctgcaaataacaacaaaaccgccgttacgccggcgaaagcaatggtggctgccgtcagcggctatgccatggatggatttgatctgctgattctgggctttatgctgccggcgatcagcgtgtcgctggcgctggatgcgtcgcaggccggttcgctggtgacctggacgctgatcggcgcggtggtcggcggcattgtgtttggtcatctgagcgatcgctatggccgcatccgcattctgaccgtgacgatcctgatgttctcactgttcaccgggctgtgcgccgtggcgcagggctactgggatctgctggcgtatcgtacgctggccggcatgggactgggcggtgagtttggcatcggcatggcgctgattgccgaagcctggccgaaggagaagcctcggcgtattgctggcggcctttatcacgccgccgctgctgagcgtgattggctggcgcggtatgttcctggttggcctgctgccggcgctgaattttggctattacggcctgatgatatggatgccaagctatctctcttccagctttggcttcagcctgaccaaatccggcctgtggacggccgttacggtggtgggcatgacattcggcatctggctgttcggcgtgctggcggaccgctttgcgcgctggaagattttcctgctgtaccagtttggtgccgtggcgatggtggtggtttacgcccagctgcgcgacccgacggtgatgctgtttaccgaatgtgttgtttaacctcggccgcggcgtcggcgtttcggcccgctggtgatcggcatgctggccacgcatatttccttcaccgctgcgattacgctgctggcgctgatttacctgctggatattgtcgctacgctgttcctgctgccaaaaagccagggcaatga

SEQ ID NO: 5643 - DNA, 942 bp, Glycine max
  Peptide Sequence Number=SeqID_97328
cacgccgacatgttaccgggcataggagatactgaagtcaggcagattaggatcggcaaagcagaggcgaccgctgctgctggcgatcagcggcggcaggtcacgaataccatagacgcgcagcatcagctgggccagcagcgcgcgtgcggcaagaaagcggccgcggcgcttatcaggcaggtgcccggcgctggtcatcacatcctgtggaacccgcatggtatctggggtgaggggcgggttaaccacccaacgaacaaaatgactagccatctgtcgctccgtgaaaatggtcggataatcatcagggctattgtaagaattttctcatgggtttgcatccggcttacgctggatagccagatttggacaggaaagagctgcacaatgaagtgcttaaattattcacctatctgccaatcgtgcgcatcgcaaaccatgcacgtcggagttgttatgtctgttacctctcttgctcgccaggaatcgatctcgctggatgaatttcgtcacggcatgcgccgtctcactgccggtgtctcgctggtgaccacctcatccagcggagaaaagttcgggctgatcgccacctcggtcagctcgctggcagcggaaccgcccagcctgctggtctgcgttaaccgcagcgcatcaagccacgatgccattctgcaggcgggctactttgccgtgaacgttctgcgcgagcagcacgatgacctgtgcgcgcaattcagctcgccgacgcgccgcgctgagcgtttccagagcgctggaaaaaacggtggagtggaacacccacagcgtgctgctggcgcgtatcgtgggtattgcgctgccgggcgaagcgacagcgccgatggtctacttcaacagcggttttcactcgctgggctaagtcatggcgcagcgcgcgcgtcgggcggctgcgcggcttaa

SEQ ID NO: 5644 - DNA, 165 bp, Glycine max
  Peptide Sequence Number=SeqID_97329
atggcttcgaaacgctgctggtgctcagcgctcctcaaacgatggctatcgaactcgggagcggcactagtccctgcggccgcggcttccttcctagatctcttcgaggaaagcttcctcggagccatttcctgtgaagacagacagttggaagaactcccttaa

SEQ ID NO: 5645 - DNA, 314 bp, Glycine max
  Peptide Sequence Number=SeqID_97330
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccggttcagtccgaccgctgcgccttatccgggtaactatcgtcttgagtccaacccgggaaagacatgcaaaagcaccactggcagcagccactg

SEQ ID NO: 5646 - DNA, 276 bp, Glycine max
  Peptide Sequence Number=SeqID_97331
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtagaaaatcatga

SEQ ID NO: 5647 - DNA, 60 bp, Glycine max
  Peptide Sequence Number=SeqID_97332
atggttcaaggcaaatttgtaccaaatttgggggagttattatcaaggtatggaagctaa

SEQ ID NO: 5648 - DNA, 237 bp, Glycine max
  Peptide Sequence Number=SeqID_97333
atggtgctggtagcagctattacagccgcactgacctccattatctcctgtatgctcatcatggcctccatcattgtggccattttctctttcaaggcctccatgtcagccttgatctattcttgtacctcctctatttcacccattactctagctctagcacgtgtttgttcggttttcaaggaaagaatgcaatgggcagtgcaaccaatgaaaagcatggatgtatgcgaatga

SEQ ID NO: 5649 - DNA, 342 bp, Glycine max
  Peptide Sequence Number=SeqID_97334
atgcctgaagaagttaatatgaatgaagacaatggagaggaacctctgataatgaggtcagacatagatactagaaatagaggaagaaccttatatgttttaattggttgtgagaggagtggaaaatatagggcatacaagaaagatttagtacgaacagttattggtagtagaaaatataagtgtccctttaatttgcgagtgaaaccagtgttaggaggtgaaggatggatgatgaagttaatatgtgggaatcataatcatgcattggctaagtcattagttggacattcatatgttggtcgactgactaaggatgagaaactattattggtgatatga

SEQ ID NO: 5650 - DNA, 372 bp, Glycine max
  Peptide Sequence Number=SeqID_97335
acaggcgcagggtggcaacccgcaggccccagacgcaccgccgccacctctcaggcttacccagctgggtcatttgacatggagcggtatttacggcatttggttcgccagcaggcggccaaccatagggcgtacgtgcagacccatgactgtctctaccagctcagcctcagcctgcagagccagggttttgcttcttttccatgccctactccagatcagttcagggcagaggtcgcatggcccggggattggtttgaggcccaggcaggggaggcacccgcagaggctctcggcgatgcagatgaggcccgcatggacgaggagatgacagatttactcgatttcttgggagggagcggagccacatga

SEQ ID NO: 5651 - DNA, 252 bp, Glycine max
  Peptide Sequence Number=SeqID_97336
atggcttctccacctgcctcccctcctcctcctcctcctcctccttctcctcctcttgctcctttcgacgcatcggcttcgctgtctgccgtgaagcggacatgcaaagcctcacgtctaccatcattgtctactagaccacctggtgctgagagaccagtggtccatattgatcctgctatcggcaaggtggacgtcacctacgagaattggaaagaggtccctactgctcagaacatcattgtctactag

SEQ ID NO: 5652 - DNA, 210 bp, Glycine max
  Peptide Sequence Number=SeqID_97337
atgggcgaggaagataaaaaatcagaggaaaacaaagtggaggagaaaaaagaaaatgaattagaaaagaaagaagaagagaaaaaaccagaggaatcaaaagatgacaaggaatccaaggaagaatctgcgccgctagaaatcgtgccaggcacaacctttgcaatgcatggacactttaagcatgatttctggcatcttttaagttag

SEQ ID NO: 5653 - DNA, 541 bp, Glycine max
  Peptide Sequence Number=SeqID_97338
agtttcctacacgtcctcgcctccagagggctgcacgccctcgcccgacctcaacttcagaggactacacgtcctcgcctttagaggactacacgtcctcgcctttagagggctagacgccctcgtcttcagagggttgcacgccgtcactttcagaggactacacgtcctcaccttcagaggactacacgtccttgcctttagagggctagacaccctcgccttcagagggctgcacgccctcgccttcagaggactacacgtactcaccttaagagaactacacatcctcaccttcagagggctacgcgccctcaccttgagaggactatacatcctcaccttcagtaggctgcacgccctctccttcagaggactacacatcctcgccttcagagggctgcacgccctcaccttcagaggactacacgtcctcaccttcagaggactacacgtcctcaccatcaacgggctacacgtcctcgccatcaatgggctgcacgccttcgccttcataggactacacatcctccccttctga

SEQ ID NO: 5654 - DNA, 453 bp, Glycine max
  Peptide Sequence Number=SeqID_97339
atgacaatgatagtagacacattaccagtattctactatggaaaaaggtgggctacacaccttcaaagctttgaggatttggtctttgccagtgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaagtgaattttgcagcgagaaagcctgtagaattcaccccaattccagtgtcctatgctga

SEQ ID NO: 5655 - DNA, 456 bp, Glycine max
  Peptide Sequence Number=SeqID_97340
atggcgcctaccaggcaccctctggacccagataagtccaacagggccctgggatttcccaccttgatcacaggactctgccagtcgttcggcgtccccgtcacacctagcaaggtgattcggctgcccatcacccgagcttttattgagaagtactgcacgcagagacagtatttgcggcatttggttcgccagcaggcggccaaccaccgggcacatgtacagactcatgattgtctttatcagatgagtctcagcctgcagagccagggctttacttctttttcgtgccctactccagaccagttcagggcagaggtcacatggcctggagattggcctgaggcccaggcaggagaggcaccagcagaggctcccgacgaggcagatgaggcctgcgaggatgaagagatgaccgatttacttgatttcttaggagggagcggtgccacatga

SEQ ID NO: 5656 - DNA, 555 bp, Glycine max
  Peptide Sequence Number=SeqID_97341
atgtctcagcgatataaactctatcgtcgaactagcggcatttatgttgtccgcattagtgttccccaacgttttcgtcgatatgcaggacagtgtgagattcacacttcaacaggcactcacgatcttcatgaagcaaagcagaagtccgcgctcctgttggcggtctggtatcagaccttacatgagtatgaactaatggattatcaggctttaagtgacagcgccccgctgcttgctggtgaggggatgatctcgctttcaaacttctcccaagcaattgaactgcccgttgctcagttaattcaggcggtgataaaccgtaacttgcccgtattttggctggcgacggggcaggctggcttttatgttgagaccctctctgaggccgagttagaccctcttgatggcagctacgtgcttaactatggcgaagagcagggtattgagggggttgctaaaggttatctgcaactgacagcgcagccagcgcatttgcgtaacattatcagcgacggttattcagaagcttcggtgttcagtgggatcctctag

SEQ ID NO: 5657 - DNA, 189 bp, Glycine max
  Peptide Sequence Number=SeqID_97342
atgaagcctaagagaataaaggtcattcctgagtggcccactccaccaagtataaagaaaatttggggcttccatgacttaacaaacttttacaaaaggtttgtcccatatttttctatacttgtagcacctctcattgagttggtgttgattaaaaaagcccagagtttcaagaagctcaggatttga

SEQ ID NO: 5658 - DNA, 858 bp, Glycine max
  Peptide Sequence Number=SeqID_97343
atggggctgcacatccttgccttcgtagggatacacgccctcgcctttagaggaccacacgtcctccccttcatagggctacatgccctcaccttcagaggactatgcgtcttcaccttcagagggctttacccactcgccttcaggggacttcacgtcctcccctttagaggacagcacgtcctcggcttcggaggactacatgtcctcacctttagaggactacacgtcctcggtttcagagaactacacgttctcagcattagaggactacacgacctcatcttcagaggactacacgtcctcgtcctaagagggctacacgccctcaccttcgtagggctgcacgccctcacctttagaggactacacgtcctcgaattcatagggctgcacgccctctccttcagaggactatacgtcctccagtttagaggactacatcttctcaccttcagaggactaaatgtcctcggcttcagaggactgcatatccccaccttcagaggactacacgtcctccccttcagaggactacaccttcagagagccacacgccctcgccttcagaggactacacgtcctcgccacaaagggccacacgccctcgccttcgtagggcaacacaccctatcatttagaggacttcatgtcctcgccttcatagggctgcacgccctcgccttcagaggactacatgtcctccccttcagaggactacgtgtccttaccttcagaggactacatgtccttaccttcagagggctacacgtcctcagcctcagagaactagacgtcctcaccttcagaggactacacatcctcaccttcaaaggactgcacgccctcgccttctga

SEQ ID NO: 5659 - DNA, 227 bp, Glycine max
  Peptide Sequence Number=SeqID_97344
ggtacatcctttgtggtacaagtaaagggagcatctacttgggtttgactgggaacaagagagggtacatctcttgtggatcagttctagtggagggtacatccactaggttgttcaaagagaacaagggagggtacatcccttgtggatctttgtttgtaaaaggatttttacaaggttggaaaagaaatctcaaggaccataggtcgcttgaggactggatgtag

SEQ ID NO: 5660 - DNA, 357 bp, Glycine max
  Peptide Sequence Number=SeqID_97345
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagaagcgtcctcagtggcggaccgggcccaagtcccctggaaggggcgccagagagggtgagagccccgtcgtgcccgaccctgtcgcaccacgaggcgctgtcggcgagtcgggttgtttgggaatgcagccccaatcggccggaaattccgtccaaggctaa

SEQ ID NO: 5661 - DNA, 729 bp, Glycine max
  Peptide Sequence Number=SeqID_97346
gttggcactctagatgttggttttggtgtcggtgctttggttggtgctggtgccagtgcaaggttggcacgcaaggttttaggacagaaaagacaaaggaggtgggcactgaggggggactctagctatggtgataatagtctcactagtaggaacactggttcagcctttggtactccattgtcccctccagagccaactaactgtgttcaaccaacggtgccgaatcttgggagcttgatcgctgacccaacaacctttgctcttccattttggaactgggaccatcctaacggcatgaaaatgcctttcatgatttacacagatgaatattcttatctctatgaccatcttagggaagcaattgaccttccatggctccacgttagtccggatatacatgttaaaccagaaaatcttgctcctcgggttggtgcaaaacaagctttggatttgaaggcattgcggttccctctcactttgaattccattgaacgtacaactgtgaacatgccaaaggtggagtcaaggaacgaggaattaatggaggagttgctactgatagatgttgagtatgataggtctgaagatgtgaggtttgatgtgtatatcaacgacaaagccacaatcgtaactgatctgttgaaagagttggaagtaaaagacgatgatagtactattgctgtgacactggttccaaagtatgggaacaagcctgttacagtataa

SEQ ID NO: 5662 - DNA, 882 bp, Glycine max
  Peptide Sequence Number=SeqID_97347
atgggggaagttttacagaagattggtacagaggaaacaacatcaacaaacactcatccggtggtatgtgattctgctcctataaatcctaaagaagagaattcaagtaacatcaatatgtcctctgtaaccactaaggaaagagaagaaactggttttatcaaagagaagccaaccactgaggaagtagatgctgaggcttctagtttaaacaaagttcagatatttcgaaagtcatcctcagtggaatctggtcttgattctctggatgaaagcaatatttctgaaattcaacgagagtctaatgatgatagactaaggagacgaattgagtattacaagaaatgcaatgattctttacagaaggaagtggaggaagaaagaaacgcttctgctgttgctacaaatgaagcaatgtctattattacaaggttacaggaggagaaggcagcactggagatggaggctcttcaatattttagaatgatggagaagcaagcagaatatgataatgatgaattggagaaagtgaatggtctactcacagaaaaggaaaaagagatacaagatttggaagctgagctggaattttatagatcaaacatgacaagctcgaatggaagccttgaagatcatcttgcctgcaagaataacacccctccgttgtcatggcaagctcgaattcgcattgctgctgaaactgctgctgctcttgcagctgcttctatgatttttaaaaaagttttccagtttgccgataaatataggggaccctacagcaatggcttgaagcctgttgtgtgccccttctattgttcttactctggttatgaggatgagctgttgtggggtgctgcatacttggcttcacaaggctactaa

SEQ ID NO: 5663 - DNA, 528 bp, Glycine max
  Peptide Sequence Number=SeqID_97348
atgtcactatccaattattttggaactatatacatcgatcggagactgaccacaacaagtaaaaaacatgctccatcgatgatccaaaagtttatgtggaccactgtatacatagccgcatcccctattccgcaagagttatactactttgaacaaggtccgcacaacaatgcccatggatggactgctgcaagagatcccattttctttgctcaccattcgaacgtaccaggagggtatagaagagatttcaccgatgatgatgattggttggagtctagctttctcttctatgatgggaacaagaaccttgtgcgtgtgaaggtcgtcaaagattgtcttgactccagaaagctagggtatgattacgaatatgttgacacgcaatggctgagaactcgtactatacccaaatatccagtttctctccctctccctgttccacttccacaacctttgccattccattcaacgtacaactgtgtggagcgaggtagaaaaggagaaggtgttagtgatggaagttga

SEQ ID NO: 5664 - DNA, 363 bp, Glycine max
  Peptide Sequence Number=SeqID_97349
atgaaatgttacaaagaattttggccattcttgctttgcacaaagtatgctctctttcagaagaagttgggttggagattagatttggtcttggttataatctataacttaactggtcatggttttaatcttgcttctcctatggatcttatcctggttgttggcaaattagttgttcgcccgcaagctaaagatgttgttcttgctagttttatctctgtggtcatcaaagcttttaacatcaatattcatgcacccaaggctggtaaaatcatttcatggttcccttcgctatgctcattccaaaggttagggcaagctttggctggaggtggattcccttttagtcctcaaggcttttag

SEQ ID NO: 5665 - DNA, 1235 bp, Glycine max
  Peptide Sequence Number=SeqID_97350
atgttccaacatcttcaaccccgaatgtttctgtgccggatgttgagaaagatgttccaacatcttccgggccaaatgctgaagtactctcttcccccagcaaagagagatcaacagaggaagatgatcaagcgacaaaggagacccctgcaccaagggcaccagaacctgctccaggtgacctcattgacctggaagaagtagaatctgatgaagaacccattgccaacaggttggcacctggcattgctgaaaggttacaaagcagaaagggaaaaactcccattaagaggtctggaagaatcaagaatatggcccagaagaagagtactccaatcactcctgccacatccagaagaagcaaggttgctatcccctccaagaagaggaaagaaatttccttttcctcatccgattctgatgatgatgtcgaaccagatgtctcgacatctaagagggccaagaaatctggagaaagtggaaatatgtgtatcaacgcagacttgcggttgaaagagaactggaagagacgcattgattgcaaggagaccatggaactcattaaggctgctggactactgaagacagtcaccaagttgggagactgttatgaaggcctagtcagggaattcattgtcaacattccctctgacatatcaaacagaaaaagtgatgattatcaaagagtgtttgtcagaggaaagtgtattagattctcccctgctgtgatcaacaagtacctgggcagacctactgaaggaatggtggatattgatgtttctgagcatcagattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcagcatcccaatatgttaaactacactgactctgtgatgaaaagagaatctcctctatccctgcattacaaactgtttgaggggacacatgtcccagacattgtctcgacatcagggaaagcagctgaggaagacaaagaagcagttgaagaagaagaagaagctgctgaggaagaggaagatgcagcagaagagacagaatcagatgatgattctgaagccaccccatga

SEQ ID NO: 5666 - DNA, 375 bp, Glycine max
  Peptide Sequence Number=SeqID_97351
atgactaaagcacgtcaaaagggggtacggaaattcaatttcgggaacttaccggttgagatcgaagaacgaacgaagaacgtcgaagaacggttgcaaatcttcgcgaaatcacccacggaaacgtctcggaagcattatggaagcgcctcggcttggattttcttcacggaaacagtttttctcactaattttaaggaaaaagagggagaagcttgccacccagcttgctcaggcgagctaggttgcttcctccagaaggcaccgccttctggggaacttcctggaaggcccaagtgggcctggttgctatttgcacccctctgtttactaaatacacccccttgcctttttttgctgattctttttccgtaa

SEQ ID NO: 5667 - DNA, 243 bp, Glycine max
  Peptide Sequence Number=SeqID_97352
atgaagccttcttctacacaacaatggtgccctcaaaagtcaaagacttcatcatcaaagaattctaggtctaggtacttgggatcaagaatttgcgtagaggaaaaaagagatgagtaccgtagacattgttcgtcggatgagaatagtgtggatgatgacaatgaaggtggaattggtgccggggggtgctccggtggcttcgtgatgtcaagttcctgttgccgcagtggaggtggatga

SEQ ID NO: 5668 - DNA, 312 bp, Glycine max
  Peptide Sequence Number=SeqID_97353
atggccactccacctgcctcgcctcctcctgctcctgctcctcctcctccttctcctgcagtagcattagcgtctccgtccaccttgaagcggacatgcaaggtcgatcctgtgaccggcaaggccgacggtccccacaagaagaaattaagagcatatttggggattcttgctcgtgataaggtcgatgtgacatacgagacttggaaggaagtccctactactcagaaggatttgatatgggaggatattcaggcggaatttgaaatccctaaagcttctgacagtaggacaaagaagaaagttctttag

SEQ ID NO: 5669 - DNA, 644 bp, Glycine max
  Peptide Sequence Number=SeqID_97354
atgggtgatcaagaggagacgcaggaacagatgaaagccgacatgtcggctctgaaagaacaaatggcctccatgatggaggccatgttaggtatgaagcagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatacgggccacattgcttctcccgtccatgaaaaagagcctcctcagcagcccgacgaagtccataaagaccctcaagattatgctcggagggatgtcgagttttatcccccgatccccgaagggccggcaccaggcacgttgcctcaacccaacctcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaa

SEQ ID NO: 5670 - DNA, 238 bp, Glycine max
  Peptide Sequence Number=SeqID_97355
tcgtcaagcagctttaatgcttaacactgagaagaatccgaaggaagaatgtaaagctataatgacaaggagcagaatgacaattcatgctgatgaaggtagagttgaagagaaggtggagggatataaacaacaatcggcagctgagccgacactagaaccagtttctgatcttattgaacttaaggaagttgtggaagataaagatgaccaacaggagagagagacaccaatataa

SEQ ID NO: 5671 - DNA, 177 bp, Glycine max
  Peptide Sequence Number=SeqID_97356
atggagaagatgaggggtatgaagaggatgagggtggaaggaggaatgagagggacttgtgatccagaagtgtatcttgagtgggagatgaaggttgagcaagtctttgcttgctacaactacgatgaagaaaaaagatcaaactggcctccttggagtttgagggatatgccttag

SEQ ID NO: 5672 - DNA, 153 bp, Glycine max
  Peptide Sequence Number=SeqID_97357
atggagatactggtggatggcgaatttgatgctaacagactgtttgatgaagctgttttctggacttggacttggcttagacattttgagaaaaatttctcaactcatctaaaccaatgggcaagcaatattagtcaaggttttctcatgtaa

SEQ ID NO: 5673 - DNA, 420 bp, Glycine max
  Peptide Sequence Number=SeqID_97358
aagcttcgcctggcggagaagacgaagaagaagctggaggaagctgcacagtcaggaagcgttgatggcgtcatcgaccctccatccccggtcagacaccacgtgaagtggaaggtggcccgcacgaagaaaacaggggagatgacgactgaggctgcaaaggaaatcgctgagaagattgatgttctcactgctgctattggacgtccagagcaccctggacgtgtccgtgctgctggagccggtgtcaccatcaagcaatactttggaccagctccacggacgtcccgcagctcttcctccctgcctcccgaagaattgcagcagttgacccagcaaatcagggaccagctagaggagtccatcacagaaaaagtgacgcggcagctcatggcatcattaagccagatgcagtcctag

SEQ ID NO: 5674 - DNA, 600 bp, Glycine max
  Peptide Sequence Number=SeqID_97359
atgtctgccagtgatcatgctattctacgtgatagagtgcatcaacccaccaagaagagcttattggagttaccatcacaagacactgtgttggcacaaaataagttgttttctaagcaacttgagatcttaacagaaacaattggtaagttgccaactaaattgtttactggtcaaccttcacaatcttctgttttgcagaaaaaacgcaggaagttagttacatgggaaatcaacaaaggcaaggatacaaccaacgaggattctcaggtttccagcaaggtccctacaatcagcaaggacaataaagatcacaccctgaggactaccaatctggaagaaaccctggctcaattcatgcaagtgaccatgtccaaccataagagtactgagtcagccctgaaaaaccttgagattttggtgggtcaactcaccaagaagttagctgagaagacatccaacagctttggggcaaatactgagaagaatcccaaagaagagtgtaaagttgttgtaacaagaaacaggaagcttgtggcggctgaggatgaggatgttgttgctatagaagcaagcttcatgatgttgaatcaagattga

SEQ ID NO: 5675 - DNA, 59 bp, Glycine max
  Peptide Sequence Number=SeqID_97360
atggatcaaggaatctcccaatcatgtggctccgcatgccaccggtctcttgggacacg

SEQ ID NO: 5676 - DNA, 405 bp, Glycine max
  Peptide Sequence Number=SeqID_97361
atgaaatacgaatgcccccgactgtccctgttaatcattactccgatcccgaaggccaacacaataggatcagaatcctgtgcaccggaggcacgacccggcccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 5677 - DNA, 282 bp, Glycine max
  Peptide Sequence Number=SeqID_97362
atgttcgtggtattcaacagtgctttgaaaggacttaacgatactccacgacctagatccaaggctagtgctaggtggattgttgttaaatgtaatagacaaaaaggaagcactgagtgtggctattacgtgatgcactggatgtccactataatcttaggaagtttcaagaataattgggaaacgtatttaaatgatgttagaccattggaagcaaagagattaaaggcgcttcgcatccagtgggcaaagtattatctcaaagttagaaatcaaacttag

SEQ ID NO: 5678 - DNA, 1815 bp, Glycine max
  Peptide Sequence Number=SeqID_97363
atgaataatcaaacgttccagtcgccggtgcgcgaacggggcttcgcgcgtctcggtgactacgcggccatcggcgagggccggtcggtggcgctgatcgcgcccgacggcgcgattgactggtggtgcgcacccaaccttgactccgccccgctgtttgaccgcctgctcgatcccgagatcggcggttttttcaagatcgaacctgacgctccttatcgtaccgaacgcgcctatcgtgctgacagcaacgtgctggaaacccgcttttttaccgatgacggcagcgtgctgctgaccgaatcgctgaacagcacgctggcaggccgtctgccgtggagtgagctggcgcggcgcgtggaaggcgttgacggcgaagtgacgctgcgcctgacgctgcgctttggcaccgttgccgaaacccgctcgccgtggcaggacagcaccgaacagggcgacgtctaccacgttggcgatctgctggcgatgctgcgcaccagcgaggactggcagatcgaacagcgtgacgatgagcaaatctgcgccacgctatgtacggctgtcgacagccgatcgctggtggcgttgctggttaccgagcgcgaaccgctggcggtgccgccgctggaggcgatcgatacccgtattgaaaccagccataccgcctggtgcgactggacccgcagcttgagctatcaggggcgctttgcggagcacgtgcgccgctcggcgctgtcgctgaaatttttatggtattcccccaccggcgcgcaggcggcggcagccactacctcgctgccggaaggcattggcggagagaagaattatgactaccgctacgcatgggtgcgcgatgcctgtctgatcatcaaagcctttgtttttctcggtgcgctggaagattgtaaagcggcgttctcctggctgtcgaaaaccatcattcgccatggtaccgcgctgcgcacctgctacacgctggagggcaacgaagtgcctgccgaacgctttgtgccgctgcgtggctatcaccattctcagccggtacgcgtgggtaacaacgcgcgcgaccagctgcagctcagtatgtatggcgacatgcttgccaccgccgagctgtttattcgcgccgggcacgtgctggacttagccacctcgcgcatgctgggtgcgctggctaatcactgtgccgatttatggcgtcagaaagacagcggcatctgggagctgcccgagcagcagcactatacccattcaaagatggcctgctggctggcgctggatcgtgccgtggcgctggccgaagcgcgccacattgaaccgacctggctgaaacgctggcagcgcgagcgcgaccgcatcagcagctggattgaagcgcactgctggaacgaagagaaacaggcgtatgtgttttatcccgatagcaacggcaggctggacgctgcgctggcgctggtgcatccctatggcagccgcgtcaacccggcacgtatgcaagccacctaccgtgccattgagcaggaactgggacacggtagcgccatgctgtatcgctacagcggcacggaacaggaagagagcacctttatcgcctgctcattctggctggtggaagcctgggcggcgctgggagaatgcacgcgcgccgagaacgccatgcagcagattctcggcaaactgtgccagcgcggcaacgtggaaactttcaacgaaatgtttgatgtgcgcagtgacgaatggcgcggcaatatgccgcagggcctcagtcatctggcattaatttgcgccgcacaggcgctgaccgatcatggctga

SEQ ID NO: 5679 - DNA, 423 bp, Glycine max
  Peptide Sequence Number=SeqID_97364
atgaatttaagaggaagacaagtggagatagctgatccattgtgcccattctacaacaatttggatgaagatgcagcgcaccttttcttcaactgcaacaaggtacttcccttgtggtgggagacagtctcatgggtcaagtcagtgggtgctttcccaaaagaaccgaaagaccacttcatgcatcatagcagatcgaatgctacacgaacaaggctttttgtatcactagaggatgatagcaacacactaacagcagtaccagatatcacacagataacagcatcagacaataattccaaccaagaggaaatcatgatacatataaagatagtctaccaaacaatttatctaccaaacaaatacagcagtatatgtgtatataaatgctacgacaaatgtcaaaacagtagtctatcataa

SEQ ID NO: 5680 - DNA, 513 bp, Glycine max
  Peptide Sequence Number=SeqID_97365
taccctcacctccagaggactacatgtcctcgccttcagaggactacacgtcctcgccttcagaggactacacgtcctcgcctccagatgacttcacgtcctcaccttcggaggactacacgtcctcgccttgagagggctacacgtcctcgccatcagtgggctgcacgccctaaccttcagaggaggacttcacgtcctcgccttcatagggctacatgccctcaccttcagaggagcacgtcctcaaccttcagaggactacacgtcctcaccttcagagtgactacacgtcctcaccttaagaggttgcacaccctcgccttcagagggttacatcccctcacttcgaggcttcacgtcctcgccttcagggtactgcctcctagactgcacgccatcgccttcagagggctacgcgtccttactttcagtgggctccatatccacgccttaagaggatttaagtcctctgcccttaaatgcttaaccgagacttgcgctcccggctaa

SEQ ID NO: 5681 - DNA, 210 bp, Glycine max
  Peptide Sequence Number=SeqID_97366
atgaacgtaagtgatgagcccgctaagcgtgtctttgcgctaagcgggactagtgttccgacattaagtcaggctaagcgcaccctgtgcgctaagcttgagtgttattcggttgaggttgagctaagcgcgccatgctgcgctaagcctattctgcagaaagaaatgttttttgtgtcttcgagcttagtgccagcctgctgcgcttag

SEQ ID NO: 5682 - DNA, 477 bp, Glycine max
  Peptide Sequence Number=SeqID_97367
atggactttttgttcaagctggatacccatttttttctcgaaaatggcggtggtgaggtctgtgacccagccgcggaagaagttggtcaccaggccaaccagcaggtaactgaccgccagcgggccgagcggcagaccaagggtggtaaggccgctggcgataccgaggtaaacaaacagctctcctgggttgatgtgcgggaacaggccgttcatcgaatggcagctgtaggaggcggcggcgtaataactcggcttgtagcgggacagcgggttcccggcgcagcgctgagcgaagcgttcaatgcgatgctggccgataaagttaatcagcgcgttcatgatcaccagcaggctgatcagcaggggcaggatcccggtcaccatgccggtgaacacttatccgcctttctgaaacagcccgatgaaccactcggcgccgggggtgaaggtctttatcattcttctttcctgtag

SEQ ID NO: 5683 - DNA, 1473 bp, Glycine max
  Peptide Sequence Number=SeqID_97368
atgacgctatccaccgcgccctcaccgccaccggcattagaagaggagccgttacctcacgacggcgacgattaccacggcatcgtttcactggacgacgagggtttcccgtcgcaattccccgaatcaggaacggcgtcggaaaagagcagtttcgccgcggatttctatcgcagcggaaccgattggtcctcgctgttgttgtcgctggaagatagtaaacagagcgatttagcgcaagattcggggaagaagatgaagcaggccaatctgttccagatttgggggtttaaaagaaacgacgccattggttcagttgaatctggtcccagtaaaagtggttgttgtgacgacggaggtggttcttctgagaggaagattgtgaaacctgaaaatcggtgttcgatttttcccgacacagggaaagagttcgagaacgcgaaatcttctcgcaagagaaagggttcctgtggtgaaaataggggacaatgttcactgttgatgcttttcgttatgggtgtgttgaagggtgctcagcatattttcttactcatttccattgcgatcactatggtggccttagcaagaaatggtcacatggccctatatattgctctcctctcacaggaaggctcgttcaaatgtgtctctcggtatatccaccctttggaatttaatgaggaacatgtgattgatggtgtcaaagtgactttgttagaagctaatcactgccctggtgcagctttgattcactttaacctaccaaatggccaacgctatttgcacactggagattttagagcatgtaaactaatgcaagcttaccatcttcttgtaaatcaacgtgtgaatgtactttatttggataccacatattgcaacccaaaatacaggttcccttccaaggaagaagtactcaattatgttgtcaaaatcacaaagaaccacctcaaaattcatcctagaactttagtggttgttggggcatacagtattggcaaagaatgtgtatatcttgcaatttctaaggctcttggggttaaaatttatgcaaatgcttcaagaagacggattttgcaagcttttggttggcctgacctttcagataaactctgtacaaacggaaacaacacacttctccatgttctgccgatgtcatctttaagagttgagaccttaaaggattacttgaagacctacaaggagcaattcacagcaattttggcatttcgtcctacaggcattttacctatacttatgataacatttatttctgaatcatcttgtgagaagataagcaacgatctggaactaattaaacctgtttctaaaggaaatattacgatatatgtacttatttgtattgaaaatgctctgtactggacaatggtggatgagggtatagtgtttcttcgtagtaacaatctgctttctgatgctgaaatgcatcctcagtgtgaaacacaattttaa

SEQ ID NO: 5684 - DNA, 1626 bp, Glycine max
  Peptide Sequence Number=SeqID_97369
atggcttcttcttcttcttctcttctcccaaggtcacacattcccacacccctcatctccaaaatcagctcctcccccagaacatggagcctcttcattctcacatacccttcacaccccaaaaacaacaacaacaacaacaacaacaaaagactattcctttcccccaccaatgcagtgtacactcaaagcccctacaccccttccacaccctccaagaccgaactccacaacgaccccatcaccgtcctcaacgagaggattcggcgcgacttgagcaagaaggaggctttcagaacggtgatggactcggaggaggcggggaagtacatgaagatggtgaaggtgcagcagcagagagggttgcagaagttgaagggcgacagagagagtaaagatggggtctttagctacaaagtcgacccttacacgctccgttctggggactatgttgtgcacaggaaagtcggagttgggaggttcgttgggatgaggtttgatgttgccaagaattcttcacagcccactgagtatgtcttcattgagtatgctgatggcatggcaaagctacctgtaaacaaggctgctaaaatgctctatagatatagtttgccaaacgaaaccaaaaagccaaaggcattgagcaagttgagtgatactagtgcatgggagaaaagaaaggttaaagggaaggttgcaatacagaaaatggttgtggacttaatggaactctatctacataggctcaaacaaagaaggcctctctatccaaagagtcctgccatggccgaatttgcagccctgtttccgtatgaacctacgccggatcagaaacgggcatttattgatgttgagagggatttgacagagagagaaactccaatggacagattaatttgtggagatgttggttttggtaaaactgaggttgcactacgtgctatctcctgtgttgtctcagctaaaaaacaagcaatggttctggcaccaacaatagttctagcaaaacaacattttgatgttatttcagagcgcttttctgtatatcctgatattaaggttggactactaagcaggtttcagaccaaagcagagaaagaagagaacttggacaagattaagaatggtagcttggatattatcgttgggactcattcactcctaggagaccgtgttacatataacaaccttggtctgcttgtggttgatgaggagcagaggtttggtgtcaaacagaaggagaagattgcttcttttaaaacttctgtggatgtacttactttatctgcaacccctataccacgaactctttatttagcattaacagggtttcgtgatgctagtttaatgtcaactccacccccagaaagagttcctatcaagactcacctttcttcattcagtgaggacaaagtagtatcagccatcaagtatgagctggatcgtggtggtcaagttttttatgttctgccaagaattaaaggacttgatgaagtaatgacatttcttgcagagtcatttccaaatgtggaaatagccattgcccatgggaaggtagttacacatttacacctttttaagggtctagtgcttgcatgtaggactgtcaagcagatctccaaatag

SEQ ID NO: 5685 - DNA, 273 bp, Glycine max
  Peptide Sequence Number=SeqID_97370
atggccttattaaaatggaaaagcttacccagagacaaggcgcaaattgtcctcataacgctgtctttgtcgccctgttcgtgccggcacagacgacataggtttctagaaaaagacaaaaagaacttgaagcacacaaaggaaaacaggggagattcaaaaaccaaggttatgttttctctcaatcttgaacacaaaggagcatctaaaaaagctcttgcatgcgataataaagagaaggtgatgtttttggccaacacgtgttttgattag

SEQ ID NO: 5686 - DNA, 461 bp, Glycine max
  Peptide Sequence Number=SeqID_97371
tctcgggagaagaaggcattcttgtgagttgtccttcttctattccttatgtggaagccgtagaggagtctttggaaatgtcctttcaagcattggaagtagtgagcaatgcttatgtggagtctcccccggtacaaccacgctcatctagggttacattgatggtagctcgggtgatgttgggacatggatacgagcctggaatgggtttgggtcggaacgacaatggcgtggcgagtttggtagagttcagagggaatcgcagaaggttcggactgggatatgagccaacgcgtgccaacatgaggatgaatgccctagaaaggaggggaagaagcatgggccagacacaagggttgcaagtgaaagcggttcccttgtgtcacatcaacaagagctttgtcagtgcgggttggatgtgcgagggatggatcgccatgatacacgaagaaaccccttag

SEQ ID NO: 5687 - DNA, 221 bp, Glycine max
  Peptide Sequence Number=SeqID_97372
aatggaaagattgaaaggaaaaccttcaatgataagaaaacaaagaaagcttacatcacttgggaagataacaatatggattcatctgaagactcagaaaatgaagtcgtgaatctaagtcttatggcaaaaaattatgaaagtgatgaaaaggattctttgaagaagagttggtacattgatagcggatgctctaaacacatgacgggagatgcatcaaa

SEQ ID NO: 5688 - DNA, 462 bp, Glycine max
  Peptide Sequence Number=SeqID_97373
atgacttctacaagtggagatgctactccaccatctccaaaaaccgcaaggctcatggcggagatgattaaacttggtgatcaaatcagaagaatgagttatgaaaatgaagaaaggatggaaagaatgaaaaaagagaacgaggagagcttgggaagaatacaaaggagtagtaaagctttaagtgtgaggattgacaatatagagcgaagaagagaggacagatcatctaatcttctcatggagaatatgagaggtatagggagagaagaaaccatagaaggtacagaggggatgaaggttgagcaagtctttacttgctataactacaatgaagagaagaagatcaaattggcctcccttgagtttgagggatatgccttagtgtggtggaaccaagtgaagagtggtgttgagaggatgagaagccctttgattaatactttacaaggcatgaagaga

SEQ ID NO: 5689 - DNA, 1030 bp, Glycine max
  Peptide Sequence Number=SeqID_97374
atgacgaagaaaagcactgaaacgtctcgagctgatgtgagacccaagaaacccactggggtgaagatccaagaatggaaacaagaagagaaggaagaagaggaaagaccactcataagaaagagaaagttaccttcgacttcgaccaagtccgctgaacaaacagagacaggcaattctcaggctcaaatgcctaagaagaaaaagaaagtgaagcaggtcgagcctgaaccttctgtggctgttgagggtggtgagccaatcaagaagaaaaagaaaaaaatcaagccctcaaaagaacaaggtgacaatcagactgttgatgtccaaccaccttcgaccgatattgacggcactgaagtagaggctactccttctgttgctgagatggacaaccctgtcgatcaaccggactcatcaccagcacaacctgccgtcgaggtacaacaaaatgtttctgtagaagaaataccctcacgcgctcgaacatctcccgctcctgagacggatgcagtgcatgttgaggaacagggtgaaggtcaaggtattgggtccatcagtccttatggatcgagtcagaaaagttcatctgaagaaaacttttccgatgaagaggccatacaagaggctgaagctggaggttcggacatttacccggcgtcttcaacatctaagctttccgctagcatagggatcgcagaagacacattcattaaaatgcaagacgaagacccagctgcagcccttcgactcctgctgaacaccagtcaagccaacacttcgagtgaaaagattcctggtgcttcgtcctcatctgatgctgacatcacctcttcagtacgccaagattgcctgcttttgaagttatcaatggaatacgcacgggcagacgtacttaaatccattgaagagaacccctctgctgcttttgggcacctgaactttttgaagaaattgcacaaccctcttacctctgatgaaattctaggcaaagtcatccaaatcgagtccattatcgatcaatttgcaa

SEQ ID NO: 5690 - DNA, 471 bp, Glycine max
  Peptide Sequence Number=SeqID_97375
atgctgcaagaaaaagaagagagcaagaaatacaaggaagcagtcaaccctcacctccaccctctccacaaagctactaccaaatggaagaggagcgcggccaacataacctactttcactctctcatacaattgatacaaggaaacctcttccatggtctaccgaatgaggatcattacactcatcttgccacttacatagaaatttgtaacacggagaagcaaaaaggtggctacactcctttaaaggcaatagcttctagacttgggaagaacaaggcgctcgaccatttctacggactactcagaaagacgcctacacatgggtacaacgagccgatgcaattaaacatctccacagatggcctacgaccacagtcaaaacaactccttgacgcatttgtaggaaaaaatcaagatgaaggcactagaggaggcaatgaagctgatagagaacatggaggccaatga

SEQ ID NO: 5691 - DNA, 225 bp, Glycine max
  Peptide Sequence Number=SeqID_97376
atgactattgcagacagtattaacacaactctccttaagagcgataatgctaaagtgtttgtggggttagtggaagagcgctctcaaacaactgataagtctcttgctgggacattaatgagttcagtaaccaccatgaagtttatggttcacggattccttacaattcaaaccataagcccaaataagaagttagtcttcatgaagaatagagtgaaagcttaa

SEQ ID NO: 5692 - DNA, 1227 bp, Glycine max
  Peptide Sequence Number=SeqID_97377
aggactatacgtcctccccttcagagagctgcacgcgctcgcctttagaggactatatgtcctccctttcagaggactacacgtcctcgctttcagaggactagacgtcctccacttcagaggactacgcgtcttttccttcagaggactacacatcctccacttaagaggactacacgtcctcctcttcagagggctgcacatcctcgccatcagagtgctacaccccctcgcctttagaggactacacatgctcgccttgagaggactacacatcatcgactttagaggactacacatcctcgccttcaaagggctgcacgccctcgccttcatagggctgcacgccctcgccttcagagggctgcacgccctcgcctttagagggctacacgccctcaccttcagaggactacacatcctcgcttttagaggactacatatcctcgccttaagagggctacacgccctcgccttcagagggctgcacgtcctcagcttccgagggctccacgtcctcaccttatgtactagaaccctcaccttcagagggctacacgtcttcgcctttagaggactaaacgtcctcaccttcagaggcctacacgccctcgccttccgaggactacacgtcctcaccttcagaggactacacgtcctcgccttcagaggattacacgtcctcgccttcagaggggtgcacgtcctcgccttcagaggactatacgtcctcaccttcagaggaggactacacgtccccacctttagaggactacacgtcctcgccttcagagggctacatgccctcgcctttagaggactacacgtccacccctttagaggattacacgtccttgccttcgaaggactacacatcctcaccttcagagggctgcacgcccttgcctttagaggactatacgtcctccccttcagagagctgtacgccctcacctttagaggactatatgtcctctccttcagaggactacacgtcctcgctttcagaggactagacgtcctccacatcagaggactacacgtcttttcctttagaggactacacatcctccacttcagaggactacacgtccacctcttcagagggctgcacgtcctcgccatcagagggctacaccccctcgcctttagaggactacacatgctcgccttgagaggattacacgtcattgcctttagaggactacacatcctcgcctttagaga

SEQ ID NO: 5693 - DNA, 108 bp, Glycine max
  Peptide Sequence Number=SeqID_97378
atgaaagcaacaggcaaccaaaagtggcttgagggggcaagaaccgcaagccttcgtgttctttctttcttgaatgaagggggggggttgctcgcccaggcgacctaa

SEQ ID NO: 5694 - DNA, 226 bp, Glycine max
  Peptide Sequence Number=SeqID_97379
atggtggaaaaggagagatttgatcatatagaggagagaatgagggctattgaaggaggcggggattatgcctttgctgacatggcagaactgtgcctagtgcccaacgtcgttatccctccgaagttcaagggatctggtagctcaagtagtgccctcaatgatggagagggaaatgataacaatgatagcaaacacattaccggtgttgtactatcaaaagatg

SEQ ID NO: 5695 - DNA, 186 bp, Glycine max
  Peptide Sequence Number=SeqID_97380
atggaagaagatctcaagaagactctcaaattcttagatgctacaaatgcaaccaacttggtcacatcaaagcaaattgtccctcaaatgaggaatggcctgagaagagtgataagaaaagagaaggagatcaaccttctaaccaaggactatgagagttatgagaacatctctcaagaagattaa

SEQ ID NO: 5696 - DNA, 558 bp, Glycine max
  Peptide Sequence Number=SeqID_97381
atggtgtcaccacaagggcggaaaacatggacagttgatgatctcgtgccttatgtggagaagctaatgattttatccgaagagcaagagaggatcactgagcctgtggcacatggtctagcatcagagcgccgatttcccccacaacagtttcacatgcttcagtcaagtgttgaaactcgaggttttgacagacgaagggagattgttcaagcagaagatttttcccaacaaatgcagcagcgtggccatggaatatattacatgccaccaacattttctcaatatcctttgcagatgtatcagtatcctttcgaaggtcatgacactgatatgtctgcaagcgaacattcatttggtggtgttgtggaaacacatcctcatttttcatggtcgaccatgacctcttcgcattttctgcagaggctgagcaacaagggcggagacagcgtgcaagaagaaatccagatcatcaagcccgaaggtgggattgaccatgtggcacatcctcacgccatcacggacaccataatgactgattttgatgtctctatttaa

SEQ ID NO: 5697 - DNA, 504 bp, Glycine max
  Peptide Sequence Number=SeqID_97382
gggggcggagcctatggaaaaacggctttgccgcggccctctcacttccctgttaagtatcttcctggcatcttccaggaaatctccgccccgttcagcggccgccaccgcggtggagctcattcgacaccctatagtgagtcgtattacaattcactggccgtcgttttacaacgtcgtgactgggaaaaccctggcgttacccaacttaatcgccttgcagcacatccccctttcgccagctggcgtaatgcgaaagggcaccgatcgccttcccagacagttgcgcagccgaatggcgaatgggacgcgcctgtagcggcagcaattaagcgcggcggtgtggtggttacgcgtcagcgtcgcaccccggctacacttgccagcgctgatgtccggctggtatgcttttgccgaattagcggtacaccatccccgtcagtagctgaacaggagggaacagctgatagaaaccagatagccactggagcacctcgaaattaa

SEQ ID NO: 5698 - DNA, 321 bp, Glycine max
  Peptide Sequence Number=SeqID_97383
atggaacctctttcgtgccgatcaacgtctcattttcgccaaaagttggcccagggcttcccgcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 5699 - DNA, 138 bp, Glycine max
  Peptide Sequence Number=SeqID_97384
atggcaacttatgctgcacaatgtcgaggtccagacctggcatgtcatggaattaatgaaacattgggcttaatccggattttggttgtggacttgaagagggcaaataaagcagcgcttaccttagttaatttctaa

SEQ ID NO: 5700 - DNA, 273 bp, Glycine max
  Peptide Sequence Number=SeqID_97385
atgaagccaaggggttacatagaatccgatcatgtacaagatgatgtgccttaccaagttgaggaaaagtcacatgtcaatgaagtcattgaagttgaaagtatttctggattgcaagatttaagaggtggagttgaagaagtaaactctgctaatttgttgacaaatgaagaagaatcggctaatttgaatggagaatcaaacaatattgaacaagacaatgaaggggaattagaagatgactttgaggtttacaattctgaagaggattag

SEQ ID NO: 5701 - DNA, 708 bp, Glycine max
  Peptide Sequence Number=SeqID_97386
atggggttggtcggcgccgctcttgtcacggtgtgtgcagtgggcttggtgcgtgacagcggccgcatcatgcttgacgcgcagatggacgcaccggtggtggctgaagtacgcgaagtgatcgaacagggcccgtggccggcgcgcctggccgacctgcacgtctggcaggtcggccgcggcaagtacgcggtcagtgccagcgtggtcaccagcgacgcagatccaccgtggctgatcctgcgcgaccgcggtcgaatctgtagccgaacccatgctcggcttgccgttgcctttgcagcgccgagccatgctcggctgtcgcaggccatcagccgagcacgggctcggctctacagtcagaacttcagcatcatccgcagcaggtacatcagcagcggcagcgcactcagcaccgcaccaccgatgccgatccacggccaacgctcaccgcgcacgcgcgaagccaccgccagaccgccgcccaccagtgccgcacccagcacgcccacgcccagcccggcggccatgccattgccgcctgcggccaccgccgcctgcgcagccaacgtgcccgcgccccaacccacagcgatccccagccaactgaccatgccgcaccacggtgccttgccttgcgccatccgaaaacccctttgttcttgccgaatttctgtacgggcgacgcccgagtgctgcctacactag

SEQ ID NO: 5702 - DNA, 282 bp, Glycine max
  Peptide Sequence Number=SeqID_97387
atggagtcaggtgacatgcgggggtaccgtatggttatccacacctttcgtcatctaggggcaaacgagcccattgacgcgcagcgactaacatcatattctgcaccttttgtcatcctaacccatggggtcagggtttttactctagtcgtccacagacatgcaagcccgacgatgcacaaaattcttctctgctgggcgtggggcgatcaagttcgacggcgtggggaagtgtcgtggttgtcccactttatcgctttcaagacactgaagttttgttga

SEQ ID NO: 5703 - DNA, 171 bp, Glycine max
  Peptide Sequence Number=SeqID_97388
atgaatggtaccacattacatttgagagttgaggtcagaaaaggccatcgagaaggccatggtgttggagaagaaatacgagcaggagtggcaatcaccaatgatgttagagtcaaggaaattagagatgacagtcataaggtcgagttgacaccgccaacgatagaatag

SEQ ID NO: 5704 - DNA, 855 bp, Glycine max
  Peptide Sequence Number=SeqID_97389
atggaaactgcaaaagggaccaccaccgaaacaacagcaagcaaccaaaacggaagaaacaaagcagaaaagaaacaagcagagaagaaagcgcatttgtgggtacttccggaagtcacaaattcttcttccggaagaagtttttccggaaaatttccggaaaaaggttttccggaaaatttccggaaaaaggttttccggaaagtttccggaaaaaaacttcttcctgaagaagaattactaaagggcagtttcgccacttcactgtttgctgggtgccccagcaataatgcaggaaaccgaaacaagtttattttttccaacaagaaaaaccatgacagcacgattatccatagaattgaaaacgaagtggtggatattagacaagcaaattctcttgtggctgcactgcctattccaaactttaatcattatactattggctccatttgttgggaagctccgtctggtgataaacttaaacttaattgtgacgctgctgtaaatttgaatggtgctgccgtgtgtggtggtgttcaccattgtggatccgttattttcgtgtttgcagccttcattcgaaagtgctccatcactcatgcagaattatgggcgcttgatattggctccaagattgttgtctccaaaggttattccaatttccttgttgaatctgattctcaggaaaccataaacctcattcaagaagggtgtttatcttcccatgaatgcgcttggcttgtaaatgatattctgcttactgcagcaatccatgatattgattcctggaagcatatttatatgcatagttttaaaaatctaaccggtcaaagtattgagttattgagtcaatga

SEQ ID NO: 5705 - DNA, 309 bp, Glycine max
  Peptide Sequence Number=SeqID_97390
atggttgcggcatttccccaacaatttcaagcatcatacatcgaagttagcaaaatttcacgcgatcttcagtctttgaccacttttggctttcaaggggaggcattgagttcgctctgcgcgttggggaacttgaccgttgaaatgagcgaaccgggaaccgccagtcaaactggcgagttccaagttgcagaagttacagtcgtaagctcaggtggcaggcttgctttttcagatggcaggccaaaggcaagttacaactgccattggcaagttaagggaaagttgcaactgccattggcgatttag

SEQ ID NO: 5706 - DNA, 1131 bp, Glycine max
  Peptide Sequence Number=SeqID_97391
atggaccctatttgttcatggagcttcctttctttcgattggccgcttgcaccacctcccaaacaaccatctcagcccccatcctttgctgaagcactatgcaacactttagatatcccgcttagtcagctatgtaagccatgtttgaaggaacagcttttacgaacttctgagcatagccaaaggaattgtcttcgtaaaaatctcaggtttgagttagaagcttgtggatggctagaacctaaacccaggtatcttgcatacccaatgttgggtctaactctgcgatcttcctttggaatattggaggcgcctcttcagtcactacgcttccccctttttgctcttgccaccatagccaacatcacgcaaggcactgcaaatcctctaaaggctcctcgcatatctcctgctaaagctctgaaggaggaaacacaagaacctggcccctccaaccaaaaccaaaagcaggctccaaagcttagtgctcgccatatgcctaccaaggcttgcaaggacgcaacccaacaaaacctagagaatgcttatcatatttctgatgcagaatctgattcaaaccctggacatattgttcccactccccctctgggtgcaagctctcccccaactagcagacaaggtgttcaaatgtcttcttcaggtaaggctgacattgtggatgaggaacatgatgaatctggccaagaggaagaggacgagaatagagggttcatagaggcggtcgtctccctcttcccgcttcctatgataatttccaggcttggacggatgccagtgcccttaaccacattgataccattggtgctctctatgcctagtcaaatggtcgtcatactaataggcacattgaagctcacctggatagggccatcgataacgatgattgcctggatagttgggactccttatcctgttgcaaccttaccagaaaatcattgtgttgaaaatgacctcatagctactttaattctctccttggcttcctctgacaacaagtgtatgctcactaatttgcctatcaaagaagaagttagactcgtttttgctatgaatggttacagggcttcaagcctagatggttttggagggagcttcttccaagcattctag

SEQ ID NO: 5707 - DNA, 225 bp, Glycine max
  Peptide Sequence Number=SeqID_97392
atggcatcaccatgcgattgcaacgcctccaagcttcatgcaatggatctgttggcggaggacagggaagtgtgccaaagagaaaatgatctttgttcttggattcaagtgccacaatcatatcacgttctcattgatgaaagttgctttcggtcaacggtggtgaaacaagagcaacgacaggattctcttcgggatgaagaaaatagggattggcagggttga

SEQ ID NO: 5708 - DNA, 627 bp, Glycine max
  Peptide Sequence Number=SeqID_97393
atggcctcccgtaaacgccgtgccgtgcccacaccaggggaagcgtccaactgggactcttcccgctttacctcagagattgcttggcacaagtaccaagacaacattcagcttcggaacatccttccggagaggaatgttgaacttgggcctgggatgttcgatgagttcctccaggaactcaggaggtgcagatgggaccaggtgcttacacgcctaccagagaagaggatcgatgtggctttggtgaaagagttctattcgaacctttatgatccagaggaccacagtcccagattctgcagggtgcgaggacaggtcgttcattttgacgctgacacgattaacgacttcctcgacaccccagtcatcttggaggacggggaggagtacccagcctacaccagatacctcagcactcaccctgatcctaacatcatcgccgccacactatgtactctaggggggcattttgttctatacaccgatggtcttccctggaagctgctgaggaaggacatgacgacactcgctcagacatggagtgtcctctcttattatgatcttgcacccacttctcacacatctgatgttaatcttgacagggcacgcttgatctacagcttg

SEQ ID NO: 5709 - DNA, 381 bp, Glycine max
  Peptide Sequence Number=SeqID_97394
atggccattgagggtttacaactggggttgaaagaaagaatagggataataaaaacaaagaatatagagagagaagggagagctcaagcttggattgctgaagtgggctttgggctttcatattcacgcttagcgcgttcggattgcgcgcttagcgcgcgctgcaagcttagcctgtgcttctgttggatcgcgcgcttagtgcgtagctggggcttagcgcgcgtaacagattctgcatcttcgagctcaacgcctcacttagtgcctgtcttctttgctcgcttagcgcttgacgtgcgcttagcgcgagtgttgggctgggcctgcttcagaactccttctttttcttcatttttgttgcctttttgcttaatgtaa

SEQ ID NO: 5710 - DNA, 231 bp, Glycine max
  Peptide Sequence Number=SeqID_97395
atgtgtgagacaattaataaattgaatgctgagcttttggcaaaggcaaataaggagaagacacttgaggaaaagatgttgcaattgatggagaatcatgaccaccaaagtcaggagatgcaacaacaaatgcaatctatcatgccaactcctagtccatcgactaccatagcagatggaactgagcaccatgttaatgatgctcagattgatcatcctcatgacatgtga

SEQ ID NO: 5711 - DNA, 1560 bp, Glycine max
  Peptide Sequence Number=SeqID_97396
atggccgagaaaacaaagtcaagactgaatgaaggtgacgatactcaaaatgcagatatggtcgtcgaccctccatcccctattgcgagacatgagaagtggaaaaaggctaggacaaacaaatttgggcaaatgacatctgcagcagctcaagaaatcgcagacaaaattggagctttggtcccacatggtcgtgaagacatcctgaacactgccattggccgtccagagcatcttggatgtgttcgtgttagtggacatggtgtgaccataaccagctactttggacaacgtgcctgtgcgtccaacagttcttcgcctgcgatcaccgccgaaaaattggttgaaatcatacaaactattaagcaagaggtgaagaaagaggtagaagacaagaacaaagaccgtatggacaagatgaaaatggagttggatgcgatcaagagtgagttatcccaaattcatacgcaacagtcagctcccccaagaccgtttaaccctgacatatttgatgcacgtgttagcaccaaagagagttgtgttgaagctgctaataatgttgttggtaacaagaggtctacatttgatacatgtagtatgggcttatacattatttgtggtgacaatacacagctggtggccttgggaaaggtctttggagtaggtggcacgatacacactgtttcttatggagatgatgtactaagggtgtgtgttaacactgtatacaatggtgaagtcattctcccgttacccacttcagagattcagtatgtcagggacgtcgtgaactcattcattggatggcccagacatctagtgaaacctttatctgatgattcaaaccttaatgtgcggaagccagttgaacgtagtggtgatgcaaagcttgcaagtgaatccgatccattgggagagtttatgaagatattgttttatgtgtaccagaatccagtggacgtgccgagggaggcaagccaatttggacttcctgatattggggcaaaattttacatcacacatgcagatctagcggaaataatatcagcttatcagtcactgtatggtttgttggagcctcaatctatacaaaatgctaaggacagacgtcaacaatgccaacaatacattgaaacatgggtcaaggaatcacaaaggcagttgtatttaggagcttacttgcatcaggcacattggcaactatttgttctccacccaagggaaaacacggtcgttaggttttgttctctgaggaagaagcttgatattaacatcaaaggcacaattaacagtgcaatgaagacaataaccagttcttttgaaggcatgtctaatcaaggtgcacctcggtgggttgaacccaagagtaatgttcaaagtggagggttcgagtgcggatattatgtcatgcattggatgtggtgcatcgtgactgccggtttgaaggatgattggcacaagtggttttctgatggatcaccgttagacgtggaggccatcacaatagttcgacagaaatgggcaacttactttttaacttttaggaaaagcggttgctaa

SEQ ID NO: 5712 - DNA, 651 bp, Glycine max
  Peptide Sequence Number=SeqID_97397
atgttctatgttgaatatcccagcgactcaagatggtcagttgttcttcaggggaaaacaattggtatccctcccaatattgatgcttcaacccttgatgttaacgacatgccgaccttctccacagaaaagcctgtcgtaaatgatgaaaatgaggaggaggaggatgtatatgcaaatcgtatcgatcatgacgaaggcatggcaacacccccgaggtcccttccaccaccagattctcctacagaaaccacaaaaaagaagactagacaaactaccaggatgcgaaggttaactaccaaaagcttagatcaaccacgaccaactatccacattaacccttctactggtagaggatctggccctcataaagaaaaatttcacaattacctgggggtagtggcacaggagaaaatccctatcattcatactacttggaaggatgtcccagaaactctaaaagttcttgtatgggatgacattttggccaaatttgacatccctgaaggtttaactgcgaagaagaaggttatgtccaccgttgggaccagatggaggcaatttaagtcctccctgacgaccagatatgtatacgctgagaaagacgatgaacaaaataaggatccatctgctaagtatggtattgattga

SEQ ID NO: 5713 - DNA, 201 bp, Glycine max
  Peptide Sequence Number=SeqID_97398
atggtgggttacacaccttcaagctttgaggatttggtcttcgccggtgaaaggatcaaagtgggtctagaaaaaggcatatctaatcattctgctttgatgaatgcgaaaattggggcaaatgaaaaggatgagaatgagggagaaatccttgctatgactgccattcctacacggtcaaatttcccatcagcccaataa

SEQ ID NO: 5714 - DNA, 588 bp, Glycine max
  Peptide Sequence Number=SeqID_97399
atgccctcacctttagaggactacacgtcctcgccttcagaggactacaagtcctcgccttcagagggctgcaggccctcgccttcagagggctacagaccctcgctttcagaggactgcacgccctcgccttcagagggctacacgtcctcgccttcaaatgactacacgccctcacctttagaggactacacgtcctcgcctttagagggccgcacgtcctcacctttagaggactacacaccctcacctttagaggactacacgtcctcgccttcagagggctacacgtcctcacttttagagggctctacatctgcgcctttagagaattcaaggccagtagtttccttttatcagttcctggtccacccccttgatctcggaggagggccaactgtgcgagcacaaccagaggaggaggctggtctccaacttcgacaaggaggctatcacacaactattatgcataccggggtaagatttcgctcagactactgcagggatacgagtgcggatcatgcgtacaaccacaactccgatgttcccctgtcgaaaagtcagctggtttatgccatcatgacatag

SEQ ID NO: 5715 - DNA, 132 bp, Glycine max
  Peptide Sequence Number=SeqID_97400
atgtactcgcccagcacgccgcaagctcacccattggtggaaactaaaggagaggagtcgaaaaacagagccaaaggagaagctagagcaacaaaaacgaagccaccaagagagactaggttaaaggggtga

SEQ ID NO: 5716 - DNA, 315 bp, Glycine max
  Peptide Sequence Number=SeqID_97401
atgaatcattgttaccttgaagaaagcgtgaagggaggatcaggggctccgttcactaccaaatccacgagttgggttttgaagattccgctccaattaaaggcttccactttatgcgatggtccaaatgcaagcagtggtggctcgtggtggtcgccagcggtcgtgggtagaggaggagatgggtctagggtttggggagaaaaagggttaaaatccacgtttttcatgctactggacgttgtgagcctacaacagaaattggaaggcgatccaatggttaaaaagtccaagatcatggttttactgaaatag

SEQ ID NO: 5717 - DNA, 237 bp, Glycine max
  Peptide Sequence Number=SeqID_97402
atgaagaataggtcgttgtatgatcatttgcacgtcaaggacgagggtagcagaaagagagctatattaaagtacgtgaaagatgaaataacccaatcattaagtctagtggacgttgtagtgcctgctatcttggctcaagatttggtgaaaattttggatccaaaagttgcaccaccgaatgttaatgaagcattcacagtggagttagtggcctatattgctatccatgtgtga

SEQ ID NO: 5718 - DNA, 165 bp, Glycine max
  Peptide Sequence Number=SeqID_97403
atggaagagatggggaataaaaatgttgttgtcgtcaagaaatcgcttccaatagcagcatacaatggaggtgtcgtcaaagcttgcaggagagggagagagtttttagagaagatgaagataggcatgcccacgagccacataaaggaaaggattgtctcctag

SEQ ID NO: 5719 - DNA, 333 bp, Glycine max
  Peptide Sequence Number=SeqID_97404
atggaaggggaagaggactcttaccactgcaaacaaccccaaacaacaaaaaggaataagaaagatactttcttgaacaagatgatgacaaaggtgatgacaaaaaactcaaaggtcaatcaaaggatgagttcaatatgttcaagaaggaatcaagaacaattcaagactcaagaggaaaggttgaaggacacttcaaaattcaagaggaaagttgaattcaagaatcaagattcaaggatcaagcttcaagaatcaagattcaagattcaagaactcaagagaagacttaatcaagataagtatgaaaaggatttttcaaaaactgagtag

SEQ ID NO: 5720 - DNA, 96 bp, Glycine max
  Peptide Sequence Number=SeqID_97405
atggaacaggcgggttttgtggctgatctaggggtggcctttgtggatgattgggtgttcttggctgataggatgatgggtaatgagaaaggatga

SEQ ID NO: 5721 - DNA, 501 bp, Glycine max
  Peptide Sequence Number=SeqID_97406
atgaagaagacgaagggacggaaccaaaatggacaaccaaagcttgtgccgacgagaagaagacttctgcgacgaagaccactgaagaacaccaacgaggaaggagcgcggaagaagactctggaccaagaagaagaagtcgaagaaggggagaaggctgttgctggcgcgcttagcgtgaagaaggaatccagaagagcacctgaatcgaagcagcgtactaagcgcgagatcagctcgttaagcgactcgtccgtctcttgccaggctcaccgcagcattggcgccaagcccaaatccacttactcgcgaggaggaagcaacaacaaggagcctagggttcatttgagcaagattagagagtgtttgagagtttgtgaggtgccaagaagagaaggagggatcccccttcctatgaactttagcactgggaagtgtactgtttccttagaacttgatagagcagggctagataactgcattgctagggatagattgcag

SEQ ID NO: 5722 - DNA, 318 bp, Glycine max
  Peptide Sequence Number=SeqID_97407
atgtctcttcccactctctttgggaaacttcaagaacatgaaatggaacttatgagactcaaccaacatgaagagaatgacaaaaagaagaaaggaattgcactcaaagcctcatcttctattcatgaagaaagtgacaaagaagacatgaatgaacaaaataatttagaagaagatgatgatttcagtctctttgtaaaaagattcaataaatttatgagaaacaaaggaaatcgaaggagatccaaagaaaaaaggagaagattccttctcgatcagttccaaaatgctatgaatgcgatcaacttagccacctga

SEQ ID NO: 5723 - DNA, 312 bp, Glycine max
  Peptide Sequence Number=SeqID_97408
atgtccacactcacaggagttaggcactacgcttgggggaagctgcagttgacaggctacactgttatggactttcatggaagaaaacttgatgagatgctgctgtccattgaagctctagttgatgatgcagaacaaaagaagttcagagatccgcgtgtaagaggatggcatatcgctgccaaagatgtcgtgtttgacacagaggatctattggatgaaatagactatgaactctccaaatgccaagtggaatctgaatttcaaacctttactttcaaggtaacaaatgttggatcaagtggcctctga

SEQ ID NO: 5724 - DNA, 476 bp, Glycine max
  Peptide Sequence Number=SeqID_97409
atggaggaggctaaatttgatatcaaagcttgggtttgtgtttcagatgattttgatgttttgacggtgacaagaacaattcttgaggcaatcactacattaaaagatgatgttcctctaaattacgggtctaagggaagtagaattcttgtcacaacgtgcagtgagaaagttgcttctactgtgcagtcatgtaaagtgcatcagctaaagcaactacaagaaatttatgctagcaaaggattgcctctagccttgaaaacaattggaagtcttttacattcaaagtcatctattttggaatggaaaaatgtatcgataagcaagatatgggatttaacaaaagaagattgtgaaattatccctgctctatttttgagttatcaccaccttccttctcatctcaagaggaagaatgatgatctcggcacactccttggccgtctaccggcagtaatatcacctgagaggaatgg

SEQ ID NO: 5725 - DNA, 453 bp, Glycine max
  Peptide Sequence Number=SeqID_97410
atggccccgaagaaactttctgctaaaagagctaggaaagccgctataggagaaggatcaagtattgcaccaccgagacacccggtggaccttgagaagtccaatagtgcactgggttttccggcattgattacaagtctctgccaattctacggagtactgatcgcaccgacaaagcttatccaacctcccattaataggacattcactgagaaatattgcatgccaaggaccctaacccttacccgtggcctactcccgagtagtttagagccactgtcgcatggcctggggataggcccaatttttaggaggaggcaggtcctacagatgcttaaggagtttcccaagggaacgaaggtggagccgaggacgatggagacatggcagatttgcttgatttcttcaatggaggaggttgagctccccgaccgcgatcttctaaatttgtga

SEQ ID NO: 5726 - DNA, 357 bp, Glycine max
  Peptide Sequence Number=SeqID_97411
atggaaaactcaaaacacttggctactcctatgaatacaagttgttatcttgacaaagatgaatctggtcaaccagttgatccaaagcaatacagagaagttgtcatcatcaaaaagggggagattgtagaagcaaagcttcatggtgaatcaaagatgattcaaaggtgtcgacaaaaagctcaaagatcaatcaagaacaattcaagagttcaagataagaatcaagaagagttcaagactcaagaagaaagtctagagacaagaatcaagattctaggttcaaaaatctcaagaatcaagatcaagattcaagactcaagattcaagaatgaagagaagactcaatcaagataa

SEQ ID NO: 5727 - DNA, 573 bp, Glycine max
  Peptide Sequence Number=SeqID_97412
atgcatgtttgtgataccttaaaaactcgacggtgcaatgcaattgaagccggaatgcgcgttgaaggagaaagcttcaaggaacacgttaagggtgaaaaaatgatgaaaaggagaaaaatgcagaatgaaacaacaaaaatatggagaaaacgcgttgttgttaatcggagggctgagaaggaagggacaattagattggacggttcagatttggtagcttttcataacatggttgtcacgtttacgtgcaaattgcaaactttgcaatatctctatcgatctgtctccagaacgtggtcaaccgccggcggccggcagcaggccttcgccgagtactccgtaaagccccgtcttaaaagaacaacgcaaaaacaactttccaacaagccttcagacatcgatgcttcccgcgcacttttcatcgagatcacagagattctaggagctgataccgtgatcccagaccaatccccatctgggtttttgtttccacttgaaacaccccattctgaagggggtttaaatgatcaaccagcttgcaccgaaggtgtttgtggaaatgccgcatag

SEQ ID NO: 5728 - DNA, 598 bp, Glycine max
  Peptide Sequence Number=SeqID_97413
atggtggttgagggccaaagcaaaggatatgtttgccataagctaccggaaggcggggacgcgggtcatgggggaggcggtgggcggcaccgccgccgtgtgctgctgcttctccttcggcctggccaacattatgtacctagcgatgtacaaggttccggcgatgctgtgccagaaggcgctgcggaggaagcggcggagccgccgcctcctcctccttcagaccagggaggaagcagcggcggtcccgtcgcggccgcggacaaggaggtggtggagttggagaaagagatgtgggagaggttttatggaagtgggttttggagaagcccctctcagagagaaaactcttctccgcaacaaaggattaatgccaccactgtttctgctcctaattatcttcagtttgttgatggctctgattttgtaaagacgggtgaaaagatttttgagttgtttgatgccactatggaggaagttggagaagagaatgttgttcaagttgtaaccgataatgggagcaactatgttttagcggctcattgtattgatttgatgcttgaagatattgggaagcttcccttgataaggaagacaa

SEQ ID NO: 5729 - DNA, 246 bp, Glycine max
  Peptide Sequence Number=SeqID_97414
atgagtgacttgaagggtgcggattcagggaagaatagagagaaagtgatgaaaagtgcaaagctagcctcgtcagctttggggacaactttgcggaggaagaaggcaacaatgatgttaccgatgaaaggaagagagatcctgacagaggcgtggagagaaattcaagtgctttttgcattcggggcacttgaggttatcctcagagatcatcacacacataaggcactgagggcaccctactag

SEQ ID NO: 5730 - DNA, 192 bp, Glycine max
  Peptide Sequence Number=SeqID_97415
atgactcaagaacttcttttttttttcttttcttccgagggcaaagatggacattctcaccctgggtcaatgtttatggtgagttggtatttttggctcagagcttgtagaacgactggacatgatatatgtcagggtgttggtttggtcagcagtctaggggtaaagggatgtcccacattatttccatga

SEQ ID NO: 5731 - DNA, 357 bp, Glycine max
  Peptide Sequence Number=SeqID_97416
atgaagatgaatgcaaacaaaacaaaaaatgaattgaaagtctcggattcgaacacttactggttgaagaacgaagaacagacgaagaacgataaagaacgtaggaaaatcttcacagatttactcacggaaacgtctcggaagcgttacggaagcactttgactcgattcttcttcacggaaatggaaaaagggaggtgcttgctgcccagaggcttcttgagaaaaatttctaagcgcaacccaattactaagttcacccccttttcgtactctacggaaaagttacggaagccttacggaagttttttggatttgattttcatctttttttctcttccctttcaccaatattaa

SEQ ID NO: 5732 - DNA, 854 bp, Glycine max
  misc_feature (789)..(789): n is a, c, g, or t
  Peptide Sequence Number=SeqID_97417
atgatcatttcgagaggtggtcaatacagcgtcaaatccaagacagggataaaccaaggcactaggctgatggtcatcagatcatcatcccgcgactggcttcgcatgatgcacagggttagctcgcctgggcgagcaccccctgcacgagaaagattaaaaggagagggaaagggtgagtttttcacccaaaacgtcttcctctcatccaaaaaacgtatgctcactggatcccttggatttccagccttaggtcaccatttctcaacgttttttgattccattttgcacttttattcatccccaacaagagatggcaccgaagaagctctccacaaagaggtccaggaggaacgcccatggggaaagctccagcgcctccatggagttcgacagtcaccggttctggagtgccgagcaccagcagcacttcctggaggagatagcatgcaggcattggacacctctagtgactccaatggccaagggtcagtggatttccttcggcacagatgccctcagctagttcctgggtcacccactgatcttggaggaggaccatcggtcatcgcccagctattgtgcatatcggggcaagactttgcccggactgctgcggggaggcgggtgtggattatgtgcaccagcatgactactctgacacagataaggatgacgctactactcagcaacatcctgcccaacgaccataatttttacctccctctgcctaagtgccagatggtgtacaccatcctgaccaggatgactgttcacatggcccagatnattgcttacgccatttatttatttgccgggacggcgcccactaggcaccctttggacccggagag

SEQ ID NO: 5733 - DNA, 332 bp, Glycine max
  Peptide Sequence Number=SeqID_97418
atggctccgaagaagctctccacaaagaggtccaggagggacacccatggggaaagctccagtgcctccgtggagttcgatagtcaccgggagaggcgcatccagctcatagaggatgagtactcagacttccaggaggagatagctcgtaggcattggacacctctagtgactcccatggccatgttcgaccctgggatagtcctagagttctaccgacagtgcgaattcagccagaggagggaccaggcctctggctttgacgaggaggccatcgcccaactgttgtgcatactggggcaagactttgcccggaccgctgcggggaggcg

SEQ ID NO: 5734 - DNA, 450 bp, Glycine max
  Peptide Sequence Number=SeqID_97419
atgggggaggcggtgggcggcaccgccgccgtgtgctgctgcttctccttcggcctggccaacattatgtacctagcgatgtacaaggttccggcgatgctgtgccagaaggcgctgcggaggaagcggcggagccgccgcctcctcctccttcagaccagggaggaagcagcggcggtcccgtcgcggccgcggtgcacctgcggctgctgcgatgacatcatcagcgccgggcgggtttacccgctgtgcagcaacgacggcggcgacgtggcggtgctgcgaagccgtagctcggtggagaaggacaaggaggtggtggagttggagaaagagatgtgggagaggttttatggaagtgggttttggagaagcccctctcagagagaaaactcttctccgcaacaaaggattaatgccaccactgtttctgctcctaattatcttcag

SEQ ID NO: 5735 - DNA, 293 bp, Glycine max
  Peptide Sequence Number=SeqID_97420
atggaatttgttgttctgcctctattagaaacaatcgatagatatatatacaagccccctgacaagcttgcttcttttgcaatcacacagtttatccaccatggaatgctttatgttcctattggttatagttttggtatgctttatgttcctattggttatagctttggtgctggaatgttcaatttggagtccacaaaaggaggaactctatatggtgctggagtttttgctggagatggtacaagacaagcaagtgaaatggagctagagcttgcagagtatcatggcaa

SEQ ID NO: 5736 - DNA, 207 bp, Glycine max
  Peptide Sequence Number=SeqID_97421
atgactaaatctttaaatagggcatcatcaattgaatgccgtatatgcaatgacttccaagattattttgatgatgtcaaagaatcaagagttaagcaaattccaaagattcaagaatcaagtttcaagattcaagaacaatcaagatcaagattcaagactcaagattcaagattcaagagaagactcaatcaagataagtactaa

SEQ ID NO: 5737 - DNA, 183 bp, Glycine max
  Peptide Sequence Number=SeqID_97422
atggagtcaaacaacatgccagacatgaacggtgtcgctaagaagactaaaggcctaggatcttcttcatcaatggattcctttgcttcttggaagatgattggcagcggaatggagaaggaagagagagaggagacgccacttcaaggagaagatgagtctagaagaagctcaccaccatag

SEQ ID NO: 5738 - DNA, 183 bp, Glycine max
  Peptide Sequence Number=SeqID_97423
atgtttctttcatgtctcaatcataagaaaaattggagtgtgcttggagcagccataacggttattggtttttatgctgttatttgggggaaaagccaagagcaagcaaaggaagagtgtgaagtctatgatgactcagaatcatactcgccgttgtccctcttttggagaacaagagaatga

SEQ ID NO: 5739 - DNA, 327 bp, Glycine max
  Peptide Sequence Number=SeqID_97424
atggtgtttaaaatccaagacaccaacatagattgcacggtccaccaatcctccatctctgacgatcattcctttggatgctttacggtgccatccacaaaaccccatttacaccatgcacgtaaggaggttttcatagccttaaccccttctttttttggtatgctttatgttcctattggttatagatttggtgctggaatgttcaatttggagtccacaaaaggaggatctccatatggtgctggagtttttgctggagatggtacaagacaagcaagtgaaatggagctggagcttgcagagtatcatggcaagtatatatga

SEQ ID NO: 5740 - DNA, 727 bp, Glycine max
  Peptide Sequence Number=SeqID_97425
ctccgccctctcccaggtgactgagcaggtcagtcatatcctcatccatgtgggcttcctccgcttcgcccggggatcctgcgggtccggttccctcctcaggggagccctgcccctactggctgaggctgaaatgctagaaggactcatgcaattgcacctgcccgcggtggttggcccctgttgtgtgtcatccttcacttgcctagctggtgctcataatccacacccgcctccccgcagcggtccgggcaaagtcttgccccgggatgcacaacagctgggcgatggcctcctcgtcaaagctggaggcctagtcccttctctggctgaatttgcaccgatggtcctcctccaagatcagtgggtggcccaagaactgcctaagggcatctatgccaaagggaatccactgaccccttacccacgagcgcatatctcgaactccctcctcctactcatcctttatgagctggacgcgcctctccctatggaacgactatcccttgatggcctcaaaatgctgctggtgttcggcacttcagaatcggtgactgtcaaactccacagaggcgctggagctttccccatgggcgtccctcctggacctctttgtggaaagcttcttcggagccatctcttgttggggatgaataacaacgcaaaatggaataaaaaaacattgagaaatggtgacctaaggctggaaatcaaagggatccagtga

SEQ ID NO: 5741 - DNA, 177 bp, Glycine max
  Peptide Sequence Number=SeqID_97426
atgcggaaattgattaaggaaaggatgaaaaataaggtggttaatttcatgggtcttaataaggtggttcttggcataaaatggatgaatgggatgaacaaggttgaagatgaaagaaaggaaagaatcactctttctgggcgagggcaacacacaaaggttgtgaaagtcctttga

SEQ ID NO: 5742 - DNA, 477 bp, Glycine max
  Peptide Sequence Number=SeqID_97427
atggcgagtggcatgtatgcaagaccaagactcccaaaacccaagtctaataattccatggttaatcctccaaagggcttgcaaaacccaagactatttggcaagaccttcaatcaggtggaagtcatacttgctcctcataaccatcaaaggataagctttgtcgttcaagatgacccatcaccagattgtatgacaagacattcaattaggtccagctcatacttactcctcataaccatcaaaggagaaactctgcaggtcaagcaacctacccccagattggttggcacgaccttcaaccaagggaaagtcaaacatactcctcataatcatcaaagaagaagctcagtaggccaaacgacctacctcaaactggttggcaagacctttaaccaggggcaagtcaaacatactcctcacaagcatcaggggaggagctttgcaaagcagaaggaagccccaccagatgggtga

SEQ ID NO: 5743 - DNA, 231 bp, Glycine max
  Peptide Sequence Number=SeqID_97428
atgagggagaagaacggagagggggaagaaggaaacagaacaacagaagaaccaaccaagaacaacaacagggaggcatggcggagtgggagggcagagaaggaaggtggggcggagaggaaagggaaagggaagagtaggagatggagaggctacggaggagggtggggccgatgcaggaggagggcggcggcagcaacagaagaagaagaagcagaggaggaggcgtaa

SEQ ID NO: 5744 - DNA, 435 bp, Glycine max
  Peptide Sequence Number=SeqID_97429
atgctggtggttgtgtttcgagttcacactatattcgtcttctccactgccgtcgtttcggtttctcaaaagcatttcgcacgcgagggatatgagtcattcaaggtttatgacagcgacaagcacgttagtgaactcaatgccgagcaagaggaagaatttctcgtgcttgtggtgctgttggggatctatgacgcgtgcttggcaatgctgaacctgcgatgtctcgcgattgtgttcgatttggacgagacgctcatcgtggcgaacacgatgaagtcatttgaggataggattgaggccttgaaggggtggctttttcgtgggtcccactcgtccccaaccccttcttccccagcttcaactacgttggcctttcgggtctcggggttggaggcacgcagcttaacatatcagaagatctttatcgtgtga

SEQ ID NO: 5745 - DNA, 279 bp, Glycine max
  Peptide Sequence Number=SeqID_97430
atgacaaaagcatgtcaaaagggggtacggaaaaaaaatgagggaggagcttgccacccagctcgcccaggcgagctaggttgtttcctccaaaaggtggtgccttctggagaacttcctagaaggcccaagtgggccagaattgtgcaacaatgcttccttttgacttccggcatattacggaacttcacggattgcctaacgatgggtgccaagtacctcgaagtggtcaaacaagggtcgcatcccaataaacggatggtccccggacgaaattag

SEQ ID NO: 5746 - DNA, 147 bp, Glycine max
  Peptide Sequence Number=SeqID_97431
atgacgaacaaggccaaaggaaaaggcaaggaggtcgccggaaaaggttctgccgacaaacgcaagggcgccttcgacgatgacaagaccggtggtgtccaaaagagaaacaagcgaggggtacttagacaagtttacatggcctga

SEQ ID NO: 5747 - DNA, 840 bp, Glycine max
  Peptide Sequence Number=SeqID_97432
atggctgatacccaaccgcgaccaaacgacgccgttccttcgaaggagcgcctcggcacacgatgctgtcactgcctctgccaaacattctggatccttttggttctcataatcaccatcgtcatgcttgcgattcttgtcctgtacatcatcatcacaccacgctccttcaggttcaccctgattgacgcgaacctcacacaatttgattacaccgccaacaacagcactctctactacgacctcgttctcaacatcaccgcgcacaaccccaacaagaggctcaagatctactacgacgtcgttcgggcccacgcgctttaccggcgcgtggagttctccgccgccgacgtcaacatgccctggaacggctaccttcaggacaagaagggcacgaacttcttcggcgctgttttctcgggacaacgtgtgatggggctgaatagagaccaaatcgcggaagataaaaaagatgggatgttccctattgaccttaagattcattttactatgaggttcaggcttgatgattttcagttaggtcactactatcccagaggcacgtgtgagctcaaggtacctttgacttctaataatggaaataaggtggcttcttttcaccctgccatgaagccgcagtggggaacctttgatgctgctagtgacgtcaaggaggcggtgaaagcccttggggatgaaggcgtcgacgtagacagagagctcgctctgggcggcgaagaacacgacgtcagcggggaacaatcgagggagcgcgatgagaaggaggcaaaggagggcggagagttgggagagcaaggcggagacggagaggcattctag

SEQ ID NO: 5748 - DNA, 150 bp, Glycine max
  Peptide Sequence Number=SeqID_97433
atggagatgacactagtgagggccaacattgaagaggaaactgaggacacaatggctcattttttgagtggcctaaatcctgacattagagatgttgttgaattacgggagtatatgaaattggatgacttgttgcataaggcagttcgg

SEQ ID NO: 5749 - DNA, 372 bp, Glycine max
  Peptide Sequence Number=SeqID_97434
atgaacaacatgatcacactgcaaaacaccgaaattaaggcatcttttgagacaagtacacatgtggttgaacaagtttttaaagttaccttatacaagaaactacttggcatggtatcaagatatgctttaaaccagattgctgctgagtttgagcgtgtaacttatgttggtattgacagttctcgttgtggatgtgtaatgagaactactcaagggttatctgagcccgaagtcagcataatcgaagagatggaaatcatttccaatcagtttgaagagcttgatgcttatggaaaagttactctaaagagtaaaattcaggaaattgcctatcctgatctaaactctatgtgtgttcctccagaaaag

SEQ ID NO: 5750 - DNA, 642 bp, Glycine max
  Peptide Sequence Number=SeqID_97435
atggttacaaccagaggtttgggtcgggctttaggcagggttataggaagagccttagggagagaagttagtggtgatgcagatgaagcccctcagcggcgaaggcccacaacatctgcacataggcaatgggaagctgcacctattgatgaggatgttgagcgtttggattatgcagttgacgagatccaagaacagcctgaaggggcaactactgatgatgcagttactcatgccgaaggttttctaggtaggccccatgatacatcattttttatggactatgttcatcatgtggcagtgacagtttggaatgaagaggaacattctgagttgaagttgtcctcccatggaaggaaagtagagaaatttggtaggcctgctccaaagattgaagacttagttgctaccataggattaagtcctctgattgcatgttccttggacactaatgatcggagacttatatctgcttttgcggagagcatagtgaactatagaagctcaagtatatcttttgcatttgctgaagattatcatgagaggaaatcacgtacttgtcattggaagtctgggaaggcattactaatgtcgatgtatcgtaagcgtttggataaattgacgtatgattccttatggtga

SEQ ID NO: 5751 - DNA, 390 bp, Glycine max
  Peptide Sequence Number=SeqID_97436
atgtatggacacacatgtcataaaatagctcaaagtggtcaatttcaagaaggagtgaccaaccttcataaccatggcaagcgcccagcatgtcttcaaaatccacctcaccatgaaaacgttctgcatcgcggtttcactgaccaccagactctcggactggggcatcggacctcagatcgagaacagcggcagttcgaccatggcagattaaatggtggagttgtaaatgtgatgttgaatttgttgacgataatagataatgaaaaggaggatgctgactggtgtggggatgatgagactaatgaaaaggaggatgctgactggtgtgggatgatgagacggagggagtcatggttttccctaggcattgtaacggtgacggtgtga

SEQ ID NO: 5752 - DNA, 588 bp, Glycine max
  Peptide Sequence Number=SeqID_97437
atggcgtttcagttcaatcgttcacattttccactccctttttcgccactcagaaacaaagatgaaagagagaagaaagtgaaacgcagtatagtcttgccattttttaaaagaacgctaaacgacgaagcaaaacgcattcgtaacagtagaaaaatcatcgatgatatggccctgaatggcggacactggcaaatggtcgtcattctgcgtaaggaaaacctagttgtctggttttgttctttacataacaggccagacaactaccttaagggaataattaacagcaacatcaatagtttaatgttcctcatattcaacactagtgctttgaaaggacttgatgatactccacaaccgaaatctaagactgctgctaggtggattgttgttaagtgtaatagacaaaaaagaatcactgaatgtggctactatgtgatgcactggatgtccacgataatcttaggatctttcaggaataattgggagacgtattttaatgaagttagaccattggaagtagagagattcaaggcacttcgcatacagtgggcacagtattatctaaaagttagaaatcaaacatag

SEQ ID NO: 5753 - DNA, 902 bp, Glycine max
  Peptide Sequence Number=SeqID_97438
atggctcgcaccaagaaaactggtcaaatgacgtctgaggcaacaaaggaaattgattcctcgaaggcgcaggcctcacagggttcctttgtcgcccgtggacgtcgagatgtactgactgctgccattgggcgaccagaacaccctggtcatgtgcgtgctgctggagccagtggacttgcactgtcttctaagcctaaggttagtccttcagctactcgcgtcagcacaaaagagagttgtgttgatccctcggggaacgacccaggcatgggtgactcagagaaatgtgggttgtacgtcgaagaaaatcctccatgcctagttgccctaggaagactttatgaggggtcgacaaccattcacaacatccctttgggcaatgatcaattcaaggttggtgttgaggaagttagagatgcagatgctcacattcctgtacccactcaagaggatgctaccatgtttggggtgtttaatgacaacttcttcttgtacataaaacctaaagatctgtctgaaatagtacacggtggtcaatgtctcagcatctctgttatacaattatggattctgcatatgactgagacaagtatgcgagcggggaatgccgatgtgtatggattccttgagccacagcccatacagagatctaggcaattgcaatttaaatcagaaagttatattaagaactggatgcagaattcaaagagggatgtgtacctaggagcatacttgaatgatgcacattggcaaatgattgtcattttgcttaaggaaaatgttgtcatctggttttgttcgttgcacaataggccagacaactacctgaaaggaattattaatagtgctttgaaaagatttgacgatactccacaaggtaaatctaaggttgttgctag

SEQ ID NO: 5754 - DNA, 144 bp, Glycine max
  Peptide Sequence Number=SeqID_97439
atggacaaggagatgaataagatgaaggctgaagttgccaaaaccaaggagtcggagttggcactggctagagataggaaaaaaagaaaagcggcagataaggagaagaaagtagttgaagacagcacagtggaatcgaggtaa

SEQ ID NO: 5755 - DNA, 966 bp, Glycine max
  Peptide Sequence Number=SeqID_97440
atgtggtgttatgagtggaaaaagagtgaggctttgagagttggaaggttaaatccggattctgtgaaaaatgctatgcatttgcgggttgtggaaagagtagtgcagaatgagttctggatgtttgctagtagatcccaacggattgatggggacccggtgttgagagaaacgaggatatgggctacgtgggagtacgtgagctcagttggaggtgggcaacaggggatggtgggtttatgcgcgatttgtggatgtggaaaacttgttgtgcaccatcgcccgaccgccacctatggtacctggagatatgtcgcgggggtcaggagaccttggggacgtcaggcgagctcctggcagtcaacagataaaaggaacaaagaccacaaagcaaggaggcttgtgtggtggctggccagctgtgaatcttgtgtgatatatgggttatggtctctggtaatcgattaccaagggcttgaaaatgaggtcaggaagctaggggagcttctggtaatcgattaccaagggatcgtgatggcggcgcagataatccatgatcgagtggagatggagtgcctagagagagcttgggagaccctcgaaggcaacacgaggtgccgatttcggggcacgatccgattcacggctacttcattggtgcatccagatgaacccgcgcgtacgcttcagcgcactgtggagtggatactacccacgcctacaccatatcgtctagtggaaccagtccaagtgatcgaggtaacgtcgtccgaggaagaccctgaggaggatcttgaggagctacctcctgagcctgctgtggatgctcttgactttctagagggtgatgaggatcctcttcctgaggtggattctcccgaggaagtcacgtcggcatctgaggcagactctacggaggatagtggcccgggagagatggcgatcagtggaggctcttcatcatag

SEQ ID NO: 5756 - DNA, 282 bp, Glycine max
  Peptide Sequence Number=SeqID_97441
atgttgatgagaatcctgaaactggccaaatataggctaaaggcccaagtggagaaggacgaaggcccaagtggagaaggacaaagcccccgagtggagaatgatgaaggcccaagttccttgttgaaccaatatcagacttatcaaggtaatccttgtggcatctaccctgacttatcttcctttactggaagtggcatcatccaaatctccgtagcctgtatcaagcgatccgctcctagtcaggatcacatcatctggtatcagagcttcggctcttga

SEQ ID NO: 5757 - DNA, 342 bp, Glycine max
  Peptide Sequence Number=SeqID_97442
atgacccgacatcgattccagacgccaacggtggcggtgcgggcactgagggtggactcagtggcaatgcgaaggccattgggaagcatgttcatagggtgggctgaagtgacccgtgcttcaggaaccgaggatcggggttctcgagctgccgaagcttggacttcacagcctcggcggtggggggaagaggggcgggaggcggagggagccacaatggcggcggaggtagagatggatcggagggaggagagggtggaggcccatcggtcgaagcggtgggccatagagaagatgcggttgagggacatggcttggccccgcactcgcagttgggtctaa

SEQ ID NO: 5758 - DNA, 1083 bp, Glycine max
  Peptide Sequence Number=SeqID_97443
atgcaatcacagggacttgcactgcctccggagagttgtgtcagcagaaatgagagttgtgttaatccctcaaggaacaatccaaacacgggtgactcaaacaaatgtgggttgtacatcgaagaaaatcctccccgcctggttgtcgtaggaaaagtttatgagggattgacaacgattcacgacattcatttttcgcatgatcaagtgaaggtcggtgttgaggaggttagagatgcagatgctcccattcctatacccactgaagaggttgagttagtggggcaggcacttcacaccttccttgcttggtcgacacatctcatcaagtgtttatcagaacatggagctgtgggaccagcaaaacctgcaaataggccatatcatgaggtcgatgatcccctatatctgatgacattgaccatcccacagctttttttgaagccgttgcaggttatgtgggatgctatcgtgttcggggtgtttaatgaagacttccccttgtacataaagcatgaagatctatctgaaatagcacacggtggtcaatgtctcaacatctctgttatacagttcggggattccgatgtgtatggattcctcgagccacggtccatccagagatctggacactcacaatttgaattagaaagttacatgaagaattggatgcagaattcaaaacgggatgtctacctaggagcctatctgaatgatgcacattggcaaatggtcatccttttgcctaaggaaaatcttgtcgtctggttttgttccttgcataataggctagacaactacttgaaaggaataattaacagtgctttgaaaggacttgacgatactccacaacctaaatccaaggttggtgctaggtggattgttgttaaatgtaatcgacaaaaaggaagcattgagtgtggctactatgtgatgcactggatgtcaactataatcttaggaagtttcaagaataattgggaaatgtattttaatgatgttagaccattggaagcagagagattgaatgcacttcgcatccaatgggcaaagtattatctcaaagttagaaatcaaacttag

SEQ ID NO: 5759 - DNA, 369 bp, Glycine max
  Peptide Sequence Number=SeqID_97444
atgtggcggcgtctggacaatgtcccagatctgattacgaacttaagcttgaatctcagatttcatggcctcttgccaacaacggtgctttgcggcttcgggaaaagtggtggattcttgctcagaagaaagactcatcaaaaaatgagtattggacagggtatgatatctttggagaagattggtttgattgcgttgagccatggatgggaacgcgagggcacgcgttgcactcgtagtcagcaagttaagtgggacggtggtgagggcgagttgagtggtgggtgggctggggttctggtggtgacgttgataaatgagaggaggatggcatggattttgaactgttgcatggaggtggaggtatag

SEQ ID NO: 5760 - DNA, 267 bp, Glycine max
  Peptide Sequence Number=SeqID_97445
atgaacttaatcattgttatcaaaaagaaagaacacgctttacggcgcccttaccgaacccgtgctagagctagagtaatgggtgaagtagaggaggtgcaagagcatatgaaggccgacacagaagccttgaaagagcaaatggccacaatgatggaggccatgatgagcataaaggagataatggaggtcaatgcggctgcaatagccgctaccagcaccattactgaagtggacttgaccccccatatggcctcaattaaataa

SEQ ID NO: 5761 - DNA, 1500 bp, Glycine max
  Peptide Sequence Number=SeqID_97446
atgcttgttttgacttccagaatgctgcgaaactttatggattatgcaacaatgcttgttttgacttttggaatgttgcgaaactttatggattacgcaacaatgcttgttttgagggtcctgaagggaataaacaagggaagtaaagataagacactaatttcgtttgagctgaacctcactcgaccatcatcatccagttatcatcgaacttgttcgcctctggctgacaaaggtgtcgttaaccacgaagtatctccacatgctaccagacccttgagtctgacgatagaaacgagacttcttcgcggtctcgaccggatgacgccgacatctccgggaaaggtgcagatgaccacgttggtctctacgtgctatcggacccttgagtctgacggtagaaatgagactttttcgtggtctcggtcggaagatgctgacatctccgagaaagaagacgctgacatctccgggaaaggtgcagatgacaacacccttgagtttgatggtagaaacgagacttttcatagtctcggcccgaagacgctgacatctctgggaaagtcgaaatacactgacatctccgggaaaggtgcagatgacaatacactaacatctccgggaaaggtgcaaatgacgacgttagtttctgcgtgctatcggacccttaagtctaatggtagaaatgagacattttcgcagtctcggccggaggacgctgatatctctgagaaaggtgcagatgacaacacgctgacatctccaggaaaggtgcagatgacgacgttagtctctgcgagctaccagacccttgagtctgacagtagaaaggatactttttcgcggtcacggccgaaagacggtgacatctctggaaaagacactgacatctccgggaaaggtgcagatgacgacatgatgacgttagtctcagcgtgctaccgggcccttgagtttgacggtagaaatgagactttttcgcggtctcggccggaagacgctgacatcttcgggaaaggtgcagatgatgacatggcgacgttagtatctgcatgctaccggacccttgagtctgacggtagaaacgagactttttcgcggtctcgaccggaagacgcttatatctccgggaagggtgcaggtgcgaataaccataaggtgtctccgcgtgccatcggactctcgggtcacaggatagcaaaaagtcacgatagcaaaaagtgtgcacggataaccatttggtgtctctgcgtgccatcggactcacaggtcacgatagaagaattgagacatttttgcggtctcggccggaagacgctgacatctccgagaagggtgcagatgaccacattggtctttgagtgtcaacgggctcgcttgcctctagctgacaaaagactcacaggtcacgatagcaaaaagtgtgcacggataaccatcgggtgtgtctacgtgccaccggactcacaggtcacgatatcaaaaagtgtgcatggataa

SEQ ID NO: 5762 - DNA, 168 bp, Glycine max
  Peptide Sequence Number=SeqID_97447
atggaggatttcattgtgcataccagtttttaccgtcactcagtcacttttcctaaaatcaaggcttacagaaaaatgattgttggtcaggatcttgttgaatggcaaatccttgttgccattggagaagatcttccgttgagtcaatcacatacctttatcaggtga

SEQ ID NO: 5763 - DNA, 387 bp, Glycine max
  Peptide Sequence Number=SeqID_97448
atgcatccttattttcctaattcagaagatccaaggtttccaacagctttgggtgtaggacacaatgatcagaaagttcttgttctagcaactacaaatacaccttatgctctagaccaggtgcacctaggagatactccccataacttggctgaaagtgattttgaacatttgactcgcaagacagaggggttttcaggtttagatatatctgtctgtgtgaaggatgttttatttgaacctgttcgcaaaacccaagatgccatgtttttctttaggaatcctgatgatatgtggatcccatgtggaccaaagcaacagagtgcaatcctgccacctcctagtttaaacatgggattcacaaaggagttcggagaggaaggataa

SEQ ID NO: 5764 - DNA, 294 bp, Glycine max
  Peptide Sequence Number=SeqID_97449
atgacgcgtggtggtaacccggggtcattgaatcacaacatcggttttatgaccgtctttgaagggcagcttttctacatcggttgtgcagctacaaccgatgtagaatgggtaggtttctacagcagttctaaggctgaaaccgatgttgaatggaatgggcacgaatggaaaggtttatacatcggtcttcaatcaaccgatgtagaatttgaagggtttttacatcgtttatcgcctaaccgatgtagaatgaggatattttctacatcgtttataattgaaccgatgtag

SEQ ID NO: 5765 - DNA, 651 bp, Glycine max
  Peptide Sequence Number=SeqID_97450
atggcggaaaccgctatcgggaagttgttgtactttttacggatcacaggattaggtcgtgccttaggtcagcgagtcgctgtgactgtggcgcacgatgagctagtgatccctacgccaaatgttcaggatgacccgatggaggcaccagctgctgtagaggacattgtggcagacattcctgtggacacaggcgcggaggctgctgaggatgagcatgagggatttccgggtggtccgagcgacccatctgtgttgacccagtatgcggatcacgttgcttgcagcgtatggacgggaaaggagcgtcctgaattgaagctatcctctcatgggaggaaggtccacagtttaggcaggtctgtccctgccattgagggacttgttgccggtacaggactaagtcctctgatcgcgtgttcgatagacaccggcgatcggggaattttgttcgcatttgtcgagcggtggcaccgggagacgtctagtttccatctcccaatgggagagctcaccatcacgctggacgacgtctcctcgcttctctatcttctcgtgattggcgacttatacgcttttgagcccttgcacatggatgatgcggttcagatgctggtggacttattgatggtctctacagagtctgctagg

SEQ ID NO: 5766 - DNA, 248 bp, Glycine max
  Peptide Sequence Number=SeqID_97451
ctaataacaatgttctagttcaaacacccacatcactacatgaaagtgctgagaacatttcgggttttacaaagggacatcatttggaaattccgaccatgccaataggaagcgtaaaacatgcaatgacggtttccaaactcagaaatgatgcaaagggttcctctcggtgtggggttttaacggagaacaacggcgctttgtggtggctaatggtggctgtggatgatggagaaaaagcttgtcac

SEQ ID NO: 5767 - DNA, 219 bp, Glycine max
  Peptide Sequence Number=SeqID_97452
atgagagaagccattaaatgtgtcagtcaggctcttccagaggcacaaacagttaggcgcctacatgtgactgtgaacataaaagcgattttgagaactgctagaacaagagacaaccttataggaggaggttctcgggttgcaaacattccaagggattattatagttctgatattgttgttttcgaatttgcccatttgtacagggtagactattaa

SEQ ID NO: 5768 - DNA, 165 bp, Glycine max
  Peptide Sequence Number=SeqID_97453
atgactggtcaccttatgatgttacttagtgagagtgaccgagtgtacccattgtgtggtgtgctttgtcatgtactcctaagcgccccagtgttgtttttcactgacatgatgaggcttcatatgatgagtcacatgctagagatggagagacttagtctgtga

SEQ ID NO: 5769 - DNA, 275 bp, Glycine max
  Peptide Sequence Number=SeqID_97454
atgaagtgtccattgtcaccattagcgatcagtgacgacgtaaagaacaggaagatgaaaaagaaggcaaaggcagtggaaaacaatgatgacatggagcgcgtggaggggctggtgtgtttccacaacaaccttctgtttgaggtgttgaagcacgtggacgcacggatgcttgcaatgtcagggggacttgctaatggagttggcgagttgggcacgtggcgacacctggtggactcgccagtggagttggcgagttgttgtccacatgacgg

SEQ ID NO: 5770 - DNA, 90 bp, Glycine max
  Peptide Sequence Number=SeqID_97455
atggctactgaagaacccataatgttagcgacttcagtgatgacgagcaacaacatgattttgatgaacatggtgaaccaagcaatcaaa

SEQ ID NO: 5771 - DNA, 939 bp, Glycine max
  Peptide Sequence Number=SeqID_97456
atgaatttgattcctaaagttaatttcttttcgacaatcaaaaagtttccagcttgttgggtgttgccatggccgatgctcttgttgatttcggcagccatgcttcgcaaccttgctgacaagctctatgagaagcataaaaatgctgctcttgataatttacttattgaccacaagccaaccatcggaagtcagattaaaactcgagaaattgttgctctgaagaaaatacgaatggacaatgagagagaaagggtgaagctgtgtagagcaccagctgaggtgaactggcctggtgtttctaagactccttggtataatcaatttaagccaacaagaccaatgaaaagacgtctccgggaagttttcagacatgtgaagtctatcaatgagacactcattctgcaaagtccaggatctgatgcagatattatcatcctcaacccaaattcaggctttgagataactgcaaagtcccaccactccaaactggacacaaatgtctatgagggaaggagaggaaagcagagtagtatcaatgtctcaaagaattttatgcgagaggatccccttcttgatgctaatcctagtgagaaattttatggaggagataaccaatatagaatgagtggacaggctttggagttcaagcaacttaacactcatgcttgggaagcatttgagaaaggccaggatatccacatgcaagctgcaccttcccaagctgaattgttgtataagaattttaagataataaaagagaagctgaagtcacaaacaaaaaatgccatagtggagaagtatggaaatgctgcatcccaagaagagcttccaaaggagcttcttttgggacaaacagagagacaagtagaatatgatagggctggcagaattatagaaggcctggtaaatgatctggagtgcaccaatgcaagataa

SEQ ID NO: 5772 - DNA, 816 bp, Glycine max
  Peptide Sequence Number=SeqID_97457
atgatccgcggaagaacgtccgtaggatcttccgtgagaataaaatgtagcctgcggaagaagcttcagcaggatcttccgcgggtccgcggaagacaaggtttttccgctggatcacgcggaagatcttgcagaaccttcttccgttggatcacgcggaagatccttcagaagcttctttcgcaggaatccgcggaagaaccttccacacttcttccgcgggagttccagaagccactttcctacgcgtggaagaaggttcaacctccagccattaatgtcgtctatcctaaggttcctacagccatttacaccattcacgccattgaaacagacacgaacaacagcttcttctccaaatttcaaattcagaacgaaatgagggcgaggaggaagaagctcaatgagggcgaggaggaagaacaagcacgaatggagattgctgggtgcacgaggaagaaacaagtgcagaagcaagcaattttgctgggtgcccctagcaacagccccaaaactatatgcatgctgttgaaagtttactgtatattgaaagttttgcatgaagacaagtatagggcgctttgggttttcttttacgtttcaagctctgtttctttcattgtggtccactttctgtcgttcgtggtggtttttgcaagtgttgtaagaggtagcggttcagtgaagatggacaaagatcaatggacgtatgacaatacgatgcctcaagaagttgatatggattatgaaaatgaacaagaatgtggtgtgaatcaaccacatgttgattgttcagatgtttataatactttggag

SEQ ID NO: 5773 - DNA, 405 bp, Glycine max
  Peptide Sequence Number=SeqID_97458
atgccatcacagggacttgtattgcctcctgagcttaaggttggtccttctgctacccgtgtcagcacaaagggaagttgtgttgatccctcagggcaggacctaagcacacgtgaatcagacaaatgtgggttgtatgttgatgacaatcctttccgcctggttgcccttggaagagtttatgaagggtcgacaaacatccacaacatccctttgggcaatgatcaagtgaaggtcaatgttgaggaaggattcaacgatattcaaggaagtaaatccaagactactgctaaatggattgtagttgaatgtaataaacaaagaggaagcactgagtgcggttattatgtgatgcattggatgtcaatgatagtcttaggaggtttcaaggataactgggaaatg

SEQ ID NO: 5774 - DNA, 369 bp, Glycine max
  Peptide Sequence Number=SeqID_97459
ccttatttaccaacaacgacgggtgctccagccaccgtcgttgaaacctcaaacaacaatgacggtgtacacaccaccgacgttgacatactaccaaacaacgtcggtggtgagcccgccaccgatgttgacaggaaacaaaacaacgacgggtcttgcgaacccgacgttgaaatggaccgaaacaacgacggtggtgagcccgccaccgatgttgacaggaaacaaaacaacgacgggtcttgcgaacccgacgttgaaatggaccaaaacattctcggttctttcccggccaacttgcctcttcttgatggcaagaactttgagaaattagtgacaaggtcatctctggtttccaagaggtgctga

SEQ ID NO: 5775 - DNA, 387 bp, Glycine max
  Peptide Sequence Number=SeqID_97460
atgaatctttgggatctaaatgcagctcaactattgactttattgttgccttctcaaccgccacctcctcctccctccttaaccgcaccctctccacctccttcctctacctcaaattccaaatcaaccccttcgatgacatcgtcgtcatctcatcgcgctgcccactcaactacgcctgtaactacctcacccacctccttccctcctgcatcctcaaaatcgtttacctggactccgacctcgttctcattgacgacatcgccaaactcgccgccaccccccagagacaacaacaacaccaccctcatcgctcccgaatactacaacgccaacttcagcgcctacttcaccccctcattttgctatgcacgtggagggagatga

SEQ ID NO: 5776 - DNA, 1263 bp, Glycine max
  Peptide Sequence Number=SeqID_97461
atggacgagatcgacgtgcctcctttcttcgtatgccctatctcattagagctcatgaaggaccccgtgaccgtctccaccggcatcacctacgaccgccacagcatcgagaagtggctcttcgccgccgtgccgaagaacaacacgtgtcccgtcacgaagcagcccctcctcccggacctcactccgaaccacacgctccgcaggctcatccaagcctggtgcaccgtcaacgcttctcacggcgtccagagaatccccacgccaaaacctcccgtcgacaaaaccctcatcgagaagctcctccgcgacgcctcggcttccgattccccgagcctccagctccggtccctccgaaccctcaagtccatcgcttcggaatcccaatcaaacaaacgctgcatcgaatccgccaaagacgcagttagtttcttagcatcatttataaccaccactgtcaccgtcaccactaccaccgtactcctcgatgacgtcgagttggaaataaaaacaagtatagcccacgaagcattgagccttttacacagcattcagctgtcagaatccggtttaaaggctctgatgaaccatccagagtttataaactctctaaccaaaatcatgcagagtggaatctacgagtcacgcgcctacgcggttttcttgctgaattccttatccgaagtggcggatccggcgctgttggttaacctaaaaattgatttgttcactgaactggttcaagttcttaaggatcaggtttcggagaaggcctcgaaggcgacgctgagagcattgatccaggtgtgtccgtgggggaggaatagggtgaaggcggtggaggccggagcagtgccggttctggtggagcttcttctcgaatgcaaggagagaaaaccaattgaaatgatgcttgttttgttggagattttatgtcagagtgctgatggaagggctggtttgttggcccacgcggcgggggtggcgatagtggcgaagaagattctgagggtgtccacgatggccaacgatagggcggcgaagattctgctttcggtgtgcagattctctgccacccacggcgtggtgcaggagatgctgcagcttggggtggtggcgaagatgtgtttggtgctgcaagtggatagtgggaacaaagcgaaagagaaggctagggagattctgaaattgcatgctagggcttggaggaactcgccttgcatacctcacaatttgcttgcttcgtttccaatgagttcctga

SEQ ID NO: 5777 - DNA, 2352 bp, Glycine max
  Peptide Sequence Number=SeqID_97462
atgaagctagaagatgttgttttacatcaaaatgaagttctagttttttcaaagacacatcagttgcttgaaaacagtgttgagaagattgatgatcatctttatgttggtggacttggtgacaaatttctttgggaatgtccagaaacattaccggatagattaacacagacaaatcttgctgccaagaggaagcttccatcaatggatggtcctgtaaggcgagctagaggagaaagttttcaggctgatatgtcttctcaaaatgttttttcacggggtgtagcacagtctgctgtttcttctggtcctacacgtagggatgccttccggcagcgcaagccaaataccagcagaccaccttctatgcatgtggatgattatgttgcaagagagagaaatgttgaaggggttactaatgtaatatcagtgccacgagcaggatctactggtgggagacctccatccattcatgtagatgaatttatggcaagacagagggaacggcagaacccttcagcaacagttgtgggagaggctgttggacacctaaaaaatgcttctcctgtgaaacccacagatacggagaagttaaacaaatctaagcaattgaaaacagatcttgatgatgatcttcaaggaattgatatagtttttgatggagaggggtctgaccctgatgacaagttgccattccctcagctggatgataacttacaacagcctgccccagctattgttgaacaaagttctcctcactcaattgttgaagaaacagaaagtgacgttgttgatagtagtcaattttctcaaatgggtactccattaggatctaacatcgatgaaaatgctcaaagtgaattttcttcaaagatgtctggttcacgtcctgatatgtcattaactcgtgaatcaagtgtttcttcagacaggaagtctgctgagcatcttgatgactcgaaaaatgttcaagctaggccctctggcagatatgattctgtagcatcaaatacttcatttccaatgtctctttacaataatccatccgcatctatgcaatcaccagctgattcaaggatggtttcccaaaattacttgttaaagaccagtcctcaacatggtggtattgcttctggttctcaaggactgtatgaccaaaggtttatgcccaaccaacctcctttaccacccatgccacctccacctacagtcttgcctgtaatatcgcatgcttcagattcagttcctggtcattcatctccatatgttaattctccagcaggcacacagcgtcctgtggcattccaagttcagttagactattcatcaccattcaacaatggttcaactgctgcatcttctgttcctgtgccagattcaaaatactccaggacttctgtgtcttcccctggtggacctaatagaattgctcctcccctacctcctacaccacctccttttgcatctagtcagtataatttacccattgttaaggcttcagcctcccaaccttctatgtataatcagacaagtattggggccactgaactttcccaggcctccattgcatcttcaggagccagattgtcatcctacccaaatccctcaatgatgtctgtgggctttagtaggccagcttccatgccattgactatgtttggcaactccctaaatcagcaacagactgagaaccagcccagcatgttacaaagtgtctctgttcctccatcttcctttcagtcgatgcattcagtttctcagttgcagccaccccagcttccacgcccaccaaaaccacctcagctccttaggccgactgttcaagctttacagcagttggagcaagggatgggtttgcaaagcaatgttcaagtgcatcaattacagatgctgcagcagtctcaggttccttcaatgcagactaattaccaaacccagcagcagcaagttgaatatactcaacagccagggaattgtcaatcacagcagcaacaagatgcagcaatgtcattacacgagtatttcaagtctccagaggccattcagtctttattgagtgatcgggacaaactttgccaacttttggagcagcatccgaaattaatgcagatgcttcaggttgttcttcttgggatttatttcacagatcttttgaaagattgggccaactgtagccgcataatgatgaccaaaatattgatggccaatattatggttggagagtggcttctgatgagaagcttgagtggggatgtttacattgaagtcactgggggcagtggtcccactgttaattactggtatagctcctggacgggtctgggttggttaaaattggaactcagtgaataa

SEQ ID NO: 5778 - DNA, 2340 bp, Glycine max
  Peptide Sequence Number=SeqID_97463
atgggtcgacctgagccatgcgtcctcttcgcccaaaacttcgttcatactcatctcgacgagtacgtcgacgaggtgatgttttcggagcccattgttattactgcgtgtgagtttctggaacagactgcgtcatcagctgctcaagcagtgacacttgttggggcaacttcacctccatcatttgcgatagaggtgtttgttcattgtgagggagagacaaggtttagaagactttgtcagccttttctctattcacactcttcgtcaaatgtactagaagtagaggctgttgttactagtcatctagttgtaaggggcagctatcgcagtctgagtttggttatatatggcaacacagctgaggatctgggtcagtttaacattgatattgatgacaatgcattgactgatcttgttgattctactgaggggaagcttgaagaccttccacctgcattacgctcaactaattttacaattgatgattcacgttcatctctgagggtgttgtctattccagttcctgcaacagatatttctgttgaagtcaatctttttctacagttgatgttaaaaattttggagttttcagagcttggggatgctgggcataaaattgtagatcctgtagtgtctgcaatcacttcttacatttccagtgacatatgtgaatcaatcggtgggagatatcagatgcagaagagatctgagaatttggaagagttgcacagtgttgttaatgagggaagaaaagagcttctagaggtttataaggttcttcacaaaaaatttaggagtggatcttctgagtgttcaccagatgccaattatcttgaaatggatgctgaaatgttggattccaaaactttggtggatatgtttaaccagtactttcattttcaacggcactcttcttgtataggagatcactgcctttctcagagtgagcatgccctattaatattgagcatggcttatttgctttgttctggtagagagagtggctttcagtttgttagtagtgggggaatggagcagcttgcagtgtttttttccaaggattggcaaaattctactactattatgctactgcttcttggtgttgtagagcgggctactaggtattcagttggatgtgaagcctttttaggttggtggccccgggaagatgaaaatataccctctagtatcagtgaaggttatagtcatttgttgaagttgatattgtcaaaacctcgtcatgatgttgcttctcttgcaacctatttgcttcaccgcttacgattttatgaaattgcttcaagatatgagtctgcagttctttctgtgctgggaaacatcggtactgttggcagggttacagatgttacactgaatatgctcagttctgctgaaattctgctcagaaagctcctgaaattgataaattcacgtggtccaattgaagatccttctcccatagcttgtgcaagcagatcacttattactggtcaaacagatggattgttgtcatataaaacaacttccagcttgattagctcttcaagttgttgcttttcagattgtgatattgattcccatttattgggacttttgaaggagaggggttttctttcattatcaactgcattgttgtcatcatctatactgcgtgtggagagtggccatgatcctgaactttctagtacattaatccgtgctcttaggggcggtcaccgaggcaacaaggaagattgtattcctcttcgatatgcttccatttttatttcaaagggtttcttttgtagtccacccgagattggaatgataattgagatacatttaaaaatggttaatgccgttgatagtttgctttctttgaatccgcagtcggaagagttcttatgggttgtctgggaactctctatgctctcacgatcggattgtgggcgccaggcattattggctttagggaattttcctgagcttaatctagcaggtgtcatccgccgtcgcccgccgccgtcgccgccgccgtccgccgcaaccgccgccgtctgccgccgccgccgtcactttccggcggctatttctccggcgaagccagggttaggctcgccttgggaagcgcgagccagtcggccaactcgcgtcagcaacggagcagccacgcgccgccaccgtcccgcgcgtcctccggcgcgtgcagtccacgcgccgccgtcccggcgccggaatcgcgccgcgcctccgccgttctcttggtcggcttctcctgagtccgttccagccctcagtttccagtttcgtcacctggaacgctacagtcctattctctccacctttttgctcccttag

SEQ ID NO: 5779 - DNA, 1878 bp, Glycine max
  Peptide Sequence Number=SeqID_97464
atgagagagagagagagagagaatgagagacagagagaacgagtcaaagagtgcgagagaaacactgagagagacacaatcagggatcgagagtggataactgtgaggaaccgaaagagagagagacagcgtggatggcagcacccgacggagggcctcagacaacactacggcggacagcggcaacgaaggactggacaacaacgcaaccactatcaagtaaactggcatgacagacctgacgtcatgacattttacttcactagatttccggaggacacatcggagaaggagctgtggtaccatttcaagcagatgggggacgtgagggaaattttcatccctaaacaccgaaacaaagaaggaaggaggtatgggttcgtgagatacaaaggagtctcaaacgcgagctacatggaaagaaaattagataacatgatcgttgggggcttcaaattgcacttgaacatcccaaagtatgggagaggaaaggaggaaaaagaactaaccgcagccaaacaaagggggcataaggagggtgataatccgaggtgcaacgtggcagtagagcaaaacacgaagagatcgtatgcggaggttgtcatttcacacgcagagaacaaggaaagaagaagcggtacctcctccttgacgacgacacatgggagaacccattcttccatcacacttgagatttcggaggagacgaagaaaagatatgcagatacctgggtaggaagactgaagagacaacaggtgttcgaacgagttgaggacgaactctctactgatcaactgcgcaaaatagtggctgaagtgggcgatttggtcaaagtcgacgacaatttcgaagacatgcaaaggcttgatagagctcgggttctggtcagaaccccatggacgccgacagtagagcacatagtcatagcccatatagatggcgacgcccacaaaatttcaatcgtagaggagaattgcaatgcggggatagtatgcgcaaggcaccatcagagtgtttgggggtcatcggaggaaatcctttccgacagtgatgacaccggcaccttgcaatcgtggccgatcgataattcaccgccttctaccaccttcgtaatgcacggtgacaacacattctggcaaagcttggtaaaatccaatggtcaaaccggtacctgtagcccattgggtattactcgtagtagaaagaaacgtggtctgtgtaaagctattagccactcaggagctgaaaaaggaaaggagataaaccttgaagaatgcaacccaactttactagtagtagagtacgaggaattggaaagtcaacttgcaggggcagaaggacagtttacgcaaaaaggggaagatatcccacaacgttttctggccaacacaggggagaaccaaaaaggggagccagatgccttggaccaaggacttgtgggggagaattttcaaaaacatagtaacgggcctctagaggagtttttaaataagtcacgtgacatcactgtatactcccgaaaaaaggggtgttcaaagaaatgggctcaggatagggggaaacagatcaatccaaagacactggactttgcagaaaaacccagtaaccacaagcacaatgctgcctcatgtggttcggacgaagttttggagtctccaaaacagcataacttccatcaaagcccttccccttcaagtatcctcaatataaatgacatggaggttaaggatgatgcttataggaacttagccaaggaattgggagtttctttcgcagatgataaaagcaatggtgcaaagttgatgactgatatggacaacactgaaaatcctccaaaatcagcagctgtgttgggaaatgaagacaatgcctcatga

SEQ ID NO: 5780 - DNA, 801 bp, Glycine max
  Peptide Sequence Number=SeqID_97465
atggcgaaagagattttagagtcagaagtttatagggagctggacaacattcaaaaccagtctttagtgtaccctgattattatttgaatccattccatgcttatgatgagggcaatcttacatggctggcagcagcagaagcagaggctgctacaatgtcaatagctagacgagcagttccagatgcttcttcaacacaggaagcaattaagatactgcgcggcaattggcttcgtgcaattgaacaacaccatatacagtattcggaatcatttgtgatcaatgacattctagatattggatgctctattggtataagcacaagatatcttgcggacaagtaccccacagccaaagtcaccgggctagatctgtcaccatattttctagctgtggctcagcataaggaaaagagtgcaccacctagaaaatttcctataagatggatacatgcaaatggggaagacacaggcctgccttctaaatcattcaacctggtttctattgcttttgtgtttcatgaatgtcctactagagttatagtgaatatagtgagggaagcattccgtctccttcggcctggaggcacactagctttgatagattcttcgatgaagtcaaaggtcgttcaggaattatctcctgtcctgtttacattgtataagtgcactgaacccttcattgatgagttttacttgactgatatggatgaaacactgagggaagctggttttgtgaacataacatcaattcttacgagtcccagacacgctacaattacagcaacagcgcctcaatga

SEQ ID NO: 5781 - DNA, 1467 bp, Glycine max
  Peptide Sequence Number=SeqID_97466
atgtcttccactgcttcttctactgcttcaatctgcgccacttccagaactactttctcatcgaagcacgtcgcgagaagctgcttcgtcgccgttcccaatcgcgcgttctcgaagctcaatttcagattcaaacccgtcgctatggctacgctcggcgctcgcatggtggccgctgcaccctctgttactcctccggcctcgcttgacttcgaaagctccgttttcaagaaggagaagattaacctctctggacacgacgagggacctgctcaggcgcagaatttgcgggactcgcttgctgatgcaaagtctgatattgtggttaagattgggctcaggaaaggttctcttttgattaatgaggctcgtgcagctggttttagtgaggagaatggaactctgggtgacatatgggttagtgaggagaatggaactctgggtgacatatgggaaactatctcaggcagtgatcttgtgttgctgttgatttctgatgctgcacagtcaatgggacttgattttcccaagcacttcagtgtaattgctgtatgcccgaaaggtatgggtccttcggtcaggaggctatatgtccaaggcaaagagataaatggtgctggaattaattcgagttttgcagtccaccaggatgtggatggcgggctactgatgttgctttggcatggcattttacttggtgctgttcatggtattgtggaatccttgtttaggaggtacactgaacatggaatgagtgaagatttggcttataacaacaccgttgagtccatcacaggaactatatctaaaatcatctcgactaagggcatgctggctgtatacaatgctttatctgaagatgaaaaaagggaatttgagaaggcatatagtgcttcatattatccctgcatggacattatgtatgagtgctatgaggatattgctgccggcagtgagattcgcagtgttgtcttggctgggcgttgcttttatgagaaagagggtctgccagcgtttcccatgggtaagattgatcagacccggatgtggaaggttggtgagcatgtccgatctacaaggccagcaggtgatctaggcccattatacccatttactgctggggtctacgtggcattgatgatagcccagattgagatcctgaggaagaaggggcattcttactctgaaatcattaacgagagtgtcattgagtctgttgattctttgaatcctttcatgcatgctcgtggggtttctttcatggtcgataactgttcaaccacagcaaggttgggttcaaggaaatgggctccccggtttgattacatcctaacccagcaggccttggtggctgtggacaatggagcacctatcaaccaggatctaatcagcaacttcctgtcagaccaagtgcatggagccattgaagtttgtgctcaactgagacctacagtagacatttcttga

SEQ ID NO: 5782 - DNA, 198 bp, Glycine max
  Peptide Sequence Number=SeqID_97467
atggtgattgtcgcaacctacccttcggcgggagggcaacgcgagggctcacgggtgcgtcttccaaaaaggaaaatgcgcgaagtcgccaccaacatttattcgaggaaaacgtccgtaaaatctgaaaggcgtggtctacgaactttaagcgtgaaaggtttaggagttgtatttgtgcacggggaaggaaattag

SEQ ID NO: 5783 - DNA, 306 bp, Glycine max
  Peptide Sequence Number=SeqID_97468
atgattatgaggggccaagaaatttatagtagtcaagatgaggctactacttcaccttcctcttatgaaagtgaaaaagaaaaaggggaagaatctagtaaagagatctacccccaagaagaaggacaacctttaatggttaaggaggactgtaaggagagtgatcaaggggttcccatgaaccctaagagaataaaggtgttgaggaaaaaaagcccagagtttcaagaacctcaggatttgaggtcaaatccttttcaagggggagggaatgatgcaatcctataccgcaagggccttggatag

SEQ ID NO: 5784 - DNA, 393 bp, Glycine max
  Peptide Sequence Number=SeqID_97469
atgccaacgtcatcacgtcggctcggcagctcctcaccagaatttcactttttgcaccctgttgctgtcattctgctcccacgaacaatgttcgtgatcatcacaggtgtcaaccacacgatacaaaattgcaagggtgagttcattataaaaagaaccaataccaattccaaacaatcacaattagcaaggaacataggcaaacaagatgagcatacacaacattcattattcaacactcatatccaacaaatattcatcatccacatccaacaattactcatcattcatccatggacccaatcaagactacacaaaatgatgcatgcacctgactcaaatactcagatgcaatgtggtacgtaccaacaacaaccaaatctcaggaaatag

SEQ ID NO: 5785 - DNA, 501 bp, Glycine max
  Peptide Sequence Number=SeqID_97470
atggctgaagagccaagaagagtaaccctggaggattattcaagttctactgtgccacaatttctcactagtattgcacagccagaagttcaagctcagacaattacatatcctccttctttgatacagctaattcaaaataatctatttcatggtgtgcctgcggatgcaatcaggttgagtctgctttcattttctttatctggagaagctaagaggtggcttcattattttaaaggaaacagtttgaagtcatgggatgaagtggtagaaaagttcttaaaaaacttgcctgcatcttcatcgcttcatttcaagaacaatccaagggaaatatggctgaaaggggtgaatacccatgtggttctgtctagaaatcacgatgaacgcgctaagcgtgccagtgcgcttagcctgttcatcgcaactgttaaaattttggaattccaaatgaacgcgctaagcggaccatgtcgcgctaagcgcgttcatccctgctaa

SEQ ID NO: 5786 - DNA, 258 bp, Glycine max
  Peptide Sequence Number=SeqID_97471
atgctttgtgtaatcgattacatggttatgggtacatcctttgtggtacaagtagagggtacatctacttgggttgttgtaactgagaacaagagagggtacatctcttgtggatcagttcaagtggaggatacatccacttggttgttcaaggagaacaagggaaggtacatcccttgtggatctttgtttgtaaaggattttacaaggttgaaaagaaatctcaagaaccggtggttgcttggggactggatgtag

SEQ ID NO: 5787 - DNA, 213 bp, Glycine max
  Peptide Sequence Number=SeqID_97472
atggagaactggcgaacagcgctaggcaataacttcgcggggctccagactcgaaggtggaggatgcatgaacagctcttggcaatgatcattcgtgggctccgaataaaagggagaatggagaattggcgaacagcgctaggcaataattcgcggggctcccgactcgaaggtggaggacacatgaacagcgcttggcaatcaattcatggg

SEQ ID NO: 5788 - DNA, 674 bp, Glycine max
  Peptide Sequence Number=SeqID_97473
atgggttttgttgcttcttcggcttcacaggcagcggaagtatacaataaagacggcaataaactggacgtgtacggcaaagtgaaagccatgcactacttcagcgattatgacagcaaggatggcgaccagacctacgttcgcttcggtatcaaaggcgaaacgcagatcaacgatcaactgaccggttatggccgctgggaatccgaattctccggcaataaaaccgaaagcgattcctcgcagaaaacccgtctggcgtttgccggcgtgaaattaaaagagtttggatcatttgactatggtcgtaacctcggcgcgctgtacgacgttgaagcctggaccgatatgttcccggagttcggcggcgactcctccgcgcagaccgataacttcatgaccaaacgcgccagcggcctggcgacctaccgcaacactgatttcttcggcctggtggatggtctgaatatgaccctgcaatatcagggcaaaaacgaaggccgtgaagcgaaaaaacagaatggcgacggcttcggcacctctttaagctatgatttcggcggcagtgatttcgccgtcagcgcggcttataccagttctgaccgtaccaacgatcagaacctgctggcgcgcggccagggctccaaagcggaagcctgggctaccggcctgaa

SEQ ID NO: 5789 - DNA, 756 bp, Glycine max
  Peptide Sequence Number=SeqID_97474
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaaatccaagccgaggcacttccgtaacgtttccgtgagtaattacacgaagattcttgaccgttcttcaacggcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgaaaatggtttacgaacggggcggagatttcctggaagatgccaggaagatacttaacagggaa

SEQ ID NO: 5790 - DNA, 237 bp, Glycine max
  Peptide Sequence Number=SeqID_97475
atgacaaggagcagaatggaaattcagactgatgaaggtagagctgaagagaaggtggagggatataaacaacagtcggcaactgagccggcactagaaccagtttctgattttattgaacttgaggaagttgtggaagatgaagatgaccaacaggagagagagacaccaataaaagagagtgaaataggaataaagatgaaggaagaacaagaaaatgaaaaagaaaaagaagaa

SEQ ID NO: 5791 - DNA, 517 bp, Glycine max
  Peptide Sequence Number=SeqID_97476
taagccagtatacactccgctagcgccccaatacgcaaaccgcctctccccgcgcgttggccgattcattaatgcagctggcacgacaggtttcccgactggaaagcgggcagtgagcgcaacgcaattaattgtaaggccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 5792 - DNA, 450 bp, Glycine max
  Peptide Sequence Number=SeqID_97477
atggatgtgtcggccaagcaaggaaggtgtgaattgcctgccccactaaggaaacctcatcagtgggtactggaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 5793 - DNA, 749 bp, Glycine max
  Peptide Sequence Number=SeqID_97478
atgtcattattgttacgccgaccaccaggccgtgaggctttcccaggcgatgttttctatttacattcccgtctcttagaaagagccgctaaacgatcggaccagacaggtgcaggtagcttgaccgccttacccgtcattgaaacacaagcgggagacgtatcggcctatattccaaccaatgtgatctccattactgatggacaaatatgtttggaaacagagctcttttatcgcggaattagacctgctattaacgtcggcttatctgtcagtcgcgtcgggtctgccgctcagttgaaagctatgaaacaagtctgcggtagtttaaaacttgaattggcacaatatcgcgaagtcgccgcctttgctcaatttggctcagaccttgatgctgcgactcaggcattactcaatagagtgaagtattcgttttcatcattttttgatattgatacgctccttgcttttttcacgcccgccttttgtatggacgacgtgggcgccagctcacagtcgtccttgcccactgtgaacccaacccctgacccagccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaagtcaaaatcgaaagggccattgagaaagctctgctctccgacgg

SEQ ID NO: 5794 - DNA, 444 bp, Glycine max
  Peptide Sequence Number=SeqID_97479
atgcaagttgtgaaaaaggatgaaggtggcatgtttttcctacatgcatatagaggtacaggaaaaacatacatatggagaacattagcaagttctttgagggtaaataatcatattgtaattatggttgcttctagcggcataacttctctgttattactaggaggcagaactgctcattcgaaatttaagatacctgtaccaatttttgaagactcaacatgcaacatgcttcaaggaactcagttagcagaattgctaaatcaaacaaaattgataatttgggatgaagcacccatggctcacaaattttgctttgaagcacttgatcaaagtttaaaagacattattaaagaaaccaaaaatcccaatcaaatctttggaggcaaagttattgtatatggtggagacttccaacaaatactacctgtcattccaagatga

SEQ ID NO: 5795 - DNA, 234 bp, Glycine max
  Peptide Sequence Number=SeqID_97480
atgttggtggcgactccgcgcgtattcctttcgtggaacacgcatcccgcgagtctcgcgtcgccctcccgccgaagggtaggttgcgacaatctttcttcatctgttcttgtgcatccacccattctcactcatttgcatgtttattttcttgttgcgcttaaacggtgcagatccgatgatgagtcccgcaaaggtactaataccgcggacccaaccgttgatttcgagtga

SEQ ID NO: 5796 - DNA, 165 bp, Glycine max
  Peptide Sequence Number=SeqID_97481
atggaagttggaagttggaagtggaagttggaagttggaaatgaaagttattggaagttgaaagttgaaaatgcaggttggaagttggaaggggaagtggttgtcatcatcaaaaagggggagaatgtaaatcatgaagattttgatgatgtcaagaagaattaa

SEQ ID NO: 5797 - DNA, 535 bp, Glycine max
  Peptide Sequence Number=SeqID_97482
atggcatccttcagccagcttcagtcgcagaggcaatctcagggacttgcagtgcctcctgagcctctggttgtgttgatccctcaggaaatgatcctaagacgggtgagcacaaaggggagttgtgttgatccctcaggaaaagatcctgagacgggtgactctgacaggtgcggcttgtacatagaagttgatcctgcccgcctggtgagtgtggacgagattaaagatgcagatgctgcagttcctgtacccactgatgaggtttcccttagtggggcaggcacttcacaccttccttgcttggccgacacatttggtcaagtctttatcacaccagctgtgtctccgccaaaaccacctccgaagcccgatccggaggtcgatgatccgctttatctgatgacattgaccatcccagagcttttcttgaggccttatcaggttagatgggatgccaccgtgtttggggtcgttaatccagatttccccctgtacataaagcacgaagacctctccgaaatcgcacacggtg

SEQ ID NO: 5798 - DNA, 222 bp, Glycine max
  Peptide Sequence Number=SeqID_97483
atgaagcaaccagctcgcccggccaagctgggcagcaacctcctctcccattttttctataaatggacgtggggggctgagggtgtcgcaacatgcccttcgcgggccagcgagggcgaggctcacgggtgcgctttccaaaggaggaaaggtgcgcggagttgccaccaaggtttatttgtgggaaatgtcggaaaaaccgaaggaaaccggtcaaaatga

SEQ ID NO: 5799 - DNA, 335 bp, Glycine max
  Peptide Sequence Number=SeqID_97484
gactacacgtcctcgccttgagaggactacacgtcctcaccatcagagggttgcacgccctcacctccagaggactacatgtcctcgccttgagagggctacacgtcctcaccttgggtactagttaccctcaccgtcagagggctacacgccctcaccttgaaaggactacacatcctcgccagcagagagggctgcacgccctcacctccagaggactacacctcctcgccttgagagggctgcacgccctcacctttagaggactacgtgtcctcattttcagtgtgctcgacatccacaccttaaaagaatttaaggtcctctgcccttaa

SEQ ID NO: 5800 - DNA, 223 bp, Glycine max
  Peptide Sequence Number=SeqID_97485
attttcctctatttttcgttcagcactagactcacgtagtctattcagacctccttcttctcattctctgcaattcaggcttaaaaagggctttttgtctgtgaaggcacgcttagcgccatcttcgtgcttagcacgagtaagtgaaatttggcttagtgtcattctcgcgctaagcgcagaagagacaatcttctcgttgaacgagctgatgacgcgttga

SEQ ID NO: 5801 - DNA, 240 bp, Glycine max
  Peptide Sequence Number=SeqID_97486
atgcgaatgctggaaacggaggagagtcctccaaataatgtatgcacacttacaaaggagtccaaatttagggtggggatagagtgtactctattcggagaatatgttgacaagttgagtgcttccttgcttctagagaaggttaatggcttgatttgttttgggagtgtcgggtatgtggtcttaggttctgatttaatttatctcgacaacatgaggctaaaggaaacaatggtgtga

SEQ ID NO: 5802 - DNA, 318 bp, Glycine max
  Peptide Sequence Number=SeqID_97487
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgcgcattaa

SEQ ID NO: 5803 - DNA, 382 bp, Glycine max
  Peptide Sequence Number=SeqID_97488
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaagactggactgattcatttgcttccaaagtttcatggccttgcag

SEQ ID NO: 5804 - DNA, 108 bp, Glycine max
  Peptide Sequence Number=SeqID_97489
atgcattctctgaagaactcgctaagcgtgcctgctgtgctaagcgaggctgaatcgctaagcccagcctttgaggagcttagcgcatatccttgtggcagaccttag

SEQ ID NO: 5805 - DNA, 130 bp, Glycine max
  Peptide Sequence Number=SeqID_97490
atgggttctccacctgctccactctctcctcctcctcttcctcctcctcctagatgcatctgcttcgctgtctgcatgagcggacacgcaaagcctcacgtctacgatcgttgtccactagaaccacctg

SEQ ID NO: 5806 - DNA, 276 bp, Glycine max
  Peptide Sequence Number=SeqID_97491
atgcctctatggtgggaattttactcatgggttaaggaacctagagtgctccattgtaagcctatggataatttcctccagcactctcccatgtcaggattgcagaatactaacagaaggagagtctacctcctgtggcttactgtagtacccctggcgttaactcttaaactgttacaagaacacaataagggtaagggaaacttcactaaggagaagaagcacaaagttgtcacgatgctcgagttaaatatgagataccctagccatgtttag

SEQ ID NO: 5807 - DNA, 1105 bp, Glycine max
  misc_feature (524)..(524): n is a, c, g, or t
  Peptide Sequence Number=SeqID_97492
atggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttgggggnccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgacattgggtccaaaaagaggggcagtgccccgcttccgattcacggaataa

SEQ ID NO: 5808 - DNA, 225 bp, Glycine max
  Peptide Sequence Number=SeqID_97493
atgactaaagcacgtccaaaggggatacggaaaggaaaagagggagaagcttgccacccaactcttgcaggcgagctaggttgcatcctcccgaaggcaccgccttctggaggaacttcctggaaggcccaaaacttcacggattgtgcaacaatgctttcttttgacttctggcatgtcacggaacttcacggattgcctaacgatgggtgccaagtaccttga

SEQ ID NO: 5809 - DNA, 277 bp, Glycine max
  Peptide Sequence Number=SeqID_97494
caaaaaagaaggagtagagacaagaatcgtcatcacggaaagggcaggatggacgaaatctgtgtcttatctttgctttcctcttatctccgatgagagattcttcctccagaaggctgttgcttctagaggaagcaaccttgctcgcctgggcgagctgagctcgcctgggcgagctgggggttcagccttcttggcacttcttattctctcgaaattgctgaggaaaattatttccgtgaagaaaatacaagccgaggcgcttcctcttcaacag

SEQ ID NO: 5810 - DNA, 114 bp, Glycine max
  Peptide Sequence Number=SeqID_97495
atgggagtgttcttggctgatagggtggaacgacagtcacatcatgggttcctccctccttcttattctctccatttgcccctgtcttcctattcatcaaagcaggataattaa

SEQ ID NO: 5811 - DNA, 171 bp, Glycine max
  Peptide Sequence Number=SeqID_97496
atggcattagcgcttgacttttgtattagaaataccagaatgtgcacgtatgcaatttttgatagccaaagtgctttgagtatgcatgtatgtaaatttagcaaaggaaatgcgtgtgatgtaggaaatggccccgaggaagcttgcctcaaagaggtccaggaaggataa

SEQ ID NO: 5812 - DNA, 222 bp, Glycine max
  Peptide Sequence Number=SeqID_97497
atgggcacacaacactgtacatttgatcgcccattgagtcctttcgctaagcgcaagcctcgtgctaagcgcatcttttgtcatgcgctaagcggagagtctctagcacttagtgctcaacccttgcatgtcaggctgatttggtccactatgttggccaaggttgagctaagcctatttcaattcgatttgaattcggttaagcgatggcctgctcgctaa

SEQ ID NO: 5813 - DNA, 168 bp, Glycine max
  Peptide Sequence Number=SeqID_97498
ggcatgcagccctctgaaggtgaggacgtgaagtcctctgaaggcgaggacagggtggcgagggcgtgcatccctctgaaggtgaggacgtgcagtcctctgaaggagagggtgctagtacccaagggtccacctgatgcaatcctatcccacaagggcattgggtag

SEQ ID NO: 5814 - DNA, 582 bp, Glycine max
  Peptide Sequence Number=SeqID_97499
atggaagggttagtggacctagcagcgattgatgctttcctcgcctttcatcatggcaaggaaagcctggtcgtcgccattttggccatgcatgacacgttcgaccagagatgtgaaaagagcggcgcaagaattgtttgttgtacaccggctctctatgtgtggctggtttcgcacctttttctccaagaaggtaggctcgtctatccgctacaaggaaggaagaatcaggattctatcttcatgcgaaggatttccaaatgttcccttaatgggaacaagggaaaggacagagagcttaggagaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccgggtagtcaaagagaagttcaaggcagcaatagtgagctcaagctccgaagaggtgaaaggaatcatcacgggtcaaaggcatgatcttgaaggacgagctaaaggcttgccttag

SEQ ID NO: 5815 - DNA, 162 bp, Glycine max
  Peptide Sequence Number=SeqID_97500
atggactcgggaaggttccaagttagtgtaccagggattgcctttgtggataactgggcggtgggtaaggagaaggaatggcagtcacagcatgggcttctacttcatcctcaccctcttcatttgccccaattttctcattcgtccaagcaggatgactaa

SEQ ID NO: 5816 - DNA, 162 bp, Glycine max
  Peptide Sequence Number=SeqID_97501
atgactattgcgctaagcggacccattgggctgggcgtgcatccatcactaagcgtggcttcacatgctaagcgtgagatcaactcgctaagtgagtcgttcgtctcttgccagactcagcgcaacattggtgctaagcccaaatccacttactcgcgctaa

SEQ ID NO: 5817 - DNA, 138 bp, Glycine max
  Peptide Sequence Number=SeqID_97502
atggaatacttacttgttggtgatgaacaaaagcgcaaaacggaatcaaaaaatgcgaaaaaggatgaccctagggctgcaaattcgtcaatcccgtgggggaaaattaaccctgtccccccccctctcctggattaa

SEQ ID NO: 5818 - DNA, 515 bp, Glycine max
  Peptide Sequence Number=SeqID_97503
atgatgtttgctactaaactactgaaatggtatcttgagcatggattggctgtttcaaatattacttttgctgtaagatatgaacgtaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 5819 - DNA, 135 bp, Glycine max
  Peptide Sequence Number=SeqID_97504
atggatacctcagtgccctacattggggcaatgaaaggcaccatgcataaacctcaagcgaacctagggacggatcataaattctcacccaataggttccctgcgacaaggagaattataagcaattgggcttga

SEQ ID NO: 5820 - DNA, 204 bp, Glycine max
  Peptide Sequence Number=SeqID_97505
atgggtgctttgaggctgattaactattttgccatgattgggttgccctcgccttcagagggctacacgccctcgccttcagagggctgcacaccctcgccttcagagggctacatgccctcgccttcagagggctacacgccttcgcctttagaggactacacgtcctcgccttcaaagggctgcatgccctcgccttcatag

SEQ ID NO: 5821 - DNA, 513 bp, Glycine max
  Peptide Sequence Number=SeqID_97506
atgaccacattggtctctacttgtcaatcggacttgaggtctctgaatgacgaggtgcgaataaccgtaaggtgtctctgcatgctacaggactctcgggtcgcggtaacaaaaggtggggtggtcgacaaaagcagggcttttgctcctacatatccccaatttgtgatgaggaactcagacttacatatgcgaggcgagaaagccatcgacgcacaggatttttggttgacaatcaaagggagagaaccacttcaagtcgtgggcaaggatgggcattctcaccctgggtcaaggtttacggtaagttgggattttggcttaaggcttgtagaacagctggacatgatatatgttagcagtgggtttggacagcggttcggggataaaggggatgccccacattatttccatgacacacatgcaacgatgacgattaggaaattttatgcaaaactggtcatgcatgtacctatgaggacactcaagcatcatgtttttatggttatgtga

SEQ ID NO: 5822 - DNA, 330 bp, Glycine max
  Peptide Sequence Number=SeqID_97507
atgggattaaaatcaagaactcacatgagtaatcaatttaatcttaagatatgcacaaattcaaaaacaaagggggagaatttatttgtcatcatcaaaaacggggagattgtagaagcaaagcttcatggtgaatcaaagaacaattcaagagttcaagataagaatcaagaagaattcaagactcaagaagaaagattagagtcaagaatcaagattcaaggttcaagatctcaagaatcaagatcaagattcaagactcaagattcaagaatcaagagaaggcttaatcaagataagtatgaaaagtttttcacaaaaattgagtag

SEQ ID NO: 5823 - DNA, 351 bp, Glycine max
  Peptide Sequence Number=SeqID_97508
atgactttaaagaacctcgtgctagaggacgctaggacacaatgctctgataggattagagggtacatctacttgggtttgactgagaacaagagagggtacatctcttgtggatcagttctagtggagggtacatccactaggttgttcaaagagaacaagggagggtacatcccttgtggatctttgcttgtaaaaggatttttacaaggttggaaaagaaatctcaaggaccgcaggtcgcttggtgatgagaatcatgaaactggccaaatacaggctaaaggcccaagtggagaaggacgaaggcccaagtggagaaggacaaagcccccgagtggagaaggatga

SEQ ID NO: 5824 - DNA, 233 bp, Glycine max
  Peptide Sequence Number=SeqID_97509
atggatcgttcaaccgcagttaggaaagagaagcagatgggaaataataagctcgacttaaaggagaggaagaataagaagagcaagctagacgtacagattgaggatccttgggaagtaggaggagttgcttgtttatcaatgaacaactgggataagaaagatgttgttcataatgaagctaagatagaagagtcccaagctaagtcaacgaagacggatattgatagtgg

SEQ ID NO: 5825 - DNA, 407 bp, Glycine max
  Peptide Sequence Number=SeqID_97510
gactacacgtcctcgccttcagaggactgcacgtcctcaccttgagaggactacacgtcctcgccttgagaggactacatgtcctcaccatccgagggctgcacgccctcacctccagaggactacacgtcctcgccttgagaggactacatgtcctcaccaccagagggctgcacgccctcacctccagaggactataagtcctcgccttgagagggctacacgccctcaccttgggactacacgtcctcgcctcagagggttgcacgccctcaactctagaggactacacgtcctcgccttgagagggctacacgtcctcaccttggggctacacgccctcaccttgggtactagttaccctcaccgtcagaggactacacgtcctcgccttgagaggactacac

SEQ ID NO: 5826 - DNA, 237 bp, Glycine max
  Peptide Sequence Number=SeqID_97511
atggttatcgattaccagaagcagaggccatttaacatcttgtctccatttttaagccctgtaatcgattacccacgaatggtaattgattaccataggctaatttccagataccacccaagatacatagctggccagccgccacacaagccttctagcttcgtggactttgttcttttattggttgactgccaggagctcgccagcttaggtacatcgcaggttctcactgactga

SEQ ID NO: 5827 - DNA, 384 bp, Glycine max
  Peptide Sequence Number=SeqID_97512
ggatcgcgcccacaaagacacccagtggacccggagaagtccaacagggccctggggtttccagctctggttacgggtctctgtcagtcctacagggtgcccgtccccccggcaaggtcacgtcatcatgacatagggatcgcgcccacaaaggcacccagtggacccggagaagtccaacaaggtcttgaattctatggagtgcctgtcaccttcagcaagggcatcaggccccctactaatcgagctttcatcaagaagtattgcgtccccaggcaggcgcagggcgaaacacaacagcagcctggggatggccggcagcgggcaatagacgcaccgccatcacctctagagttcacctcagctcatccacaaaaaggttag

SEQ ID NO: 5828 - DNA, 349 bp, Glycine max
  Peptide Sequence Number=SeqID_97513
cactttccgtcagttgcggagtgcatcgttgatccggactacgacgaggtgtctccacgtgcatgccgatggattgctatgaagaagactggagcatcaaccagcccgggagttttagttgatttcatgcttttccggttagctccgctgggggcccgttgctgtcagacactaaccagaaaaggtcagtgtgcgcccgactacattgattggttcttggtcatttctcatccattcgtggcagtggcacaaccattagatccgccgcgcgatgcacctgcgacacatcatgccgcatttgtggagccacataggccccaggtcctagagccagcccagacatgcagtg

SEQ ID NO: 5829 - DNA, 413 bp, Glycine max
  Peptide Sequence Number=SeqID_97514
atggcctcgaggaaacttgcctcaaagagatctaggaaggataaagcggctgaaggaaccagttccgctcccgaatatgacagccaccgctttaggagcgctgaacaccagcagcgcttcgaggccatcaagggatggtcatttctccgggagcgacgcgtccagatcagggacgacgagtacaccaatttccaggaggagatagtttgccggcggtgggcatcgctggtcacccccatggccaagtttgatccagacatagtcctcgaattttatgccaatgcttggcctacagaggagggcgtgcgtgatatgaggtcctgggtgaggggtcagtggatcccgtttgatgcagatgcgatcagccaactcctgggatatcctttagtgctggaagagggccaggagtgcga

SEQ ID NO: 5830 - DNA, 234 bp, Glycine max
  Peptide Sequence Number=SeqID_97515
atggagcatacatccacttggttattcaaagagaacatgagatgtgacattttggctttgataccacatgatgtagctccatgtggagcttctaggccttggatcttcttcatcaatggagtcctttgcttcttgaagatcatcgcagaggaatggagaatgaagaaagatgattggatacgccacttcaaggagaagatgagtcaagaagaagctcataaccataggaagtga

SEQ ID NO: 5831 - DNA, 795 bp, Glycine max
  Peptide Sequence Number=SeqID_97516
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttctgtttaacagcctgcccaccctggaaaacggctcagccggaggtagggtccagcggctggaagagcaccgcacgtcgcgtgggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccggggcgtcgaacagtcaactcagaactgtgctctggaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 5832 - DNA, 198 bp, Glycine max
  Peptide Sequence Number=SeqID_97517
atgcaagagaaggcctctaggattcttgagttattcctcaaggactcattaggagagaatgagtttgttcttatttttagtttcaatacaaacttagtgatcattggggttcccatgaatcctaagagaataaaggtcattcctgatggttcagcccactccaccaagtataagaaaaatgtgcttggggttccatga

SEQ ID NO: 5833 - DNA, 543 bp, Glycine max
  Peptide Sequence Number=SeqID_97518
atggtgttaatttcgagtgctccagtggcgtatctggtttctatcagctgtccttcctgttcagctactgaaattcggggtggtatccgctcacaattcggcacacaagcataccagccggaagcatcagcgctggcaactaaccaccacttaacccgccttgcgcttacactgcgccgctttcacagtcggcgaaacctgtcgtgccattcgctgcattcaaggctgaatcgccaactgttgggaagggcgatcggtgcgggcctttcgcgtattacgccagctggcgaaagggggatgtgctgcaaggcgattaagttgggtaacgccagggttttcccagtcacgacgtgtgtggcaggagaaaaaacgacggtgccagagaattgtaatacgactcactatagggcgaattggagctccaccgcggtggcggccgctctagaactagtggttatcccccgggctgcaggaattcgatcaatagctgtatcttgtcctatcagaatatttgaaggaaatgatcacttaacagggaagtga

SEQ ID NO: 5834 - DNA, 623 bp, Glycine max
  Peptide Sequence Number=SeqID_97519
tgtcggcccagcagagtgctttcgccgttggtgttctttccgatctctacgcatttcaccgctccaccggaaattccctctgcccctaccacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaaggcgttcatcctgagccaggatcgaactctccatgagattcctagttgcattacttatagcttccttgtcgtagacaaagctgattcggaattctcttccattccaaggcataacttgtatccaggcgcttcatattcgactggagttcgctcccagaaatatagcccccccacccctcgtgctcgaactgataacttccaccacgtcaaggtgacactctaccgctga

SEQ ID NO: 5835 - DNA, 198 bp, Glycine max
  Peptide Sequence Number=SeqID_97520
atgcgtgatcatggatcaataggactttttcttgggaatgatgaacaagtcaccgacacacaagattttggttggcaatcaaagggagaggaccactttatgatgcaatcctatcccgcaagggcattgggtagaagactccaactagattgggctagagatccaagggaaggccctagggttctcatgagccttagg

SEQ ID NO: 5836 - DNA, 700 bp, Glycine max
  Peptide Sequence Number=SeqID_97521
aggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtccttgccttgagagggctacacgccctcaccttgggactacacgcccttacctccagaggactacatgtcctcgcctttgggggctacacgccctcaccttgagggacaactgtgcgagcacaaccagagagggagctattacacaagactactatgcattaccagggggcaagatttcattcgtgccgctggatcgcacccacaagacgcccagtggacccggaaaagtccaacagggccctggggttcccagctctggttacgggcctctatcagtcctacacggtgctcgtaccccccctagcaaggtcatgctatcccgacatagggatcgtgcccgcaagacatccagtggactcgaagaagtccaacagggtcttggagttgtcaaagctctaatcacgggtctctatcagttcaagggagtgcctgttgcccccagcagggtcatcaggccccctactgatcgagctttcatcaagaagtactgcgtccctaggcaggcgcagggcgaaacaccacagcagcattgggatggccggtag

SEQ ID NO: 5837 - DNA, 279 bp, Glycine max
  Peptide Sequence Number=SeqID_97522
atggtagccataaccccaaccaaggttcatcaacctccatttctccgagaatacgactcgaacgcaacgtgtgcttgtcatggagaagccccggggcattccattgagcattgtaggggtctgaagcgtaaggtgcaaggattttcaactttcaccggaatcgggtgcaagccattggtctatttgctcaagcgacctgtgaccattcaatcagagattactcgtcttgtacgctggtggggctgccgtaaaacaacaagtaaagttcaaaacaaataa

SEQ ID NO: 5838 - DNA, 366 bp, Glycine max
  Peptide Sequence Number=SeqID_97523
atggatagggagatgataacaatgatagtagacacgttaccggcattctactatgagaagatggtgggttacatgtcttcaagcttttccaatttagtgttcgctggtgaaaggatcgaagtgggtctgagaataggcaaatttgtttatcctactttgatgaataggaagcctagggcaaatggagagaataagaaggagggaggaacccatgttgtgactgccgttcctacatggccaaatttcccaccagctcaacaatatcaacccttctcattacccaccaccctatcatccacaaaggccacccctaaattagtcacaaaactcgcctgctacacatccgataccaaacaccacccttaa

SEQ ID NO: 5839 - DNA, 1239 bp, Glycine max
  Peptide Sequence Number=SeqID_97524
atggttaggactagaggcttaggccgtgcctttggtagggttatcggcaaagctctggggagagaggatcatcatgattctgatgatgctccccagcggcgaaggcctacaacatcggcacgcaggcaacgaggagctgtctctgttgccgaggatgaccctgtggtagctgccgatgagcctatggtagatgcagacactggtgcaaacgtacatccacctggtgtggacgctagtgcaaatgagcctgagggatttccaggtgggccgcgtgacccatcagtgcttacggagtatgctgaccatgttgtagtcagcgtatggaacgaagaggaacgttctgaattgaagttatccttccatgggaggaaggtgcagaaattaggtaggcctgctcctcaaattaaagggctagttgctaccacaggactaagtcatttgatcgcatgttcagtagacactgcgatcggggacttatatcctcgtttgtggagaggtggtatagggaaactagcaatttccatcttctcgtgggggaggtctccggagaggcagacatggccgagacaacacattgtcatggaccatacatacgcctatcttggctatgagatatatatcagagcagatgtcaggctagacattagacagctgcagctcggcgctgctgccgtagtgcatatgtacgatcatttgaatgatgcttgtatctgcaccaaccgacagcttgctggttacatcactctcttacaatgttggatatatgagcacttttcgtcagttgcggagtgcattgctaatccggactacgatgaggtgtcaccacgtacatgtcggtggattgctacgaaggcaactgtgaagtctatatctacagcgacgtataggcagcatctagatcgactcaggattcttgatgtctattggatgccttatggggagaatcgagccacaccgactagagaagaaatagacaacagatggatgcactactcagaccatcttgtgccagtaggtgagatatgtcttgtgccaggtcagtgtgcgcccgagtacatggattggttcttcgtcatttcttatccattcatgaccgcgacacaaccatcaaatccaccgcaagatccacctgcgacgcatgatgcctcatttgtggagctacatatccctcaggtcccagagtcagcagcaacatcgacacatgctcgttctgatgtggacgagcctagacatgcaatg

SEQ ID NO: 5840 - DNA, 174 bp, Glycine max
  Peptide Sequence Number=SeqID_97525
atggtgtggaaaattgggttgttgattttgcaactggaagtttctaaagacttcaccgagcagattcactctcgtgtctacaccaatgtcgagcaaatcgacgacgacataggcacaaatgctattgaagaaggagaagaatggactgtgaaatgcataagatatgatcgctag

SEQ ID NO: 5841 - DNA, 363 bp, Glycine max
  Peptide Sequence Number=SeqID_97526
atgttaatgtgtaatgatcaatactcgtgcgttggctcgattaagttactatgcatcattggtagaacaccggatggtatattaaacttacttcaagccactataacctctactcttgatgccctgctatattacaacgggaggtggaacatgtcatgccaacacgactttgtcggttacccattcacaggaaaaaatacaaaaagatttgacattccttcgggatgtaccatcgatggaatgaaggatgtgatcaagcaagttgcacctcaagggattccctcttatggtcattctgagtattcagacaaaattatcaaatttgaaattattgagctgaaaactgatgatgacgtgctaaag

SEQ ID NO: 5842 - DNA, 141 bp, Glycine max
  Peptide Sequence Number=SeqID_97527
atgtcttccaagtcaagcaaaatccaaagattcaagaatcaagtttcaagaatcaagattcaagattcaagattcaagattcaagattcaagtttcaagaatcaagattcaagaataatcaagatcaagattcaagactaa

SEQ ID NO: 5843 - DNA, 201 bp, Glycine max
  Peptide Sequence Number=SeqID_97528
atgcatctacttaaggattgttatactaagaacaagaaagggtacatctcttgtggatcagttaaagtggagggtacatccacttggttattcaaagagaacaagggagggtacatctcttgtggatccttggcttgtaaaggattttacaaggttgaaagaaatctcaagaaccgcaggttacttggggactggatgtag

SEQ ID NO: 5844 - DNA, 411 bp, Glycine max
  Peptide Sequence Number=SeqID_97529
atgaaaggattagcatgggcagaaaatgtgtcagcattgataggtaaatctgttcctcacatttctgagaaatgtaagaacccaggtgatgacaaaaagctcaaaggtcaatcaaagaatgagttcaagatattcaagatagaatcaagaacacttcaagattcaaaaggaaagttgatttcaagaatcaagaatcaagattcaagagatcaagatttcaagaatcaagattcaagagatcaagattcaagactcaagattcaagaatcaagagaaggcttaatcaagataagtatgaaaaggttttctcaaaaattgagtagcacgtggatttttctcaaaacatgtttaccaaagagtttttactctctggtaatcgattaccagattgttgtaatcgattaccagtag

SEQ ID NO: 5845 - DNA, 228 bp, Glycine max
  Peptide Sequence Number=SeqID_97530
atggcaattggaatcatgaggcatgacaatatcattgtttattttatggcctttggaatctcgaggcctcacgttcagacaaaagccatgtgcaagacagtcttgcatgccaaacaaaggatcaagctgaatgttttgatgatgccaaaggattacatgaatcacatgcttctcaaagatttattcaagacaaagatattcaagatgaatgatcaagacagtctttag

SEQ ID NO: 5846 - DNA, 279 bp, Glycine max
  Peptide Sequence Number=SeqID_97531
atgcagatattcattgaaggaatagatctaaatatatgggaagcaatagaattaggaccacatatatccactatagtagatgtaagcacaagcactacaacccaaaaacctagagatcagtggacagaagaagataggagaaaaatccagtacgatctcaaagccaaaaacatcatcacttcagccctagggatagatgagtactttagagtgtcaaattgtactaatgccaaggatatgtgggatactctccagttaacccatgaaggaaccacagat

SEQ ID NO: 5847 - DNA, 126 bp, Glycine max
  Peptide Sequence Number=SeqID_97532
atgggggaggcaaatttaatgacagcggaatggagaaggaagaaagatgattggagatgccacttcaaggagaagatgagtcaagaagaagctcgccaccgtaggaagccatggataagagcttga

SEQ ID NO: 5848 - DNA, 331 bp, Glycine max
  Peptide Sequence Number=SeqID_97533
cttgggaggattgatggggacccggtgttgagagaaacgaggatatgggctacgtgggagtacgtgagctcagatggagagtggtacctcgagatatgtcgcgggggtcaggacctttgggacgtcaggcgagctcctggcagtcaaccgataaaagaacaaagaccacaaagcaaagaggcttgtgtggtggctggccagctgaagctaagatggcctctggtaatcgattaccaagggagtgtaatcgattaccaggctttaaaacaagatcaggaagttaagagggcttctggctgtgtaatcgattacatagaggaacagggcactg

SEQ ID NO: 5849 - DNA, 321 bp, Glycine max
  Peptide Sequence Number=SeqID_97534
cttgcatcagggttagctcctgatcatgcagaatttgcaggatatggtccagcagtggccagttatgagcctggaggagaggatgacattttagaggccttagagcctactccacctgagcctttcatttttgaaactgatccagtagcacctaccccacaagtgacaccagagccttccactgcagtgctggacatgtcttctcctcagcctgagtcatctgcactagtgctagacctgcctctttctcaggattcaccatcaagcactcctgcactgaatctgaatgagtatgccatggacgctacacaggatcattga

SEQ ID NO: 5850 - DNA, 306 bp, Glycine max
  Peptide Sequence Number=SeqID_97535
gtcgactctagaggatccccgacttcctttgggtaccgtaaagatcggaatggtcaatggctgaagaaggatgcactccctcctcaagatgaacgtactccttcacctcctcctccgcctgaagattccgcactcatgaatgaagtcctctctgaattacggggtcttcgttcttatgttggtgaccgcttcgactcgttagatacacactttgccggtatggacattcgcctcacacagcttgaagaggatgtcggatacattcgtcagagtttcgatcttccaccaccacctccgccttcttag

SEQ ID NO: 5851 - DNA, 299 bp, Glycine max
  Peptide Sequence Number=SeqID_97536
aggaacccgcacgcacgcttcagcagcctgtggagtggatactacctacacctactccatatcgactagtggagtcagttcaagtgatagaggtgtcatcctctaaagaagatcctgaggaggacccagaggagttacctcctgagcctgctgaggatgctctggacttacctaaggatgatgaagacccactccttgatgttgattttccagaggatatcatgtcagcatctgaggcagactctacagaggaaagcggccctggagggacagcgaatagtgaagactcttcatcatag

SEQ ID NO: 5852 - DNA, 636 bp, Glycine max
  Peptide Sequence Number=SeqID_97537
gagcttgccacccagctcgcccaggcgagcaaggttgcttcctcgagaagcaagagccttctggaggaagaatctggaaggcccaagcttaccacaaccatttggctgctgagcagagaaggtagcaggtcagcatatggcattgggattggggtgaacttcgtgggttttctctctgggaagttcctccttgggttggtgtttgtattggggacttacacttggtcagggctgtgcagggaatggatgttatgggtgatgttggggtggtctttatggttgattgaacattctcagtcggatgggcgtcgggcaggggggagattcgatattggtcgagtaattatattggtgcgggggatattggtacatggggttgtgaggggtttgttgggagcttggccatgtgggtgctatggtcgcagcataggcgtgctatggaaatcttcttgtagtagaacacaggattcatgctcccttttgcacatgttctgcaactacattctatctggagccatgtcggagttgtactggtatttcctgataaaggcggccattaggtccttccaggaatggatccaagaagattccagactggtgtaccaagtgatagttgcccccgccaaactctcttga

SEQ ID NO: 5853 - DNA, 225 bp, Glycine max
  Peptide Sequence Number=SeqID_97538
atgtggggcttgcgggtgcgtcttccatgggaggaaaatgtgcggagtcgccaccaacgtttattcgaggaaaacgtcggaaaaactggaaaggtgtggtctacgaactttaagtgtgaaaggttcaggagttgtttttacacacgaggaagcttttgtattttttatctttttgtggtcgacaagggtgtttccctcggtcctacgtatcctcaattgcgatga

SEQ ID NO: 5854 - DNA, 318 bp, Glycine max
  Peptide Sequence Number=SeqID_97539
atggaatcgcttgattcgccctttagaaagaactacgtaggtctgatttcctcttcgatggaggtttccttcggtttttccgatgttttccacaaagaaaaagttggtggcgactccgcgcattttcctcctttggaagatgcacccgtgagcctcgcctcgctcgcccgcaaaagggtagttgcgacagttggcgactccaccggggactatttttcacccacgggtttgagtaaaaaggggccctatacccgggtccatggaaatctaaggagtggaggtgaatctatggtcatgctaggtcttcgacttgcttga

SEQ ID NO: 5855 - DNA, 247 bp, Glycine max
  Peptide Sequence Number=SeqID_97540
gatgatggggaaattgaaggggatgtgaatcatcgcattcaagcaggatggatgaaatggagaaaagcattcggggaatgttgggcggtcaagagccaacatgagaataaagtaggtgtagcggagatgaggatgttgcggtggatgtgtgagaagaccggtagactctgtagtgaggagagtagaccagatggagagaagacaaacaattcgaggcagaggaagaccccaaaagactataagagag

SEQ ID NO: 5856 - DNA, 351 bp, Glycine max
  Peptide Sequence Number=SeqID_97541
atgtccttgtcgttaaattcccaggtgacagcgttagagaggtgcataggtggcaattcagtgccatgtagactgtccaacgtggcactgaggtctgcatttataaatcctctctcacgcaaggttacttcttctacttccccaaataaattagggtttacgaagctgctggtttctcatgctgagtcgcttcttcttcttctcctctgtcgctcaatcgctattgctgttcacttgatttctccatgtctgcaagtggcaattgttgtgcattttatggtagtttcattcggcaatgccaccatggaagatgtgcagctatttgaactacaagaacaaggaggaacctag

SEQ ID NO: 5857 - DNA, 364 bp, Glycine max
  Peptide Sequence Number=SeqID_97542
ggccaagcatttttcaacggaatgcctcgggacacccccatggtacttgcaagttgcgttagggtcatacctctttggggaaggggggaagttccttgttgcgttggaattaccggccgggcgagtcgtgttcggagtcggaacttggggagcttccctctgggtgggtgccttaggctgcacgggtgctgaactagaggcgttcccgacggcatggccatctccttccttcctttttgcccctgttgccctgatggaagcttgcttgtggggcttctatggaggctggatctttgagcttcaatggggtcctttaatggtgattttccaccatggagatgaagcggaagacaaaggaaaatag

SEQ ID NO: 5858 - DNA, 392 bp, Glycine max
  Peptide Sequence Number=SeqID_97543
gtctagaagggacgccactagagaaggctccagtgccgcctcagagtttgatagtcaccgtttctggagtgccgagcactagcagcacttcgaggccatcaggggatggaagagatatctcgcaagcattggacacctctagtgactcccatggccaatggattcccttcgacgcagatgccctcagccagttcttgggtgacctgctgattttggaggaagaccagctgtgtgaattcagccagaggaggagccaggcagacagtttcgatgaggaagccatcgcccagctgttgtgcatactgggggaggcgggtgcggatcatgcgcaccagcatgactactttgacccagatattgatgacactgctgctcagcaatgtcttgcctag

SEQ ID NO: 5859 - DNA, 567 bp, Glycine max
  Peptide Sequence Number=SeqID_97544
atggcacatggtccagcatcagagcatcgatttccaccacaagagtttcacatgcttcagtcaagtgttgaaactcggggttttggcagacaaagggaggttgttgaagcggaagaattttcccaacaaatggagcagtgtggccatggaatgtattacacgccactaacattttctcagtatccttcacagatgtatcagtatccttttgaaggtcacgacactaatatgtctgcaagcgaacattcgtttggtggtgttgtggaaacacatcctcatttttcatggccgactatgaccccttcacaacaacatgatgccccaatggcaacacctaacgccccattggctctgcaatggaatgtacccggagcaatacctgatatgggtgacttattaggtgttgatttgtgtcacgacttttctgctgaggttgagcaagtagaagcggggagacatcacggcagaagaaatcttgatcgtcaagcgcgaagatgggatcgaccatgcgacacatcctcatgtcatcacgacaccataatgaatgattttcatgtctctgtttaa

SEQ ID NO: 5860 - DNA, 321 bp, Glycine max
  Peptide Sequence Number=SeqID_97545
atgagagaagatccaattaagaacagccacttcaggcacgatccacttacaaaggaaaaggcaaaggaccatggaaaggaaataagtcatgcaccaataagaaacaccaggatcaaggatctaatgcaggattactggcaaggagagggtgctaagaataagcccaataatcagtcaaacttggcacaagatgaaggatcagattctgaggttgtaatgctcatggaaaccacaagcaatgaatcctccaatgacacttcatggtacttggattttggctgttccactcatatgacaaggagaaaaggaatggttcattag

SEQ ID NO: 5861 - DNA, 459 bp, Glycine max
  Peptide Sequence Number=SeqID_97546
atgcgacagtttggatacacccagaccattcctgctccgcctgtcggttcatgggtgtcgtatgatgatatacacgacaggtggatgcactattcggagcatatggttgcagcaggtgaggtgtgtgctatgccaggtcaatgtgccagtgactacatggactggttcttccgcattttgcatcctttcatgacaccaggccagacatcagatcctctgccagatcgtcatggtccgcagcctccagtcgtccctccggagccaagagcgccatcaacatctactatggacgagcctagacatgcagtggaaatttgcagtgacattgctgagaggttagagcgccatctgagccttggggtggtcacgccaggctcatcctcacatgacgtgatccaagaatgcatcaagatggccaggagtgtgacacaggatcagctagtatatgttaggtcttga

SEQ ID NO: 5862 - DNA, 300 bp, Glycine max
  Peptide Sequence Number=SeqID_97547
atggaggatgagtcatccgagactaccactccagagcccttggtcagaaggaagaaggtagatcaaacacaagaagctgcagccacttctgagaaatctcttgagaccacttctgagcctttagaactagtggcagatacaacttcacttcagcagaccgcagacccttccactcctgaggatcagactacaccaatcctgtctctgaacacctctcttacagctacccttgtgcttcacttaacagacgaggaggatgttcagacacaggatactcaggaccagccacaggaattttga

SEQ ID NO: 5863 - DNA, 252 bp, Glycine max
  Peptide Sequence Number=SeqID_97548
atggacgccaaagtggcaacggaaagtaaaagagtagggaagaaggagacaaacactgatgaggacatgttcaagagcaagggcaaggatccacttgaaggacttggaggacctatgacaagggctagagcaaggaaagccaaggaagctcttcaacaagtgctgtccacactatttgaatacaagcccaagtttcaagcagaaaagtccaaggttgtgagttgtatcatggcccaaatggaggaggactaa

SEQ ID NO: 5864 - DNA, 71 bp, Glycine max
  Peptide Sequence Number=SeqID_97549
atgccattgaggcatttcaccgaacacttggtgggcgcatgtgatgcaatcctatcccgcaagggcattgg

SEQ ID NO: 5865 - DNA, 399 bp, Glycine max
  Peptide Sequence Number=SeqID_97550
atgaagactttaaagactaccgtggatggtaaaactgatcaagctgcacctcaatggattgaagtaaagagccatgttcaaagtggaggctatgagtatggctattatgtcatgaattggatgtgtaacatagtaagcgggggtttgaagaatgattgggccatgcggtttggtgatggcaaaccattagacaaggagaccataacaacaattcaaaacaaatgggcagcttattttgtaaaagtcaacaaatttgaggttcaacaactacactcatataaaagaggaaacataaaagagaatatgaatctggagatctcccgtgttggaccttgtggcctcaataatcttaagagggataggcttagaatgcagaagaagcaacaacaatcaatttaa

SEQ ID NO: 5866 - DNA, 696 bp, Glycine max
  Peptide Sequence Number=SeqID_97551
atgatcattgaggagggggagagcctatctgcctattctaggtttacccagctgaggccaaatccacaggaactggaagcccgactatgcatccctgggaggggatttaagctaaattcagatgggctgcctttgaagatcctgaggaagaatttaaccactctcgctcagacctggagcgtcctttcattctccaacttggcacctacctctcatacatcagacatcacactggatagggccaagttgatctacggcatcatccagaagatggacatgaacttgggatacctcatctcaaccattaacttggcttatgtgaagaaaaactgttggaaccttgatgacccctcgatcacttttcggggaccccgaaagacaaggggcaagaggtctgaggctccttcatcctatgctctcccaatctatgctccttccacatctacactagcttcattgactcccgcactagcttcagctcccactccttcaggaccttccacaagccttcataaaggtcagatcatcatcatgcagagcctacagagctcaggtctgcagcctatcatgagcatggacgagttcattagtcaggtggcttggccaggagttcagccttctcctttgggagggagtgaggccttcgcaacccaagagcctgtgccagaggaggatgagcccatccctcctgagtga

SEQ ID NO: 5867 - DNA, 1050 bp, Glycine max
  Peptide Sequence Number=SeqID_97552
atggatcctccaaggaagaagaaaaaaggacgatacgacgtcgcagagctgaaaaccctagggaaccagcttctcctcaccttcgtttcccctcctcaccacgtcctcgaatccctcctctcgcaccactccttcttcctccctctcctccccaagctcccttcctcctccgcctccgccgccgccaccaccgctctctccgtcgtcggcgaccaatccgagttcatctacctctcatggctccgttccaagttctatgagttcctcaagtccctcttcaacgtcctcgcttcgccgcagggagatgagacgctcaaggaactcgtgttggacacgctcatgcaattcgtaaaggtcgccaatggcggcgcctttcacccttctcagtaccacaagcttcttcatagtattgtttactctactagtccccctacatttttggtggatttactggcgtcaaagtatttgaagcatatcgatgtccggctgaatttatgcagtaagctcctcgtcttcaaggagattgacctgcctgataaagattatgctaagctgttgctaaaatccttggcttctatctaccagtattcaagagaactatacgaagctccttgccttttcatattctatcaaggttttgtcatggttgcatgtgtccatttcattttggatgcatatacttgtctataccttgagatagaaagaactaagctgaagtcgatggtggatcagtttgctgaactaggagttcgaaacaaaaagttaaatcagtttattgccaaaagtcctcaactactattgcggaagcccaaagactttctacaggttgagacagttgctcaatttggtgtcatttttttgctctttgcattgggcttagagctttcaacaagaaagcttcgagttgttcaggcagtggctattcttggaggcctactccaaattttcttatctatgtccttgtgtggaataacagcttcagggagggatgttgtacgcggtcttacccttgcatatgcaaagaggctgtttccggattcgaacccatga

SEQ ID NO: 5868 - DNA, 324 bp, Glycine max
  Peptide Sequence Number=SeqID_97553
atgtctcctccacctctaggacctctcaatcactcactaactcagctcaagctctcaggacggcttcctcttccagctctgtgcaaatgcacaactcatccttcttctagattcttcctcacgctcagcggatggctcgctaagccgataggttggcttagcgagaagatgctcttgataccacatgatgcagctccatgtggagcttgtaggcctttgatcttcttcatcaatggagagaaggatgattggagatgccacttcaaggagaagatgagtctagaagaagctcaccaccataggaagccatggataagagcttga

SEQ ID NO: 5869 - DNA, 213 bp, Glycine max
  Peptide Sequence Number=SeqID_97554
atggactcaagcggtgcgcttagcgggatgaaccctcgctcagtgaatatgcacagctcatccttcttccagattcttcctcgcgctcagccaagcaatggtgcgctcagcggatggctcactaagcctgcagattggcttagtgagccgatggaaatcagcacttcacaaacttgcctaattaacctgaaattgagaggaactgattattaa

SEQ ID NO: 5870 - DNA, 115 bp, Glycine max
  Peptide Sequence Number=SeqID_97555
gccaattccggaagaaggtcttccggaagcacttcttccggaattggccttcgtaacttccggaagaccttcttccggaagtggtcattccggaccttcctccttctgtgcctaa

SEQ ID NO: 5871 - DNA, 150 bp, Glycine max
  Peptide Sequence Number=SeqID_97556
atggtgattttccaccatggagatgcagcggaagacaaaggagaagagcttggagatgatgcttcaatggaggaaaagaaagagggagagaaagagagaggggggagcacgaaattgaaggaagaaaaagggagagaagttgaactttga

SEQ ID NO: 5872 - DNA, 270 bp, Glycine max
  Peptide Sequence Number=SeqID_97557
atggagaaatctgaaaagaaaaattttagtgaaaagaaaatgaagaaagcatacatcacatgggatgacaatgatatggaatcttctgaagattcagaaaatgaagaaataaacctctgtctaatggctaaaagttatgaaagcgatgaacatgtgtcttcgaggaaggaatggtacatagatagtggatgttcaaaatatatgactggagatgcatcaaaatttacacatatctctcccaagaaaagccgggcatgtaacatatggtga

SEQ ID NO: 5873 - DNA, 192 bp, Glycine max
  Peptide Sequence Number=SeqID_97558
atgaatgcattgcctagcactgttcatgtgtcctccaccaacgagtctggagccttgcgaattcattgcctagggctattcgccaattctccattctccaatgttattcggagactcatgaattcattgcctagcgttgttcatgtgtcctccgttatcaagcgcggagcctccgagaaagaagaaggatag

SEQ ID NO: 5874 - DNA, 143 bp, Glycine max
  Peptide Sequence Number=SeqID_97559
cttttgatctaaataatttaattttcgtggaacctaatgatgatgcacaatctgaggaagaccttgatgatgatggagatggtgatgaaagtgatgatattcatggagatgatcctattagaggattgaacatgcttctttga

SEQ ID NO: 5875 - DNA, 105 bp, Glycine max
  Peptide Sequence Number=SeqID_97560
atggttcagcctaaaaaaatatatatgaataagaaggttaagtggtggctggacagaaatatagaaatggcaataactgaagctacagggctccaaatgaggtga

SEQ ID NO: 5876 - DNA, 155 bp, Glycine max
  Peptide Sequence Number=SeqID_97561
atgttggatgttctggagatggccccgaggaaacttgcctcaaagagatccaggaaggataaagcggccgaaggaaccagttccgctcccgagtatgacagtcaccgctttaggagcgctgaacaccagcagcgctttgaggccaccaagggatg

SEQ ID NO: 5877 - DNA, 393 bp, Glycine max
  Peptide Sequence Number=SeqID_97562
atggagagaagtatgatagatgctgccagtggtggagcccttggagacatgacccctactgaagctagaaatttaattgagaagatggcttccaactcccagaaatttagtgccagaagtgatgttattgtcattagaggagtgcatgaagtagccacaaattcatcctcatcaggcgagactaagaagcttgaaggtaaactagatgccttggttaatgtggtaacccaactgaccatgaataaaaaatctgcacctgccgccagactctatggtttatgctcctctgccaaccaccacacagacctttgcacctctgtgcaacaatctgaagcaattgaacagcctgaagcttatgctgcaaacatctacaacagacctcctcaaccgtag

SEQ ID NO: 5878 - DNA, 184 bp, Glycine max
  Peptide Sequence Number=SeqID_97563
ggtacatcctttgtggtacaaatagagggtacatctacttggatttgactaagaacaagagaaggtacatctcttgtggatcagttctagtggagggtacatccactaggttcaaagagaacaagggagggttgaaagaaatcccaaggaccgcaggttgcttggggattggaggtaggcacag

SEQ ID NO: 5879 - DNA, 84 bp, Glycine max
  Peptide Sequence Number=SeqID_97564
atggcctctggtaatcgattaccaagggtgtgtaatcgattacaggggcttagaaatggtaatcgattacagggcttagaaatg

SEQ ID NO: 5880 - DNA, 358 bp, Glycine max
  Peptide Sequence Number=SeqID_97565
gggaggagcttgccacccagcttgcccaggcgagcaaggttccttcctctagaagcaacagccttctggaggaaggatttggaagtcccaagacgccaagtgtctcgaagcggccaatcaaaggttgtatatcatcaaataataatccccggacgaaaggaatagggatgcgtgtcgcaacctacccttcggcgggagggcacggtgtcgcaacctacccttcggcgggagggcaacgtgagactcgcgggatgcgtgttccacgaaaggaatacgcgcggagtcgccaccaacgtttatttgaggaaaacgtcggaaaaaccggaaaagacgcgatctacgaatttttaagtgaaag

SEQ ID NO: 5881 - DNA, 329 bp, Glycine max
  Peptide Sequence Number=SeqID_97566
gaaacgatcctgagacgggtgactctgataggtgcggcttgtacatagaagcagatcttgcccgcatggttgacatggggagagtttatgagggatccactattgttcataacactcctttgttgcctggccaagtaaaggtagttgtgtctccggcaaaaccacctccaaagcccgatccggaggtcgatgatccgctttatctaatgacattgaccatcccagagcttttattgaggccttatcaggttccactgcagtggacactggcagatggtggtcatcctgcccaaggaacacctagttgtttggttttgttcattggataa

SEQ ID NO: 5882 - DNA, 573 bp, Glycine max
  Peptide Sequence Number=SeqID_97567
atgttggaaagttttaaacaacaacaagaaatgtcagttctagaattgtacatagaaaaagatgtggctggtggttcaatgtttcattctgcaaattcccttacatcatgtggaaattatgtatctaatgattacacacaaccgccaacaaatatgagcaatttaaatcttgacgaagatgatgatcatgatgatgatgattatcttgtgtctaactcatacgttgaagagtcgttagacgaagatgacagtgttgacgatatatcagatacagacaatgaagtccccgagatgattccaccagtaagaattgttcacccagcagaaggtgtacaaggaattcagaatccattttggaatgatgctttgcattataataatatcaactggagtcatcctgatgaggaggacatttgtggtttggagatgccatccacttttaatgctggccaagaattatatgttggcatggaatttgatagtaaagatgcggtcaagaatgcggtcaaacaatatgttatgagggtgcatcaaagtttcaaagtggttgaaagcaaatgggacaagtatgtg

SEQ ID NO: 5883 - DNA, 790 bp, Glycine max
  Peptide Sequence Number=SeqID_97568
gattcgtttgaggagcaggaccacacagggatcgttcgtcccccatggacagcaccctggacgtatccgtgctgctggagccggtgtcaccatcaagcaatactttggatcggctccacggacgtcccacagcgcttcctccctgcctcctgacgaattacagcagctaacccagcagatcagggacaagctagaggagtccatcacagagaaagtgacgaggcaggtcatggcatccttcagccaacttcagtcacagatgcaatctcaggcacctcctgagcctctggttggtcctggtccctccagtcctcgggtgagcacaaaggggagttgtgttgatccctcaggaaacgatcctgagacgggtgactctgacaggtgcggcttgtacatagaagcagatcctgcccgcctggttgtcgtggggagagtttatgagggatcgactcttgttcataacactcctttgttgcctggccaagtaaaggtgagtgtggacgaggttaaagatgcagatgctccagttcctgtacccactgctgaggtagctgtgtctctgccaaaaccaccttcgaagcccgatccggaggtcgatgatccgctttatctgatgatattgaccatcccagagcttttcttgaggccttatcaggttagatgggatgccaccgtgttcggggtcgttattccagatttccccctgtacataaagcacgaagacctctccgaaatcgcacacggtggtcaatgtctcagcatatcagtgttacagttgtggattctgtaa

SEQ ID NO: 5884 - DNA, 177 bp, Glycine max
  Peptide Sequence Number=SeqID_97569
atgggcccaaaatctaccctaaggctcatgagaaccttagggcattcacagagggataggcgcttagcggttgatggatcgcttagcgctgctctgatcacccttgcccagcttagcggaccaaatcagcctgagaggcaagggttgagcgctaagcgccagagactctcggcttag

SEQ ID NO: 5885 - DNA, 213 bp, Glycine max
  Peptide Sequence Number=SeqID_97570
aacattcaagaaatcatgtcaaacataatcaggattgagaaattcaatggaaagaacaacttcaatctgtggcgcatcaagatgcgtgctttgttgaaggaacaacatgtttgggctcctgttgcttctgcatctgtgaagaaagaagtggcttctgaatcaaaagaaaaggccgttgtttcaaagactgaagaacttgcagaacaagaataa

SEQ ID NO: 5886 - DNA, 252 bp, Glycine max
  Peptide Sequence Number=SeqID_97571
atgaaagattgcagaattacaagtagtggggatgtctcctccacctctaggacctcacaatcgctcacaaactcatctcaagctctcaggatgacttcctcttctagctttggtctctgcagatcttcacacaacaaattctctcaaactctctggaacttggacctttctctctctagaactcttcaaatttgcagaagcttcaagaaaaggccaaactcccctccaaaatcagatttcaggctaaaatag

SEQ ID NO: 5887 - DNA, 233 bp, Glycine max
  Peptide Sequence Number=SeqID_97572
atggcatcttcgtcatcatcttcatctagtatacacattaagtctggtccaatagaaggagacgtcttatggctgcaacctaaacatgtttccgaacatgtttggaatggggaagcagacataaaactacatatcagacgagctgtacccatcaatcaaggacaagaagaaataccagaggaaattattcctctgcttcgccaatcaggattctattggataatgaaaatggg

SEQ ID NO: 5888 - DNA, 222 bp, Glycine max
  Peptide Sequence Number=SeqID_97573
atgctctcagaaacgaaaacttcgcgcacactccagacatcttctcaaagatcccaacggtcagatcgtggacaagtgtctgtgcagcccgagaccaaatttcgagaagatccaacaattaacgaaggctgggaagtgtttttactgagacagcttcatgtagcttctttgagaagcttcattaagaggcttcctcgagaagcttcctcgtggcttctttga

SEQ ID NO: 5889 - DNA, 225 bp, Glycine max
  Peptide Sequence Number=SeqID_97574
atgcgggatgaaccggaagcgggttacggtgcccaactgcgcgtactagaccccacaagcctgcccaccctggaaacggctcagccggaggtagggtccagcggctggaagagcaccgcacgtcgcgtggtgtccggtgcgcccccggcggccattgaaaatccggaggaccgagtgcctcccacgcccggtcgtactcataaccgcatcaggtctccaaggtga

SEQ ID NO: 5890 - DNA, 198 bp, Glycine max
  Peptide Sequence Number=SeqID_97575
atggtgactgatgaaggagaaaaaacttgtcctctttgtgttgaagagatgaatttgacagatcagcagttgaagctttgcatatgcggttatgagagagtattttgctcagtattggaaggtcttaaaaagtgtcaatgtctcgaacaacatctggtgtcattcaacactcttccgaatgatacttgcagtgtgtaa

SEQ ID NO: 5891 - DNA, 1392 bp, Glycine max
  Peptide Sequence Number=SeqID_97576
atggagcttatggggaaacaagagcatgaaatcatgaccttgaagaaccaacttgcatctaaagagttcagagataatttgctttcaaataatccagagtttgaaaacaagtcccccttacaggtaaaactcagaaggatgcatgattgtcttgaaaaagcaaagcaactgaacatgtcgtaccaaagtgatcatgcattccagatatccaatgaggaagagagggatgaaatccgtcggcaggcagaggctgaaactgttgaggtaattgtctgtatgcaagaagaacttgcccagctccagcatcaaaaaaaaatgcttactactattgatgataatagaagtttaaaggaggagcttggccaaaaagatatagaactgacatcactggcagaagaatgggaactgttaacctctgagattgaagaggttcttcttgatggatgtgaggcaatagttgatgcctctgaagaacttgggaatataaggaattcatttccacagaaaaggattaggatttttgaacaagttggcatgatagttagaaaaatttctgagaatgaattattaattgatgaacttagaagatgtttggaagatgcaagaaataaaagaagtgatatggagtgtatgctgaagtccttaagaagtgcagcgttagtcattactaaatcttgcaagaaggactgtgctgaaaatgaaaaagaaattctcctattgacctcacaattgagtgaaaaaacatctactttggtcaaaagtggaaatgatacgaaagacctaaaatcaagaaaagttggcaagaatgtgcttgaaagagatgctactattaggcttttgagaaaagaaatcgaatgtgctcttgaaagcttaaaagaagtgcaatatgagatggccagattacatgaagaaaaaaaagagatgtcagtgtctgaaaagaagagtcggcaaagcatagagtgcctcacaaatcacatacttttcctacaagaagctatgtatcactttgaggagaaatctaaagtcaagattgatgtactcagtcacaaacttagaggcctggagaaacctctgaaagaagccaactcccattggtaccaaaggaaagagtcacttgaacttgaagttggagaggcaaagatcattcaagctcagaaagctcaagaggcatcttttattcttgctaaatttgaagaagcacaagatacaatgagagaaacagatattatgatcaatggattggtgatagctaatgagtcaatgaagatagatatagaaagactgaaagacagagaaatgactttactcaatgagaagggtacattagtcagcaatattgaaagcttacaaactactgaaacagttaatgaaaaagaaagtagtggccattga

SEQ ID NO: 5892 - DNA, 558 bp, Glycine max
  Peptide Sequence Number=SeqID_97577
atgttggcactgcttattttctgctctaaggatgaagaagctttcaaagagtgtttagttgagataattaataaggatgaagaagctttcaaagaagccatatttgctgcactacaagagctctttgatctccctctacaaacaaagatactcaatgtgtctaagaagccttatcatggttatgttgggcaatatcctatggtcccactttttgaaagtatgggcattgatgatgcaaatgtctatgaaaatgtagaaagcatgacaaacatcatgtggcctcatggaaacccaagttttaggcatatgattttggagagtttgggtgttgaaaagtacttggatgagcacatgaactcaaccaattatcttctcgaggttatgaaatacaaaggccctcaaactagtgacacaaaggttggcctcacaacacactcagacaagaacatagtgaccatattgtaccaaaatgaagtggagggtttagagtttggaatgggaccagttattaagcaattcctcaattccctgagtaacagaaatatgatagaagcctaa

SEQ ID NO: 5893 - DNA, 162 bp, Glycine max
  Peptide Sequence Number=SeqID_97578
atgaaagatcttggtgacgcctcctttgtattaggaattaagatacaccgagatcgatctcagggtattataggattatcacaaaggagctatatcgaaaagtgccaagcaaactcttactacttcatccactatggcggcataatttgtggcatgctatga

SEQ ID NO: 5894 - DNA, 439 bp, Glycine max
  Peptide Sequence Number=SeqID_97579
atggcttttcgtcttacagaacaacaaaaagtttatacggataaccactcgggtatttacgcccgtcagcgtgactcaaaagtcagtatgacagatcttgtgagcgcggaagatgacgtaaatctccgcgtgtcaacgggcttgtcggccgcgattgacgaagggtcgcagaagacgacgtttgtctctgcgtgttatcaggcttttcgtcttacagacagcaaaaagtttatacggataaccactcggggcgcagaagacgaccgtgagtcaaaagtcagtatgacagatcttgtgagcgcggaagatgacgtaaatctccacgtgtcaacgggcttgtcggccgcgattgaggaaggcttttcgtcttacagaatgcaaaaagtttatacggataaccactcgggtatttccggccgtcagcgtgactcaaaagtca

SEQ ID NO: 5895 - DNA, 510 bp, Glycine max
  Peptide Sequence Number=SeqID_97580
atgcataaggcattgcgattgaatgctccattgccttaccctcatcttgttaccctttgggttcagcacttcaacatccctcttgattctgaaccttatgtttcaatcaagagatcttttcttataggcacttcagtcatagcatctttttcttatcaaaaggagcatgatggctcttgggtgaagaaaggtactcgacatgttggtgaagaaggacatgatggagaggattcatctctcctttcaaagattttagacaggtttgatggtcttcaaacctttgtagaagttgtcatcatcaaaaagggggagattgtagaagcaaagcttcatgatgaatcaagaatgataacaaaagatgatgacaaaggtgatgacaaaaagctcaaaggtcaattaaagaatgagttcaagatattcaagatagaatcaagaacacttcaagattcaagaggaaagttgatttcaagaatcaagagatcaagatttcaagaatcaagatttaagtga

SEQ ID NO: 5896 - DNA, 903 bp, Glycine max
  Peptide Sequence Number=SeqID_97581
atgggttccagcaaaagagggatgttgaacgtattgatcgccgccgtcctgtggggcagttccggggtctgcgcgcagtacattatgcagcaaagtcagatgtcatcgccctatctgaccatgatccgcctgctgttcgccgggctgattttgctgatgctcgccttcgttcacggcgacaaaattttccgcgttatgcaaaaccgcaaagatgcccttagcctgctgtttttctcgctggtcggcgcgttaaccgtgcagtacaccttcctgatgactatcgagaagtcgaacgccgccaccgccacggtgctacagtttttgtcgccgacgattatcgtcgcctggttcgcgctggcgcgtaaggcgcggcccagtccctttgtgctactggcgattggcacctcgcttgccggcaccttcctgctggtcacccacggcaacccaacctcgctctccatctcgccggcggcgctgttctgggggatcgcctcagccttcgcggcggcgttttataccacctatccctcaacgcttatcgcccgctacggcacgctgccgatcgtcggctggagcatgctgattggcggggcgatgctgttgccgttttatggcagccagagcgcgaactttgtagtgaacggccgtcttctgctggcgtttttctatctcgtggtgatcggcacctcgctgaccttcagcctgtatctcaacggcgctcagaaaattggcggcgcgaaagccgggatcctcagctgcgccgagccgctgagcagcgccctgctctctctattgctgttgggcattacctttactctgccggactggctggggacgctgttgattctctcttcggtcattcttatcgcggtggattcccggcggcgggtacgcgcggcgtaa

SEQ ID NO: 5897 - DNA, 978 bp, Glycine max
  misc_feature (970)..(970): n is a, c, g, or t
  Peptide Sequence Number=SeqID_97582
gcgacgacatgcagcactctgaaggcgaggacgtgtagccctctgaaggcgaggacgtgtagtcctctaaaggcgagggcatgcaaccctctgaaggcgaggacgtgtagtcctcaaaagtcctctgaaggcgatggggtgttgccctctgaaagaagggttagggcatgtagacctctaaaggctagggcgtgtatccctctgaaggcgaggacgttcagtcctctgaaggcgaggtcgtgttaccctctaaaggcgaggacgtgcaagaggacatgtagtcctctaaaagcgagggtatgcagccctccgaaggcaaggacgtgtagtcctcttaaggcgagggcatgtagccctctgaaggcgacgacgtgcactcctcagatgacgagggtgtgtagtcctctgaagttgagggcgtgtactcctctgaaggcgagggcgtgtagccctctgaaggcgaggacgtgcaagaggacatgtagtcctctaaaggcgacggcttgcagcactctgaaggcaaggacgtgtagtcctcttaaggtaaggacgtctagtcctctgaaggcaagggcgtttagtcctctgaaggcgaggacgtctagcccacttatggcgagcaggtgcaagatctcatgtagtcctctaaaggcgagggcatgcagccctcttaacgtgaggacgtgtagtcctctgaagttaaggacgtgtagtcctctgaaggtgaggacgtctagcccgcttaaggctagggcgtgtagcgctctgaaggtgaggatgtgtagtcctctaaaggcgagggcgtgtagccctgtaaaggcgagggcgtatagccctctaaaggcgagggcatattgcccgcagaaggcgagcatgtctagtcctatgaaggcgagggagtctaaccctatgaaggcgaggggtgtgcagccctctgaaggcgaggacgtgcaatcctctgatggcgagnacgtgtag

SEQ ID NO: 5898 - DNA, 328 bp, Glycine max
  Peptide Sequence Number=SeqID_97583
agaaagaaggaagagagacgggagtcgtcatagactaatcacgaagagggcgaagacggacgaaatagtgttttatcttttctttcctcttatctccgataaaaggtacttggcaccctttattgcacaatacgtgaagttccgtgacatgccagagatcaaaaggaagcattgttacacaatccgtgagattccgatgttcctccagaaagcggttgcttctggagaaagcaacctggctcgcttgggcgagctgggtggcaagctcctcccctattttcctataaataaggagaggagtgaaggagaaaggggttcaactcttctg

SEQ ID NO: 5899 - DNA, 267 bp, Glycine max
  Peptide Sequence Number=SeqID_97584
atgtcatcaaccccgccgactgctccagttgacgaagaagttggtgatcatatagaagacatgctacgtgatcttggacaagagggttttaggaaagcacattcaccttactatgaaagcttagatactgattctacgactccattgtatatgggatgcacaaactgccctacatgtggagcatcacgttacaaagtgaagtttgacgtgttgatgcaagcacatacaaagattgtccatcaaaagtgtgttggtatctgccagtaa

SEQ ID NO: 5900 - DNA, 138 bp, Glycine max
  Peptide Sequence Number=SeqID_97585
atggataagagcttgaaggtaggagaagatgagtggagggagagggagagaaagggcacgaaattttgtgcttcaaaagagcccactaatccaagatcaagtacaagattctccactaagtgtgctaaggtgtcatga

SEQ ID NO: 5901 - DNA, 414 bp, Glycine max
  Peptide Sequence Number=SeqID_97586
atgacaagcagagacaaaatttggtcattctgcacccttgtgtcatccaaaggcggcgggcccgatgatacgcggagataccttacggttcacccttttgtcatccagaggcggcgaataggtcatcacattttgtgggaccttcttgatgacatgcagagaccaaaatttggtcattctgcacccttgtgtcatccagaggcgatgaatacgcggagataccttacggtcatgccacccgcaacttgtcatccagaggagcggaaatacccgagtggttatccgcccacttgggccctccagaatattcctcctgaaggctgttgcttctggagggagcaacctggctcgcctgggcgagctgagctcgcctgggcgagctgggcggcaaccacttcccctattttgctataa

SEQ ID NO: 5902 - DNA, 906 bp, Glycine max
  Peptide Sequence Number=SeqID_97587
acgaagaagaacctgcacagtcaggaagcgttgatggcgtcatcgaccctccatccccagtcagacgccacgtgaagtggaagatggtccgcacaaagaaaacagaggagatgacgactgaggccacaaaggaaatcgctgagaagattgattcctttgaggagcaggccacacagggatccttcgtcccccatgggcatcaggatgttctcaccgttgctattggacgtccagagcaccctggacgtgtccatgctgctggagccggtgtcaccatcaagcaatactttggatcggctccacggatgtcccgcagctcttcctccctgcctcctgaagaattgcaacagctgacccaacaaatcagggaccagctagaggagtccatcacagagagagtgacgcggcaggtcatggcatccttcagccagattcagtcgcagatgcaatctcagggacttgcaccctctggaaacgatcctgagataggtgactctgataggtgtggcttgtacatagaagcagatcctgcccgcctggttgccatggggagagtttatgagggatccactgttgttcataacactcctttgtgcctgccaagtaaaggcaattcacaccttcctttcttggccgacacatctgatcaagtctttatcacagcagcatgcctcaaattagggcatttaactttctttcatgaacaacctattgtgtctccggcaaaaccacctcaaaagccggatccgaaggtcgatgatccgctttatctgatgacatttaccatcccagagcttttcttgaggccttaccaggttacatgggatgccaccgtgtttggggtctttaatccatacttcccgctctacataaagcatgaagacctcttcgaaatcgcacacggtg

SEQ ID NO: 5903 - DNA, 195 bp, Glycine max
  Peptide Sequence Number=SeqID_97588
atgaaagttaaaagttggaagtggaagttggaagttggaaatgaaagttattggaagttggaagttggaaatgaaagttattggaagttgaaagttgaaaatgcaggttggaagttggaaggggaagtggttgtcatcatcaaaaagggggagaatgtaaatcatgaagattttgatgatgtcaagaagaattaa

SEQ ID NO: 5904 - DNA, 255 bp, Glycine max
  Peptide Sequence Number=SeqID_97589
atgcaattatcattcaagggggggtcagctgtttctgcaactggtgaatcaggaggagcaactgcttcatctgatgatgcgtcagaaatgacaatcagagaaggagatgggggaactacttcaagttcaggcgaagaaggtggatgcaccattggatattgtgggttagctggctctgaattgacctgcataggtgtgggctcaagcggagcagcctcgttgggtctcacgaatggaagttgggcttcaggctag

SEQ ID NO: 5905 - DNA, 255 bp, Glycine max
  Peptide Sequence Number=SeqID_97590
atgtcatggaacttcacgtattgtgcaacaaagggtgccaagtacctcgaagcggtcaaacaaaggttgcatgccatcaaacaatggtccccggatgaaattagggcaatcaattcgtggggctccagactcgatggtggaggatgcatgaatgacaatcaattcatggggctccggataagatttgagggtggaggatgcatgaatgacaatcaattcatggggctccggataagatttgagggtggaggatag

SEQ ID NO: 5906 - DNA, 159 bp, Glycine max
  Peptide Sequence Number=SeqID_97591
atgctccaaccatgtgggatcggcacaggcttaaaggagcactcaaactgggtgacccccaagacctacactctgaagagttcgttagggcctctccctcctgattcagacactgctcatgaattatacaatacccacgacctcacactcgtgttttaa

SEQ ID NO: 5907 - DNA, 87 bp, Glycine max
  Peptide Sequence Number=SeqID_97592
atgggatacttacttgttggagtgagtaggagtaccaaaaatgaaagcaaaatgcaaccaaaggggttgctcgcccaggtgagctaa

SEQ ID NO: 5908 - DNA, 378 bp, Glycine max
  Peptide Sequence Number=SeqID_97593
agacaggcccagggggatgctccgcaggccgcagacgcgccgccacctcatcaggctggcccagctggatcatttgatacggagcactatttacggcatttggttcgccagcagacggccaaccaccgggcgcatatacagacccatgattgtctttaccagttgagcctcagcctgcagagccagggttttactttttttccatgccctactccggatcagttcagggcagaggtcgcatggcccggagattggcctgaggcccaggcaggagaggcaccagtagaggcacaagcagaggctcccgacgagaagattctcgaccgttcgtcaacattcatcgttcgttcttctttttcttcagtcttcaacgggtaa

SEQ ID NO: 5909 - DNA, 288 bp, Glycine max
  Peptide Sequence Number=SeqID_97594
atgaattcaagaatcaagattcaaggatcaagcttcaagaatcaagatcaagattcaaggatcaagcttcaagaatcaagatcaagattcaagattcaaaattcaagaatcaagagaaggcttaatcaagataaagggtacatctacttgggtttgactgagaacaagagagggtacatctcttgtggatcagttctagtggagggtacatccactaggttcaaagagaacaagggcgggtacatcccttgtggatctttgcttgtaaaaggatttttacaaggttga

SEQ ID NO: 5910 - DNA, 288 bp, Glycine max
  Peptide Sequence Number=SeqID_97595
atgacagccattggcgtgagagcacttacaagggacgaagagaatggttggaagtggaatcaaggggaagaagagaagtatgtagtgaaggagatgtatctacagccacatgcagggaatatctcgaatgaggaggaatcttcttgccaactgtggaagctaaaagttccatcaaacattaaagaggagagtggcaaaccaaagcaatatttgatgaggcaagatataggacttggtgttggtgcagagcaaaggaattatggaacatatgaagataagggtgggtaa

SEQ ID NO: 5911 - DNA, 6382 bp, Glycine max
  Peptide Sequence Number=SeqID_97596
ctgacagaatggagtctgtgttgtccccgatagtggaacgaacctttaattttgcggtggaccccattattcggcagttggcctacatcctccgttgcaggcaaaatgttgatgaactcttgactagttttgagagtcttgaacttgaaaaagagtccatagatcgtcgatgtgaccaagctcagaataatttacaaaacattgaagccaaagtcaaagaatggtcaaggaaagtagatgagttcaagactgaactagagaagtttaggaacgatgaaggccacacaaagacagggttgtccaatgttttatttttatttccttacttttggaataggcatagacttggcagacaagctaagaagatggcagagattgtcaagaatctaatagatgagtcggccaagttcaatgatgtttcctacacagacaacttaacatttaatgatttcactttgtctaatccgggctacatgggatttgcttctagacattctacagtggaaaaaataattgcaaaacttgaagattcctctgtaagaatgattgggctgcatgggagtggtggcatgggtaagaccactttaatcaaagcaattgctaagaaagctatggagaagaagctgtttaatgtggtggctgtatcagaaatcacagccaatcccaatccacaaaaaatccaggaagacattgcttaccggttaggattgagattggaaggggagggtgagaatgctagagctcatcgtctgatgacgaggttaaagcaagagaaggagaacacccttataatcttggatgacctttgggacagattagacttgaataagttagggattccacttgatggtgatgttgatgataatgatttaaacacgaagacaagcaatgctaaacagggtcccaaagaggtgactaaagaaaaatctcttggtgattataagggctgcaaaattttgctaacttcaagggataaaaacgtattaactgataaaatggaagttaagtcaactttctgtgtagaggaattagatgacgatgatgctctgaggttgtttcggaaggaggctagaatacagggtgaaatgtccaagtggaaacaagaaattgttaagaagtactgtgcagggttacctatggcaatagttacagttggaagggcattaagagacaagagcgactcagagtgggaaaaacttaaaaaccaagacctggtgggaattcagaattctatggagatttctgtaaaaatgagttatgaccgtctagaaaatgaggagctcaagtccattttctttctttgtgctcaaatgggtcatcaatccctaattatggacttggtgaagtattgctttggtttgggaatacttgaaggggtctactcgcttggggaagctcggggcagaatatctacatcaatccaaaagctgaaaaactcaggtttagtattggatggaagttctagtattcatttcaatatgcacgatctggttcgagatgctgctttatctatagcacagaacgagcaaaatgtatttactttgagaaatgggaaacttaatgattggcctgaactcaagaggtgcacttctgtttctatatgcaatagtgatattattgatgagcttcctaatgttatgaactgccctcaacttaaatttttccaaattgacaatgatgatccatctttaaaaatacctgagagtttttttaagagaatgaaaaaactcagagtgttaatattgactggctttcatctatcaagcttaccatcttcaattaagtgcctatcagacctcagattgctttgtttggagcgatgcactttagatcacaacttatccatcatagggaagctgaaaaaattaagaattctcagcttttctggatctcaaattgaaaatttgccagctgagttgaaggacttggataaactacaattactagacatcagcaattgttcagtagtcaagaggattccacctaatcttatatcaaggttaacttcgttggaagagctgtatgtaagaaagtgtttcaaggaagtgtcagaggaaggagagagaaaccaaagtcaaatttcatttatttctgaactaaagcatttgcatcaattgcaagtggtggacttaagcattccatgtgctcaagtttttcccaaggaattgttctttgacaacttaagtgattacaagattgagattgggaacttcaaaacgctttcagctggagatttcagaatgcctaataagtatgaaaagttcaaatctttggcattggagctgaaggatgacactgacaatattcactctcagaaaggaataaagttgttgtttaaaagagttgaaaatttgttgttgggagagctgaatggtgttcaagatgttattaatgagttgaatttggatggatttccacatctgaaacacttatccatcataaacaaccctagcatcaaatatatcatcaactcaaaggatttgttttatcctcaggatgtttttcccaagttggaatctctatgtctttacgaactaagaaagatagagatgatatactttagttcaggtacagagatgatatgctttagtccatttacagattgctcattcaccaaattaaaaaccatcaaggtcgagaagtgtgaccaattgaagaatcttttctccttttgcatggttaaattgcttgcaagtcttgaaacaattggtgtttccaattgtggttctttagaggagatcattaaaatacctgacaattctgataagattgagtttcttaagttattgtctttgtcacttgaatcattatcatcattcactagtttttataccacagtagaggggtcttctacaaacagggatcagatacaaattactgttatagagaatgagcatagtgagatggctcctcctctttttggtgaactggttgaaataccaaacttagagaacttgaatttaatctcaatgaacaagatccagaagatatggagcgaccagccccctttgaggaaactgaaaggcctctttgtaagcaagtgtaaaatgatggagaagatttttagcacagaaggaaatagtgcaggcaaggtctgcgtctttcctaagttggaggaaatccacctcgactacatggataagttaacagacatatggcaagctgaagtgagtgctgattccttttctagtctcacttctgtgtacattaagagttgcgataaactagacaaaatttttccgagtcacatggaaggatggtttgcgagtttgaacagcttgaaggtttattcttgtgagtcagtgaaagtgatttttgaaatcaaagattctcagcaagcagatgcatctggtgggatagacacaaatttgcaggtttttgatgtaaggggactcctaaagttggagcaggtgtggagcagggatccaggaggaattcttaacttcagaaaactgcagagcatagagatgtatgattgtaaaagtctgaggaatgtatttccagcttctgtggccaaagatgttccaaagcttgaatacatgtcggtcagatggtgtgatggaattgtggaaattgttgcctgtgaagatggatccgaaacaaacactgaacaattagtgtttcctgaactaaccgacatgtgcttatatgacctatcaagcatccagcatttctacagggggagacatcctatagagtgtccaaaattgaagaagttggaagtaagggaatgtaacaagaagctaaaaacattcggaaccggagaaaggagcaatgaagaagatgaagcagttatgtcagctgaaaagatattccccaatttggagtttttggatattgactttgacgaagcacagaagtggttattgagcaacactgtgaagcatcgaatgcaccgtttaaaagagcttaggttaagccaagttaatgatggtgaacgtctctgtcagattctgtacagaatgccaaatctagaaaagttacagttgtgggaagctgaacatttgcttaaagagtcgtcggagtcacgtttgggaaccgtattacagctgaaggaattggttttgtgggagtcagagataatggatataggatttgaacgagaaccagttctacagagactagaggttttgagcttatatgagtgccacagattgaggaatttggctcctccctcggtatcattggcttacttgacaaatttggaagtaagagattgtgttagattaaggaatttaatggcatcctcaacggcaaaaagcttggttcaacttaagtccatgaagataagcagatgtgatgaattagaggaaatagtaagcgatgagggaaatgaagaagaagagcaaatagtgtttggcaaattgattactatagtacttgaggggctagaaaagctgaaaagtttttgcagttacaagaagtgtgaattcaaattcccgtcattggaagtattgattgtgagagaatgcccaatgatggaaagattcacggagggtggcgcaagagcagcaaagttacaaaacatagttactgcttatgaagaaggaaaagaggaagccaaatggcagtgggaaggagacttgaatgccaccatacaaaatgtttgggaagatcagcttttggagtctgcaagtactgtatcatctcttagtctgctcggagatagcccactacaagtgatatggcttgactcacggcggatcccaaagtcgtgcttcagtaacttgaactctttggctgtggagggatgccaatttttaacagatgttgtcatacccttctatttacttcctttcttaactaatttggaagaattacaagtccgaaagtgtggttctgtgaaaagcatatttgacgtgaaaacaactacgggattgggagcagcagccttccctagacctctccctttttccctcaagaaattgactttagagaggctgccaaaactggagaatgtctggaatgaagatcctcatggaattctaaccatgcaacttctacaacatgttattgttgagaaatgtaaatgccttacaagtgtgtttcccgcatcagtagccaaagatcttgaaatactagttgtcaaagactgtgaggaattgatggaaattgttgcagaggataatgcagatccaagagaagacaatctagagcttacgttcccttgtccctgtgtgaggtcattgaaactacaaggtttgcccaagttcaagtatttttattactgctcactgcagtgtgacatgttccagacacctaacgaagatgaaatgcctacatccaacttgaagtgcctgtcactcggtgaaaaaggactggagatgatcaagcgtggagaatttcagagaaacttcatacacaagttacaagttcttactctgtgctttcataatgggtcggatgtattcccatatgaaattctacaactggcgcccaatatagagaagcttgtggtgtacaatgcttccttcaaggagattaatgtggattacactggactcctattacagctcaaagacctatgcttggagtcccttccagagcttgtttccattggacttggtaccatctacagtgtctttctccaatctgacatatttggaagtagaaagatgccattgcctgctatatttgttcacatcctccacagcaagaagtttgggtcaactcaaaagaatggagataaaatgctcaattgtttgaaacttgaaagaataggaaagctgagaaggttctacagaggaagtttattaagtttcccatcattggaggaattgtcagtaatcaagtgcgagtggatggaaacattatgtccaggtaccctaaaagcagacaagttggttcaagttcaacttgaggagtcatcagatgctatcaaattggaaaatgacctgaactctaccatgcgggaggcatttaggaaaaagggaaaccacttaaacgagttaaaagttcttgctctgttctttcatattgagtccgatgtatttgtacaacgggtgcccaatatagagaagcttgaggtgcttggtggtttcttcagagagattttctgctttgatagtcttaatgtggatgaggcgggattgctttcacagctgaaagtgatatgctcggactcccttccagagcttgtttccattgggtcagagaactctggcattgtgccctttctcagaaatctagaaacattgcaattgcaagagtctgctatatttgttcacatcctcaacagcaagaagtttgggtcaactcaaaacaatggagataagttggtgattaagaaagctgagaaggttctacaaagggagtttaagtttcccgtccttggaggaattcacagtatggcgttgcgagaggatggaaagtttgtgtgcag

SEQ ID NO: 5912 - DNA, 483 bp, Glycine max
  Peptide Sequence Number=SeqID_97597
atgtgggcttttcataaagtccgacaaattgattgggcacacttagtccgatatcgcatgcataaggcattgcgattaaatcctccattgccatatccacacctagtcaccctcttccttcaacactttaacatccctcttgattctgaaccttatgttccaatcaagagatcctttctaataggcgctgctgtcattgcatcctttggatatcaaaaagagcatgatggctcttgggtgaaaaagggtgctcgacctattgatgaagaaggacatggtggagaagattcctctcttcttcaaaagattttggataggtttgatggtcttcaaacctttgttggtgaaaggtttgatactttggagttacaagtggacatgggcttcaatgagatggagtcaagaatcaccaaggtcgaagaagatgtttcttatattcatacaagctttgatctacctccaccgccgccaccatcatcttag

SEQ ID NO: 5913 - DNA, 288 bp, Glycine max
  Peptide Sequence Number=SeqID_97598
atggacaaagaccaattaatgtatgaagaagttgatataaatgttgaaaatgaggaagatgctgacgttaaaatagaacacgttgattgctttgatgcctttaatacttctcagttgtttgctagtcgtgatgaagttttacaatgggctcaatcgttggctcatgatattggatttgttgtcgttataatgaggtcaaacaccaatactggtgttcttggaagagccttatttctgttgatagcttgtgacaggagtggtaagtataggcctaagacacataatttg

SEQ ID NO: 5914 - DNA, 147 bp, Glycine max
  Peptide Sequence Number=SeqID_97599
atggccgacagcgggcaacagatgcgccgccgccacctccagagccccttaactcatctacaaaggctggagcgttgcctacgacccgtggccgaccagcaagcgaccaagttcaaagccaaagggaaaatgaatcctgagccctag

SEQ ID NO: 5915 - DNA, 186 bp, Glycine max
  Peptide Sequence Number=SeqID_97600
atggaagaagatcacaagaagactctcaagttcttagatgttacaaatgcaaccaacttggccacatcaaagcaaattgtccttcaaatgaagaatggcctgagaaaagtgataagaaaagaaaaggaaattaatcttctaaccaaggattatgagagtgatgagaaaatttctcaagaaggttaa

SEQ ID NO: 5916 - DNA, 270 bp, Glycine max
  Peptide Sequence Number=SeqID_97601
atgtcgtacaggatgtcacgacatcacgcttcagaacatgcagattatatgtgtccgtatgaacagattaaacaaccactgtctacaaccttctcacctaaccactacccgtgcaatctctacctaagagccactcttagatatgagaaccccgctcactccctctcaaccacactcccgtgtttacaaatcaatcaaagacacaccagagatttctctctgaacaaaagggatcaaccctacacactagagatcaactctacacactag

SEQ ID NO: 5917 - DNA, 531 bp, Glycine max
  Peptide Sequence Number=SeqID_97602
atggtagccacaacctaccaaacatctcatgagtgtccggaagaaaccattattgatatcctagtagaaggattttccagacagttgaaagttaagacgaatctcaacggaaaagtcattactaatgacgataataagaagattcctgacgctgttaatacacttatatttacaatagcccaacattttattggagaccggtctctttggaaagataggtctgcagaattactatccaatcttaagtgtagaacattagcagattttaggtggtacagagataccttcctaactagagtttacaccagagaagatagtcaacaacctttttggaaagaaaaatttctagccggtcttccaagatcattaggagataaagttagagacaaaatccgtagccagtctgctaatggagacattccatatgaaagcttaagttacggtcaattaatctcttatgttcagaaagtagccttaaaaatatgtcaggatgacaaaattcaaaggcaactagccaaagagaaagcctaa

SEQ ID NO: 5918 - DNA, 267 bp, Glycine max
  Peptide Sequence Number=SeqID_97603
atggataaagctgtgtctataatatgtccattggatttaatgatgaaatatgtgcaatttcagttgagcttagctcatcactgggctaagcgcgcatccaccactaagcgcagcttcagcgtgcttagagcgacagaagaatctggcagggcatcaatatcaaggccgcgcgctaagcgcgagatcagtgcactaagcgtagcagctgtcttcagtcaggctgagcgcatgactagcgctaagctcaaatccacttactcgtactaa

SEQ ID NO: 5919 - DNA, 297 bp, Glycine max
  Peptide Sequence Number=SeqID_97604
atgtttgcacattcgattaaaaggctgccgtcccttgggacagacgtgtggggtactaacaccttccccatgcgtaaatacaactcccgaacctttcacttaaaagttcgtagatcacgtcttttccggtttttccgacgttttcctcaaataaacgttggtggtgactccgcgcgtattcctttcgtggaacacgcatcccgcgagtctcgcgtcgccctcccgtcgaagggtaggttgcgacacaacgaaaaagaaaagctaagtgccgaaaggcaagtaatagagctagaataa

SEQ ID NO: 5920 - DNA, 183 bp, Glycine max
  Peptide Sequence Number=SeqID_97605
atctacggagtgcctgtcgcccccagcaaggccatcaggccccctactaatcgagctttcatcaagaagtactgcgccccccgacaggtgcagggcgaaacaccacaacagcctggggatggccggcagcgggcaacagacacaccgccaccacctctagagttcacctcagctcatccataa

SEQ ID NO: 5921 - DNA, 249 bp, Glycine max
  Peptide Sequence Number=SeqID_97606
atgccatttgaattggctcagaggttcaaaattcaatttcgagcgtctcgttatattacgggactcaatcatacatccgagaaaaagttattgtcatttgaattggctcataggactcaatcagatcatccgagtaaaaagttatcatcgttagaattggtcagagcttcaacagtcaatttcgagcgtctcgatatattacgggactcaatcagacatccgagtaaaaagatattgtcgtttgaatag

SEQ ID NO: 5922 - DNA, 765 bp, Glycine max
  Peptide Sequence Number=SeqID_97607
atgaccaccgtgacccagatgtggatgacaatgttgctcagcaatgtcttgcctagtgatcataactccgaccttcctctgtcgcagtgtcggctggtgtatgccattctgacatggatgagcgtccatgtggctcagttgattgttgacaccatctatttatttgcaggtatgccacccaccaggcaccctctagacccggataagtctaacagggccctagggtttctagcattgatcatgggcctctgccagtcattcggggttcccgtcacacctagtaaggtgatccgaccgccgatcacccgggcctttattgagaagtattgcacgcctaggcaggcgcagggtgatgcaccacaggccacagacgcaccgccaccacctcatcaggctgatcctgctgggtcattaggcatggagcgatatctacaacacttggttcgtcatcaagcagccaaccaccgggggcaggtgcagatacatgagtgtctctaccagctcagcctcagtcaacagggccagggtttcattccttttgcgtgccctactccagatcagtttagggctgaagtcgcatggcccggagattggctcgaggcccaggcaggggaggcgcctgcagaggctctcgacgatgtagaggaggtccgcatggatgaggagatgacggatttctcagtttcttggaagggagcggagccacatgaccatgggatcccaagattcattgcttacttcgttattgttgataatgtttgttga

SEQ ID NO: 5923 - DNA, 315 bp, Glycine max
  Peptide Sequence Number=SeqID_97608
atgaaggggaatgagaacgaagatgcaaaggctgcgggtgtaagcaacctagtggtggtcgttaatgtcgttaatggcaatgtcgtggaggcgttgatgcgcttgctggtaccaccaatgcgggttcaatttggcgatggtgattttgaaccagaacatggtgatattgtggtgatcgtgatgtatgttgtttctagttttcaacagtcccgtgtgaagaccaagcagacggtgacgtcgtggaggaatgagtgtgacagctcttcaacaacaacggcgataaagacatggtctggtgttgcaacgttttcataa

SEQ ID NO: 5924 - DNA, 228 bp, Glycine max
  Peptide Sequence Number=SeqID_97609
atggacccaaaatacaaggaccaaaataagaaaacaacctattctactatttacaaagaagagtggaccaaaccttggcccatgggctcaaaaatctaccctaaggttcatgagaaccgtaaggccttctttatcaactctagcccaatcctcttggagcctcttgctcatggctctggtaactggtcctttcctagggaggattgcatcataggagaccatggataa

SEQ ID NO: 5925 - DNA, 687 bp, Glycine max
  Peptide Sequence Number=SeqID_97610
atggccccgaggaaacttgcctcaaagagatccaggaaggataaagcggccgaaggaaccagttctgctcctgagtatgacagtcaccgctttaggagcgctgaacaccagcagcgcttcgaggccatcaagggatggtcatttctccaggagcgacgtgtccagctcagggacgacgagtataccgatttccaggaggacatagttcgccggcggtgggcatcactagttacccccatggccaagttcgatctagacatagtcctcgaattttatgccaatgcttggcctacggaggagggcgtgcgagatatgaggtcctgggtgaggggtcagtggatcccgtttgatgcagatgctatcagccagttcctgggataccctttaatgctggaagagggccaggagtgcgagtatggccagaggaggaactggtccgatgggttcgatgaggaggccatcgcccatttgctatgtataccagggcaagattttgcccggactgctgtcgggagacgggtgcggatcatgcgcaccaacatgaccaccctgactcagatctggatgactttgctgctcagcaacatccagcccagcgatcataattccgacctccccctgccgaagtgtcagctggtgtatgccatcctaacacggatgagcattcacgtgggtgggatcctctag

SEQ ID NO: 5926 - DNA, 531 bp, Glycine max
  Peptide Sequence Number=SeqID_97611
atggggtggtcggaataccgagaaatatttggagtcctctttccaaatgtggatgggttggtggacctggaagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtgtggattctatcttcatgcgaaggatgtcccatgagaggagtaccatcagacgaaagcatcacgcctttcatcgcacgaggtttcagtgaccacaatgctagggacagagagcttaggggaagcagtaatgggatcatcggcggctatcataagtggctgagagtccggacacaaggattggattggctcccaaatctaaagactgtgagagacaatgaggttaaagcttcggaagaaagtgatgacgtacaagccctaaaggcaaagcttgagagagcccgggtagtcgaagagaagttcaagtccatagccatcaaa

SEQ ID NO: 5927 - DNA, 231 bp, Glycine max
  Peptide Sequence Number=SeqID_97612
aaggcggttgcttctggaggaagcaaccctgctcgcctgggcgagctgggcggcaaccacctcccctattttgctataaataggggaggaagtgaagaaggaaggggttcagcccctgaggcacttctctctctttcgaatttgcttggaaaaattgtttccgaatgtcgcaaaggtttcaaccgttcgacgttcttcattcgttcttcatcgttcttcgatcttcaacgg

SEQ ID NO: 5928 - DNA, 261 bp, Glycine max
  Peptide Sequence Number=SeqID_97613
atgaagcataaactcaaaaacaaagggggagaatggaaatttatgagttttgacgataacaaagatgatgataaaaagctcaaaagtcaagatcacttcatgataacaaagatgatgacattcaagaatgagttcaagattgagtcaagaacacttcaaggaaaaagattcaagattcaaagattcaagaataatcaagatcaagattcaagactcaaagattcaagaatcaagagaagacttaatcatgataagtattaa

SEQ ID NO: 5929 - DNA, 345 bp, Glycine max
  Peptide Sequence Number=SeqID_97614
atgcggggttaccgtatggttactcacaacattcgtcaaccagggggaaacgagcccgttgacatgcagaggctaacatcatcttctgcaccttttgccatccagggacagcgagtcaggtggctggtggagataccttatggtcatccgcacctttcgtcaaccgaggggaacgaattcgacgacatcaggatgatgttggttttactctcgtcgtccggaaacattcaagcccggcgacacgcgagattcttctctgctggacagggacaatcgagtgcaatggcaaagggaagtgtcgtggttgtccaactttttcgctttcaagacactgaagtttgttga

SEQ ID NO: 5930 - DNA, 492 bp, Glycine max
  Peptide Sequence Number=SeqID_97615
atggcgcccactaggcaccctttggacccagataagtccaacagggccctgggattccccgcactgatcacaggactctgccagttgttcggagtccccgttgcacctaccaaggtgattcggccgcccatcacccgggcttttattgagaagtactgtacccagagacaggctcagggtcaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccaggagctcccggcgatggagaagaggcccacgaggatgaggagatggccgatttgctggatttcttgggagggagtggagatacgtga

SEQ ID NO: 5931 - DNA, 583 bp, Glycine max
  Peptide Sequence Number=SeqID_97616
atggagtacaccggtgcagcgacaaccgcaaaccacttgaccaaagccttccccagcagtgaatggatgaactgcgtgccagtgtccggcatctgccgccagcacatcggcgatacgcggcgtgcggtgtctcgcctcggccaccgacaggacaggcgtctccacctccagcacgtcgcgcaggcgggcatcgaagggaatgcggcgcaccagcatgcattcgcagcgccggctgcagctggcgcagtcatgggcgctgcacaggctcgcgctggaaacgcgcacgctgctcgtgggcgtcgttcagttcgtgatagccgttggccagttccactgcacccaggtacagctcgaaacgctccgccagcggcggcgcgccggcacggatgcgtgccaatgcggcctggctggcgggccaatcgtggaccacggtcatcaccgcgtcatcgaaatgcggctggatatgatgggtcatcagcagatccagccagtcatcgcgggtcagcccgaccgggtcgatgtgcacctcgcccagcgcggcacgcagcgcagcctcatcggcatcgaacggatccacgcccac

SEQ ID NO: 5932 - DNA, 839 bp, Glycine max
  Peptide Sequence Number=SeqID_97617
atgttgcaggacgttgcgcggcgcatcgcgcaggaaaagatcgccccgagcgcggagcaccatgaccgcaccggcgagttcccgctggacaacatccgcctgctgggcgagaacggcctgatgggcatcgaagtgccgaccgaatacggtggcgcgggcatggacccggttgcgtacgtgctggcaatggtggaggtcgctgccgccgacgctgcccactcgaccatcatgtcggtcaacaactcgctgttctgcaatggcatcctcactcacggtaccgaagcgcagaagcagacctacgtgcgtgcgatcgccgagggcgaggccatcggcgcgtttgcgctgaccgagccgcagtccggttcggacgccacggccatgcgctgccgcgccgtgaagcaggccgacggcaccttcatcatcaacggcaagaagagctggatcacctccggcccggtggccaagtacatcgtgctgttcgcgatgagcgagccggacaagggcgcgcgcggcatcactgccttcctcatcgataccgacaaggcgggcttcggtcgcggcaagaccgaaccgaagctgggcatccgtgcctcggccacctgcgagatcgagttcaacgattacgtggcgcaggctgaggatgtgctgggccaggaaggcgagggcttcaagatcgccatgagtgtgctcgatgccggccgcatcggtatcgcctcgcaggccatcggcatcgcccgcgccgcctatgaagcgaccctggaatacgtgaaggagcgcaaggcgttcggcgcggccatcggcaccttccagatgacccaggccaagattgccgacatgaa

SEQ ID NO: 5933 - DNA, 51 bp, Glycine max
  Peptide Sequence Number=SeqID_97618
gagaaattgggtgcaaattttaagtcctttatttcgaaaaaagtgactctg

SEQ ID NO: 5934 - DNA, 245 bp, Glycine max
  Peptide Sequence Number=SeqID_97619
tgcctgtcgcccccagcaagatcatcaggccccctactaatcgagctttcatcaagaagtactgcggccccaggcaggtgcagggcaaaacaccacagcagcctggggatggccggcagcgggcaacaaacgcactgccatcacctctagagttcaccgcagctcatccccaaaaagtccgtgaccgacaagccatcaagcatccagctcaagacgttaaagaagcgctactgggaggcaaccta

SEQ ID NO: 5935 - DNA, 84 bp, Glycine max
  Peptide Sequence Number=SeqID_97620
atggccattaaagatcaatgcgactctttgcaaatccagaagaaggaaatttggacacttccagaaggattacctaaagagtaa

SEQ ID NO: 5936 - DNA, 114 bp, Glycine max
  Peptide Sequence Number=SeqID_97621
atgactacaggagatccacccaaacagaagacaagtcaagcaaatgagaaaaagaaagaagatgagaatattactcaaggcgatccacctcaagagaagaggagagaagtctaa

SEQ ID NO: 5937 - DNA, 372 bp, Glycine max
  Peptide Sequence Number=SeqID_97622
atgggtgccaagtacctcgaagcggtcaagcaaagggtgcatgccatcaaacaatggtccccggatgaaattagggaaccgattgggaaaataacaaaaaaaccgtattttcccctcaccggaggcttcttacttgataacggaggatgcatgaatgacaatcaattcatggggctccgaataagatggtggaggatgcacgaacaacgcaaggaaatcaattcatggggctccggacttgatggtggaggatgcacgaacaacgctaggcaatcaattcgtggggctccggactcgatggagcaccatattttagagaaacaatatgcatatgccaaaatattattccttgtaaccaaaaatgaagggtag

SEQ ID NO: 5938 - DNA, 397 bp, Glycine max
  Peptide Sequence Number=SeqID_97623
atgactagaggcaatccatctgacttacaaccctttgatcctgagatagataggacatttcatagattagttaggcatcattttataccttttgatcattctgagcattccattactggtgaatctgtgcattctgttattggtgattttgaacatcctgatcttgagcattataattttgagcattctgattctgagcattctgattctaagcattctgattttgcacattctgagaacatgacacaacctccaccccgtgagaggactctaagggaaatggctgcacctgatttcacctacgaaagcttgtgcatccaataccctgatgaggatgtcccatatgttcttaaaactggactaattcatttgcttccaaagtttcatggccttgcag

SEQ ID NO: 5939 - DNA, 552 bp, Glycine max
  Peptide Sequence Number=SeqID_97624
cctcaagaggctaacattaacctcccatacttccatgggaaggacaatgtagaggcttacttagatggggaaataagggtagagcaacaacttaaaagaaagtctacttcaaaattttatggctctcactcttatccaaataaagagcaaagtctaggcatcttaggggcggcaccttgtaagcccaaagatgataagtggaagacaatagaaaagcaaccccctaaggctagtatgcaagagaagactagctatataaagtgctttaaatgtcttggaaaaggacacattacatctcaataccccaccaagaaaactatgattatgaggggccaagacatttatagtagccaagatgaggctactacttcaccttcctctagtgaaacgagcaaggcgaggctcacgggtgcgctttccaaaggaggaaagatgcgcggagtcgccaccaacgaaggtattagcatctctcacgtcgacaaaagcggggctcttgctcctacgtaccctccatcgaagaggaaatcagacctacgtagttctttcttaagg

SEQ ID NO: 5940 - DNA, 249 bp, Glycine max
  Peptide Sequence Number=SeqID_97625
atggtaatcgattaccagattgtgatggcggcgcagctaatccatgatcgagtagagatggagtgcctagagggagcctgggagaccctcgaaggcaacaggaggtgccgattttggggcaccattcgattcacggctacttctttggtgcatccagatgaacctgcacggacgcttcagcgcacggtggagtggacagcttttttcggatttgttttccaacactgtggacacctttgctctggatga

SEQ ID NO: 5941 - DNA, 156 bp, Glycine max
  Peptide Sequence Number=SeqID_97626
atggtgtggcgtctccaatcacctctcctccttctccattccgctgccattgatcttcaagaagcaaatgactctattgatgaagaagatccaaggcttacatgctccacatggagctacatcaaatggctaggagcatcatcaacaaaatgttga

SEQ ID NO: 5942 - DNA, 201 bp, Glycine max
  Peptide Sequence Number=SeqID_97627
atgggggagaagcttgcttctggaggaattttctggaaggcccaagtgggcctgagcttcacgaattgtgctacaatgcttccttttgacttccggcatatcacagaacttcacgaattgcctaacgatgggtgccaagtacctcgaagtggtcaaacgagggtcgcatcccaacaacggatggtccccggacgaaattag

SEQ ID NO: 5943 - DNA, 366 bp, Glycine max
  Peptide Sequence Number=SeqID_97628
atgtctttgttttcatgttgtcgcactaagcgtaccctgcccgctaagcatatgacctctagaaagagaaaagataccgtctccagacccagggaggcctatgacaccactagattcatatctgagggcacctgggagagatatgcacaaaacgttcactctcagaacatccttccagagaggaatgtcattttatacgtcacagagtacgacaagttccatcaggagctcgagaggaagagctggcataaagccttgaccagaaggggtgccctagaagctcctgaggaaggacctcaccactctagcactgacttggagagtgctctcatactccaacctcgcccctacctctcatacatatga

SEQ ID NO: 5944 - DNA, 392 bp, Glycine max
  Peptide Sequence Number=SeqID_97629
ctgagactaagaagcttgaaggtaaactagatgccttggttaacctagtaacccaattggccttgaataaaaaatctgcacttgtcgccagactctgtggtttatgctcctcttccgaccaccacacagacctttgcccttctgtgcaacaatctgaagcaattgaacagcctgaagcttatgctacaaacatctacaatagacctcctcaacctcagcggcaaaataagccacaacagaacaattatgacctctccagcaacagaccatacgttcctccaccaatccagcagcaacaacagcaacagccccagaaacaacaaatagttaaggctcctccgcaaccttcccttgaagaacttgggaggcaaatgactatgcaaaacatgtag

SEQ ID NO: 5945 - DNA, 309 bp, Glycine max
  Peptide Sequence Number=SeqID_97630
atgggaaagttggatcatctagaggaaaggctcagggccattgaaagaggaaaagagtatgcctttgctaacctagaagagttgttcctagtacccaatatcatcacccctcccaagttcaaggtgtcggactttgacaagtacaaggggactacttgccccaagaaccatctaaggattatcggtacaattctaatatggctccggataggatgcaactacagagcatatgcaagagggggcacagatctttcaaagaatacgcccaaaggtggagagacctggcagctcatgtggcacctccaatga

SEQ ID NO: 5946 - DNA, 177 bp, Glycine max
  Peptide Sequence Number=SeqID_97631
atggagaagatgaatgtgcacataataacaagggggacccctaagggcctaggatcttcttcatcaatggattcctttgcttcttggaagatgaatggcagcggaatggagaaggaagagagagaggagacgccatttcaaggagaagatgagtctagaagaagctcaccaccatag

SEQ ID NO: 5947 - DNA, 426 bp, Glycine max
  Peptide Sequence Number=SeqID_97632
atggatgaacatcaacaaaactggaagaaaatggctaacataatgatgaagattaataaagaatcaaatgaaatgttcaacattgttcatgttattgatcagccttatggtgaagtgagtatgtcatttgttataagatggaaggatgaactagagcctacgtggcatctgctacactctagtggcaacatgcactctgtcacatataatcaagatttggtgagtccagctctacttgctggatggacagaacttagagaattctatgggctcactggaaatcatcaggtcaccttgatccactatggacaaagtgttttcctcctcaccatcttcaaaagcaactctgaaccaaaagctttccctaaatggcacttcctgtaccaccaagttcctaactcaatcacttttaaagtcactcactga

SEQ ID NO: 5948 - DNA, 180 bp, Glycine max
  Peptide Sequence Number=SeqID_97633
atgaatttcaagaaatgccaaaatgccctaggtgtggggtatcactgtacaaagtcaaggatgatgacgagtgtagtagtgacgacactcaaagaagggccccccagtgaaggtgttatggtatcttccgatcattctaaggtccaagacaaccaggaaataacattgatgtttatctaa

SEQ ID NO: 5949 - DNA, 762 bp, Glycine max
  Peptide Sequence Number=SeqID_97634
atgggatcaagtcaaaagccttcgcttaaaaagaggttctatcaagtcaaaatcaagagcttagaggtcactagtttaggagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatcccctccacgacaagagttgccaagggcaaaggccttggcaaatcaaggcgaatgggctttcttttattgacatcttggcgcttttgatctttggagttgccctctttccgaatatggaagggttagtggacctagcagcgattgacgctttcctcgcctttcatcatggcaaggaaagcccggttgtcgccattttggccatgtatgacacgttcgaccggggatgcccatctatccgctacaaggaaggaagaatcaggattctatcttcatgcgaaggatgtccaaatgttcccttgatgggaacaaggggttgtattaattataatcccgtcctcgcaataagacagcttggctacctcatgagaggagtgccatcagacgaaagcatcacgcctttcatcgcacggggtttcagtgaccacaacgcgagg

SEQ ID NO: 5950 - DNA, 282 bp, Glycine max
  Peptide Sequence Number=SeqID_97635
atggcacgcaacgtgcttgctccgtgcccctattttagggacctatatgggagagagctaaaagggcttttaacgataattcccaaggtggttatatctctcttgatggtctctagagtccccagtggagtcgccaactgtcgcaacctccccttcggcgggagggcgacgggtgactcacaggtgtgccttccaagaaaggaatacgcgcggagtcgccaccgacgtttattggagggaaacgtcggaaaaaccggaaaagatgtggtctacgaactttaa

SEQ ID NO: 5951 - DNA, 210 bp, Glycine max
  Peptide Sequence Number=SeqID_97636
atgatggcacatcaggaacccttcaaccgaagcggaatcttgcaacttggcttgcagtttgctccattcgagcttctaggcctaggatcttcttcatcaatggactcctttgcttcttggaagatgaatggcagcggaatggagaaggaagagacagaggagacgccacttcaaggagaagatgagtctagaagaagctcaccaccatag

SEQ ID NO: 5952 - DNA, 189 bp, Glycine max
  Peptide Sequence Number=SeqID_97637
gcaatcaattcatggggcttcgaactcgatggtggaggatgcatgaacagcgctaggcaatcaattcatggggctccggacttgatgatggaggatgcacgaacagcgctaggcaatcaattcatggggctccgaataagatttgatggtggaggatgcatgaacgacaatcaattcatggggctctga

SEQ ID NO: 5953 - DNA, 486 bp, Glycine max
  Peptide Sequence Number=SeqID_97638
gtcgactctagaggatcccttaaggcggtaataccccgttatccacagaatcaggggataacgcaggaaagaacatgtgagcaaaaggccagcaaaaggccaggaaccgtggcgaaacccgacaggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 5954 - DNA, 364 bp, Glycine max
  Peptide Sequence Number=SeqID_97639
gtatgccacctaccaggccgcagacacaccgccaccacctcatcaggctgatccagctgggtcatttggcacgaagcggtatttacagcacttggttcgccagcaggcggccaaccacagggggcaggtgcagatacatgagtgtctctaccaactcagcctcagtcagcagagccaaggtttcactccttttgcgtgccctacaccagatcagtttagggctgaggtcgcatggctcggagattggcctgaggcccaggtaggggaggcgcctgcagaggctcccggcgatgcagaggaggcccgcatggatgaggagatgacagatttactcgatttcttgggagggagtggagccacatga

SEQ ID NO: 5955 - DNA, 606 bp, Glycine max
  Peptide Sequence Number=SeqID_97640
atgagcgttcatgtggctcagttgatcgctgatgccatttatctatttgcaggtatgccacctaccaggcaccctctagacccagataagtctaacagggccctgagttttccggcattgatcacgggtctttgccagtcgctcggggttctggtcacacctagtaaggtaattcgaccgccgatcacccggactttcatagagaagtactgcacaactagacaggcacagggtggcgacccacaggccccaaacgcaccgccgccacctcctcaggctgatccagctgggtcatttgacacggagcggtatttgcggcatttggttcgccagcaggcggccaaccacagggcgcacgtgcagacccatgactctctctaccagcttagccttagcctgcagagccaaggttttgcttcttttccatgccctactctggaccagatcacggcagaggtcgaatggcccggagattggcctgaggcccaggcaggggaggcaaccacagaggcacccgcagaggctcccggcgaggcagatgaggcccgcatggacaaggagatgaccgatttgcttgatttcttgggagggagcggagccacatga

SEQ ID NO: 5956 - DNA, 426 bp, Glycine max
  Peptide Sequence Number=SeqID_97641
gcttttcgtcttacagatagcaagaacaatgtttatacggataaccactcgggtatttccgcccgtcagcgtgactcaaatgtcagtatgacagatcttgtgagcgcggaagatgacacagcaaaaaagaatgtttatacggataaccactcgagtattttcgcccgtcagcgtgactcaaatgtcagtatgacaatcttgcttgtcgcgattgacgaagggtgcagaagacgacgtcagtctctgcgtgctatcaggcttttcgtcttacagacagcaaaaaagaatgtttatacggataaccactcgggtatttccgcccgtcagcgtgactcaaatgtcagtatgacagatcttgtgagcgcggaagatgacgcttttcgtcttacagacaccaaaaagaatgtttatacggataacactcgg

SEQ ID NO: 5957 - DNA, 768 bp, Glycine max
  Peptide Sequence Number=SeqID_97642
atggtggaagagtttgaagagatcctaggatgccctctagggggaaggaaaccatacctcttcttaggattctatccctctttagctagaatttctaagatagtccaaatctcggcgcaggaattagaccacagaaagaaattcgaaaatggggtggctggagtaccgagaaaatgtttggaggcaaaagcaagaatcttggcaggtagaggcgaatgggccccgttcatagacatcctcgtgcttttgatcttcggaggagtcctctttccaaatgtggatgggttggtggacttagcggcgatcgacgcttttctcgcctttcatgaccgcaaggaaagcccgcttgtcgctatcctagtcgatctatatgacaccttcaaccgaagatgcgaaaagagcaagacaaggattgtttgctgtactccagccctctatgtatggttggtttcgcaccttttcctccaagagggtgagacatgcttgcccgttagaaagccaccgttcatgcacagagaagaaagaggcaagttgggaccgactcttagcaagcaaagaaggagcgtctgtcaactggttcccccagtggaaagaaggaagaaccggagtcctaattttgtgcagaggatttccaaatgttcccttgatggggacaaggggttgcatcagttacaattctattcttgctataagacaacttggttaccccatgagaggggcaccactagaggaagagctcgcacctattattgcatgaggtttcaataa

SEQ ID NO: 5958 - DNA, 558 bp, Glycine max
  Peptide Sequence Number=SeqID_97643
atggtgagttacacaccttcaagctttacggatttagttttcgtctgcaaaaggatcgaagtgggtctgaaaagaggaaaatttgatcatcctgctttgacaaataaaaagccttgggcaaatagagaggatgagaaggaggaaggaacccatgctatgactgtcgttcctacatggccaaatttcccaccagctcaacaatgtcattactcagccaatatcagcccttctcattacccaccacccaatcatccacaaaggccatccctaaatcagccacaaagccgacctgccacacatccaatgccaaacaccacccttaacacaaaccaaaacaccaaccaggaagggaattttccagcgaaaaagcctatagaattcaccccaatttcggtgtcctatgctaacttgctcccatatctactcgataattcaatggtagccataacccacccaaggttccttaacctccattttttcgaggatatgactcggatgcaacatgtgcttaccatggagaagtttcggggcattccattgagcattataggaccctga

SEQ ID NO: 5959 - DNA, 739 bp, Glycine max
  Peptide Sequence Number=SeqID_97644
atgccgatctccccctacggaggactacacgtcctcgccatcagaggactgcatgtcctcaccttcgagggcatacacgccctcacctttagaggactgcatgtcctcaccttcagagggctacacgccctcgccatcagaggaccacacgtcctcactttcgtagggctacacgccttcacctttagaggaccacacgtcctcacctttagagggctacacaccctcgccatcagaggaccacacatcctcaccttcagagggctacacgccctcgccatcagaggactgcatgtcctcaccttcagagggctacacgccctcacctttagtggaccacacgtcctcaccttcaaagggctacacgccctcgccatcagaggaccacacgtcctcaccttcgtagggctacacgccctcacctttagaggaccacacgtcctcaccttcagagggctacacgccctcgccatcagaggaccacacgtcctcaccttcagagggccacacgccctcgccatcagaggactgcatgtcctcaccttcagagggctacacgccctcgccatcagagggactgcatgtcctcaccttcagaggactacacgccctcgccatcagaggactagcgtcctcgccttcgtagggctacacgccctcaccttcagaggactacacgtcctcaccttcagaggctgctacacgccctcgccatcagaggacacaacgtcttcacttc

SEQ ID NO: 5960 - DNA, 783 bp, Glycine max
  Peptide Sequence Number=SeqID_97645
atgcctatcatgatgatgggatctgcaacaacatttatagactgtgatgagtgttggaaattgttgctggtaacaagaaacaaatctctttatttatgggatttattcaacaaaacatgtctccttcatgactcattggcttctcttattgcttcaagtcctaactcatctactaaagatgctgacactattaaagttttatatgcaaagctatcaaaatctggttctcctcttgtcgtttatgccacttgtcatgctttcttatttgacatgagtctcaagtgttggctaagggttgcaaatgactacttccctgcatcaagttttgccagctcttggtgtatgagattaattcaaagtggtgaacttgctgctttgcaggttgatgttagaaaatatttggcacgaaagccaggtgatggttgcatgtcattgttgaagaagagacattttggaattaggctgcatgttgttcaaaaaaggactccccagggctccaaacaaatattagcatgtggaatccttggcaagctcactgctatcactcaactagttcatcatggaatgatactcattccaatcggttacacattcaatgccgacatgtttgagatggagaaagtgaaaggtggaagtccatatggtgccagaacttacaccggtgacggctcaagacagccaagtgagcttgagttacaacaagtatccaccaagggaagtacattgccggcaacacaaagaagctcaagcaagctgcataatgttgccttgccttcatattag

SEQ ID NO: 5961 - DNA, 294 bp, Glycine max
  Peptide Sequence Number=SeqID_97646
atgtaccctctcttgttctcagttacaacaacccaagtagatgtgccctctacttgtaccacaaaggatgtaccctccaatgtgttaagacaaagttctcaggcagttagtcctttgaaactttgtgaaggggaaacaaaagatatctcaggcggaaagggaagaatcaaaagaattctcagactgtatcgttttgaattctttgaaaagggagaagggagacacaaaagaattcaggcggttagtcctttgttcttttggaaaagggagaagagagacacggggatcctctag

SEQ ID NO: 5962 - DNA, 7692 bp, Glycine max
  Peptide Sequence Number=SeqID_97647
atgcaggaagctgatggtttggacatgaagaaatcttatcaaagcactgatcctgtgattgatggtcaaaaggagctttctttgtctgaggttggtgagagtgaccagtctctttcgggaattgctttggagaagattagagttgaggaggcatctcatgaagctgagcaactacgcaagtcaattgaattactctcctctcagtttctgctcgaggcaagaggagcagtctctgatttggatcctttagccagtagttcagttctatcagacaatgacatttcagaagcatttcagagtctcaaagaagaattgtttcttgcaaatttaatgaaaaatatatttaacactcaactagctgaacaactggagtctgatgatcagcgtcaccagttggttgatgaaatatctcagcttcatgcttctcataataaagtaaatgacaagaatcaacaacttactgaagaacttgctaattgccatgttgaactacatgatatttctagcaagaacgtagaagtacaaaatcaatttaatgctgccatggctgaggtggaagcactttctgtcagagtgattgagctgcagaatagttttgatgtgtcccacaaagattcgttggaattgtccagagagttggctgactgcagaggcttgatctcaagtttacaggtggaaaagaagggcatgaatgaaactcttaatttgatgattgctgagaaaaataaacttgtggaggagaaggaatttcatctatgtgaaagtaagaatctggcaactgaattggctgacttcaagagtttgatggaaggagtaagagttgagaattccaacttaattgacaggatctctttggtgactgaagagaggaataagattgaagcagaaattgagcatctcaaacatgagattgacagactgtcattagatttggttgaaaataaagatttggtggcaagtctagaggcagaaaattccaacttaaatcgtaaccttgcattgtcagctgataagattaaaaatcttgaagatgagaatcaaagacactcttctgaaatcattgccctaaatgagcaattgtctacagaaaaggcggaacgaatgaggtttgaaggtgaccttaaagaagccacagtgcacttggaacaaatttccaaggaaaatgtgtttctcaatgacactttggataagcaaaaggccaagatagaagaaattggaaaggagcacagccaaccactatctcaacctagggaccttggaaatcaagctcatgttgcacgtacacaaagtaagggccttgaaattgctattgctaacgattctctgcatatggatcaggagccagatgaaggggcactaggaggaccacatgtgaatatacttgagcatgaagtctttgatgattctcatgggtttgtttcattgaaagcttgctcggatgaggtagagaaagttctggtgaagcttgaaaaggcaattgatgtgttgcattctcaatcagtatcctccagcagggccggtgaaaaagtttcttcgcctgtggtttcgaaattgatacaggcttttgaatcaaaagtacaagaagatgagcatgagacagaaagtagggattccagtgatgttctgtcatcatcaaactcatttattatgttaactaaagagcaaattggagatttgaaaaaattgctttcaaagtggaagctgaatgttcagattgcaggtacattattcaatggggagcgagatgatcggaaaactggtgatgcaaagtacagtgatctcaaggaccagtttgaacaattgaagcaacattgctcagatttggaagcatccaacattgaacttgcagttcaatatgaaactgcaaagcaacttctgggtgatattcaagaaaagaaatgccttcttgaggaattctatgatgctttaaagcaagaagatacccatctcaaagccaaaaataatgaactttatgagaagcttggctattgtcagtcaaaaattagtgaattgcatactgaaatgaatgatgtgaaacaaatttcaaatgatatggcttctactgttggcagtcaactggaaaatttgcagaaggaggtgacagagagggcaatgctacttgagcaaggctggaatatgactattgcccagattgttgagttagttgggaagctgaaagaatcagttggtgaaactttgtgcacaactgtttcttctgatgcttatggcaacttggatatctgtcatcagttagaagtttcagttaatgcagccgctgaaatgatttttgatctgcagaagaaacttgaagctacttattcggaacatgaaataatgtgcacatcatataaagaaatgaattcaaaatgtgatgatctgcttgggaggaatgaattggctgttagtctattgcataagatgtacagtgacctgaggaaacttgtgtttagtaatggtgggactatggatgaagataagatagatttacaaagtgaagtgctgcctgatctgctgaactataatagctatcaacccatcttgaaacatattgggaatatattgaccgagaagctggaacttgagtctgttaccaaggagattaagtcagaattgatgcacagggaaacagaattggaagaattgaagatgaagtgccttggtttagattctgttagtaagctaatagaagatgtcgtgggtgtgctgaatgtggacatttcaaagatcgatataaataaatcacccctttcttgcttagattcattagtctctagtcttgtacagaaaaccagagacactgaaatccagtatcacacgactaaagaaggatatggatctaaggagatggaattggctgaattgaaggaaaaaatgcattttctagacacacttcgtcttgagaatgaaaatgaaatccttgttctgaaggaaagcttacatcaggctgaggaagctcttactgttgctcattctgaattgcacaagaaagcaaatgaacttgagcattcagaacagcgggtgtcctccattcgggaaaaacttagcatagctgttgccaaggggaaagggttggttgtacagcgagatggactcaagcaatccctggcagagacatccagtgaattggagagatgcttgcaagagttacagttgaaagatacaaggcttcatgaggttgaaacgaaagttaagacatatgcagaggctggtgagcgtgttgaagctctggaatctgagctttcttatatccgtaattcatctaatgctttgagagagtcatttcttcttaaagattcaatgcttcagaggatagaagagatattggaagacctagatctgccagagcagtttcattcaagagatataattgaaaagattgattggttggctagttcagtttcagcaaactcattgccaattaatgattgggaacagaaggaagctatgggaggaggctcatactctgatgctggttatgttgtcacggattcatggaaagatgatagtcagctacgaccagattcagatgattttagaaaaaaatttgaggagttgcagagtaagtattatgggttggctgagcaaaatgaaatgctggagcaatcattgatggaaagaaacagcttagttcagagatgggaagagcttgtaaatagggttgaaatgccttcacatttgcagtctatggagacggaggataagattgaatgtataggcagtgcgcttactgaggctaatcatcatatagattctatgcagctgaagattgaaaaatatgatagctactgtggattgctaaatgccgatctggaagagtctcaaaggacagtgtctgctcttcaagaagaccttagtgctcttacatctgaaagagagcatctttctgagaaaatggagtctttggtgtatgagtatgagaaactatcattgcagacaagggaggctgaacttgagaatggaaagctgcatgatgaaataactagtttgaaggataaattggaacacaaaactgcaattgaagaacaaattttcactattgaaggcaagatcagaaagttgcgagacttggttggtgatgccttgtcggaatctgaaacagaaaatatggtttccggtagtgcaaatattgattccttggaagaattgctggaaaagcttgtagaaaagctgaacatggaaaggaaaccatcagcacagacaagagaagctgaacttgagaatgaaaagctgcatactgaaatttctagtttgaaggataaattggaacagaaagctgcaattgaagaacaaattttcaccattgatggtaaaatcagaaaattacaagacttagttggtgatgccttgtcagtacctgaaacagaaaatctggtttcttgtagtgcaaatattgattccttggaagaattgctgagaaagcttatagaaaatcatgcaaagctttcattaatgaaacctgcatatggggttgtaggtgatggactccattctcaaaaggaggatgctacacttctcgaggaaagaagtatggatgtgcatgataaggaggcggcagatattgacatatataaaagagatctggaggagtcttcaaatgaattgatgcatgtgaaggaggagagaaatagatctttggaaaagcaaatatctttatcaggtgaagttgaagctctgacaaaaagaattgaggaattgcaagggcttcttaatcaggaggagcagaaatcagcttcttttagagaggagttagcaagtgaagttgaaactctgacaaaaagaaatgaggaattgcaagggcttcttaatcaggaggagcaaaaatcagcttctgttagggagaagttatcaggtgaagttgaaactctgactaaaagaattgatgaattgctagggcttcttaatcaggaggagcagaaatcagcttcttttagagagaagttaaatgttgcagtaaggaaagggaagtcattggtgcaacaacgagacagtctaaagcaaaccattaaagatatgactgttgagatggagcacttgaaatctgagataaacaaccgggaaaacactcttggagagcaagaacagaagttgagacagttgtcaacctacccagataggttagaagctcttgaatctgagagtttgcttctgaagaaacatttggaagaaactgagcaccatttgcaggaccaagaatattctttgaaactgattttgaacaagttgggtgagattgaggttggcggtgaaggtcatataagtgatccagtgaagaaattggaattggttgggaagttattttctgatctacatagtgctgtggcatctttagaacaagaatccaggaagtctaaaagagcatcagaactcctcttggcagagttaaatgaggttcaagaaaggaatgatagttttcaggaggagctcgcaaaggtgactgctgaacttgtggatctcagaagagaaagggattcagctgaggctgccaaactggaagcggttgcacatcttgaggaggggaaaaagagccatttttctgacatcatggaattaaaatctagtatgaaccaagtctgcaaaagctttggtgaggttcagaatttactgtgtaatgcttttttcatggatttggaatcttatcggaaagtggaggctggtcttgagtcatgtatgaaaggaaacaatgataaaaatgtggtggattcatccatcaccaaagaacatgatggcattttacactgctcatctgctaataagaagagctctgtgtctgcagatccttggtcagattttgacagaattgaccactatgatgataatactatagttgaaatttctcgtctatttgggcatcaactgcaagagctcatggtggaggttagttctctcagggaaagaataaacatgcactcaagtttggcgcaggagacggacaaaactctatctaaactaatagcaagtattcaaagggaaatgacttcccaaaaagaggcgtgtgaaacgatgaagaaagaagtaagtgagcgagatggggaacttgctgtattacgtgggaacgttgcctatctttatgaagcatgcattaattctgtcattgtacttgaaaatggaaaagctgaactggttggaaggaaggttgaatcttcagatctgggaattaacttggaaataccttcatttgatgatggcatatctgaggaatgtattaaaaccctgacagatagattgctgttgagtgcaaaagggtttgctagtttaaaaactgaatttttagatgccaatcaaaaagaaatgaaggctactataacaaatttgcagagagagcttcaggagaaggatgttcaaagagataggatttgctcagaactggtgaaacagatcaaggatgctgaagctgctgcaaacagttactctcaagatcttcaagcttttagtcttcaagaacataatataaagaaagaggtggaagcaattgaggcagaaaggaagatactggaacagagagtgaatgaactgcaggatagacaagaaaccgcagctgaattagaggagaaaatgagatctcaaactggtttactggctgccaaagatcaagaaatcgaagcactaatgcatgcacttgatgaggaagaaacgcagatggaagaattaacaaataagattgtggatcttgaaacggtagttcaacaaaagaatcaagagattgagaaccttggatcttcccgtggtaaggttatgaaaaagctttccataactgttagtaagtttgatgagcttcaccacctgtctgcaagtctcctttctgaggttgaaaagctccaatcccagttgctagaaagagatactgaaatttctttcttgaggcaagaggttactagatgcactaatgatgctcttcttgcatcacaaatgagcaaccagagttctgatgagatctttgagttcttgatgtgggttgacacaattgtgtctcatgatggggtgcatgatatacatcctgatatgaagagcaacagtaaggttcatgaatgcaaagaaatacttcataagaagcttacgtctttattgtcagaattggagaatctaagggaagttgcagaaagcaaggatgcaatgttgcaaatagaaaggagtaaggtagaagaattgaactgcaaaacagaaactcttgagacatccttacatgagaaagaattgcaattgaatttgcttgaaggtgtggaagaaactggaaagggagctggcacaagctcagaaattgtggaggtagaaccagcaatgaatgattggtcgtcatctggtgcttttgtaacaccccaagttcgcagtttgcgcaaaggcaatagtgatcatgttgccattgctgtagatgtagaccctggtagtactagtaggatagaagatgaagaggacgacaaagtccatggtttcaaatccctcacaacatccagaattgtcccaagatttactagaccgttgactgacttgattgatggcttgtggactcagttaagttgtacagtatcttccttctgcttagttcttgttgcggtgagagacagttacaagtataatgaatttaaagatgcagctgccagaaagagttacaggcagagcattgaagaaaagatgagaaagcagattgctcaatattttgaagagcaacacaaacatcattccagttggtgtttttaa

SEQ ID NO: 5963 - DNA, 261 bp, Glycine max
  Peptide Sequence Number=SeqID_97648
atggatgaatatttcagggtttcaaattgcaagagtgctaaggaaatgtgggacactcttcgattaacacatgaaggaactacagatgaacacgagatagaactattgagattgcaccaaaatgaagaaaatgacaagaaaaagaaaggaattgctcttaaagcatcatcctcaattcaagaagaaagtgatcaggataatgatgcagatgatgatgatgatctaagtctctttgtaaaaagatttaacaagtttcttaaa

SEQ ID NO: 5964 - DNA, 549 bp, Glycine max
  Peptide Sequence Number=SeqID_97649
atggctccaagaaagcttcctgcaaagagatccaggaaggacaaagcggctgaagggaccagtgctgctcctgagtatgacagccatcgcttccggagtgctaagcaccagcagcgttttgaggccatcaaaggatggtcattccaccgagagagacacgtcctgctccgggacgatgagtacaccgactttcaggaagagatagctcgtcggcggtggacatcgctggttacccccatggccaagttcgacccagacatagtcctgaaattttatgccaatgcttggcctacacaggagggcgtgcgggatatgcgatcttgggtaaggggtcagtggattcctttcgatgcggatgccctcagccagttcttgggataccctttagtgctggagaagggccaggagtgcgagtatggccagagaaggaaccgggccgatgggtttgatgaggaggccatcgcccagttgctgtgcaataccgggacaggattttgcccgaaccgctgtcgagagacgagtgcgaatcatgcgcaccaaactgactaa

SEQ ID NO: 5965 - DNA, 951 bp, Glycine max
  Peptide Sequence Number=SeqID_97650
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaattctccatggaaccgattgcatccctttcccagtattatgaccagccactaaggtgcttcacatttgaggacttccagctagtgccgactgtgaaagagtttgaagaaatcctgggatgcccactgggaggaaggaagccatatcttttctctgggttctatccctccacgacaagagtttcccaaggtagtgaaaatctcagcacaagagttggaccgtgtaaagcaaaacagaaatggagtagtcggagtaccaagggaagtgtttggaggaaagggcaaaggccttggcaaaatcaaggcgaatgggcttcttttattgacatcttggcgcttttgatctttggaggtgtcctctttccaaatatggaagggttagtggacctagcagcgatcgacgctttcctcgcctttcatcagggcaaggaaagcccggtcgtcgccattttggccatgtatgacacgttcgaccggggatgtgaaaagagtggcgcaagaattgtttgttgtgcactggctctctatgtgtggctggtttcacacctttttctccaagaaggaaggaagaatcaggattctatcttcatacgaaggatgtccaaatgttcccttgatggaacaaggggttgtattaattataatcccgtcctcgccataagacagcttggctaccccatgagaggagtgccatcagacgaaagcatcacgcccttcatcgcacggggtttcagtgaccataacgcgagggtactccaaggagttcgcaaggcatgggatgcggcgtga

SEQ ID NO: 5966 - DNA, 198 bp, Glycine max
  Peptide Sequence Number=SeqID_97651
atgttacagcaggaagaagaaagtttatcctcaaagaaggaagaaacaagttctgctgaagaagaagaagaagaccccttttaccaaaacgaagatgattgttttgccattaaagtcccggtcgaaactacttgtcttgtaacaaacagtcaaatagtcccgatcaaaactaccggtcttagatttttggctatataa

SEQ ID NO: 5967 - DNA, 252 bp, Glycine max
  Peptide Sequence Number=SeqID_97652
atgacacagcaatggcatcttcatcatcatcttcatcacatatcaacattaagtctggccccatcgatactgatgtattatggatgcaacctaagcatgtttcagaacatgtttggaatggggaagaagaaaggaaattacatatcagacgcgctgtccccacgtatcaaggggaagaacaaattccagagcaaatttttccttttcttcaacaatctggtttcgggtggattatcaaaatgggatacttaa

SEQ ID NO: 5968 - DNA, 747 bp, Glycine max
  Peptide Sequence Number=SeqID_97653
atggacagagccaggttggtttatggcttggtaacccacatggatatgaacatcgacaccctgatctcaggtcaaatctcttctgttgctcagagtaactcctctaggctcagatttccagccttgatcactaccctctgtagagctagaggaattacctctgatagtctgacttatgagagcctgagcccggccattaacttggcctacattaagaaaaactgttggaatatggattatctgatagttaacttcagaggggcaaggaaagcaagggctcgaccagttgatgttccttcttcttctactccaccagctccttccacttctgctactcctacactagctcctctagacccatctgcccaggactctcagcgctttgagtccatgcttcagagtctttatcagggaaaacagttcgtggagaaggtagcctggccagaaaatcagccttttcttgtgagggaaggtggaagtcccagtgctcaggcaggagggacacaggtaaggcaggaggctgctactccagagaggtcaacacagatttcaccagatccacctacaccaatgcatgagatgccagcagacccttctactccattactggagattccagaggaccctgcctcactagtcctgggactgactaccactcctctagccactcttgtgctacattttacagatgaggaaggcactcaggatcaagataaccaacaagatgaccagtcacaggagttttaa

SEQ ID NO: 5969 - DNA, 291 bp, Glycine max
  Peptide Sequence Number=SeqID_97654
atgaaccctaagagaataaaggtcattcctaagtggcccactccaccaacaccactcactgagttggtgaggaaccatgttccttcatgggaagatgcccaggaaatgggtgtcgagggaaggagcccagagtatgaagaacctcgagatttgaggtcaaatcctttccaaggtggacagatgatgcaatcctaccccccaagggtattggatagaagactccaagaggcttgggctagagctactacagaaggccctagggttctcatgaaccttagggtagatttttga

SEQ ID NO: 5970 - DNA, 221 bp, Glycine max
  Peptide Sequence Number=SeqID_97655
gtcgatgttgaggaagttcgaaatgttgatgctcgcattcctatatccactcaagaggttcagttagtggggcaaacacttaataccttccttgcttgggcgacacatcttgataaacagaaaactgaagggccagcaaaacttgtagataggctggatcctgatgtcgatcccctatacctaatgacattgaccatctcgcagctttttctcaagctgtt

SEQ ID NO: 5971 - DNA, 812 bp, Glycine max
  Peptide Sequence Number=SeqID_97656
atctgggacctatcatcgtagaggtttccacagaggccattgcctccctcgcccaatattatgaccaacctttgaggtgcttcacctttgtggacttccagctaacacccacggtgaaagagtttgaagagatcctgggatgccctctaggaggaaggaaaccatatctcttctcgggattctatccctccttagctagaatttctaaaatagtcaaaatctcaacacaggaattggaccgcgggaagcaagtcgaaaatggggtggttggggtaccaaggaaatgtttggaagcaaaggcgagagtcttggcaagtcaagacgaatgggccccgttcatggacatcctgacacttttgatctttggggtggtcctctttccaaatgtggatgggttggtggaccgggcagcgattgatgcttttctctccttttacgaccacaaggaaagcctggttatcgctatcttagccgatctatatgacacatttgaccaaagatgtgagaagaacaatgcaaggattgtttgctatacactggctctctacagggtccacaaggcatgggaaatgtcgcaaaggaaggacaaggaacttaaggggagtagcaacgggcccatcggcggttaccataggtggttgaaagcctatgcacaagatctggattggctcccgagtttgaggaccactaaagggatggaggttgaaactccagaagaagatgaagaggatacgaaaggagaacgccgaactgagagacgtcaatatagccaccaccaaggccttggagcaagagaccaagagggcccataa

SEQ ID NO: 5972 - DNA, 137 bp, Glycine max
  Peptide Sequence Number=SeqID_97657
gaggatgcatgagcagcgctacgacaaatttcgtggacctccaaatgaagagcataatggcgagttggagaactgcgctacggtataacttcgcggaactccagactcgttggtggaggatgcacgaacagcgttag

SEQ ID NO: 5973 - DNA, 1209 bp, Glycine max
  Peptide Sequence Number=SeqID_97658
atggtcggcaaccgcctaccgccgggcattgtgcccaatatcacaccactcacctcctctgccagcacagtcatggggttgggcgtcacctcaaacaagctgtcgctgatggagttacgcacattagtagactggcatttaaccccacatttaatgacgatcccgggcatcgcagacatcaatgtctacggtggcgaagtgcgccagttccagatcaagttggatccgcgcaaactgatgctttatcagctgaatgtgcaggatgtagaaacagccgccagccgtgccaccggtgtgcgtggtgcaggctatatccagaacgacaaccagcgcattattctgaatacacaaggccaaacgaccacgccacaacaactcgcaaacatcacgctggtgcgtaagctaggccggaccatacgcattagggacgtcgccgaggtcagtgaaggggcggccccttctatcagtgccgcggccatcaacggccagccagcggtttacctgtcggtacaaggacaattaggtgcgaatgtctacgccctgactaagcaacttgaactcaagctcgcagaaattaaacccagcctggaaaagcaaaaagtcactttgcatgaaggcctgttccgcccggccaactttattgaaatcgcgatccagagtttgcgcagtgacattctgatcggctctgtactggttatcctggtgctgttcatctttttgtttaatgtgcgaacagccattatctcagccaccgctattccgctatctttgcttacagccatcgtcgtactttaccagtctggcgtcggcctcaacatcatggtgctaggagggctggccatcgcattgggcgaagtcgtggacgatgccatcattgatactgaaaacattttccgccgtttacgcgaaaaccgcttgctatcagtgccattacccgtgaccaaagtcgtatttcaagcctctatggaggtgcgcagctcagtcgtctatgccacgattattgtcgctcttgtgtttttaccactactgaccctgtccggagtcgccgggaaactgtttgcaccactgggatacgcttacatctcggccattctggcctcactagttgtcgcactcaccctgacccctgccctctgctatgtcttgctggcgagggcaccacttaaagatgaagactcccccttactgaaatggcttaaaaaacgctat

SEQ ID NO: 5974 - DNA, 417 bp, Glycine max
  Peptide Sequence Number=SeqID_97659
atgcacaccgaggcaggatttcgcccggaccgctgcagggaggcgggtgcggatcatgcgcaccagcatgaccaccttgacccagacgtggatgacattgctgctcagcaatgtatgccacccaccaggcaccctttagacccagataagtctaacagggccttggggtttctggcattgatcacgggcctttgccagtcattcggggttcccgtcacccctagtaaggtgatccgaccgccgatcacccgggccttcatcgagaagtattgcacgcctaggcagacgcatggtgatgcacctcaggacgcaggtgcaccgccaccacctcatcaggccgatcccactggatcactaggcatggaacattatctacagcacttggttcgccagcaggcggccaaccaccgagggcag

SEQ ID NO: 5975 - DNA, 309 bp, Glycine max
  Peptide Sequence Number=SeqID_97660
atgcatcaacctcatgttaaaatttatgtctcattcatcacgaatggagagagacagaaaagaaatgatgcaagctccattggagcttgtaggcctaggatcttcttcatcaatggattcctttgcttcttggaagatgaatggcagcggaatggagaaaggaagagagagaggagacgccacttcaatgagaagatgagtctagaagaagctcaccaccataggaggccatggataagagctttgaggaagaaggagatgaatgaagggagagggagagaagagcacgaaattttgtgctctaaatga

SEQ ID NO: 5976 - DNA, 707 bp, Glycine max
  Peptide Sequence Number=SeqID_97661
gactctgccagtcattggagttccccgttgcacctaccaaggctcagggtgatgctccacaggccgcaggcgcgccaccaccacctcatcaggctggccaggctggggcatttgacatggagcagtatttacggcatttggttcgccagcaggcggccaaccaccgggcacataccagttcagggcagaggtcgcatggcccggagattggcccgaggcccaagcaggagaggcgccaccagaagctcccggcgatggcgaggaggcccacgaggacgaggagatggccgatttgcttgacttcttgggagggagtggagcttcatgactgggagatcctcgaaggcaatgagaggtgcggattccgtggcacaattcgacttactgctacttcattagtacatccggaggaacccgcacacacacttcagcagcctgtggagtggatactacctacacctactccatatcgactagatgagccggttcaagtgatagagttgtcatcctctgaagaagatcttgaagaggacctagaggagttacctcctgaacctgctatggacgcccttgacttacctgaggatgatgaagacccactccctgatgttgattccccagaggatgttatgtcagcatctgaggcagactctacagaggagagtggccctggagggacagcgaatagtgatgactcttcatcatag

SEQ ID NO: 5977 - DNA, 213 bp, Glycine max
  Peptide Sequence Number=SeqID_97662
atgggtgaagtagaggaggtacaagaacgaatcaaggctgacatgaaggccatgaaagagaaagtggccacaatgatggaggccattatgagcatgaaggagataatggagcacgccttcacgccatatggcttgcctcccaactatacaccacccaatgtggcatacactcccagtgaggatgtcaataactccctctcccatactcattga

SEQ ID NO: 5978 - DNA, 1095 bp, Glycine max
  Peptide Sequence Number=SeqID_97663
atgaatgacgtaaggaaactggtgcaagacttaaagcctgtatttctgatggtatcggtgcaaattgcatactcttccgtgaatgtgctctataagctcgccataaatgatggaatgagcattagggtagtcactgcctaccgcctaatgttcgcagtagttttcacttcttctcttgctcttattttcgaaagtgcaagtttatttcataacctattcctcgaggcattggatttggtgtcggcaacattcgctactgctgtttataatctcgttcctgcagtcacttttatattggccatcttgtgcggcatggaaaagttaaatgtgcgaaccgcagcagggaaggccaaggtgatgggaacaataataggaattggtgggtcaatgttgctgacatttttcaaagggcaagagattaacgttaagagtttcggtactaatcttttgcaaaagaatgagcaggtagtagctttgcatactgactctggtaaaaaatttctgggagttttgtgtggttttggaagctgcttcagttttgcattatggctcatcattcagtccaagatgagtaaagaatacccaagtcatcactcaagtactgcattgatgtccttgatggctgcaatacaagccacagcctttgccctttatgttgagaaggattggagccagtggaagttgggttcgagtattaggattctaactgtggcttatacggcaattgtggcctccggattagtggtaattgtcattgcatggtgtgtacggatgagaggcccaatgtttgtatctgttttcaaccctcttatgcttgtgcttgtggctgtggctgattccttgatgtttggtgaaaatttatatgtaggaagtgtaatgggagccatgctaattgtgggtggcttgtacatggttctatggggtaagagcaaagaaatgaaaaaggcgaatctgtcggtctcatcagaaatcaaccaagagcatgaagcaactgaagttgttgtcatgtccacaacaataaatgatgataattgtgaccgcgttaacaataccgacgccaattgtaaaagcaatatagttgccaaggtttcttga

SEQ ID NO: 5979 - DNA, 780 bp, Glycine max
  Peptide Sequence Number=SeqID_97664
atggacaagagatactggttcatccctgcttattcaaaggaagatatacgaaggatggctattcttcagggccttgagtatccatcaacaccagacttcaatgcccaagatgtttctgatgatgcaatgtgctttgctttcgccccagtggcatcaggttccatctttggaaacttagcacagatgaaccagttggttggatatgatttcctgaggaagactgtgtcctttaagtccactgctcaatgttttttatgtattgatggcttggtgcagatcaagaaagcgaacccagaggccgaatttaaggaaatttcaaccatggtgattgcaaaggaaaaacgtgaaactgagtcaatgaggttgttggaagacgagcagaagcagaggactgcgatggaattgcttgaacagtacatgcaattcaaacaagaggcagaaaaagatggaaagaagaacaaagaaggatccattgaaaccaaagcaccccatgtcagttatttcttgttcactaatgataggggagcagctcttgctgccgagaacaagaatttcttggaggttccaaaaatcacatccgaagagtggaaaaacatgacagaagaacaaaaaagaccctatgaagaagagcaatatgccctagaaatggaggcttataaacagaagaaagatgaggaggctggccatttcatgaaggaagaggaggaccatatgaaacttcaaaaacaagaagcattgcaactgcttaagaagaaggagaaaactgaaaatataatcaag

SEQ ID NO: 5980 - DNA, 829 bp, Glycine max
  Peptide Sequence Number=SeqID_97665
atggataatgttaaagctgtcaaggatattcttagaagttatgagatggtttctggcatgagaatcaattttggtaatagtcaatttggagcaattgggcaatctgatgagtggtgctgtcttgctgctgactacttgaactgtgccctactgcattttcccttctactatctagggttgcctataggaatcaatccgagaaggaaggttcatgttgctgcgatggtcacagaatcaacttcaaggaacgataccacttcaggaaacagacatgcaaatgatgaaaaccttgttgctgttgcaggggacagtgaatcagatgttgttgaaggagaatcagtcacactcacacatggtggagcggtttcaaagagtgcattgtgtgttttgagtgatctaggaaacttgagagggaggcatagtttaattgatattagagatgaagggtatgattccattagaaggacggtttcaatggaccattcgtttcaaaggggtagtggtctttcaattactgatgttctgcatgtgaatcaagagcataaagggtgttctaatggggctggtccttcaaagaattcaagaggtgaaattagcaagtctagctacaggagaagggttttgcattgtgttttgagtccaattgcaatgaaaagatcattttctagtggaaggcaaggttttcatgagtttgtgacggaggttcttatgttgagcctgctgcacgattctaatcttgtcaagttaattggctactgcactgatggagatcaaaggcttttggtttatgagtacatgcccatgggttcactcgaagaccatctttttg

SEQ ID NO: 5981 - DNA, 699 bp, Glycine max
  Peptide Sequence Number=SeqID_97666
atggaaacacaaatagaagagattcagagcacacgttcattgagaatccccaaaatctcttcagttgctagagactctgatatcattgaaaatctgcaatacacgagcctgaaggacatcaaatcgtgcaacttcggtttacctacaatctgcggcgttgtagattaccaaaaacgaaaactgctttatgactttctgggaaaggctaaagaacagggctgcttcctattcaatatggagggtttcagatcatgcaaacccattcagggcttgtcttgccccaatttaccagtttctgaatcacatgttggggagtattcagaagaaatgattctcattaaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaaaatactggacatataaatctgttatatcgttaacagattattgtgcaatttttcagaagaatgatagatctcatccagcacaagaagttgcagcccagatacgctcactgctatataaacacgaaggctgcacgagttctgtaccaagtccgggattgaagagttatttcgtgagtttcgggacttga

SEQ ID NO: 5982 - DNA, 210 bp, Glycine max
  Peptide Sequence Number=SeqID_97667
atgggatcttcgttagcaatgagatgttcatctcagtttgatgtttgcatttatggtagttgtgaaggtggcgtaaagggggatgaaggatggttttgttggtcaaaggagattggattattgaggtctatgttgttatacggtaactgttgtggagacggtagttgtagttgtggacataagggttgtggagacgatggttgcggttga

SEQ ID NO: 5983 - DNA, 543 bp, Glycine max
  Peptide Sequence Number=SeqID_97668
atgggacagtatactcctttggatcaggtgctaatttttgtcttggccatggtgaccaacatgatgagttgcagccacatcctatacaaaaattcagaaggaaaggtatatacatggggcaagggatactgtggtgctttaggccatggggatgagattgacaacacaactccaaagttattgactagtctcaagaatcaattggttgttcaggtctgtgtaaggaagaggaaaacatttgttctagttaattctggttcaatgtatggctttggctcaatgggatttggcagcctcggattcctggatagaagggtatctgataaagtattgaaacctagaatcttggataccttgagagctcaccatgtttcccaaattagcacaggcttataccacactatggtgatcactagcaggggacatatatttggctttggagacaatgaaagagcacaacttggtcatgacacattaacaagctgccttgagcccactcaaattttcattaaacatacatatgaagatgtagaaaacacctga

SEQ ID NO: 5984 - DNA, 1752 bp, Glycine max
  Peptide Sequence Number=SeqID_97669
atggggtgggggcagaccaatttatttgatccgtgtaagaagcggggtggattggctcagtctactgccaatgcggacttatgcaggcgggccttacgcgggatggaccgacccgtttacccacccctgcctacatatcccatgccatcaacaaaaattatgcctctaagctcatattctaccgttgttgccatagcgcttttattttcatttacatcttcagcacatactcaagaaaactttgttcaatgtcttaacaattatccccataatatcaacgccacctcaatctccaaggttctttacaaccaaaccaactcctcatactcctctatactagatttttccattaaaaatcttaggttctccaacgtaagctcaaaaccccttgtcattgtgacacctcttgttgtctcccacattcaagccaccataatctgttcccaacgccatggcatgcagattcgaacccgaagtggaggccacgattatgaggctctctcctacgttgccaaggctccatttgtggtcattgacctcataaaccttggagaaatcaaagtggaaatggaaaacaacactgcatgggttccagctggggcatctattggtgaactttactacagaattagcgagaaaagcacaacacttgggttcccagcaggtgtgtgtcccactgtgggcactggtggccacttcagtggaggtggctatggattcttgatgcataagtttggtcttgctgctgataatgtaattgatgctcacatagttgatgtgaatggtaatcttcttgatagagaagcaatgggtgaggatctgttttgggccattagaggaggtgggggagcaagctttggagtcatcgtggcttggaaggtaaaactagttccagttccatcaactgtcacagtgttctatgttccaaggacattggaacagaatgcaactgagataattcataagtggcaacttgtggcaaataaacttgacaatggactaatgattagggtcaacttggaaagggtaaattcaagtcaaaatgggaagccaacagtagtagctacatttgagtccatgtaccttggaggtgtggatcaactcattcccttgatgcaaaagagcttcccagagttgggtttggtcagagaagattgtactgagatgagttggatagattcagttgtctatatgtctcaatttacaaatggaaaatctgattatgtgagggatccgattcctgatgttgggttaaaagggttatggccattgttttatgaagatgaggctcaaggtgctgttattcagttcactccttatggaggtaagatgtatgagatttcagaatcagaaattccattccctcacagatctggaaacatattccatattcattacttggtgcgttggcgagaggaaggggaggaggcaaaacaaaagtacataaactggattaggagagcgtacaaatatatggaaccttttgtttcaaagtctcctagagctgcatatctaaattatagagaccttgacattggagtaaataataacaatggcaacacaagctacagccaagccagcatttggggtcttaagtatttcaaaaacaacttcaatagattggcaagagtgaagagcatggttgatcctctaaacttctttagaaacgaacagagcatacctcctctcaagtcgaagggactcaacatgcaagtagaaaaccttggagctgtaaatgtctttataaaataa

SEQ ID NO: 5985 - DNA, 273 bp, Glycine max
  Peptide Sequence Number=SeqID_97670
atgagcctcatcatctataaaactgccgcctacctctgtggttggaacttgattttggagagtgtgcaagagggagtgcctctaataccatgctcactctttgcagatcatgatccaatgagcctcatcatctttaaaactgctgcctacctctgtgattggaacttgattttggagagtgtgcaagagggagtgcctctaataccatggtcactctttgcagagcaaaagatgaatgcagtgatgttagttgatggcctcaaagtaggatag

SEQ ID NO: 5986 - DNA, 1299 bp, Glycine max
  Peptide Sequence Number=SeqID_97671
atggcgtcgtcgaagcttgtctcgacgaatccggatcttccacgggacccttcttcttcatcatcttcgtcttcttctatatctcccctttcttctcttctctccgatctgcaccccatggacgacctcctcaagtccatcacccccaattccgtcgacgacttctggaaggggatcgctgccgcctccaccgacaatgccggcggcgtgaccctcgaggatttcctcaccaaggccatccccgtcacagaggaagacgtcagaggtgctcctcctcctcctccttcttttctccccttccctgccgaaggctcttcctcctccgttgagcctttcgctaataatggcgttggcagcgcgccctcaaactcggttcagaaagggaagagaagggccgtggaggaaccggttgacaaggcaacgcttcagaagctgaggaggatgatcaagaatagagagtctgctgctaggtccagggagcgcaagcaggcttacacatctgagcttgagtatctggttcaccagctagagcaagagaatgcgcggttattaaaggaagagcgaatcgccgtcgacgaacaccacccaaacatgtcttctcttcgaaacgccattcctaggcgtgctcacaaagagcgttctcaaccgtcgtcgaggaaaaaattcggcctgttagaaaagcacaaagactatgtccagcgcgctaaagcattccacaagaaagaaggcactttgcgggtacccttttactctttcctcttccttcaacttctcattccttccactgttaacaattttttacagaaacttagggaaaaagctgcaaatagaaatgaagatgagttttacttcaagatggttagaacaaaaaccgttgatggagttcataaaccagagagtgaagcgaataagtacactcagcaagagcttatgctgatgaagactcaggatatgggttacattctccagaagattcagagtgagagaaataaaattgaaaggcttactgcctcgctgcactctatcgataaacagccagtgaacaagcatgttttgtttgccgaggagaggaaaacagctcagtcttaccaagagttggaagcaaggagaagtagactcaaccaactagagaaaatctacatggatatggcaatgcagaaggagttgcagaaaaaaggcaggaagcgcaaactaggtgaagacgagattgtctgtccaacctctaaaccgttgaagaatttgcatgtcttagatgaagcaccaacattgctagctgcagcatcgaatgtcttacattaa

SEQ ID NO: 5987 - DNA, 948 bp, Glycine max
  Peptide Sequence Number=SeqID_97672
atggaagcttatagactgattaatataattggagaggacaaaggaagagattctccaaaagctcaaccttggcctcaaatattgatcatgggtagaagccgagaaaaacccacaaagatggaaattgatctctctttgaagatagatactgatgatgagcataaagaagaagaagatgagcgagtgaaagaggatgaggagcaagaaatggcacagattcaggataataataaggaagaaatccctgaagccacagctggtgaaatagaagatgatgcatcagtcatagaaacatctttgcaagataacacaaaaacaaaagagttaagtgtcttacaaatggagatggagagcatgaaagaggaaaacaaagttctgaggaaagttgtagaacaaacaatgaaagactattatgatctgcaaatgaaattctcagccatccaggaaaacaataaaagaaaggatcatgaaatttctctctcacttcaagacattgcgaccaccagcggtgaagggccatcgagaattcttgagatctttaacaaacaaatgcaaagtgctccatctcctccacaccctgatcatgatgatgatagtttaagcgagagtgaattgggtttatcactaaggttgcaaccaagcacaagccatcataaagaaagtgatgtgggaaataataaggaagacaaaaatgatcaacagttggcaagttatgcatcagtgcagaacaaattacagcggacaaattgcttgcccggtattactacccatgctgcttcccctcctaatagaaaggctagggtttctgttagagcaagatgtgaagctgccacaatgaatgatgggtgccaatggagaaaatatgggcagaaaattgcaaaaggaaatccatgtccacgagcctattatcgttgcactgtagccccaggctgccctgttaggaaacag

SEQ ID NO: 5988 - DNA, 927 bp, Glycine max
  Peptide Sequence Number=SeqID_97673
atggcaaaaggtagcaggggaagacacaggattgcttctcgtcaattcagagtgactccatacccactggcttcttgcaaaagggacatttgtgaggacctctgccaaaacaaatgttctaaggctttggaaaagaaagagtgggaagatgttacatgttctgtgtgcatggaatatccacacaatgctgttcttcttctttgttcttctcatgacaagggttgccgtccctatatgtgtggaactagctttcgtcattccaactgtcttgatcagtacaagaaagcttataccaaggcaatttcacctaataggcaacctatgcaaggcactccaggtctgctacaagattcaaacatgcatcttgagaagagtgaatccacagagcttgcatgtcctctatgcaggggtcaggtgaaaggttggaccgttgtggaacctgttcgggactatctgaatgcaaagaaaagaggctgcatgcaggatgactgctcatttgttgggaactataaggagttgaagaagcatgtgcgggcagagcatccctcagcacgcccacggatggtggatcctgccgatgaacagaaatggagatggctcgagtgggagcgtgaaagagaagatgttatcagcacagtaacatcagcaatgcctggggcagtagtttttggagattatgttatagaaggtcatcataatgactttgatacagatgaagaggagggtgcaggtaatgcagaaagaaatggaagatttcagatgggtttagaggcaatgaatttcttcctcctgtacaatgaagatactgatggcggtgtatctttggttagccgtctccaccgccatggtggtggcagagttttattgggtcgttctggtaggaggcggagatgtagagaagcacgtgcaaggattggagatagttga

SEQ ID NO: 5989 - DNA, 492 bp, Glycine max
  Peptide Sequence Number=SeqID_97674
atgaagcggaaccggagggcattggctaaaaataatagcttatggtgcaaggtgttgaaatccaaatatgaggagttaaacaggttgggagtaggggtatctaacaaagggtcggtgtggtggaaggatatatcaaaatgtttaagaattcaggtcaaaagatgtgttgtgttggagaaatgggtagatgggtgcaagggaggtggtagtgggaattcgaatggaggagggactagtttgaatgggaaaaaaaatgctgaaagatttcatgcaactcattacccaaagaatgcattaatgaaaagtgggtatggaaacatgacaacagtgcagtataatatgttaaatttgcgtatgcatttctgcgacaaagacatgatcatgatgacaaatcatttttttcactgcttgtggatgatgaatataccctctattattgcgacgttcaggtggaaggtgttacttgacaatattcaaactaaagataattga

SEQ ID NO: 5990 - DNA, 510 bp, Glycine max
  Peptide Sequence Number=SeqID_97675
atggggtatctggccggagacactagtgtatctgatatagagttcacgaagcttggtgagtttggtgatggtggtgggtattgtgccaacgatgttgggggagttggtgatgaaaagaaatttgaggtagggaaggttgcctatggaggggggaatagggtagggtttggtgaggtaaatttcggagaggtcgaggttgtcgacgcgatttatctaaaagatgtgtttctccgacctgaacaacaccgacacatcacacaccaacatgttctgagacaagtccacaaaatcaaagacgagcttcgccagtgtctccagaatccccctagtgaggcagttgttagagagagttatcagcttgaagggctccgagaaggagccgaaggagttcgagatggtggcagagatgcggttgccatcgaaggagactctgtagaggttggagatcaaagggagcctaagagggaggtttccggagaagttgttatagaggaagataatggtttctag

SEQ ID NO: 5991 - DNA, 1494 bp, Glycine max
  Peptide Sequence Number=SeqID_97676
atggttacgatttcttcaacttggtacttgtttcttcccataattttatcgttatgccccataacactatgtgcatcagtgctagaagacctcaaaaacttacatcaaccaccagattttaactctacaattttctccaactgtctcaagaacccgtctctaaggtactgcagttcctctcccatgttggaccttgatgaaatattcaagttcactattgttgcaagccatctctgcaatgagtcaaagaatcccaattgtgtggagtcattccccaaagttgatcttagaaaccgaccaaacattgcacctctttatttgtccttcgatttcttttggaagtattgccccttaagcattatgtccattgatttgtcaaacaattctatgaagggtgattttccaactgatgttctctattgcactcaaatccagtctcttgatctaagtatcaatgcattttctggtgacattccaattcaaagtttctctccccttaccaacctcacttttctcaacctctcctataactgcttctcagagagtaaactctctgattcccaattcttcaaaaggtttaactcttctagttttcttcattctggtgctcttttggatcaaaaaaggcctgattttctaccaagtaaacttcaaagaagtaggaggtttacaccggcaattctaaaggcagcaactaatgatttttcaaataagtatttggtaggaaagagtgatgttgttcacatctacaaagggatcttgagagatggtactgaagtgaagattgagatgtactgggatgatataccgagggatagttaccgtaaatttgttgaagaatgtaaggttctgtctaagttacatcacaagaaccttgttagatttctggggtggtgtaggagcagaaaattcagggctattataactgaatggacaagagaagagaatgttgaaatgtggttatcagggtcaggtccaccatggaatcatagactgaaagtgttaatgggagttgttgcatgcatgcgttatctgcaggaggaatggcctgaagttgactatgaactcaacacaagtagtattttattgtctgacaatgtggaaccattgatttcgaggttcaaagttggagatcaaaacagcaatcgaagaaagatacatgggtttggagtatttcttctagagatgatactaagtagaaaggttcaagaggagtttgatggaggtgatgctggatttattagattcatgagaacccttaatcttgcagatttgaagcagatgattgatgagagaatgaaagtaactgaaacaatttttcatcaagttaaacaggcattgtctctaggattaatgtgcatagaccaatcaaacagtgacaagcctagcttggccatgatatttaacactatagcaagagcctacaaggctagccatgctttgccatctgcaaatcatagatttaagagacacatgcctgttcaaaccaaataa

SEQ ID NO: 5992 - DNA, 603 bp, Glycine max
  Peptide Sequence Number=SeqID_97677
atggcatcggtgtccggaaacataaagggtttttacagacagaagaaaaccaccgccaccaaaaaatcttccaaaaaatctccgattcccgccgcggcccaatcaccggccctcatatcccacggcggaaaacccgacctagaagatgagtacaaggagagcgaggtggcgctgcggcaattcgacctgaacatggcgtacggaccttgcctcgggatgacgcggctcgcgcggtgggagcgcgctcagaggctcggcttgaaccctccgcaggaaatcgataggctcttgaagagtggcaagggctgggcaaaagctagtgtttctgactttagagttgttcactgtggtgatgagttttatcagggctgggcaaaagctaaattcagtttcaaaccgatggcctcccctgcgactcggaatagcatcaattggtcccctccaatctcgggacacctcaagtgcaaccttgatgctggttttgctcatggcactaacatcactgaaatggggtgttgtgttagaaaccatgttgtggctcttgttgctagttacatgaactcgaggtcaccatgtatggatgttaaggaaggagaaacatag

SEQ ID NO: 5993 - DNA, 1697 bp, Glycine max
  Peptide Sequence Number=SeqID_97678
atggagacagaaacaatagcaaaccaggcagaagctactgatttggatgagaatatgtcagcaccaccatcaccatcactgcacgacattggtggtggcagtaacaagaatatcacttgtcgcattgatggtgcattatactttgctgcggtggaaggcaacttccaagagttcatcaatatccacaatttggagaatctgctcaccccaaacaaaaacaccatccttcatatacacttgacttctacaacaagtaaaagtggtaaaacaacacctgcttcagcacaatttgtgactcagattcttgtcaagtgtggacgtctagttctactccctaacgccaagggagaaacactccttcatgtcgctgcaaggtatggacactccaatatcgctaaattattgcttgaacatgccaaagctaaaatttcaccagacattgagaatggtgttggagcagatcagaagtttatcagggccacaaatgatgagttggacactgcattacatgaggctgtgcgctatgatcacattgaagtggtgaagaccttgttagaaatggatcctgattactcctattatgcaaataatgccaaagagactccgctttatctggcgtcagaaagacaaaatctgcaagtggtgcgtgagatattgaagaaagtgaaatcaccgtcatatgatggccccaataatcagacagcattacatgctgctgtgattaaccaagatatagcaatggcaagagatcttctaaagaatgaacatgtgagagtggcggtcaaacttgcggacaagaaaggttgggttcctcttcattatgctgtgaaaacaaggaatgcagttttgactaagttgctgcttaaagaagatgagaacactgcatacatgcaagataacgagggcagaaccgctcttcacatcgctgctgatagtgatagtcggcgtattgtgaaaatgataataaaatactatccagattgttcggagatagtcgataacaaaggttggaatgctcttcattatgctgtgaatggggggaaacagaatacaatacgtagaatcatgagaaacctgtacctgagcaacctttacaatgagaaagatgttgatggtaacacaccccttcattacctcccaaattccaacctcgttgcgtgtcacaaacttgtaggtcaccccagagtcgacaaacttgcagtcaacaagaaagatcaaacagttcttgatgttgcctatgttaagaccgaagatccagatccagaatcagataaacgtacaagagagggccaaattgtgttattagaaatggctggagccaaacgaagtttgcgactagatcaaaaatcaaagaatgggctaaacgggctagtgtttccgaaggaagcaaagcagacacatctattagtggctacactcatcacaaccgtaagttttgcagctgggataaccctaccaggaggtaccatacaagatggggaacttaaaggtacccctcttttggggcataaaacctctttcaaagcattcatggcatcaaacactatagcaatggttttggcatctactgcagcttttataaatcttttcacgccactgactaaaactaaatggaaggattattatttctcaaaagcagccctaatattcactttgacggccttagtaacaatgattgtcgcattcgctacaggcac

SEQ ID NO: 5994 - DNA, 1611 bp, Glycine max
  Peptide Sequence Number=SeqID_97679
atgatgcatctaagcttatattttacagttgttgccatagcgctcctattttcatttacatcttcttcagcagatactcatgaaaactttgttcaatgtctttataattatcccaatagcggaacctcaatctccaaagttgtttacacccagaccaactcctcatacacgtctacactagattcttccattcaaatttctaggttcttaaacgcaagctcaaaaccccttgtcattgtgacacctttggtcatttcccacgttcaagtcaccataatatgttcccaacaccatggcatgcagattagaacccgaagtggaggccacgattacgagggtctctcgtacattgccaaggatccatttgtcgtccttgacctcaaaaaccttcgagaaattaaagttgacgtagaaaaaagcaatgcatgggttcaagctggttcaactattggtgaactttactacagcattagccagaaaagcaaaacactagggttcccagcaggtgtgtgccccactgttggcactggtggccacttcagtggtggtggatatggattcttgatgcgtaagtacggtcttgctgctgataatgtaattgatgctcacatagttgatgtgaagggtaatcttcttgacagaaaagccatgggtgaggatctgttttgggccattagaggaggtgggggagcaagctttggagtcattgtggcttggaaaataaaactagttccagttccatcaaaagtgacagtgttcagaattgcaaggacattggaacaaaatgcaactgagattattcgtaagtggcagcttgtggcaaataaatttgaccagcgcctaatcattagggttgcgatgacaagggtaaattcaagtcaacgtgggaagctaacaatacaagccagatttgagtccatgtttcttggacgtgtagaccagcttattcccttgatgcaaaagagattcccagagttaggtttggtaaaagaagattgtactgagatgagttggataaactcaattctcttcatgaaagctgggttagttggatccgcaagcaatgaaacccttgaagttttgctgaacagaactcaagctgtttttttgacattcaaaggaaaatctgattatgtgagaaaacccatttctgttgttgggttacgaggcttatggcgcttgttttatgaagatgaggcccgagatgcttcggttgaattcgctccttatggaggcagaatggatgagatttcggaatctgaaattccattcccacacagatctggaaacatgttccatattcactacgcggtctattggcaagaggaaggggatgaggcagcacaaaggtacatcaactggcttagaagattgtacaaatatatggaaccttatgtttcaaagtctcctagagcagcatatctgaattatagagaccttgacattggggtaaataataactatgactacacaagctataggcaagccagtatttggggtcttaagtatttcaacaataactttaagagattggcaaaagtgaaggtcaaggttgatcctcaaaacttcttcagaaacgagcaaagcatcccacttctcgagtctgagtga

SEQ ID NO: 5995 - DNA, 1617 bp, Glycine max
  Peptide Sequence Number=SeqID_97680
atgatgcgtctaagctcgtattttgtcgtagccattgctcttctcttttcatttacaccttcttcgtcagcaaatactcatgaaaactttgttcaatgtctttacaattatccccataataacaatgtcacctcaatctccaacgtcgtttacacccaagccaactcttcatactcctctatacttgacttttccattcaaaaccttaggttctccaacgcaagctcaaaaccccttgtgattgtgacacctctcactgtttcccacattcaagccaccataatctgttcccaacgctatggcatgcagattcgaacccgaagtggaggccacgattacgagggtctctcctacgttgccaaggatccatttgtcgtccttgacctcataaaccttcgaaaaatcgaagtggacgcagaaaacagcactgcatgggttctagctggtgcaaccattggtgaactttactacagcattagccagaaaagcaaaacactagggtttccagcaggtgtgtgcccccctgtgggaactggtggccatttcagtggtggtggctatggattcttgatgcgtaagttcggtcttgctgctgataatgtgattgatgctcacatagttgatgtgaagggtaatcttcttgatagagaagccatgggtgaggatctgttttgggccattagaggaggtgggggagcaagctttggagtcatcgtggcttggaagataaaacttgtttcagttccatcaactgtgacagtgtttagggttccaaggacattggaacaaaatgcaaccgagattgttcataagtggcagcttgtggcgaataaacttgacgaggacctaaccataaggatcaactttggtagggcaacaagtgaaaatgggaacctaacagttcaggcacaatttgaatccatgtatcttggaggtgtggatcagctcattcctttgatgcaagagagcttcccagagttgggtttggtcagagaagattgtattgagacgagttggataggttcaattctctacatggctggatttacaaacggtgaatccactgatgttttgctgaacagaactcaagcaaacggtgtgtcgttcaacaaaggaaaatctgattatgtgagagatcccattcctgatgtagggttagaagggttatggcccttcttttttgaagatgagggtcaatcttcttttgttcaattcactccttatggttctaggatggatgagatttcggaatccgaaattccattcccacatagagctggaaacatattccatattcagtatggggtgtcttggcaagaggaaggggatgaggaagcacaaaggcacataaactggattagaagaatgtatagttatatggaaacttatgtttcaaagtctcctagggctgcatatttgaattatagagaccttgacattggggtaaataataacaagggctacactagctacagccaagccagcgtttggggccttaagtatttcaagaacaacttcaacagattggcaagagtgaagaccaacgttgatcctctaaacttcttcagaaacgagcagagcataccttctcttgtatccaagggacgcaaattatag

SEQ ID NO: 5996 - DNA, 2340 bp, Glycine max
  Peptide Sequence Number=SeqID_97681
atgggggaagatcttttctgggctattagaggaggtgggggtgctagctttggggtcatcgtttcatggaaaattatgttagttcccgtgcttcagtatgttgctgataagatacacgatggcttgttcattagggtgattcttagtcctctgacaagaaagtggggacttcggttgatgttttgcttcaaaggcatgctacaaaaagagaatttcttgaagaagaaatcagatgatgtgcagtatatggaagatgatgatgaaactagaaaagcctgttttcatttcaacccctatggtgggaaaatgggtgagatttctgagttcgaaacaccgtttccacatagagctggtaacatctatgaaattcagtactctgtgagttggaatgaggagggtgaagatgttgctaatcaatatttggatgttgatataggtgtcgatggacctggaaatgctacttatgcacaggctagtgtttggggtaggaatgttaactcgtctctcgtatccccacactatgtgcccccagaaaccgagtcactactcaaccactgttaccgaagggaccttcccagcgccatgcatgtgttggattccatggaaagaagaggagtttgggccgattctatcacctattctgagctcatcaagtgttgcttggctcacggggctgtcagggaaggaaaacgcgttcaccgccacatattctcaaatgggtatcaccctaaaacgtttttgaccaacattctcatcaacatgtatgtcaaattcaacctcttggaagaagcacaggtattgttcgataaaatgcctgaacgaaatgttgtgtcgtggactactatgatatctgcttactctaatgcccagctcaacgacagggccatgaggctcttggctttcatgtttagggatggtgtcatgcctaacatgtttactttctcttcggttctgagagcgtgtgagaggttgtatgatcttaaacagctgcattcttggataatgaaagtggggttggagtctgatgtatttgtgcgcagtgcgcttattgatgtttactcgaaaatgggggagttgttggaagctctaaaggtttttcgtgagatgatgactggagattctgttgtttggaactccattattgctgcttttgctcagcacagtgatggggatgaggctttacatctttacaagagcatgaggagagtgggttttccggctgatcagtcaacactcacgagtgttttgagagcgtgtactagtttgtcattgttggagttagggaggcaagcccatgtccatgtgctaaagtttgatcaagatcttatcctcaacaatgcccttttagatatgtattgtaagtgtggtagtttggaggatgcaaagttcattttcaatcggatggccaagaaggacgtaatctcttggagcaccatgattgctgggttagcccaaaatggttttagtatggaagcactcaatttatttgagtccatgaaagtgcagggtccaaaaccaaatcatattacaattcttggggttctgtttgcttgtagtcatgcagggctagtaaatgaaggttggtactattttcgatctatgaataacttgtatgggatagatcctggaagagaacactatggttgcatgcttgatcttcttggaagagctgaaaagcttgatgacatggttaagttaatacatgaaatgaattgtgagccagatgttgtgacgtggaggacattgcttgatgcatgcagggctcgtcagaatgtggatttagccacgtatgctgctaaggagattctaaagttggatccacaggacacaggagcctatgtgttgttatctaatatttatgcaatttcaaaaaggtggaatgatgttgctgaagttcgaaggactatgaaaaaaaggggcataaggaaagaacctggatgtagctggattgaagtcaataagcagatacatgcttttattttgggagataaatctcatcctcaaatagatgagatcaatagacagttgaaccagtttatttgtcgactagctggtgctggttatgttcctgacacaaattttgtactacaagatcttgaaggggaacagagagaagactctcttcgataccacagtgagaaactggcaattgtttttggtattatgagctttccaaaggagaaaactattaggatatggaagaaccttaagatctgtggagattgtcataaatttgcaaaactcatagcagagttagagcaacggcatattgtaattagagatcctattcggtaccatcattttcaagatggggtttgctcctgtggtgactattggtag

SEQ ID NO: 5997 - DNA, 348 bp, Glycine max
  Peptide Sequence Number=SeqID_97682
atggtggaggaacctcaaattgagaatagtgatatgaaagatggcaatgatcaatttgagtgtttgacaacttacaatgctttcgtcaagtactatagtgagcaactcaaaaatgctatagagatattaagacaagagaacctagatgcttttctttgggtaaaattgagactttcaaagcatgttgtggaaagggtgaaaaagaggctaagttttgaattgcaaaatgtaacagtttggctaagctcagcagttgggctaagcacatatccaccgttaagcgcagcttcagcgcgcttagcgcaaaggagaatttggcagagcatcaacatcaaagtcgcgcgctaa

SEQ ID NO: 5998 - DNA, 327 bp, Glycine max
  Peptide Sequence Number=SeqID_97683
atggctcgaaacaaggaagcgttgcttttgctgcttgatgtgggcccgtcaatgcatcccgctctttctgaaattgagaaagtctgctccatgcttgtgcataagaagctgatctatagcaaatatgatgaagtgggaatagtcttatttggaactgaagacactaataatgagcttactacggaagtgggtgggtatcaacatgttgtggttttgaaaaatattaaagttgtggatggagatattgttgaggctttacaacaactgcctcgaggaacaactgatggtgattgtatccatgaagttcttggttttatattatgctag

SEQ ID NO: 5999 - DNA, 462 bp, Glycine max
  Peptide Sequence Number=SeqID_97684
atgcagataatggttagaactagaggtcttggtcgggctttaggtcgaacaataggaaaagccctgaagaggagagacgaacgtcctgagctgaagctatcttcccatggaaggaagatgactaagttcgggaggcctgctcccgagattaaaggccttgtggttgccagtggactaagtcctttgatcgcctgttccctagatacgggcgatcggggactaatgtctgcttttgtggaacactggcataaggaaactaacaatttccatttgcctatcggagaggtcactatcaccttggatgacgtcgcgtcgttgctacatctgcctgttgtaggggcgttccacagcttcgagctacttcatgttgacgacgctgtcgatatgttggtggaattactcgaggtcagcgctgtagaggcgagagctgagacgattcagtgtcatgactcttatgtttga

SEQ ID NO: 6000 - DNA, 693 bp, Glycine max
  Peptide Sequence Number=SeqID_97685
atggaacgctggcataaggaaactagtagtttccatttgcccatcagagaggtgactatcaccttggatgacgttgtgttattgctacatcttcctatcataggggcgttccacagcttcgagcaacttcatgtcgatgacgttgtcgatatgttggtggaattacttgaggtcatcattgtagagagtgggagttacgcttggggcgctgttgcacttgtgcacatgtatgataatttaaatgaggcgttgaagagcaaaacgaggcagcttcattttccgtctattggttccgccctagttgtcgaggattatgataagagaagaccacgtgcatgccaatggacctctggcaaggcactgcccgtgtcgacgtatcgcagacgtttggatagattgacccctaacggtcccttgacggtcattcaccgaccggagagggttttcagtgactacattacacctgtaggacaaatctgtgtagtgcctagccagtgttcaccagattacatggatgggttctacatgatttcacacccattcatgagtccgacacagccaagggatcctcctagagtttcgccggttcaagaatatgacacatttgttgaaccagatgtgcatcagcaaccggtggaggcagcgacacctgatgaggtagacgctgatgtgcatcatcttggacatgcagtg

SEQ ID NO: 6001 - DNA, 429 bp, Glycine max
  Peptide Sequence Number=SeqID_97686
atggggcgcttttcaaaaaaatttacccaaggggactcttttggacgtaaaacgcatgcatggtgcaagcaaaccgccaatgggactggcgggtttgctgttggtgaaggactcgccactacgagtggcgatatgcacatgcaacctgaagaactcaccattcgaagtggcgacatgcacagcaaggggaaccgccagtttgactggcgagttcccaccacaagaaggtggatgtggaactcagcttcgcttgcattgctttcttcttcttcttcatattactctagttcttcatattacttcaatacattgcggttcttcttgttttctttctggacagtgtttgttcctcttgctattaggtggtttctcctcttgcgagctattatgtggtttctcttgttgctattacgtgatttttctatttga

SEQ ID NO: 6002 - DNA, 129 bp, Glycine max
  Peptide Sequence Number=SeqID_97687
atgtctgaagaagttgatatgaatgttgaaaatgagagagatgctggcgtgaaagtagaacacgttgattgctctgatgcctttaatacttctcagttgtttgctagccatgatcaagttttacattga

SEQ ID NO: 6003 - DNA, 1206 bp, Glycine max
  Peptide Sequence Number=SeqID_97688
atggcatccacaaattctagtgcaactccggccaacgacagtggcccaactccagcgaacaactccggtgcgactccgctcgacgcggttccgatgaatcaagatgtttcttcatcattccctatgaaattttttgcatcaaatcacagaaaacaaatcaagccagtgattgctgcacttggactcaattacttcgttgtgactcctcaaatccctccgcaatacctttctgatgaagatcacgatcttcatcgcattaaccctctcttcttgatcaagcagaaacaagatcagtttctccttgtttggcttcagcctatgctctcgagctccatgcttcctcgagttcttggatcaagacactcgtatcaagtgtgcgacaagatttatgcatattttcatcaccagatgcgaacaaaggcacgacagctccgaccggagcttcgtcaaacaacactagataattgttcagttttcgatttcctctctcagatcaaacacatggatgcgattctagaaggacttcctagggattttgactcgatcatcactctaattgaaagtcgtctaccacacatcaccattgaagaggctgaaggatacatcctagtgcaggagctacatcttcgcaaatacaccagactcgaatcttcaagttttggtggtcgaaatggtcgtggcagaggcggttttaactgtattcgtggacgaggtggtggtcgcagcggtcgaagctcagtccagtgtcaatatcaagctgccaatggtggtaacgatagcaattatgggaacaacaatcacaataactggtctcacaatcagaatcagaagcagaattggggtcagaatcagaaccaaaacaacaactggaacaattcttctaattccaattggagttcacagaaaagtcaaaatcagaatcataactctcagaactctataactaggcctccacaagcaatggtggcaaattttgactccaatgcttcatcatcttggtttccagattttggagcgtccttccatgtgaccaataactcagaacatctagcaaacttctcctttttttgggtccaaaccagatcttcattggtaatggacaaggattccaataaatcattcttcaaggagatgttgaatctgatgactagtaccagtttcccaatcttcagttttgatctgatatgtcttctccagcttgcataa

SEQ ID NO: 6004 - DNA, 327 bp, Glycine max
  Peptide Sequence Number=SeqID_97689
atgggatccttttctgaatctggatgggaatggagcttctcttggaggcgcaatctgtttgataatgaaatgggaagagcctcagagtttattgatcaaactgctgcaattagtccatctgcatctttgaaagactcttgggtgtggggagctgaccctaaaggaattttctctactaattctgcctatcttcatgtcaaagttgatcatcttgatgaagatcagtgccttggtttccagcacctatggaacatcaaaatccctcctagagccctagtttttgcttggagacttctatgggacagattgcccactaaggatatctaa

SEQ ID NO: 6005 - DNA, 1143 bp, Glycine max
  Peptide Sequence Number=SeqID_97690
atggcggtgtggaagtgcttaacggtgatcgtgatgctaccatcgatgctgggaaacgctgtgatgacgatcttcgtgcgtctaacagtttttcttcctatagtctcgcgtatgctactgcttgaaccaaggatactggttgcaaaacctgcacctcgcggcggatggccgacgttaatcctgaaacaaagcaacttaaaacaaactgagctggtattccgactatgcggtttgctaacgactcgaattccgtcaaataggcgttcaccgatgaccgctgctgcaacttgcatagcaatcccgcaggatcctcgtaagttgatgaagcaaatcgagtgtgtagcgcgtgtaagaatgctgaccacgatgataattgagcgttgcggtgcatccattggaaccacgccaacgcggccccttccatgtagaacatgcaatcgtcaacctctcatgatctggtgtgttgtgatactcaaaaaactgagttatttgaaggtccaacccgtaggatccgagccatcgaacctcgggacatcaagcttcaggcgatgtgtggaaccagtcaccgttggtgtttgtcctgccgaagaagacgacggcgtctacgatgctgataattttgcaatgtcacaggaactgccaaggttgacgccgtggacaatatgctcagtcagagagaaacagtgtttacgttgcttcgtcggaattgcgacctcgacgtcagacttcggtctcaaacaccacttactcgaagctcaccaagaggtattatgggccttttcgaatctcggcccgaatgggcaagacccaccacatgattctactgatcttcctccagtagctgtagataacgacccagtcgttactccgttagccatcatcacgcccaaactaattccatcgaaaaggggacctacacgcatggtcttggtccaatggaaggacttaccactcgaggaagcctcgtgggaggaatggtccagcttcaaagccttacaccaccttgaggaaaaggtgttatttgaaggggaggggaatgttacgaatagggaagaggggttgcaggaagtaagagaacagcagcgcgaggagaggcccaaaaggaaaacgaaggctccaacatacatggaggactacgtgtga

SEQ ID NO: 6006 - DNA, 262 bp, Glycine max
  Peptide Sequence Number=SeqID_97691
aagatctactgcaggtgatttgattcctattgatttggagattaataccacttgtagaaggcgtaattcagagagaatcagaatttttttgcaggatttagaagcagtagaaactccagaagaagaacctcgatctttcaaggcatcttctagttttcctattgcagggcattctcatatagaacctgttgaagacccaatcgtggctgaagagccaagaagagtaaccctggaggattattcaagttctactatgccataa

SEQ ID NO: 6007 - DNA, 96 bp, Glycine max
  Peptide Sequence Number=SeqID_97692
atgccaaaggaaaaactagaggaatatcagggaatcactagagatgccgctatcactatcgaaagacacgtgagcccgcttagaggtaagggataa

SEQ ID NO: 6008 - DNA, 1095 bp, Glycine max
  Peptide Sequence Number=SeqID_97693
atggtgggtgggagtgactatggtagcaatagtggtggtgatgacagtgatagaggtggaatagtgacagcgacgatggtggcgcaacgacagtgtggtagtagtggtggcagcgatgctggcgatggtggtggtaatagcaatggtggtggtaacgaaaacagtggtagggcagcaaaggcgaggtacgatagcaatgatggtggtggtggaatggtggaggcaatagtggtggtggtgcaaacgagaacaacggggtgtggtggtggtggaatggtgacagtggaggtggcggtgcgatggcggtggcaatgcggtgcggtggcggaaaaagaagttcaagataccctaactgttagctctattgcgaaaagtgtaaacaaggaaacaattgatttagatatgccagtttcaacaacgaatgcaagtaatgctggagcggcagaaaatctagaggaacaagaggatacacaaagccatagtgaatcctccccattgaaacaaatgtcactcccggaaccaatgctcgaagaaaacaccgttgaggtggattcgaatcttgaccattttatgaattatgaaactaagcaacaccctccaactgcaaaagaggaacttccatacataaaccctgttgttgcctttgtctccattccaattgtcaaaactaatgagccaataatttaccaaagtataatccccaattacaaatgcaggaaatctctaaggagagacagtccaatagatgttgatccatttgcatttatcgacgttttgtcttctaattcgatgccatccgaagcctctgaatccagccataacaggccatttacacattttgacaaagttgtagcaagtcaacacactactgatattgctgaaatagaatcttctatagagctggatcgaaataaattaattcaagctaaagagggttttgagaaggccaaagagaatcttatgctaatagaagggctaatcgagaaaacagagagatatgaagcagaattggtcaagaaagaagatctcttggcgaacctcaatcctattcaagatgaacctcattctacacgtttcaaccttgcagaactttga

SEQ ID NO: 6009 - DNA, 423 bp, Glycine max
  Peptide Sequence Number=SeqID_97694
atggaggcagacataccattggggtggaaaccactcaacctcgagcggtacgatgggacaacagatccagatgagcatctggatgccttcctgacacaagcgaacctctacaccaacgatgacgcgattctatgtcgtgtcttccctgctaagggctacatccaaatggaagaaatgtcaagattccgaaatgaagtccgccaagccgaacagaagcgtggcaagcgtaaaggaaacaccaaggccaatttgcacaggaagaataaaaggcacaagctagacaagtgtcagcctttccccagagggccaaggtacaagcattacacacccctgacgactaatcgcaccacgattctggaggaagcattcaacctggatgtacctattcgactaccccagacaaaacctccaggccaaggttag

SEQ ID NO: 6010 - DNA, 213 bp, Glycine max
  Peptide Sequence Number=SeqID_97695
atgacatggagaaattcacctggaaacagctcatctgcaggggagaagctcccaaactacgaccagtcaggagatacaatacaaaggttcaatcacgagccttttaactcggtgacctcgtattgcgagtccaaggtgaagccaaaaaagatccccgagtgggaaagcttggccccgactgggaaggtccctcaaggttacaaccaaccttga

SEQ ID NO: 6011 - DNA, 291 bp, Glycine max
  Peptide Sequence Number=SeqID_97696
atggaagaagagttgatcaaatgtctgaggcacaacaaggatgcctttgcttacaaagcacaagacatgtctggaatacatcccaattttattgaacataaacttttcactgaatctggatgcaaagctggtagcctagaaaaggaatttggagatgataagaggaagacgataaaacaaaggatcaagctgaatgttttgatgatgccaaaggttcacatgcgtctcaaagctttattcaagataaagaaattaaagatattcaagatggatgatcaagacagtctctag

SEQ ID NO: 6012 - DNA, 462 bp, Glycine max
  Peptide Sequence Number=SeqID_97697
atggcacacactaagaccactggtcagaaaaaggctcctccccaagaagcaaaggttaagcttgttgaaccagaccaggagtttagcgatgccataagccatgagttctatgtaatcgccttcctatctaaggcaaggatgcagttcttgagtagtacaacactgttcgcgacatttgcatcctgtatgacacatacgccatcaacacctatttggagatatcttctcccaggccgagtactgtttctgagtacaatgaatggttacaccatcccaacaatcacaaagaaatggcaaatgtgcttttgtgcattggcagcgagctttgaggtcgagatgagggagatgtgggcagacatagcagacaacaaccatgccattggcatggtcatggattccttgcgaggtttcagcctacatacctctatcggagctgccaacctttatcattgccctagctag

SEQ ID NO: 6013 - DNA, 258 bp, Glycine max
  Peptide Sequence Number=SeqID_97698
atggcccttggctattttctaagttccatattggtgaaacttgtgaacagtgcaaccaagaatatcactgcaaggtgtgacaacactcaaaagggcacggcgagcctaggtcgcgatggtgcgaacaacacgcaacgtggaggtcaaggaggcgcgacaatgtacggttccttttgcggaggtcacggtggtgagagggacattcaggcaaacacacgacgccaactgatagtagaattttcagagacagggatttag

SEQ ID NO: 6014 - DNA, 261 bp, Glycine max
  Peptide Sequence Number=SeqID_97699
atgtatatattcttatctaactattgcaaactacactttggcaggagggcggcgcagggctcacgggtgcgccttccaagggcggaaggtgcacggagtcgccaccaacatttatttgaggaaaacgtcggaaaaaccggaacgtgtggtctacgaactttaatcgtgaaaggttcgggagttgtttttacgcatggggaagggtgtttcccatgctcctacatattcctcaattgcgatgaggaaatcagacctacgtag

SEQ ID NO: 6015 - DNA, 873 bp, Glycine max
  Peptide Sequence Number=SeqID_97700
atgaatccagatgaagtgaggatgtgggtatatgaggagacattacgaagtggtgagcagctcacagatgtcatcaatcgaaccaatgaaaatgtcaaatatcttcctggaatcaagcttggcaaaaatgttgttgcagatccagaccttgaaagtgcagtgaaggattccaacatgttagtgtttgtgactccacatcaatttatggaaggaatatgcaaaaggcttgttgggaaaataagggaagattctgaggctatttcccttgttaaagggatggagatagctgtggagaagtttagtgaagcaactgttggatacaggctcaatagagaagttgctgagagatgggttcagttgttttatactcactatttcattgtgacagctgttcaggatgttgaaggagttgaactgtgtggaactttgaaaaatgttgtggccatagcagcaggttttgtcgatggcctggagatgggaaataatacaaaagctgcaatcatgagacttggtcttagagaaatgaaggcattttcaaagttgttgtttccatctgttaaggacagcactttttttgagagctgtggtgtagctgaccttatcacaacatgcttgggtggaagaaacaggaaagttgctgaggcttatgcaaggaatggagggaagaggtcttttgatgaggttgaagcagaaatgctacaaggccagaaattgcagggtgtctcaactgcgagtgaggtttatgaggttctaagccatcgcgggtggctagagttgttccctctcttctcaacagtgcatgagataagcactggcctacttccaccatcagcaatagttgaatacagtgagaagctacccaaatccttctaa

SEQ ID NO: 6016 - DNA, 138 bp, Glycine max
  Peptide Sequence Number=SeqID_97701
atggcggagcagcctggggttcacagagggcacaatgcgacgatgtcacgggagcgacagctagggcgaagaagcaaagttgtcgggttagtagtgaaggaatcacgcacatgtcgtgataaaatgacgaccaagtaa

SEQ ID NO: 6017 - DNA, 432 bp, Glycine max
  Peptide Sequence Number=SeqID_97702
atggatatggaggcatctttgtggcacctaaggcttagtcatatcagtgagaaggggctgaattgtttagccaagaaggatatgcttccaagattgaagaatgcaaatttggagaaatgttctcattgcatggttgttaacacaccaaccccacatccaaaggttcagttcaatatggcaaccttgtcaagttttgcttctttggccattctaagtttagttctagtaattggtgtcattatctctagggctgaagctaagccaagggcattctttgtatttggagattcacttgttgataatggaaataacaattacatggctaccacgacatgtgtcgatgcccctccttatgggattgattatcctccaagtcatagaccaactggctgtttctccaatggctacaacattcctaatcttatcagttaa

SEQ ID NO: 6018 - DNA, 294 bp, Glycine max
  Peptide Sequence Number=SeqID_97703
atgcttgccgagaaacttctacataaatcagattacgatattgattcagagatactgtcataccctaatttcgtccggggaccgtccgttgttgggatgcgaccctcgtttgaccacttcgagggaaaaatgttcagccctcctgataattcgagatcacttgaaattagtgaaaaaaattgtttccgtgaagaaaattcaagccaaggcgtttccgtgggtgatttcgcgaagattttcaaccgttcttcgacgttcttcgttcgttcttcgtcgttcttcagtcttcaaccg

SEQ ID NO: 6019 - DNA, 486 bp, Glycine max
  Peptide Sequence Number=SeqID_97704
atgagtaattggaaccatagggggtgttccagtgaaactgagataaccactggagctgcaatggacttgcaacagattaaacaaatagcaagacatatggtaacaaagtttggcgtgttagagattggaccatgggcattgactgatcctgcagtggaaggtcatcatgtggatttaaagctagttgctcactcacatgctcccccaggaattagaactattcctccaagtcccaaatggctatcaacttctcatggatgtattgaagcgcatttaatagacaacagtgaactagtaggattcatcatcacaaaaatagatgaatactggcaacttaagcaagtatatcgtggtaatgctttggcggctttaatttcaagtattaagcagttgcccaacaacttaaagccactaaagctacaaatgaaggcattgagtttgttgagaagtatttttccattatatttggaagagatagaacaatag

SEQ ID NO: 6020 - DNA, 345 bp, Glycine max
  Peptide Sequence Number=SeqID_97705
atggtttacaaagaactaaatgggaaagttagagatgtcgttatttcacttattgatcaagaacaggaaggagagcatattgatcgagctctattaaagaatgtattagacatatttgttgaaattggaatggggcaaatggatcactatgagaatgattttgaagctaccatgctcaaagacacttctttttattattctcgaaaggctttgaattggatcctagaagattcttgtcttgattatatgctgaaggctgaggagtgcttaaaatgggagaaagataaggttgctcattacttgcactctagtagcaagccaaagttattagaggtcttttattga

SEQ ID NO: 6021 - DNA, 75 bp, Glycine max
  Peptide Sequence Number=SeqID_97706
atggcgtccaaccgaaaaagcagcagctgggctcgcggtggaggagaaggctcgcggaagagggtaaaatggtag

SEQ ID NO: 6022 - DNA, 1065 bp, Glycine max
  Peptide Sequence Number=SeqID_97707
atggcaatcttgtcaagttttgcaccgttgaccattcttagtatagtcttgttagtagtcggagtcattgtcactggggcgaaagctaggccaagagcattctttgtgtttggagattcacttgttgatagtggaaataacaattacttggctaccacggcacgtgccgatgcccctccttatgggattgattaccctccaagtcagagacttggtgctgagtctacattgccatacttgagtccagaattaagaggagataagctcttagttggtgccaattttgcttcagctggaattggaatccttaatgacactggaattcagtttgtaaatgtaatcagaatgtatagacagctagaatattttaaggagtatcaaaaccgagtgagtgctctaattggagcttcagaggctacgaatttggtgaaacaagcactagtgctcatcactgtagggggcaatgattttgtaaacaactacttcttggtgcccaattcagcaaggtcccgccagtacccactacctcaatacgttaagtatcttatctctgagtaccaaaaaattttgcagaggctatatgatcttggagctcgaagagttcttgtgacaggcacaggacccttgggttgtgttccatcagaattggcccaacgtggtagaaatggacaatgtgctcctgaactgcaacaagctgcagcattgtttaacccacaactcgaacaaatgttgctacaactcaacaggaaaattggaagtgacgtttttattgctgcaaacacaggaaaagcgcacaacgactttgttactaacccccgacaatttgggtttgttacatcacaggtagcttgttgtgggcaaggaccttacaatggtcttgggctatgcacagcactctctaacctttgctccaacagagagacgtatgcattttgggatgcattccatccatctgaaaaggccaacagacttattgtggaggaaattatgtcaggttctaaagcctacatgaacccaatgaaccttagcaccatcttagctttggacgcaaacacaggaagatag

SEQ ID NO: 6023 - DNA, 378 bp, Glycine max
  Peptide Sequence Number=SeqID_97708
atgctgtggaaagttgattcttcgagtgtatactccactaaatcagcttatagattgctactaactactaatagtcagcttccagaggccaacatttacaagacaatatggaatctgaacatcccccctagggctgtgattttctcttggagacttctcaaagacagattacccactagatacaacctacttagaagaaatgtatccatttcggatcagctaagccaacagctcattttgcccaattctgtgatgattttggagatgggaagaatcataaaagatggtgtcgatggtggattgcattatgaggctcaatatggcagcataggaatctcttggtattccaaggccaccggtttgatccagccaaagtga

SEQ ID NO: 6024 - DNA, 231 bp, Glycine max
  Peptide Sequence Number=SeqID_97709
atgttcgtttatatgcatgtacaagacaaagttgtcacagaaaatgaattgtttgagaagatgaaagtggaagctgagaagtgcttaacccagactgaaagaattgccaatgagaggctggaatttgaatctgaaatctatgcaaagcatggctcagcctgtgtcaagaaggcacaatggtccttgcacttgacacaatggtccttgcagacttctgaggctattaattga

SEQ ID NO: 6025 - DNA, 450 bp, Glycine max
  Peptide Sequence Number=SeqID_97710
atggggcttctacagcttctccacatgtgtccaaactccaaatcccacccaaggatagacttagtttgcacatgccattatatcgcggccctgaaaactggttgcttgactttgcataactatatttgtaaacatggatgtgtgagaattccagcatcattctgtggtatttttggttttcgtccatcccatggggctgtatctaccattggagttcttccaaatgcacaaagcttagacactattggatggtttgctcgcgatccatctatcctgcatcgtgttggacatgttttacttcaattgaattcagtggagaccaaaaggtccagacatttcatatttgcagacgatctctttcagttatctaaaattcctacacagaatacaatatatgttattggtaaagctattgagaatatgtccgggtgtaagtttctggatctttga

SEQ ID NO: 6026 - DNA, 603 bp, Glycine max
  Peptide Sequence Number=SeqID_97711
atggtggtcggagggcgttcttcatgtaactctggcaaaggcaagagcagtcagtcctcagtcaagtatggctatagcctagttaaagggaaagcaaaccatccgatggaggactaccacgtagcaaaatttgtgcagttcaaagggcgagagcttgggctttttgctatatatgatggacacctgggtgacagtgtaccagcctatttacaaaagcatctgttttctaacatcttgaaggacgaggacttctggaatgatccattcatgtccatttctaatgcgtatgagacaacagatcaggcaattctttctcacagtcctgatttggggcgaggaggatcaactgcagtgactgcaattctcataaataatcagaaattatgggtagccaatgttggagattcacgagctgttgtgtcgaggggaggggtggctggacagatgacaactgatcatgaacccaatactgagcggggaagcattgagaccagaggtggctttgtctcaaacatgccaggttcttcaattaatcctgttgctttagatgttacaatgctgatttatcttttcatactatgggatttcattcatatcgtgtga

SEQ ID NO: 6027 - DNA, 2853 bp, Glycine max
  Peptide Sequence Number=SeqID_97712
atgccatcttctattatttatcaatctgcagatcttcagcaattacaacttgaagcccagcataggtggttgcgccctgcagaaatatgtgaaattcttcgcaattatcagatgtttcaaatcacatcagaaccacctaacgggccaccaagtatggtttctgcatatgctactgatcgatttattaatgccacctatgtgggaagtgttgacgtgttacactgctactatgcccatggagaagaaaatgaaaattttcagaggcgaagctattggatgcttgaaccggatatgatgcatatagtatttgttcactacttggatgttaaggttaacaaaaccaatgttggtggaaaaacatattctgacgaggttacatcagattcccagaagagcagttctttgtcatctggctttcccagaaattatggtagtgtgccttctggaagtacagattccatgagcccaacaagcactttgacatctttatgtgaagatgctgattcaggtgatcatgggcagttaccagtttctggagcagaatatatcccacatgttctgggggataagtctagagctagtgatactacttacattgagggtcagagagcacagggcattgcatcttgggacaataccatggaacagtctgcaggagagtatgctgatccttctcttgtatcatctacaaccattccatcaagtgcagtgggaaacatccttgaagaaaaccatactgttcctggcaaacttttagggcgtaaaaatgccctaactgaagaggaaaggggctctcagcctgtccaatcaaattggcagattccttttgaagacaatacaggagaattgcctaattggggcttcacccaatcattgggtttggaatttggatctgattatggtgctagtttactgggggatgtaactaataatgcaggcccagaaattgttcctgagctgttcacttttaatggtgagttaaaagagcagtctgtgcaccaaaacttctcaaagctgtatacacatgggcaatctcaacctacactgaaatccaattctgaatatgaagttcctggtgaagcaagtatcaattatgccttgaccatgaggcgtggattattggatggagaggagagcctcaagaaggttgatagtttctctaggtggatgactaaagaatttgcaggtgtggatgatctgcatatgcagtcttcccctggtatttcatggagcacagatgagtgtggggatgtgatagatgatacctcattgaatctgtccctgtctcaagaccagctgtttagcataaatgatttttctcctaaatgggcttatgctgaatcagaaattgaggtgttgattgttggaacatttttgaagagtcaacctgtggtggcaaaatgtaactggtcctgtatgtttggggaagtggaggttcctgctgaggttttagctgatggaattctgtgctgtcaagctccacctcataagattggacgggttcccttctatgtaacatgttccaataggtttgcttgtagtgaagttcgggaatttgagtacagagagggctttgatagaaatatacaatttgcagattgttttaacaattcaactgaaatggtgcttcatttgcgactggtggggttactttctttaaactcagtacgcacttcaaatcaagtgtttgagggtgatatggataaaagaagcttaatattcaagcttatttcactgaaagaggaagaggaatattcaagtaaggaagagacaactgcagagatggatatatcaaaacacaagttgaaggagcttatgtttcacaagcaggttaaggagaagttgtactcatggcttcttcacaaagttactgaaactggtaaagggcctcttgtattagatgaagaagggcaaggcgtgttacacttaattgctgctcttggttatgattgggccataaatccaatcataactgctggagtcaatatcaacttccgtgatgtgaatggatggacagctctacactgggctgcattctgtggccgagagcgaacagttgctgtccttgtctccatgggtgcagcagctggagcatggacagatccatgtccagaatttccttcgggtagatcacctgcagatcttgcttctagcaaaggccataaaggaatctctggttttcttgctgagtcattattaactggccaccttgaatcactcacaatggatgaaaataaagatggtaggaaagaaacttcaggaacgaaagtagtgcaaacagcttcagagcgaactgcgacacctgtgctttatggtgatataccagatgctatctgccttaaggattctcttaatgctgtccgtaatgctacacaagctgctgatcgtatatatcaagtattcagaatgcagtcatttcagaggaagcagtttgctcagtatgaagatgatgaatttggattgtcagatcaacaagctctttctctcctagcttctaagacgtgcaaatctggtcaaggagagggtttagccaatgctgctgcaatacaaatacagaaaaagtttcgtggttggacgaagagaaaagaattcttgatcattcgccaaagaattgttaaaatccagtcgcaaaggacgagccctggtgcagcggtaaagttgtgccttggtgacttgttggtcatgggttcgaatccggaaacagtctctttgcatatgcaagtttcacctgataacattgcattggagggttcaattgatgaaaacttagggttcaaatacttcgccatttctgtttgccctttatataacttgcatgcacgtagagatcacgttgggtgtcaatattggtaa

SEQ ID NO: 6028 - DNA, 531 bp, Glycine max
  Peptide Sequence Number=SeqID_97713
atggtgtcaccacaagggaggaacacatggacagttgatgatctcgtgccttatctggataagttagcgattatatcagaagagcaagagagaatcactgagccagtgtcacatggtccagcatcagagcgtgaatttccagcacaagagtttcacattcttcagtcaagtgttgagactcggggcataggcagacgaagggagcttgttgaagcggaacaatattcccaacaaatgatggagcgtggtcatcacactgatacttctgcaagcgaacattcgttcgatggtgttgcggaaacacagcctcatttttcatggcccactatgactcattcacagcagcacgatgcccccatggcaacacctaacgccctatttgctccgcaatggaatgtacccggagcaatacctgatatgggcgacttattaggtgttgatttgcgtcaggagttttctgctgaggctgagcaagcagaagcggggagacaacgtggcagaagaaatcctgatcgtcaagcgcgaagatag

SEQ ID NO: 6029 - DNA, 999 bp, Glycine max
  Peptide Sequence Number=SeqID_97714
atgtcaagcacaactgaaaacgtcactgtcgtagtccactacgatgcctatgtaaccgagtgtgccattggcatagagtttaagggcgaaaaaaatgttcttgtttcaatgaagagaggcatgaccttcaatgccttgaaaacaaaaatccaacagaagatggacctaaatcaaggtcaaaccataaccatagtcattttatcaataccccgtaacttcaagttgctcgtacaatacgaacaacaacctttttctaccactaatgttgaaacaaccattccatcaccacaaattcaccaaacacaatatactgactaccatactcaaagctaccgtgaaggtccatcttcttacacaccaatcccatatatgcccacaaatgattattacatcccccattttgaacccactgaatttgatgcacacattagctcatacacacaactgcttagtggatcgtcaaactacagtgtgacagctccccaacttttgaacctaaatgagccctcccacccaaatgcccaaccaactagtaaaatccatgttgctcaatctcaaagcaacgaaatgtcacacgactatcatgttgaaaacgggttgtcggaagaagtatttggtgacttcagtgaccatgaagacaaaaatttggtggacaatgacgacaacaacatcaacgacaatgacgataatgatatacaatttcttttccaaccgacaacaactgaaaatgtctatcgtccatatccaaattacgctgatgttggtgacaaccaaggttccttgttgaaccaatctcagacttatcaaggtaatccttgtggcgtctaccctaacttatcttccttcatcggaagtggcgtctaccctgacttatcttccttcactggaagtggcgtcatccaaatctccttacaagaagacaacccacacaacactgtctggcttgatcaaataccaagggaacaatggaccttgacatgggatgatggaaagcgatga

SEQ ID NO: 6030 - DNA, 759 bp, Glycine max
  Peptide Sequence Number=SeqID_97715
ggcacctaaactagtggtggataaattggtgagattgcagcgaaggtttctatggggaggaaggcttgaccaaaataagattgcatggattaggtgggaaacagtgacttcatctaaagaaaatgggggattggacatcaaggatatcaccaatttcaatgtagcattgcttgatagaccagggttggaatcagtttggtggagagacttgaaaaaggccctcattcattccccacagggtcagattattaatagtgatatgaggtggaagcagcagaagttcatccaacagatggaaagtcacaaagacaatgggtgggagtggaactttatctggagaaggccatgttttgataatgaaattgattcgacaggtgtcttcctcaatgagattcaggatatggccattcaatatcatggacctgatgtgtgggaatggactgctgaccctacaggtcagtatacggcaaacagtgcctacaaggtactaatggaaggagcagtagcagtaactcaggaggattgttttgtcaaattatggagcataaaggttgttgatacatcatgcccattctgcagagacggtgaggagaacgcaggacatctattcttccaatgtagaaaaattcagcctatatggtgggaagctatgtcatggataaatctaaaaggagctgctcccctcaccccaaaaatgaatttcaatcatcatatgggacttcaagctgatggtgttaggagcaataggtggcagtgctg

SEQ ID NO: 6031 - DNA, 867 bp, Glycine max
  Peptide Sequence Number=SeqID_97716
atgtctcacttcggacgttcgggtcccccagacatttccgacacttactctcttctcgttctgaacatcaccttccgtaccaccgccgacgacctattccctctcttcgacaagtatgggaaggtcgtcgacatcttcatccccaaggatcgaaggactggtgaatcgaggggttttgcgttcgtgcgttacaagtatgctgatgaggctcagaaggccgttgagaggctcgacgggagaatggttgatggtcgcgaaataacggtccagtttgcgaaatatgggcctaatgctgaaaggattagtagtgttgttgtttggggtgagaatggaatgcctggagaaggaagatattactatatgctggtcacaaaggaaggattattgaaacatccccaagatcaaggcgatcaaggagccgtagcccaaggaaaaggcatcgtgatgattacagagacagagattataggagaagaagtcgcagcagaagttatgataggtatgaacgtgacaggcatcgtgggagagacaaagattatcgtcgcagaagtaggagccgtagtgccagtcttgattacaagggtcgtggtagaggacgctatgatgatgagcgtaatagtagaagccggagcagatcagttgatagccgctcccctgcacgacgcagtcctagtcctcgaaggagtccctcccctcagaggagcacttcccctcaaaggagtacttcccctaggaagagtccacggggtgaaagtcctgcaaatcgtagccgtgaggaacgttcccctacccctcgcagtgtctcaccacgcggtcgccctgatgcttcacgaagtccttcccctcgaaattcaaacggggatgtaa

SEQ ID NO: 6032 - DNA, 2418 bp, Glycine max
  Peptide Sequence Number=SeqID_97717
atggcaaaccctaaaaccaaaagtcaccattccctgggcggcgaggacgatcccgactcgaccgaatcgcggtgggtcttccaggaggacgaggatccctccgagatcgaggacttcgatgccgcagatttgcgccaccagtccatgttcgattctgacgacgaggacaatgccgagcagagactcgttcgcaccggtccccgaatcgattccttcgacgtcgaagcccttgaggttcccggcgctcacagaaacgactacgaggatgttagtgtgggaaaaggaattttgttggcttttcaaactctcggtgttgtctttggcgatgttggaacgagtcctttgtataccttcagtgttatgtttaggaaggctcctattaagggaaatgaagatattcttggagccttgtcgcttgttttgtacactttaatcttgattccgttagtgaagtacgtccttgttgttctgtgggccaacgacgatggggaaggtggtacttttgcgttgtactcgttgatttgtcgaaatgctaaggtgagtcttcttcccaatcagttgcgatcggatgcccgaatatcaagctttaggctaaaggtgccgtctcctgagcttgaaaggtctttaaaaatcaaggagaggctagagacttcagtgactctgaagaagattctactattatttgttcttgctggtatttccatggtgatggctaacggggttgttacaccagcaatgtcagtactatcatctcttaatggtttgaaagttggggtagatgcaattaagcaagatgaagtggtgatgatttctgttgcctgccttgtcattttgtttagtgtacagaagtatggaacaagtaaagtggggcttgctgtaggacctgctttgtttatatggttttgttctcttgcgggcattggctctgaggctatgtttgcagatctttgctatttctctgtacaatcagttcagcttacatttgtatttcttgttttaccatgcctactgttgggttatttgggtcaagctgcataccttatggaaaaccatgctgatgctggtaatgccttttattcttctgttccaagtggtgcattctggccaactttcctcattgctaacattgctgcattaattgcaagtcgggctatgacaacagccacattttcttgtataaaacagtcagctgctcttggttgtttccctcgtcttaaaataattcatacctctcggaaattcatgggccagatctatatccctgtcataaactggtttctcttggctgtttctttggtgcttgtctgttctatatccagcattgatgagattggaaatgcatatggcattgctgagctgggggtgatgatgatgaccactattttagtaactcttgttatgcttcttatatggcagatacacatcattgtagtgctgagttttgctgtagtcttcctgggattggagttgactttcttttcatcagttctgtggagtgtaacggatggaagttggattatattggtctttgctgtaataatgttttttataatgtttgtatggaattatgggagcaagctcaagtatgaaactgaagtaaagcaaaagctgtcaatggatttgatgcgagaattaggctgcaatcttgggacaatacgagctcctgggattggtttgctctataatgagttggtcaaaggaattccaggcatttttgggcattttctaaccacacttccagcagtacactctatgatcatatttgtgagtattaagtatgttccagtccctatggtgcctcaaagtgaaaggtatggttacaaagatgttcgcaaagaaaatcaccaaacttttgagcaactgctgatggagagcttagagaagtttatacgtcgtgaggctcaggaaaggtcgctcgagagtgaaggggatgatgatactgattctgaggatgagtactctggttctagggttctcatagctcccaatgggagtgtttattcacttggtgttcctcttctggctgattttaatgatacaaccatacccatacccaattttgaagcaagcacatctgaggaagcaaaccctgaatctcctaagcccccagtgcttgatgctgagcagagtctcgaaagagagctatcttttatacgcaaggctaaagaatctggagttgtttatcttcttggtcacggggatataagagcaagaaaagactcatggtgccttctagaagcatttttactagacccgggggaaaatttgaatctcaaaagcaatgagttagtcattacgccaatggaactcagccccatgagagcccctgcaattgatggagtcagcacagtcccatttatgggaaataacactccagctgcaattggaattcctacctgtataaagatagaggtataa

SEQ ID NO: 6033 - DNA, 1860 bp, Glycine max
  Peptide Sequence Number=SeqID_97718
ggtagggagaacttgctaaatctgaaccagaaagagagaacagaaaaggctaacaaacctgaagatctgctttctccatgtgatagtgactcatgcagagaacataaaaagctaacatcagataatacaaggatgtctgatcattgtttgaagagcagcaaagtagattctagtagtagtgagctttgtgcagatgataccatcttaggagacaagtgtgtggtggaggatgatagcgtgtctcaatattcaatcaatcacatatctcaaactgacaatgaactcagctttcttgataatgatgggtggctcaatatcggaaactttgaagatgttgataggatgatgttaagctgtgacttgacatttggaatggagagcctcaataatgaagaggagttctgctggctccggtcttcaaatggaactgaaggatctgatgatgcattgaagtctgcattcaagttttcatctgctgaagcaagtctgttgaaaagcatatcagattataatatcgacacaaatgaaaacatggaaggtctgccaattaatgacggcaacaataaagcatctcctattgataaaaaattgaggtctcgaatgaatgccaatcatgatgatgttccttcttcattatcaacattccatgaatcagccatgaaatctggtaatagagatgacttgatggctaaactaaagatggaaggaaacctgttaaaaacatcagcaggaaagagaaaaaatggttacctgggacatggtgattttgatcttccttatgctcaagtggagcaatatgcaaatctgaagcaatcttttggagcctcttccagtggggtcacttcacaggatagcatccacaaacacagaccagacatggattctaattctttaggacatatacagatacaaactgacctaatggacccaggctattgtcatacttctaattacacttccctccttccaactttgtctggatctaggtctggacatgatggacatccatctccttcttttaaagaatcgtcatttgcacctaacatggagagttctaatgctcataagttggatgctgttgccttgaaaacaaaaaatgagagagaaaatttatatttttgccacgatgcacaactaataagtccaagatttaaaagtggaaatatgggaaatcctgagccattcaaaagtccaggttcagctcagaaggtaggccatcagtttgaaaatgagaatgaaggccatagtgaagttggagaaattagcataagattttcacaagaaatagactcatcaaatgtgcaggaaagctcatctatgagctctgcactggacgaagcctcacttgaaacaactagcttttgccaactgcaacagatcatggatcagttggatattagaaccaaactatgcataagggacagtctataccgcttggctaaaagtgctgaacaaagacataatgataccaatgcaagtggtcaaattggtgatgatgttgaagcctgcaaagcagtaatgatacaggactcaaacaggtatcactccattgatttctggttcaaatttgtatttctcttgggtcttgactacacaatgcaatgctggtgcggcatgattttgagtaggcttgtgtataaccatgctgctctttccctcccaccccctttcaaggcatggaaaattgaaccacctaaattggctacggccaagaacttcatttcaacccttgatttgaatcccaacaatagtacaggtagcattgaagtaaaagaactgggtttaaatgagtgtgttgtagaagaatggaatatgggagatgacgtaaaaagtctcaaggttgacagagctcaatactag

SEQ ID NO: 6034 - DNA, 543 bp, Glycine max
  Peptide Sequence Number=SeqID_97719
atggataaagtcttcaacaagctccgcaatttggacgcttacccaaaagtcaatgaagatttttacaaccgcacgctcgccggcggcgttgtcaccgtcgtttccgccgccgtcatgctctttctcttcttttccgagctaaactctgtttggacaaacttctccataatcccttataggagaagaaaatcagaaggtttatacctctacacagttacggagagtaagcttttggtggatacttcaaggggagataccttgcacatcaattttgatgtcacttttcctgctgttcgatgttcaatactcagcttagatgcaatggatattagtggcgagcagcatcttgacatacgacataatatagtgaagaaaagaattgatgctaatggtaatgtgatagaagagaggaaggatggaattggtgcaccaaagattgagagacccttacagaaacatggtggcagacttggacatgatgaaaagtattgtggttcatgttttggtgcagaagaggtacctttgaccatttactacacttaa

SEQ ID NO: 6035 - DNA, 1215 bp, Glycine max
  Peptide Sequence Number=SeqID_97720
atgaaggagcagagcgttaaaggtgatttaggtgagtctgcttctgtggtgtgtgtgggtgagaggaagaagaagaagcaaatggagtttcaacgcagcgattcatcatcgtccccgcccacacccaacaacgccgatccgaagaaaaacacttgttctgacccaatgcattcatggtgggaatcagtctcaaaagcccgttcccgaatccacgccctcgccgccatcctcccctcctcctcctccgactctctctcctctttagcggactccgaccgccccgctttgtcgttactttcctcccccgccgcctactccgccgtctcctcctccctctccggttcccactttgatcccctctgccactggctctacgacaccttcctctcctctgacccccacctccgcctggtagtcctctccttcgtccccctcctcgccggcctctacctctcccgcatccactccccggagccaccgtccctcgcgggattcgaagccgtcctcctcgccctctacgccgccgagaccaaatcccgcaacggcaaaccgcttgtggtcacaatccccgacctctcccacccctccatctaccacgcgcccctccgcaaaccccaaaccctaaccctcatcacaccaccctcggttggactcatttctccccctttagaaccccagctcggcgtcaaatccaccaagcgcgcctccatcgtcggcgtcgcgctccactccttcttctcccagatctcccacatgcccgcctggtccaagcttcacttctgccaattcgccgccgcctgggccggcggcgcctcccactgcccctgccgcaacgagctcgaccgcgatggcgaaatcgttggcgaaatcaacgatttcgccaacacgttcgagattcgtgatgatacggaagggaaaggggagaggattcccttgccgtgggagattctgcagccttcgctcagaatcctggggcactgtctattgggaccgttgaactctcaggatgtgaaggacgccgcttccttcgcggtgcggtgcttgtacgcccgcgcttcgcacgatttggtgccgcaggcgatactcgcgacgaggagtctcattcagcttgatgtgaggactcgagaggctgccaagacgaatgccgccactaactcgaacgccaacacccccaccaaggccaagaagccggagattcttctggtttccaagtga

SEQ ID NO: 6036 - DNA, 411 bp, Glycine max
  Peptide Sequence Number=SeqID_97721
atgggtttgtccgatgccccagactttaatttgaaagccatctacgagagtaacagaaggcaaggtgtccaaaaaagtcaaggaagagaaaagagattggttaccagtcatatgatcaaaggcgtcagaatcaagaatccaaggtccaagggagcaggactacgaaacaaaggctacaggattaccaggctgagccatagtggtaacagcatgataattcatgacacaagatacagttcctctaatcagtcaagtcatcatcatggccacccttgcatgacacaagcagcagttgttcgcagttttcacttcgtagagccaaagaagaggaggcagcagcagcgcaggaaacgacacagggcagcagtggggcaggatgaaggtggggcggttgagattggcagcagctaa

SEQ ID NO: 6037 - DNA, 921 bp, Glycine max
  Peptide Sequence Number=SeqID_97722
atggccaacaaagtccttgttttgttgtgtgtccttgtgacaacgttgttgagttgttgcgatgttagtgttgttcggggccagacattcgcttgtgatgttgggaagagccctgcagtggcgggttatgggttttgtgacaagtctttgggggtggaagcaagggtgaaggaccttgtggggaggttgacattgcaagagaagatagggaacttggtgaactctgctggggatgtgagtaggcttgggattccaaggtatgaatggtggtccgaagcacttcatggagtgtccaacgttggcctggggacgcgattctccaacgtggttcctggtgcaaccagctttcccatgcctattctcactgctgcttctttcaacacttcattgtttgaagtcattggaagggtggtttcaacggaagcaggagcaatgtacaatgttggccttgctggtttgacatattggtcaccaaacattaacatattcagagatccaagatggggaagaggtcttgaaacaccaggggaagatcctgtgctcactagcaaatatgcagcaggctatgtcaaaggacttcaacaaactgacggtggggaccccaacaagctcaaggttgctgcttgctgcaaacactatacagcctatgatgtggataagtggaaaggaattcagcgttacaccttcaatgctgtgctgacaaagcaagatttggaggacacattccaaccaccattcaagagctgtgtgattgatggcaatgttgccagtgtcatgtgttcctacaacaaggttaatggaaagccaacttgtgcagaccctgacctcctcaagggtgttgtccggggtgaatggaaactaaatgggtactgtcatacctcatttttgacccgtttttatttcttttttctcgtcttttaa

SEQ ID NO: 6038 - DNA, 477 bp, Glycine max
  Peptide Sequence Number=SeqID_97723
atggcgatactgctgcaattgcggttgagactcatggtttctgaggttttctctaaacctggaggtctgtgttgggaggttggccttggtggaattgatggaaattcttgtcgagtgttgactttggcaattctttctgtaatgttattgcgtgttttttatggaaatggcaacgatcacaaactggtgtttagttcgtctttgaggggcgatatatcatacagttccagtattcaagtaatgatggccttattgtttctggataccatttctgcagagtttgagggtccttgtggttcccaggaatacttgggtcggggtccacccactggacctggacgatgctttaactgtggcattgatgatcattgggcccgagattccaaagctgggcaccggaagaacaagtcttaccaatttgggggaagaggtcatatagaaaagaactgtaagaacagtcccaaaaagttgaggtag

SEQ ID NO: 6039 - DNA, 219 bp, Glycine max
  Peptide Sequence Number=SeqID_97724
atggagactgtccccatatccgaggcaactccgaagcgccaagtggctacttttggttggttggatccaattgtttgtaatcgcggtgttcttgttggatgcagcgaactggcgttgaagctgaagcttagtttaactgtcgtcgtttcagacaagatgttagtggcgtggcgtggctccttgtttggcttggcttatgccaaaaatctgttaaattaa

SEQ ID NO: 6040 - DNA, 654 bp, Glycine max
  Peptide Sequence Number=SeqID_97725
atgaaattgaacaagcgcgacgtcgtttccaggtcagggtcgaagaagattccgccgaagaacggacggaagaatcttcggatgatggaatcggaaaaccctagtttttttagtagttcgattgtggggacttcctctgcggagcttgtcgaggggggatccgattgggttggtgagggacctcgcggagtcccagaagtggcggagagggtcggcgacggtgtggaattggccatcgtagaagattcgggcgccggagtagaacttctggaggttgagagattgataattgaggagcttttgggcttccgggtaggcggtgatgaagatttggaagccgcggtcgaggaggaagccgtcgacaatgtcggtgcggacgcggcctccgacggcgtcggaggcttccaggaggaggaaggggatgttctgggagttcaggtgggtggcggcggcgagtccggcgaggcccgcgccgatgacgatgactccggtggttttggggagtggtggggattggagagggagggagagggtgattgtagtcattggagtttggataaggggtttgattctggtgggcgtggctcttcgattggttttggtggagatggtgatgccatgtttttacgtggactagagtgcaatcactcgtga

SEQ ID NO: 6041 - DNA, 725 bp, Glycine max
  Peptide Sequence Number=SeqID_97726
atgcaaaaattgcccctaccacctttcttccttaaaaatgtaatttttttttcagaaaagcttcttacctccatttttagaaagttttgcttctcgttttctctttttcgtgcggcattgcctctggttcgtgggggtaacagcgttgagcgcagcggtgaaggtgaaggttccggcgtcgagctttgcggtggtcggtggcggcaaacgaggtacgcagatggtggtttgttcgtcgcggacatggatgaagatgagtggatgtatgaaataatgtctgaacgaggggatatggattatgaaaatgcagaatcatgtagtgcgaatgaaccacatgttgattgttcggatgcattcaagacttctcaggtgtttgagtgtcgagaggatgttttacggtgggctcgatccgtggctcatgaaaacggatttgtgacggtgattttaaggccggacacaaacacaggtagtagaggaaggagtacgtttgtgttaattggctgtaaaaggagtggcgaatataagtgtaggaaaaaagaatttatcataagagacattgggactaggaaatgtgggtgtcccttcaagcttcgttgcaagccagtagttggaggagaaggctggatggtgaagttgatttctggagtacataatcatgaattggccaaggtgacaacggataagtggatggatataacagacatgggacatgtcattgcatcaag

SEQ ID NO: 6042 - DNA, 564 bp, Glycine max
  Peptide Sequence Number=SeqID_97727
atgggaggtggacacatgtcactccaaaatgagtttgttggttactcgttcacaggaaaaaattccaaaaactttgacattcccaccggatgtaccatggatgaactgaaggatttgatcaaacaagtagcgcctcgtgggattctcccttatgttgatccggaagttgcggatcaagttgatccggaaacattgtgctttcaccttggctccgctctttggtttgctcaaccgatctccgcagcaatggtgaacgttccgaagacaaagaagacctactgcaagagcaaggagtgcaggaagcacacgctccacaaggtcacccaatacaagaagggcaaggacagcatcgccgctcagggaaaacgccgttatgaccgcaaacagtccggttacggtggccagaccaagcccgttttccacaaaaaggcgaaaaccaccaagaaaattgtgttgaggctccagtgccaaggatgcaagcatgtctcgcagcacgctatcaagaggtgcaagcactttgagatcggtggtgacaagaagggaaaaggaacatctctcttctag

SEQ ID NO: 6043 - DNA, 324 bp, Glycine max
  Peptide Sequence Number=SeqID_97728
atgggatgtcgtttgctcaatgagttagaggtcatcattttgactccttatctatcgatgaagtttccaagtgaggatggaaaaattatcactatcagggtaagccttaggattgctaaagaaaagaaggtggcaaagcccaaagtgaaactggtagcatgcacctctctcaacagcaacttgggagaagtcaaactctacttgagaaaggcaaaaccgagagtggtgcccactgaagaagtgaagcccttccaactcagcaaagagtcatctcagtgcaccaaacttggatgtagattagtagagaagtcaaagaatccatag

SEQ ID NO: 6044 - DNA, 900 bp, Glycine max
  Peptide Sequence Number=SeqID_97729
atgtccaacgttagccccgtcggttattcctccacaacaacaaaacgcaccacttgccttcagtttgtctgggtcccttattctggacatatggaaatgaatttgagccaagtttgttttattgggtctgtattatggacatgtatcataccatttatttgttttcaaaaagtggaatggcaccagtcggatagagtcatgagacaatttggaatgcagcaacctattccgggcctagtaatgcaacccagtaacatacatgacttgacattaaagggaaaggaaggaagagattggatgcgactaatgcaacccgcgcttaatgaatggaatagtctctatgaaaagagagtagagcaaacgccgtctctatcaaaaggtgaaatcgccgaaacactacattttatggtgtcgcctgctgggagaaggcgaagtgtgaagactcgaggcttagcgcgatgtcggaaaactgttgatgcagcaacgtacagtttgcctccgatgccagaacgacaacatggaatgtattacacaccgccggcattaacccaagaaccatcgcagatgccaccgatgtattcatacccacatgattttcaaccagggtatagtttggcaggcatatttgggtcctctcctccaacgggaactccttcatttaccctaaatggtgaactatcgactccaaatgtcccacttgttggtccatggaatgtacctggagatatatccgacatggacgacttattaggggtcgatttacgtcatgatttttctgtggaggctgaccaagtggatgaaagggcgaatcgtagaagaagaaatcctgatagggcagctagaaattgggaccggccatgtgggactttgtcgcggcatcacagacatagtgatgattga

SEQ ID NO: 6045 - DNA, 375 bp, Glycine max
  Peptide Sequence Number=SeqID_97730
atgccaggctccaaaaatttcattcatgaagccaattggcagcgtgagtgtctcaggccacaaattcgtggggtgccccatgccctgtggcacgcagataacacggttggagcacgtcaacgctctttaagggacgccacaatcatgggaagcaggaacgggcacgcccctatattcctttggtacggcctcaacatgaaaggctacagagggtttcagaaagaggtgcagaagtgtttgaggaatgcacactacttcaagggtcgcctttgtttgagaggcctcatgatgaggggtttgtgcacaagtggcagcttgcatgccaaggcaacattgagaaacttggatgattttcttaatgagcttgtggtttag

SEQ ID NO: 6046 - DNA, 861 bp, Glycine max
  Peptide Sequence Number=SeqID_97731
atgtctttttcgtttgcttctcctgctggcggtggaaatggcgatgctggaaccgacgacggttgcggttctggcagtgagtctggagatgctaatctcaaactggtaggagacgtgggtcaagagctttttcgactttcgcctgatgttatcattctcgatgtttcggaatctggtttgagacatgctttggatggtcctgatagcatgggattcgattctcttatttccatagagaatgagaggtccctcatggaacgtgagagcccgagaggggtcttgtattgttgttgtttcataaaatatgctacctccgaagaagctgatcaggcaattagagcattgcataatcaacatactcttcctggaggtgttggtccaatccaagtgcgatatgctgatggtgaacgggaacgccttggtgttgttgagtacaaattatttgtgggctctttgaacaaacaggctaccgtaaaggaagttgaggaaattttctcaaaatatggccgggttgaagatgtttatcttatgcgcgatgagaagaaacaaagtcgtgctggaaactgggtaggggatgggggtgaaatcatgggggcgaggggttggtttccatgcttcagtttcataattgttcttgaggaaagtatgaattggttgggtgtggttttgttaaatactcacaaagatatggctctggcagcaattaatgcgcttaatggaatctacacaatgaaaatttctacatcggtcgtgctaataaccgatgtagaatgttacatcggttattacaatggccgatgtagaatgatgactttctacatcggttttcaggacaaccgatatagaaatctggcattctaa

SEQ ID NO: 6047 - DNA, 255 bp, Glycine max
  Peptide Sequence Number=SeqID_97732
atgaatgtcgaagaacggttgaaaatcttcgccaaaataggggaggagcttgccacccagctcgcccaggcgagctcagctcgcccatgcgagcaaggttgcttcctccagaagcaaccgccttctggaggaagaaactggaaggcccaactttcgaagaagttacggaaactcacggattgcacaaaaacacctccttttgatttccgtcacattacggaatttcacggatcgtgtaagcttgcttccttttga

SEQ ID NO: 6048 - DNA, 338 bp, Glycine max
  Peptide Sequence Number=SeqID_97733
gtttttactctagtagtctaaagacatgcaagcccaacaaggcacaagattattctctactgggttgggggcgatcaagtttgatggcgtggggaagtgtcgtggttgtcccactttatcgctttcaagacactgaaatacgtaaagagggacaactgtcataccctaatttcgtctgggggccattgtttggtggcatgcaaccttcgcttgaccgcctcgagccgaggtgcttccgtaacgcttccgtgagcgatttcgtgaagattcttcactgttcttcatcgttctttgttcgttcttcgtcgttcttcggtcttcaaccggtaagttcttga

SEQ ID NO: 6049 - DNA, 339 bp, Glycine max
  Peptide Sequence Number=SeqID_97734
atggagcattttcttaagcaagtagcctggcttgaagctcaacttccattggtgagacccgacgaggctgctcctgctgagcccacaactacacgggttaaaccaaagccagctgatccacaatctctagtggtgaatccacctttttctcctaagcttgaagtagttctcccatctccacctctgattatcatctctgattccctatctagagaaactattgctccccctgattcaccagctagagaagcagttgatctccctgattccccaattggaaaagctattgatctttcttattcctcatccagagaagctgttgctctctctgattcccca

SEQ ID NO: 6050 - DNA, 535 bp, Glycine max
  Peptide Sequence Number=SeqID_97735
atggaggccgacatggaggccatgaaagagcaaatggccacaatgatggaggccatgatgagcgtgaagaagataatggaagccaatgcggttgcaattgccgctaccagtgttgttgctaaggtgaacctgatgtccccatccgacatcaaccagatgaatcatccaaccttagatatggtaggcaaagatttgggaagtacgggcggcccccatgatgtgcaaattcaaaatgagcacgccttcccgccatatggcttgcctctcaactataagccacccaatatggcgtacgctcccaataagaatacacatgaaattccccatcacaatctagccgacttcgagccttggctcggatatgccattgaagggcaagcagttggtggtataccccttgaaaacacttcggaaggccctcagtatcacccccagctacacctcttgcattccacaacaagtaaaaaccctcgtgctatggcagaaatggaagagttggatcatttagaggaaaggctcaggaccattgaaggag

SEQ ID NO: 6051 - DNA, 399 bp, Glycine max
  Peptide Sequence Number=SeqID_97736
atggcagcgcagttgatccatgatcgcgctgtgatggaatgcctagagggtgtttgggagaccctcgaaggcaatgagaggtgccgattccgtggcacaattcaactcactgctacttcgctacatcctgtggagtggatactacctacacctactccatatcgactagttgagccgtttcaagtgatagaggtgtcatcctctgaagaggatcttgaagaggacctagaggagttacctcctgaacctgctatggatgcccctgacttaccagaggatgatgaggaccaactccctgaagttgattctccagaggatattatgtcagcatctgaggcagactctacagaggagagtggccttggagggacagtgaatactgacgactcttcatcatag

SEQ ID NO: 6052 - DNA, 465 bp, Glycine max
  Peptide Sequence Number=SeqID_97737
atgttccagccgcatactattttagatgctgatggttttccggtctaccataaaagaaacaatggtcacacaattgagaaaaatggtgttataattgataacagctacatctatcttcctaacagatacatatgtccctgtgaatctacttggagaatctttgggtttccaatacatggcagaaaacctgctgttgaaagattgcacttccatcttccaggccaacatagtgttctctacgaagaccatgatgatattgatgatgtattgtctaagccaagtatctctgattcaaagtttatttcatggatgaacaccaaccaaaattctgttgaaggaagaaatcttacttatgcagaatttgtttctaagtttctatacaataagaagaaaagatgttggcaccttaggaagaaaggctacaccattggtagattactatgggtcccaccaattacaggctaa

SEQ ID NO: 6053 - DNA, 522 bp, Glycine max
  Peptide Sequence Number=SeqID_97738
atggccccgaggaagcttgcctcaaagaggtccaggaaggataaagcggtcgaaggaaccagttccgctcccgagtatgacagccaccgatttaggagcgctgaacaccagcagcgcttcgaggccatcaaggggtggtcatttctccgggagcgacgcgtccagctcagggacgatgagtatgccgatttccaggaggagatagttcaccggcggtgggcatcactggttacccccatggccaagttcgacccagacatattcctcgaattttatgccaatgcttggcctacggaggagggcgtgcgagatatgagatcctgggtgaggggtcagtggatcccgttcgatgcggatgctatcagccagttcctaggatatcctttagtgctggaagagggccaggagtgcgagtatggccagaggaggaaccggtccgatggttttgatgaggaggccatctcccagttgctatatatggatgacgttgctgctcagcaacatcctgcccagcgatcataa

SEQ ID NO: 6054 - DNA, 299 bp, Glycine max
  Peptide Sequence Number=SeqID_97739
atatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaactttcagttaacagccgaccgctctaccactgagctactgaggaacaacgggaaattcgagctcatagagttcaattcccgttctcaacccatgaccaatatgagctcgaagtttccttc

SEQ ID NO: 6055 - DNA, 407 bp, Glycine max
  Peptide Sequence Number=SeqID_97740
tggtacctggagatatgtcgcgggggtcaggagaccttggggacgtcaggcgagctcctggcagtcaaccgataaaagaacaaagtccacaaagaaaggaggcttgtgtggcggctggccaactatggatcttgagtggtatctggaaattcgcctctagtaatcgattaccaaggatcgtgatggcagcgcagttaatccatgatcgcgtggtgatggagtgcctagagggagtttgggagaccctcgaaggcaatgagaggtgccgattccgtgtcacgattcaactcactgctacttcattggtacatccagaggtaccagcacgcacgcttcagcagcctgtggagtggatactacctacacctactccatatcgactagtggagccagtccaagtgatagag

SEQ ID NO: 6056 - DNA, 375 bp, Glycine max
  Peptide Sequence Number=SeqID_97741
atggcagcgcaattgatccatgatcgcgttgtgatggagtgcctagagggtgtttgggagaccctcgaaggcaatgagaggtgccggttccgtggcacaattcgactcactgctacttcattagtacatccggaggaacccgcacttgagccggttcaagtgatagaggtgtcatcctctgaagaggatcttgaagaggacctagaggagttaccacctgaacctgctatggacgcccttgacttacctgaggatgatgaagacccactccctgatgttgattctcctgaggatattatgtcagcatctgaggcagactctacagaggagagtggccctggagggacagcgaatagtgacgactcttcatcatag

SEQ ID NO: 6057 - DNA, 231 bp, Glycine max
  Peptide Sequence Number=SeqID_97742
atggaagcggaatggagaaggaagatggagaggagatgccacttcaaggagaagatgagtctagaagaagctcaccaccataagaggccattgataagagcttggaggaagaaggagatgaatgaagggagaggaagagaagagcacgaaattttgtgctctagaagagctctgaaatctgaacccactaatccaagatcaagtccaagattctccactaagtgtgcttag

SEQ ID NO: 6058 - DNA, 411 bp, Glycine max
  Peptide Sequence Number=SeqID_97743
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 6059 - DNA, 274 bp, Glycine max
  Peptide Sequence Number=SeqID_97744
cacttggttcgccagcaggcggccaaccacaggtggcaggtgcaaacccatgagtgtctctaccagctcatcctcaatctgcagagccagggttttgctccttttgcgtcctactctagatcagttcagggctgaggttgcatggcccagagattggcctgaggcccaggcaagggaggcgcccgcaaaggctcccgacgacgcggaggaggcccgcatggatgaggagatgacaaatttactcggtttcttgggagggagtggagccacgtga

SEQ ID NO: 6060 - DNA, 356 bp, Glycine max
  Peptide Sequence Number=SeqID_97745
gggttgatggggacccggtgctgagaggaacgaggataagggctatgtgggggtacgtcagctcagttgaaggtgggcaactagggatggtgggttcattggtacttggagatatgtcgcgggggtcaggagaccttggggacgtcaggcgagctcctggcagtcaaccattaaaagaacaaagaccacaaagcaaggaggcttgtgtggtggctggtcagctatggatcttgagtgatatctggaatatggcctctggtaatcgattaccaagggaagttgagatggcctttggtaatcggttaccaaggggtgtaatcgattaccaggctatattgaggttttcaatgttctga

SEQ ID NO: 6061 - DNA, 324 bp, Glycine max
  Peptide Sequence Number=SeqID_97746
atggcttgcactcatattccagtggaagcaaagatacttgaaaatcctgatgagtcattagagacatctaacaacagctttcaaaattgccccatgtgtggtatcgcttccagcctacatcaattagactttgcaccttatgcttcagggtcatacagtgctcaatggaatgtcccagggctcctccatgatatgcacatgttgcgttcaagtcgtatcctaggaaaaatggaggttgaggaaaccttgcaggggttatggctaccattgcattatcaagtagatatgggagcaagtcagcataggacaccggaattggggtga

SEQ ID NO: 6062 - DNA, 231 bp, Glycine max
  Peptide Sequence Number=SeqID_97747
atggcagcgaaatggagaaggaagagagagaggagacgccacttcaaggagaagatgagtctagaagaagctcaccaccataagaggccatggataagagcttggaggaagaaggagatgaatgaagggagaggaagagaagagcacgaaattttgtgctctaaaagagctttgaaatctgaacccactaatcgaaggtcaagtccaagattctccactaagtgtgcttag

SEQ ID NO: 6063 - DNA, 525 bp, Glycine max
  Peptide Sequence Number=SeqID_97748
atgcctctagttgtgaggaagtcaaggcactatcggacaaaaggtaaggtatctagtggatgcaaaactcttcttaaggattttcatgatttggaagagaagcataagggacgtgaggtcttgaaggaattacctcctgagattgtaaaactttatgaggaaataaaaaccttgaaagataaactaggaaaaattgttggtggtcatggagcccttaacaaaattattaaggtgcaaagaaaccccaaagacaaatatggccatggtttcaaaggaaaaaagattgtacatggtgaagaagtcattgtttgctatttttgtggaaaagtgggtcatgaaactcataagggcaaggacctcgctaaaaaaggcaacccatcaaggggtccgtcctacgcttatcagcacctacatgctaatagggaaaaagaacccaaaaagatttgggtgcctaagagcaaaataattcctattgcagatctccttgatagcaggaaagaaacatcagtcgtggtgcctggatag

SEQ ID NO: 6064 - DNA, 1323 bp, Glycine max
  Peptide Sequence Number=SeqID_97749
atgaatgaaaatactgtgaggtctgctggtgcagatctgacagctgctatagtaccattgttgaagctgctatgcctaacagtcattggactacttcttgcaaacccaacaatgcaattcattcccaaagctacatttaagcttcttagtaaacttgtgtttgcattgttcttgccgtgccttatatttactgagctaggtgaaagcattactcttgaaaactttgtagattggtggtttatccctgttaatgtgcttgtgagtacagctcttggttgcttactagggttcttagtggtgataatatgccacccacctccagagttaaccagatttactattataatgacgggatttggtaacactggaaatctgctgcttgctgtagttggatctgtttgccatactaaagataatccatttgggaagaattgcaataccagaggggtggcatatgtttctttatctcaatgggtttctgttatccttgtatacactcttgtttatcatatgatggaacctcctatagagtattatgagattgttgaggaagaggctgagattgaggaagagcggacactgaatgatatcagtagaccactccttgtagaagctgagtggcctgacattgagcagaaagagactgaacattctaagacaccctttattgccaggatctttaaaagcatctcgggtgtttcctcgtctaatattcctgagcttgaaagtggtgggactagtccaaagtccattagatgtttggctgaacctagagttgtaaggaggatcagaattgttgctgaacaaactcccattcagcacatacttcaacccccaacaatcgcctctctattggccatcatcattggcacagtgcctcagctgaaagctgtgttctttggatatgatgctccgttatctttcattactgacagtttggagattttagctggggcaatggtaccttctgtgatgcttatattggggggtatgcttgctgaaggaccgagtgactctaaacttggacttaaaactactattggtattactgttgcaagactcctggtgcttcctgtcctgggaattgggattgtggcattgtcagataagctaaatttcctagttgagaatgatgctatgtttagatttgtgcttttgctacagtacaccacaccaagtgctattttactgggagcaattgccagcttaaggggttatgcagttagtgaagcttcagctcttctcttctggcagcacgtgtttgctcttttctccttttccttgtacattgtaatctactttagaatagttatgtatgtctga

SEQ ID NO: 6065 - DNA, 540 bp, Glycine max
  Peptide Sequence Number=SeqID_97750
atggcgcctaccagacaccctttggatccagataagtccaacagggccctgggatttcccgcgctgatcacaggactctgccagtcgttcggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacggcatttgggtcgccagcagtcggccaaccaccgggcacatgtacagacccatgattgtctgtaccagctgagcctcaccatgcagagccagggctttgcttctttttcatgccctactccagaccagttcagggcggaggttgcatggcccggggattggcccgaggcccaagcaggagaggcgcccccagaagctcccggcgatggagaggaggcccacgaggacgaggaaatggccgatttgcttgacttcttgggagggagtggagctacatga

SEQ ID NO: 6066 - DNA, 420 bp, Glycine max
  Peptide Sequence Number=SeqID_97751
gcattacgggccaatgcacctctaccttatccacaattgataactttgtttctgcgtcattttcaaattccgcttgatgatgagccatttgttcaagtcaagcgttcctttgcaattggtgctggtgctgtgacttcctttggttaccgtaaggatcagaatggtcaatggctgaagaaagatgcactccctcctcaagatgagcgtactccttcacctcctcctcagcgtgaagattcaacactcctgaatgaagtccttaccgaattacgaggtcttcgttcttatgttggtgaacgtttcgactccttggatacacgctttgccggcatggatattcgcctcacacaagttgaagaagatgtctccttcatccgtacttgctttgatccaccaccaccgcctccatcatcctcttag

SEQ ID NO: 6067 - DNA, 165 bp, Glycine max
  Peptide Sequence Number=SeqID_97752
atgagtgaacggactatcatcatcaaaaagggggagattgtggaagcaatgccttccaaggttattttgatgatgccgaagaatcaagggttaagcaaagtttcaagcaaagattcaagaatcaagtttcaagtttcaagattcaagaatcaagagaagacttaa

SEQ ID NO: 6068 - DNA, 357 bp, Glycine max
  Peptide Sequence Number=SeqID_97753
aaagggtgcagacaaccacattggtctctgcgtgtcaacgggctcgcttgcctcttgttgacgaaaggtgcggataaccataaagtatttctgcatgctaccgaacccttgagtcacgatatcaaaggcgcggataaccataaggtatctccgcatgctaccggaccctcgagtcacgatagcaaaggtgatacttttttgcggtctcggtcggaagacgctgacatctccgggaaggtgcagatgaccacattggtccttgcgtgtcaacggccggaagacgccgacatctccgagaaggatgcagatgaccacattggtccttgcgtgtcaacgggctcgcttgcctctagttga

SEQ ID NO: 6069 - DNA, 955 bp, Glycine max
  Peptide Sequence Number=SeqID_97754
atggtaaccattcgtgcagatgaaattagtaaaattatccgtgaacgcattgagcaatataatacggaagtaaaaattgtaaatacgggtaccgtacttcaagtaggcgacggtattgctcgtatttatggtcttgatgaagtaatggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccgctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctg

SEQ ID NO: 6070 - DNA, 234 bp, Glycine max
  Peptide Sequence Number=SeqID_97755
atgactacaaatagtagaggcaataacagaccaaaatgcaacacacacaggcccaacttcaataatagttattttgagaatgaggaggatcttcatagggagattgctagagatttgggtgtgtcttatgctgataaaaacacctgtaaggacaagatgaagtatgatgttattaacagtagcattttccctcaatcagcagcagtgatgggaacggagcagaatgacccatga

SEQ ID NO: 6071 - DNA, 147 bp, Glycine max
  Peptide Sequence Number=SeqID_97756
atggcggacacctactccgcccccgaggagatccacggacttctcgactattggaaaaataccataactaaacgcgtcccaaggcatccctattgcaccagatccaaatctagaacgatgggtgatcaagaggagacccaggaatag

SEQ ID NO: 6072 - DNA, 222 bp, Glycine max
  Peptide Sequence Number=SeqID_97757
atggatcaaagaatgtgggtaggtgatcttgtgcgcttgcacttcaagacatgcgatgctagtgaaaaattatggtaccgagctactagaatagtcttcaagggtagtcctctggtcgtgctcatctaccatggtgatgatgaattaaaaaattgttctgtcttgcaacagtttccttctcctctcagccctgttccttctcagtgtagcttcaatttctaa

SEQ ID NO: 6073 - DNA, 108 bp, Glycine max
  Peptide Sequence Number=SeqID_97758
atgagcaagaggctccaagaggatcgggctagaattgctgaagaatgtcctagggttctcatgaacctcaggatagatttcatagcccatgggccaagggctccataa

SEQ ID NO: 6074 - DNA, 225 bp, Glycine max
  Peptide Sequence Number=SeqID_97759
atgttattgcctagtgctcttcatgtgtcctccaccttcgagtttggagctatgtttcatgattgtctaagtgcggaccctcaaggcaatcctccattctccacctctttttcggagtcccatgaatgtcattgcctagcgctgttcatgtgtcctccattatccagcatgaagcctctgaaaagaaaaaaagaaggagtagagacgagagtcgtcatggattaa

SEQ ID NO: 6075 - DNA, 336 bp, Glycine max
  Peptide Sequence Number=SeqID_97760
atgtacctagctgcaatagctgattctcaaccacaaccatctccattggctggtcagcctttctcagtgcttcaacagcagcaaggcatgcacagccaacttggcatgagctctagtggaagtcaaggcctccacatgctgcaaagtgaagccactaatgttggaggcaatgcaaccataggaactggaggagggtttccggactttgtacgcattggtaatggcaagcaagatattggaatatctggtgaaggcagaggaggaaactctagtggccactctggtgatgatggtgagacacttaattaccttaaagttgttggtgatggaaactga

SEQ ID NO: 6076 - DNA, 636 bp, Glycine max
  Peptide Sequence Number=SeqID_97761
aaaggttcacgcctaagatcattggcgactagacaagttggggcagagagacccctggtccatgtggatcctgctactggcaaagcagacggtccccacagcaagaaattcataacatatttaggaatcgttgctcgtgataagtttaagtctgatttgacgtcgaaatgggcacttgcaactgaaaaggatagtgtcaatgacactgatgtgcgaaaaaaagcacaagccatccaaaaacaaaacactgcccctcgcgtgatgtctcgtgggggttatgaatatttagaaaaaaagttgatggatgagaaaagaaagaaaaaactagaggaagctactcaatctggaagcactgacaccgtcattgatcctccatctcccatcaaacgacacctgaagtggaagcttgctcgcaccaagaaaactggtgacatgacatctgaggcagcaaaggaaattcctgacaagattggttcctttgttacccatggacgtcatgatatactgattgctgtcattgggcgaccagaacaccctagtcatgtgcgtgctataggagccggtataaccatcaagcaatactttggatcgacttcaaggacctcctccattgctcccgaatacctgcaacagtga

SEQ ID NO: 6077 - DNA, 255 bp, Glycine max
  Peptide Sequence Number=SeqID_97762
atgaaggcccaagtggagaaggatgaaggcccagaggcagagacactatcaagactattaattgttgctgaagacttatcttccttcactggaagtggcgtctacccagacttatcttccttcaccggaagtggcgtctaccctgacttatcttccttcaccggaagtggcgtctaccctgacttatcttccttcaccggaagtggcgtcatccaaaccttcgtagcctgtatcaaacgatccgctcctacttag

SEQ ID NO: 6078 - DNA, 573 bp, Glycine max
  Peptide Sequence Number=SeqID_97763
atgacgttgctactttacaacattctgtcaagcgaccgcaatgccaatctccccctacggaaggatcgcgcccacaagacacccagtggacccggagaagtccaacagggccctggggtttccagctctggttacgggcctttgtcagttctacagggtgcctatttcccccagcaagggatcgcgcccgcaagacacccaatggacccagagaagtccaacagggtcttggggtttccagctctgattacgggcctttgtcagtcctacagagtgcccgtcaccccagcaaggtcatcagggcgagacaccacagcagcctggggatggccgacatcgggcaatagacacactgccgccacctccggagcccctcagctcatctacaaaggctggagcgttgcctacgacccatggccgaccagcaggcgaccaagtccaaagccaaaggacatcctgctcgaaaagactggaattgctaaaagcattgaagctgcaggatccacgatgtcggatacaatgtccaggacatcctgcccgagaatactggagttgctgtacaatgcaagataa

SEQ ID NO: 6079 - DNA, 384 bp, Glycine max
  Peptide Sequence Number=SeqID_97764
atgaattcgtggggctccggactcaattgtggagaatgcatgaacgtcaatcaattcatagggctccgaataagacttgatgatggaggatgcacgaacagcgctaggatttcaattcgtcgggctccgaactcaatggtggaggatgcatgtatggcaattgtcgcaacctaccctttggcgggagggcgacgcgagactcgcgggatgcgtgttccacgaaaggaatacgcgcggagtcgccaccaacgtttatttgaggaaaacgtcggaaaaaccggaaaagacgcgatctacgaatttttagtgaaaggttcgggagttgtatttacgcacggggaagggtgtttccctttgctcctacgtattcctcaattgcgatga

SEQ ID NO: 6080 - DNA, 243 bp, Glycine max
  Peptide Sequence Number=SeqID_97765
atgaagcataattccaaactctttggatggaggatgcatgaacgaaaacgcaattcatggggctacgaaaaaaaggcaaggatggaggatgcactagagggtcctcacttgtcaatgatgaagcatagctccaatctctttgggtcgaggatgcatgaacgaaaaccaattcatggggctcaaaaaaaggcgaggatggaggattgcactagagggtcctcactagtcaatcatggagcatag

SEQ ID NO: 6081 - DNA, 1326 bp, Glycine max
  Peptide Sequence Number=SeqID_97766
atggctgataacaatcgaactctcaaggaacgcactacaccagatgttgtgtatcaagcttggtgtattcaatatcctaagaccaaggttagttatgagctaaattttggactaacccatttgatgccaaggtttcaaggtcttgcaggtgaagatccacacaagcatatgaaggagtttcatgtaatgtgttccaccatgcaacctggacaaccattcagacctcaacaacaacaatataatccttactccaacacctacaatcctggttggagagatcatcctaacttgaggtatgggcctggagttgataaagcaaatggccaccaacaacattttgtttcagtagaatgtgagtgttgccagcaaaaacctatagactcagattggacagggaatgtgagtgctattaccttgaagagtgacagagagcttccaaagccaatagatgttggtgccaaaattgatgatgtgagtgctattaccttgaagagtgacaaagagcttccaaagccaacagatgctggtgccaaaattaatgatgtgagtgatgttaccttgaagagtgatagagagcctccaaagccaacagatgttggtgccaaaattgatgatgtgagtgttgttaccttgaagagtgatagagagcttccaaagccaacatatgttggtgccaaaattgatgatgtgagtgttattactttgaagagtgacagagagcttccaaagccaacagatgctgccaatattcccctcttggatgccataaaaaagattccaaagtatgcaaagctcttgaagtgcactaataagaggaagcttaaggggaataagcaagtgaagaggtatgggtggacttcttctcacatgaaattcgtgggtgttgggtttttgggaactataatgggtagttctactaggaaagcttgggcagagcaaatgagaaaaatgagtgacaaatgtgaaagaggagagccatttctaggagtggtacctggagatatgtcccgggggtcaggagaccttggggacgtcaggcgagctcctggcagtcaaccaataaaagaacaaagtccacgaagcaaggaggcttgtgtggcggttggccagctatgtatcttgggtggtatctggaaattggcctctgagggtgtttgggagaccctcgaaggcaatgagaggtgccgattccgtggcacaattcgactcactgctacttcattagtacatccggaggaacccgcacgcacacttcagcagcctgtggagtggatactacctacacctactccatatcgactagtggagccagttcaagtgatagag

SEQ ID NO: 6082 - DNA, 378 bp, Glycine max
  Peptide Sequence Number=SeqID_97767
atggatatggcatgggaatcccccgatacaactgacatgtcacaagctgaggaacgtaatgcagaaattggaaatcctatagaagaaatgattcatgatcttgggcaaaaggtgtttcaacaggcacatgcacccttgtatgacaacattgaaattgattcgaaaaagcctttgtattccagctgcacatctttcaaaaagttgtctgttgtgttagctctgtacgaaaaaattcatgtctgctgtaacaactgcattttgtacaaagatgaatttgctgaactggattactgccctgtgtgcggggtatcaaggtacagattgaagaacgaggattgtagtgtacatccaattgccgacaatcggcgtccagcaaag

SEQ ID NO: 6083 - DNA, 78 bp, Glycine max
  Peptide Sequence Number=SeqID_97768
atgaagcaaagggtgaagagtctagtgaggaagtctacctccatgaagaaggctagcattgaggagtggattaggtag

SEQ ID NO: 6084 - DNA, 78 bp, Glycine max
  Peptide Sequence Number=SeqID_97769
attgtcttatgtaggtgttcattcagttatttctttgattcttgctttcattttggaccgtgttgttcatcatcacag

SEQ ID NO: 6085 - DNA, 291 bp, Glycine max
  Peptide Sequence Number=SeqID_97770
atgggtgactcagacaaatgcgggctgtacatcaaagaaaatccttctcgcctagttgccctaggaagagtttatgagggatccacagcggttcacaacatccctttgttgcatggccaagtgaaggttggtgttgaagaggttaaaaatgcagaggctcccattcctatacccactgacgaggaagttatgtctccagcaaaacctccagataggccagatcatgagatcgatgatcccctatatttaatgacattgaccatcccacaactttttgtgaggcctctccaa

SEQ ID NO: 6086 - DNA, 565 bp, Glycine max
  Peptide Sequence Number=SeqID_97771
atgttgagattctctgttatcagacaaccattaatattgcaatttaaagctgtgttccattgtgacaaagacaccatagaaataccaggtttttatcaacggcaatgggaaccaaattatccagaaatcgttgagtttaaatatgatggggccacctatgaaattcaagtcaggcaacacaagggcaaacttttctttgctgatggcctaacaacattgtggacagaattgcagatttatgaatcagtaatcataaatttcctagcctatgactaccactcaaaatttgacctccacttcactccaccattacaccatcagacatgcaaaagacgccgtgcatcaaggaaacatatttggacctatgaaatcacccaatcaatgctaggggcaccatattcactgcaacttccaccctctgtcacacaatgtctaatccactgtggtgaccacatgacaattctgagaaaattcggacctccactacaatggaatgtaattgtgcttgacaaggggattagtgataagtatatcactcagccttggtataaattccttcaagaag

SEQ ID NO: 6087 - DNA, 579 bp, Glycine max
  Peptide Sequence Number=SeqID_97772
atggtgagcaaaggttggagctttgatgaagcttcaatggtggatgagaaaggagaggaaaagcaacttctagtccttcgcgtttctctgcacccgtcggggcctgtttttgaaagtaagcaatatgtatatcaaaatgctcagaatgaaaccccgagcatggttcagaggatgtcacaatataagtctgatttgacgtcaaaatgggcacttgcagccaacaaggacagtgtgaatgacactgtttatgaaaatacgacattagcaaggaaaaataggcccagttttgttagagtcgcagagacccctcatgggaggatgtgcggaaaaagacataggtcatccagaagcaaaacactgccccacgtgttgtctcatgggggttatgaatatttagaacagaagttgatggctgagaatacaaagaaaaaactaaaggaagctgctcaatccaaaagcactgaggtcgtgatggaccctccatctcccatcagacgacacgtgaagtggaagatggcccgcgccaagaaaactggccagatgacgtttgaggcagcaaaggaaattgctgagaagatt

SEQ ID NO: 6088 - DNA, 237 bp, Glycine max
  Peptide Sequence Number=SeqID_97773
atggcacgcaatgtgtttgctccgtgcccctatttaagggacctatatgggagggagctaaaagggcttttagtgataattcccaaggtggtcatatctctctttatggtctctagagtccccagtggagtcgccaactgtcgcaacctacccttcggtgggatggcgacgcgagactcgcgggatgcgtgttccacgaaaggaatacgcgcggagtcgccaccaacgtttatttga

SEQ ID NO: 6089 - DNA, 477 bp, Glycine max
  Peptide Sequence Number=SeqID_97774
atgacggtgaaaacctctgacacatgcagctcccggagacggtcacagcttgtctgtaagcggatgccgggagcagacaagcccgtccagggcgcgtcagcgggtgttggcgggtgtcggggctggcttaactatgcggcatcagagcagattatgcgtaaggagaaaataccgcttcaggcgccattcgccattcaggctgcgcaactgttgggaagggcgatcggtgcgggcctcttcgctattacgccagctggcgaaagggggatgtgctgcaaggcgattaagttgggtaacgccagggttttcccaatgtcactcagatgtccgattcagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 6090 - DNA, 449 bp, Glycine max
  Peptide Sequence Number=SeqID_97775
gtatgctttataccaaattgctgttgagtttgagcatgtaagttatactggtattgatagttctcgttgtggatgtgtaatgcgaactactcacggtcttccttgtgcataccaagggttatttgagcctgaagtcaacataactgaagagattgaaaccatatccaagaggtttgaagagcttgatggttgtggcaaagttactctaaagagtaaacttcaggaaatttcctaccgtgatctaaactctatgtgtgctcctctagaaaaggttaaaacaaaagtcaagcatagtgcatcatcatctgaacaacctatagaagcaaggcttcaagaagatgttttgatgatgtcaaaggaacgtgcttctcaagttttattcaatccaagaaatccaagatatatgatcaagaaaccctctagaatcttccaagttgaaacatcaaaag

SEQ ID NO: 6091 - DNA, 207 bp, Glycine max
  Peptide Sequence Number=SeqID_97776
atggaacaagatgaaaagaggtttctgtaccgtatacgctattcctctgatgaaaaaaatgatccagagggaatggagggaggaattggtgatccaaagagtttgaaaacaatgttggctactggtaatcgattattgccttctggaattaatgaagcattgggcttgaatctagaattgggcttggacttgaagagggcagactaa

SEQ ID NO: 6092 - DNA, 519 bp, Glycine max
  Peptide Sequence Number=SeqID_97777
atggctccgaaaaagcttttcacaaagagatctaggagggatgccgcgactgaagggaccagtgctgcccccgagtttgatagccaccatttcaggagcgcccagcaccagcagtgcttcgaggccatcaaaggatggtcgttccacagagagagatgcgtccagctcagggacgatgagtacacagattttctggaggagatagctcgccgacattggacgtcgctggtcactcccatggctaagtttgaccctaatatagtcctggagttttatgctaatgcttggcccacagaagagggagtgcgagacatgcggtcatgggtgaggggtcagtggattccctttgacgtagatgccctcagccagttcctgggtgacccgctagtgttggaggaaggccaggagtgcgagtttagtcagagaaggaacatgactgatgggttcgatgaggaggccattgcccagatattatgcacatcgggtcaggatttcgcctggaccgctgcagggaggcgg

SEQ ID NO: 6093 - DNA, 847 bp, Glycine max
  Peptide Sequence Number=SeqID_97778
atgacaccttcgaccgaagatgtgaagaaagcaatgcaaggattgtttgctgtactccagctctctaggtggggctggtttcacacctttttctccaagaaggcaggcccgtctatccgctacaaggaaggaagaatcaagattctatcttcatgcgaaggatgtccaaatgttcccttgatgggaacaaggggttgtattaattataatctcgtcctcgccataagacagcttggctaccccatgagaggagcgccattagacgaaagcatcacgcctttcatcgcacgaggtttcagtgaccacaatgcgagggtactccaaggagttcgcaaggcatgggatgcggctctgaaaacaggattggattggctcccaaatctaaagactgtgagagacgatgaggttaaagctttggaagaaagtgatgaggtacaagccctaaaggcagagcttgaaagagcctgggtagtcaaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagtaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccatggacttctcagctatt

SEQ ID NO: 6094 - DNA, 464 bp, Glycine max
  Peptide Sequence Number=SeqID_97779
atgacttccaagattattttgatgatgccaaagaatcaagagtcaagcaagttccaaagaatcaggcttcaagaatcaagtctcaaagaatcaagattcaagaacaattaagtttcaagattcaagaacaatcaagatcaacattcaagactcaagattcaagattcaagattcaagagaagttgatttcaagattcaagagaagaaatcgagaagcaacagtcaataattcaaaagggaaaacttctaagaattcctttctactcccatgggagggtacatcctttgtggtacaagtagagggtacatatacttgggttattatactgagaacaagagagtgtacatccacttggttgttcaaagagaacaagggagggtacatcccttgtggatctttggcttgtaaaggattttacaaggttgaaagaaatctcaagaactgttggttgcttggggactag

SEQ ID NO: 6095 - DNA, 147 bp, Glycine max
  Peptide Sequence Number=SeqID_97780
atgaagatggatacctcagagccttacactggggcaatgaggggcactgtgcatgagcctcaagttccctgctacaaggtcatgaagaaagacaaagattggtacctcaaagccttacactggggcaataaggggcaccgtgcatga

SEQ ID NO: 6096 - DNA, 324 bp, Glycine max
  Peptide Sequence Number=SeqID_97781
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgacgatcagataccgtcctagtctcaaccataacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 6097 - DNA, 156 bp, Glycine max
  Peptide Sequence Number=SeqID_97782
atgactaaaccacgtcaaaagggtgtacaaaaagtaaatgaaacaaaagtaaaagcatgcgaaacaagggaaaagagggaggtggttgccgcccagctcgcctccagaaggcaccgccttctgttggatgatcctggacgccccaagtgggcctga

SEQ ID NO: 6098 - DNA, 442 bp, Glycine max
  Peptide Sequence Number=SeqID_97783
gaagcggaagagcgcccaatacgcaaaccgcctctccccgcgcgttggccgattcattaatgcagctggcacgacaggtttcccgactggaaagcgggcattttgtgacgctggaacttcatccaagctgttgatcaagggcggcaccgttgtgaatgctcaccaccaacaggttgccgatgtctatgtcgaagatggtatcattgttgccatcaatcccactattacggttggagatgaggtgacggtcatagatgccactggcaagtttgtcatgccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 6099 - DNA, 426 bp, Glycine max
  Peptide Sequence Number=SeqID_97784
atggaaaaacctttgttcaaaccttttaaggttagcgaaaaagccaaactgaaatttagggaacttagaaaacaaaagttccctactgtggagataggtgatagcaataatgaattattaagcaagattaataggttacttaaaactgtcccagaaacccctcaaccttcggaggagtcatccaaaataaggactaggcatacctccaaactaattaatgacattaatgaggataatgacaataatttagaacaagtatctaaagaaggttcaatatctgaaaaagtaattaatccgattaacaccaaacattgggaaacaccctccaaactttattaccaaagaccaactgcccttgatcttctactagaagaaagaggcaaaaataactttaaaagttttagtgcaaacaacatctatgaatga

SEQ ID NO: 6100 - DNA, 576 bp, Glycine max
  Peptide Sequence Number=SeqID_97785
atgcgtaaggagaaaataccgcatcaggcgccattcgccattcagcctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccaaatttgtacctgtcgccagactctgtggtttatgctcctctgcgaccaccacacagacctttgcccttcattgcaacatctgaagcaattgaacagtctaaagcttatgttgcaaacatctacaatagacctccttaacctcagcagcaaaatcaaccacaatagaacaattatgacctctccagcaacacgtacaatcccgggtggaggaatcatcccaaccttagatggtagaatccttcacaacagcagccttattttcaaaatgttgttggcccaagcaaaccatacgttcctccaccaatccagcagcaacaacagcaacagccccagaaacagcaaacagttgaggctcttccacaaccttcccttgaagaacatgtga

SEQ ID NO: 6101 - DNA, 177 bp, Glycine max
  Peptide Sequence Number=SeqID_97786
atggccttccagtcttttgaggtgcccggaatgggtttaggcaaggacaagggcggcataaccagcctgataagtgctaaaggaaaccgtgggaagtttgggttaggctataaacccacacaagcggacataaagaaaggcattacaggaaggaagagtggaggtcaaggctcgtga

SEQ ID NO: 6102 - DNA, 150 bp, Glycine max
  Peptide Sequence Number=SeqID_97787
atggctaccaaaggttggagctttgttggagcttcaatggtggaggaagaagaagagaatggcaacgtaaaaccagtagagaatgttatccctgttggtgtcacaccaacaaagtcaagtaacaggagcatgtacctatttgttttgtag

SEQ ID NO: 6103 - DNA, 207 bp, Glycine max
  Peptide Sequence Number=SeqID_97788
atgcatattcatggtgaaaatcacaaaggcaaaggagagggaaatgatgaagtgaccttgttggatatccctggtgggggagatagagagtttttcatgaggaaaaatactgatacttgggggcatgtcactcggtttggaactcccttgagactcaagctgatcaccgtgggggggggggggagttgcctgtgcaccacagggtga

SEQ ID NO: 6104 - DNA, 432 bp, Glycine max
  Peptide Sequence Number=SeqID_97789
atgcatgctttgttagggtcattcaacagtggaaactggtctgattctgatgaccttgataggacagggctaagttgtcatactatcacgagacacctattcactgaaatagcttaccaagtaacacaagttccccgagagttcaatactcgattcttaccgttttatattacttgtgtgatccggtgcacttgctggaagcgaacaatcacaaatagaggtatctattatctcatcgccatcccagatgaaggatgttacatacaaagtgataatgaacacatagcaatacctggtgattggagatcgatctcgaaagcaaatgttccaccacgagtaggaaagatcaaatggctaactttctatggagcatatggaggaggaagaatgatgagatctgggaaaataaggatgtcccaattgagtttgtag

SEQ ID NO: 6105 - DNA, 213 bp, Glycine max
  Peptide Sequence Number=SeqID_97790
atgtggtaccatgtcagtaaaaaatctcgtcgggcgcctaaaaggagaccagttagggtcacgctgttttgcgagaatgctccaaccatgtgggatcagcacaggcttaaaggagcactcaaaccgggtgtatttacccccaaggcctacactctgaatagtccgttaaggcctctccctcctgattcaggtccaacccataaaacattttag

SEQ ID NO: 6106 - DNA, 260 bp, Glycine max
  Peptide Sequence Number=SeqID_97791
agtcagagaccgtaccaccagagccattcatctatgaggcagatccaggcaccacattggaggagactcaagaggttgctacaccagagattaccccacagcaagcagtagaaccttccacaccagttctggatttgtcttcaccacaaccatcccaaaagccatctacacctgtcctgggcttgtcatcccccactacttcaccagcaggcaccctagtgcttcacctcacagatgaagaggaggatatcatggactag

SEQ ID NO: 6107 - DNA, 690 bp, Glycine max
  Peptide Sequence Number=SeqID_97792
atgtcaggcccaaatgacagctggctccaattctacaaccaaaattccacaccttcaatccctgacttcaccgtgagtactgctaatgttaccactactactatcgttgcggccacgagtccttcacaggacatgttgaattcgagttcatcaggcccgacccatttaagcccggaagggcgcgtggcgaagcccacccgccgtcgctcccgggcctcgcggcgaactccgaccactctgctaaacacggacaccacaaacttccgggccatggtccaacaattcaccggaggcccgagtgcaccatatgcatcaaacccatcattggcaccacatgttttgccaaacctcatgggctttgggttcccctcacgccctgttccgagcccaaccaccctcgtcatgacgtcatcaccccctatatcctaccttcaacaacaacacatgtttcagcagcaaaatcaacagtacaatttgtatagtactggtggtggtggcacacaaggtggtggagacagcaacaacaacagaatgttttttcagagactaagtaacaacaacgttaaccctataatgagtcttccaacaagcaatgttgttgttagcaataataacaaccgtgatggtgatggtggggctgtgaatacgcatcatggacgcttcctcccgaacacttcttcttcttcttga

SEQ ID NO: 6108 - DNA, 93 bp, Glycine max
  Peptide Sequence Number=SeqID_97793
atggcatggctaagtgattgtagcttatgcgcctctgaaggtgatagatttgcgaagaagccatgttttgatgatgccaaaaaggttacttga

SEQ ID NO: 6109 - DNA, 204 bp, Glycine max
  Peptide Sequence Number=SeqID_97794
atgaaggaagagttgaaaatgatcgaaaaaaatgacatgtggaagctagtggacagacctcaacacaaacaacctataggggaggagatttatgtagagcaacatgaggggtttcaaatcaaaggagaggagcaagaagtttacaagttgaaaaaggtattgggaagcgagagaagaaaagaaaaatctggaacgagaaactga

SEQ ID NO: 6110 - DNA, 173 bp, Glycine max
  Peptide Sequence Number=SeqID_97795
ttggaggattgagatgctatgagagtccaaagaataagattactgcagtacctactgaggaagaagaaatctggggtgcattcttcaagaacagagaatcagtaatcagtctcaacagtaatataaggttaatgtctgttgagactgcattaggtacacagggaaaatgtgag

SEQ ID NO: 6111 - DNA, 194 bp, Glycine max
  Peptide Sequence Number=SeqID_97796
ggatcgcgcccgcaagacacccagtggacccggagaagtccaacagggtcttggggtttccagctctaattacgagtctccatcagatctacgaagtgcctgtcacccccagcaaggtcatcaagccctctactaaccgagctttcatcaagaagtactgcgcccacaggcaggcgcagggcgagacaccataa

SEQ ID NO: 6112 - DNA, 345 bp, Glycine max
  Peptide Sequence Number=SeqID_97797
atgcctagatctcctgcaaatccgagtgtacgccgagcaatgtgtgaccgtttagcaaggctacttaaaacagcgtacgacgataattggtccgagcttgcggaaaagcttggttatgctaacgcttcgggaatgttatcaatcaagcgtggagttgcttttcctgatgtgcagcgtttaaatcgtattagtgaatgggaaattgagggcggatttataccatccttagactggatattgaccaataaaggcccagcagttattagatatgaaggtacgacaatcgttgaaggactgacgttatcgcaattagcctctttgcgtgctaattgtagaagtatttaa

SEQ ID NO: 6113 - DNA, 327 bp, Glycine max
  Peptide Sequence Number=SeqID_97798
atgattaaaccggttgctacagtagaagtggctgaagctgctggcgcacatgttgagaagagcggcgaggaaattgtaaaaggtgtttgtatcgcgtgtcatggtgtaggtgcattgggtgcgccaaaaattggcaacgctggtgactggggtccacgtattgctcaaggttatgaaacactggtcaaacatgcgattgaaggtatccgtagcatgccggcccgcggtggtaacgccgagctgagtgaccacgaagtggcagatgccgtggcttacatggcgaaccaggcgggtgcaaaatttgatgcagccagcttgaagaagtaa

SEQ ID NO: 6114 - DNA, 294 bp, Glycine max
  Peptide Sequence Number=SeqID_97799
atgatgataactaaagatgatgacaaaggtgatgacaaaaagctcaaagatcactcaaagaacaactcaaaaaattcaagagttcaagataagaatctagaagaattcaagactcaagaagaaattttagagtcaagaatcaagattcaagattcaaggttcaagatctcaagaatcaaggttcaaggttcaagatctcaagaatcaagatcaagattcaagactcaagattcaagaatcaagagaaggctcaatcaagataagtatgaaaagtttttcccaaaaattgaatag

SEQ ID NO: 6115 - DNA, 267 bp, Glycine max
  Peptide Sequence Number=SeqID_97800
atggagaattgcactaagcaattgtcgcaacctacccttcggcgggagggcgacgcgagactcgcgggatgcgtgttccacgaaaggaatacgcgcggagtcgccaccaacgtttatttgaggaaaacgtcggaaaaaaccggaaaagacgcgatctacgaacttttaagtgaaaaggttcgggagttgtatttacgcacggggaagggtgtttcccttcgctcctacatattcctcaattgcgatgaggaaattagacctacatag

SEQ ID NO: 6116 - DNA, 177 bp, Glycine max
  Peptide Sequence Number=SeqID_97801
atggaaactgcaaaagggaccaccgaaacaacagcaaacaaccaaaacggaagaaacaaagcagagaagaaacaagcagagaagaaagcgcagttcttccggaaacttccggatgacgttcttccggaagtagtttgtgggtacttccggaagtcacaaattcttcttccggaataa

SEQ ID NO: 6117 - DNA, 294 bp, Glycine max
  Peptide Sequence Number=SeqID_97802
atgtcgatctccccctgcggaagtattagttggtctatgtcgtcccgacataaggatcgcacccacaaagacacccagtggacccggagaagtccaacagggcccaagggtttccagctctggttacgggcctctattagtcctacagggtgcccattccccccagcaagggatcgtgcccgcaagacacccagtggacccaaagaagtccaacagggtctaggagttgccagctctgattacgggcctttgtcagttctacggagtgcctgtcgcccccagcaaggtcattag

SEQ ID NO: 6118 - DNA, 903 bp, Glycine max
  Peptide Sequence Number=SeqID_97803
atgaattcctacaaaaatccattggaagaacgctactccagtgaagaaatgttatttaacttctcgcataataacaaattccagaattggagaaagctttggatagctcttgctgaaatcgaaaaagaccttggacttgaaattacagacgagcaaatcgctgagttaaaagctaatgctgaaaacatcgattatgacaaggcagcagagtacgaaaaaaaattccgtcatgatgtaatggctcacgttcacgcatatggtgatgtagcaccttcagcaaaaggaattatccacctgggagcaacttcagcttttgtaggagacaatacagacttaattcagattcgtgacggacttttaatcttaaagaaaaagttggttaacgtaatgaaaaacctggcagattttgcaattcagtacaaagaccttcctactttagggttcactcacttccagccggctcagttgacaacagttggaaaaagagctactctgtggttacagagtttggttcttgatattgaagaattagacttcttccttgaaacccttcgtttcagaggagtaaaaggaactacaggaactgctgcaagtttccttgaacttttcaatggagattattctaaagtaaaacatttagataaagaactttcaaaaagattcggtttcgataaggttttcggagtttccggacagacttacgatagaaaaattgatgcgaaagtggtggctttattaggaaatattgcacaatctgcacataaattcacaaacgatttacgtttacttcagaaccttaaggaaattgaagagccattcgagaaaaaccagatcggttcatcagctatggcttacaaacgtaatccgatgagaagcgaaagaatcggggcattggcaaaatat

SEQ ID NO: 6119 - DNA, 552 bp, Glycine max
  Peptide Sequence Number=SeqID_97804
atgattatgaggggccaagacatttatagtagccaagatgagcctactatttcaccttcctctagtgaaagtgaagaagcaaaaggggaagaatctagtgaagaaatctacccccaagaagatggacaaccattagtggttaaagagaagtgtaaagagataagtgtctcctccaagagtaaagaagttgtggatgagggtttggttcgcaagagcttaaatccttgtgctttgttggtgccgaaaagaggtattattacgcaccaagttcctaaaatagctggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggtcattcctgattggcccactccaccaagtgttgagggaaggagcccagagtatgaagaacctcgggatttgaggtcaaatcctttccaaggtggagggaatgatgcaatcctatcccgcaagggcattgggtag

SEQ ID NO: 6120 - DNA, 223 bp, Glycine max
  Peptide Sequence Number=SeqID_97805
ggaaagaaggattcatggggatcctctagtagagtattggaatgacttgaaaagtgcccttaggaagaggcacattccctcctactatgaaagggaacttatggacaagctccacaggcttagacaagggagtatgagtgttaaagagtataggcaacaaatagaactactgcttttgagagctgggcttagtgatgtgccatcattttcttctatttcttaa

SEQ ID NO: 6121 - DNA, 525 bp, Glycine max
  Peptide Sequence Number=SeqID_97806
atggcttcttgtagtagaaaagccacaacttcagtgtcacaggcagaattggagaggaggaactggcacagggagatcactaatttttcggagggaagcatagatgtagtagtggttaaagagttctatgcaaacctatatgaccctaaggacaaagcaccgaagcaagtaagggttcgagggcacctgattaaatttgatgttgattccctcaacaccttcttgaagacaccagtggtcgtggagaaagtggagagcttacctttttgctccatatttgctagactgaggcctaatcctcaggagcttgcagctcgactttgtataaggggatttgtacttaatgtcgagggtctaccgtggaagcttttgaggaaagatcttaccactctggcccaaacctggagtgttctatcttattctaacttggccccgacatcccatacttttgatcttaatttggataaggccagatttcactcattgcacagtccaactcctcgcggcttggatttccagccctga

SEQ ID NO: 6122 - DNA, 231 bp, Glycine max
  Peptide Sequence Number=SeqID_97807
atgcatctacgtgatcaaggaagccttcttaacaacaaagagaagaacaagatgaaagattgcaaaaatacaagtggtgaggatgtcttcttcacctctaggatctcacaatcacttacaaactcatctcaagctctcaaactggttcctgcttcaagctttggtctctgcagatcttcacatagcaaaatctctcaaaactctctagaacttggacctttctctctctag

SEQ ID NO: 6123 - DNA, 267 bp, Glycine max
  Peptide Sequence Number=SeqID_97808
atgggaaagacaacttgggcaagtttgatgcaaaatcatatgaagactaaccctataaggccgagaaaagaaatacttgatgatattacagattctttaggagatatgcatattcatgaaaaaggtcacaaaggcgaagaacatggaaatattggagactttcaattgaaagaaaatcaaacaaatttggatcttccaaaggagtggagaacttcaaggtatcatcctcttgataatatcataggggtgacatcacaaaaggggtaa

SEQ ID NO: 6124 - DNA, 972 bp, Glycine max
  Peptide Sequence Number=SeqID_97809
atggtggcatcctcaaacaaagagtccatggccaagatcatggttgattgtaaatcagccaaagatattttacaaaaagatgttaaagaccttgcctcaaaacaaatttttgcacgatggcaagcaattttaagtgtctttgattttgacatagaatacatcaagggcacctcaaattcactacctgactaccttacccgtgaattcttacagaaaagtggaaggagtacaggcaaaggagccaggctggctcttccagagccaaccatcaagaaatcatctacctcttctgggtcaccaacccaggctgggtcatctacccagaaaaacaatttagaagggtcatcaacccagattgcctcaatcaaacctgagccatccactcaggaatctcccaaaccggcaaccgccaaacaaacatcggccgactatgcatgggcaattgaaacccttcaggcccttcaagacatgggtctgaccaaatttccaaaaataatcaaaaaatcttgggcagacattgcctcagaatctgatgatgaatctgaatcaaatttacaaacaatgatccaaaatgcgtcaatgaccaaaacagccaccaatactaaaggaaaactacctttagccaaagcccaaacaccacctaccaaacaaactaacaattatatttataaaaataaattgttaactgttttgcagatggaacctgaattttgggacaaaaatcccttcaaggcgacggccaaggctttcccaccaggatttcactacaaaccaaccaccatcctgaagacaagaactttttatgaattgattttggtagattcaaactcagtatctatcaaacacttcaaagatccaaaagaccaaaccttaaacacccactcaaccatccaaatactaaaagttcttcaaccgagacactttggttcggacttgaacaaaggaacgagattttcagttccatttgatccg

SEQ ID NO: 6125 - DNA, 282 bp, Glycine max
  Peptide Sequence Number=SeqID_97810
atggggaaatatgcgaaaaagaaggctgcatttaacaaaagtggcacagaaaggaagaaaaaagaagaaattctgaagcaggcccaatccaataggggcgctcaacgcgcatcaggcgctaagcgagcaactaactggaggcgctgggcgtggcggaaaccgttacgcgcgctaagccagctaggcgcccagcgcccgatccaacagacgcacaggcgcccagcgcccgatccaacagaagcacaggcccagcgtgcatggcgcgcccagcgcgcgatctga

SEQ ID NO: 6126 - DNA, 183 bp, Glycine max
  Peptide Sequence Number=SeqID_97811
atgtatggatttattttggttaaatggtattgtcatcatcaaaaaggggaagattgtagacaaaggatcaagctgaaagttttgatgatgccaaaggattacatgaatcatatgcttctcaaagatttactcaagacaaagcaattagagatattcaagatggataatcaagacagtctatag

SEQ ID NO: 6127 - DNA, 114 bp, Glycine max
  Peptide Sequence Number=SeqID_97812
atggtgattttccaccatggagatgcagtggaagataaaagagaagaggaagcttccttgagaagcttctttgaggagctagagcttagctacagacacccctctaataactaa

SEQ ID NO: 6128 - DNA, 195 bp, Glycine max
  Peptide Sequence Number=SeqID_97813
atggaggaaatgaatatgcacaaaacaacaagggggagccctaaaggaacccctcctcagccctctagcactcctatttataggaaaaggggaattttaggcacttgcagcttgcccaagcaagctagagctcgcccaagcgagctaaggcttagtcctgaagtcaccaactcgcccaggcgagccagaggctag

SEQ ID NO: 6129 - DNA, 1014 bp, Glycine max
  Peptide Sequence Number=SeqID_97814
atggccaaggacattgctaatgaagaccaaggtaaagaagaagacgagcttctgaccaaggagcacaggactacaagaaggcatgagttttttgcaccactccttggccctataaaagaggaaagttgcagctctagaagcctctcatccaaagaaggccaagaaagcctaaccattcataaaccacaggcatttatcatctcctctatcattccacgacacataaagatgagggcgaccaaggctaacccgaagattggtgataaagaatgggtggagctattcgcaaagcaaagaagggatcctttgcaaaaattggaacctcctaagatacaatttctgatgaaggtgtacttgttgattcctatttctagactcttgccaatgcatcctgtcgatataaaactcccacaagaagatcgttcatcccttggcaagttgcatgaacatatatacttgcgagatcaaaccactgcgtaccctcttggtctgcacatcttaagggcaattgacatcaagatggttgctaatagagcttgtccgtgtctaccggtgtgggattctgctaagaaaaaaggatttgagctatattgcaaagaagagatgcctataaggaagatgaaggtggagattgtgaacttgccgctgaattggagccctttgtttcatggaaagcagctgatacgtacttcaaacgctgatgatgctaggaccttttggagtcagattgtgtgggtggtctccaaaaaagcctccacttttggctataatggaagcggcattgttgtgcatcgtgataagaagtttgacaaagatgttgttgttgttgttaaaaaagaagttcttgcctccatccaagttaaatcatttgctgaagttgtggacgacaccattgtgtgtagggttatcattgatcttacaaacattagtatcatggacaaaactggtgatacatccaatgtagttgtggttgatgaagttgaaccacatattcaagaccctgcgtccaagtag

SEQ ID NO: 6130 - DNA, 426 bp, Glycine max
  Peptide Sequence Number=SeqID_97815
atggcctttgcaaaaaccctcgttattgagacaatcccaaccatggaaatcactagcattcacacaaacaatgagccatccatccatgaaaattgggtgaggaactatgactcatatgtcactagagcactctacaaagacaatgctgacaaggatggtgaccaaaagatcatagtatacaacctgatgtgtgagaaggaaaaaatatgggtcaacattttgaacaagagtgtgctccataaagctagttccaaaacaaccctctttgatctccacaagttcgtgctatttcaattgatgaagaaccttccgtttgaccttccacacactatatacatcaacatgttgaggaacctcgaaggcttaggtgatctagatgacatctactatgcagccctcctcaacaagctcctatgggatcaatga

SEQ ID NO: 6131 - DNA, 536 bp, Glycine max
  Peptide Sequence Number=SeqID_97816
ggctacatgccctcgccttcgtagggctacacgccctcaccttctaaggactacacgtcctcaccttcagaaggctacacgccctcgccttcagaggactacaagtcctcgccttcagagggctgcatgccctcaccttcatagggttgcacgctctcgccttcataggactccacatctttgccttcatagaactcaagttcctgggccaccccctgatattggagggcgaccaactgcgcaagcacaaccagagagggaggttatcgtgcaactactatgcatactaggggaggatttcacccagccgctgcaaggagacgagtatggatcatgcacaccaccacaactccgatctccccctgccgaagtgtcagttagtctgtgccgtcatgacatagggatcgcacccactagacacccagtggacccggagaagtccaacaaggccctggggtttctagctctggttgtgggctgctgccagtcctatcgggtgctcgtccccccagtaaggtcacatcatcgtgacatag

SEQ ID NO: 6132 - DNA, 597 bp, Glycine max
  Peptide Sequence Number=SeqID_97817
atgatgagaactgaaaatgttgatgatgaacacaatgcaatagttgtggtggagtctgagcaagggagaaatcatttaagaagacatgatgggctaagaggaagatcaaaattgcaatcatgtccgcaacgagatatgagtaacatacaatattactattgcagtgagaatgatcatgtgcaagtgaggtgcaaacaaatgaaggaggacttggaaaaattaagagatatgaacaaagatggcaccaactcccaagctaatgtagtaaaaagtgttaaagatgaagatgatgtgttttgggcaaacgatgaggttgctaaaataaaatgggtgatggattctgctacctcaaagcacatttgcaaagatcgagagatgtttaatacttttaaaatcgatagagaattcgaccatttcaagttagggaatggtgggaaattcaaggttgaaggcatatggagtgtgaggatgaagctccataatgccttgaagaggaaccatgatagcaaagtgaagaagaaagtgaagttttctaatgttgtcgaagtgttgggagagacttccgttggagggggagtttgttcactttcaaattga

SEQ ID NO: 6133 - DNA, 167 bp, Glycine max
  Peptide Sequence Number=SeqID_97818
atgtcctggacatcgtatccgacatcgtggatcctgcagcttcaatgcttttagcaactccagatgtcctggacattgtatccgacatcgtgaatcctgcatcttcaattcttcatttgacatttcatcttgccttgtgcattgtgcagcccgatcttattctttga

SEQ ID NO: 6134 - DNA, 396 bp, Glycine max
  Peptide Sequence Number=SeqID_97819
atggcttcccgaaagagaaaggcacctgcctcaacatcccaggcttgctatgaccgctttagattcacatctcaggaggcctgggattgctactctgatatagtgattggcaggaagatcctgctagagagaaatgtcatgatttaccatgcagaatttgatgaattcaagtatgagctagagagaaagaattggcacaaggagctgaccaatttcatggatgggagcatcgatgttgccattgttaaggatttctacgcttacctttatgatcccgaggataaatcacctaagcaagtgagaggccacttaattaagtttgatgaagacactctcaacaccttcctgaagacaccgatgttggaccttaatgagcatgcagaggatcattcatag

SEQ ID NO: 6135 - DNA, 261 bp, Glycine max
  Peptide Sequence Number=SeqID_97820
atgctcgctcaactcaagcctccttcttattctgcttcaagttctgatttggcttcttctactactgatgcggataatgcttcttctttgcctactaaagctgctaagcaaaagtccctcctttcactttcatctgatattaagctagcaactgactcaccaacggattcaggaaccgaaactgcaacaggaacagaaacttctgcagcttaccttagtgcggattcagcaacgaattccgcaccttctccgtccctatag

SEQ ID NO: 6136 - DNA, 903 bp, Glycine max
  Peptide Sequence Number=SeqID_97821
cggataccgggagcagacaagcccgtcagggcgcgtcagcgggtgatgacggatatcgggactggctaaactatgcggcatcagagcagattgtactgagagtgcaccatatgcgggcgatcggtacgggcctcttcgctattacgccagctggcgaaagggggatgtgctgcaaggcgattaagttgggtaacgccagggttttcccagtcacgacgttgtacgctaaaaatgaagagtttttagaagggagagaaaaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctccactgactcgctgcgctcgggtcgttcggctgcggcgagcggtatcagctcactcaaaggcggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttg

SEQ ID NO: 6137 - DNA, 240 bp, Glycine max
  Peptide Sequence Number=SeqID_97822
atggattttttagaaatcaagatattatattttcaaagctttaaaattaagcataaattcaaaagaaatggggagaaagggatgagtgaacgaattgtcatcatcaaaaagggggagattgtggaagcaatgtcttccaaggttattttgatgaagccaaagaatcaagagttaagcaaagtttctagcaaagattcaagaatcaagtttcaaggttcaagatttaagattcaagaataa

SEQ ID NO: 6138 - DNA, 510 bp, Glycine max
  Peptide Sequence Number=SeqID_97823
ctaagtgccagcttgctgcgcttagcgcttgtgttaatttcataaggcacgctaagcgccagatggcatctcagaaaagagaatccattgcttcttcatcttctcagctcaaatatgatagatacaaattttcttcccctaaagcatgggatcgctacaccaacaacatgttcggcagaaagatcattcctgaaagaaaggtgcagctgtcatttaatgactttgaggaatttcaaggggagttaaacaggaggaactggcataagaaaatcgctaatttggaagagggaagcatagatgtggcacttgtaaagaagttttacacaaatgtttatgatcacgaagacaagtcaccaaaacaggtcaaggttagaggacaatggattccatttgactcagctgccgtcaactcttttttagaaacaccagtggtcatagaggaaggagaaagtcttccgacatatgcaagatttgtgttgctaaggccaaaccagcaagagttagcagcct

SEQ ID NO: 6139 - DNA, 636 bp, Glycine max
  Peptide Sequence Number=SeqID_97824
atgcatatgaaaatgagccataccaagagcaacaacttgaacaattttctaggcttgatgatcaatattcatgccaaaggtgaagcatttagaaatccacaaaaatcagcacctcaaccacaatgtccctcaccaagtgattccacacaagctcttgaagtcccaacttataatgtccctctttctcatgaatcaacatctgaagttccagcaatgaatcctgaaatttcttgcccaccaagtgattccacacaagctcctgaagtcccaactggtaatgtccctctttctcatgtatcaacatctgaagttccacaagaagataaaacaactagacgtcatgctgggcgtgagtctacacactgttggactgttgaggcaatagactctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgataattgctttgaaacaattttaaag

SEQ ID NO: 6140 - DNA, 504 bp, Glycine max
  Peptide Sequence Number=SeqID_97825
atggttaaggaggagtgtaaggaggtgagtgtctcctccaagaggttagctaagagggaaagtcatttttcaataaagacaaacattaaagaaacttcccttcttagacaacctccacatcttctcctttgtaaaataacacttgttagcactgtcatacctcttgagcttgaggttattcctcaagtaaaggagttgttggatgagtgtttagttcgcaagagcttaaatccttgtgctttgttggtgcccaaaataggtattatgagacaccaaatccctatgataggtggtatgatgaatgtgttgagtggtgcaaccctcttttgtaaaatcacccatgtatccaacatcttcatgactcacatacataggaactcattaggggttcccacgaaccctaagagaataaaggtcattcttgagtggcccactccaccaagtataaggaaaatttggggattccatgacttaacagacttttacaaaagcactactcagtga

SEQ ID NO: 6141 - DNA, 179 bp, Glycine max
  Peptide Sequence Number=SeqID_97826
tcactaccagcacaaccttctgatcagcaagtccaggagctcaagaagactcaagctgatctttgggaaaaggctactatccatgagtcttttgtaagacagaaatctagaagcaaggcgacgcgagactcgcgggatgcgtgttccacgaaaggaatacgcgcggagtcgccaccgac

SEQ ID NO: 6142 - DNA, 486 bp, Glycine max
  Peptide Sequence Number=SeqID_97827
atgaactcgctaatcgagcatgctacgctaagcgagttcatcagtactcattgtatagaggcgttctttgaagaactagctaagcgtgcttaccgtgctaattgtgttcatcctttgaggatgaatactcatcctcttgatgcttggaccagatacacagataatattctggggagaaacattttaccagagaggaaagtagagatatatcattatgagctagatgagtttaaggctgaattggagaggcaaaattcccataaacgcctcaccaatttagtcgatgggagcatagacttagctttggtgaaagaattctatgcaaatttatacagttctgaggatcatccaccaaagcaatccagagtcagaggtcatttggtgaagattgatgctgacagtctcaacacattcttggagacacctgtggtattagctgaggggagaccttacccgcttactccagatattgtagtttgcctatag

SEQ ID NO: 6143 - DNA, 288 bp, Glycine max
  Peptide Sequence Number=SeqID_97828
atggctgtcattattttggggacgccacaagatgaggctactacttcaccttcctttagtgaaagtgaagaagcaaaaggggaagaatctagtgaagaaatctacccccaagaagaaggacaacctttaatggttaaggaggagtgtaaggaaatacttgttagcactgccacacctcttgggcttgaggttattcctcaagtaacggagttattggatgaaggtttagttcataagatcttaaatccttgtgctttatgttggatcaagtggcctcggaataattaa

SEQ ID NO: 6144 - DNA, 309 bp, Glycine max
  Peptide Sequence Number=SeqID_97829
atggaccttccggtttcccgtgacaaaagacgagaccaacatacaacgcaggtatcatctccttcgaaacgacatattgcggcagtagggactaccagcaacaatatgttatcaaagagaaaaactctagatgagggttcactattatcaagcatgttgaagacccagcatgaccacagattcagctccactccttatgttcccatagacccgggtatagggcctccttttcaactcaacgtgtgtgctaaaaaggtgttggtgttgtgtgcatcaaatgaatacatatttatcacatgcatacattaa

SEQ ID NO: 6145 - DNA, 243 bp, Glycine max
  Peptide Sequence Number=SeqID_97830
atggcgagtccaatgacattcggggagccaagcgagcccgttgacacgcagagactaacatcgtcttctacacctttgtcatccagagacggcgagtccgatgacatgcgggagtaccttatggttatccgcaccttttgtcaaccagaggcaagcgagcccattgacacgcagagactaatgtcgtcatctacaccttttgtcaaccagaggcaagcgagaccgttgatacgcagagactaa

SEQ ID NO: 6146 - DNA, 384 bp, Glycine max
  Peptide Sequence Number=SeqID_97831
atgcgtttagaaggcaatatagatgcaacagacagagaagaaacttcagcttttgcacagtggatccttgatattggtgatgggattgttgggcagcaaaatgatagtcatggttcaattgaaattccaaaagatctgttaatcacagaatatgatgacccactctatgcaatttttaattctacatttccaaatttatctcaccatcgtaacaatattgaatactttcaatctacaacgatattagcttccacaaatgaaaccgtacaacaagttaatgattatatactatcattgatcctagctgatataatttctgccaaaaatattggtcagaatgtttatattccaagaatgtctatgtctcctttacaatcaccatga

SEQ ID NO: 6147 - DNA, 426 bp, Glycine max
  Peptide Sequence Number=SeqID_97832
atgacatacgacacttggaaggaagtccctgctgctcagaaggatttgatatgggaggatattcaggcgaaaattgatatccctaaagcttctgaaggtaggacaaagaagaaagtacttcaaactgtcgacgagcgatggagacggtttaaatctgatttgacgaggaaatggacacttgcagtcgacaaggacagtgtggacgacactgtttgtgaaaaatacggcattagcaaggagaaatgggcccagattgttagacccgtagagacccctcgtgggaggtataagctgatggatgagaagactaagaaaaaactgaaggaagctgctcagtccggaagcaccgagggtgtcattgaccctccatctcccatcagacgacacgtgaagtggaaaatggctcgcaccaagaaaactgggtag

SEQ ID NO: 6148 - DNA, 1109 bp, Glycine max
  Peptide Sequence Number=SeqID_97833
aagacgaagaagaagctagaggaagttgcacagtcaggaagagttgatggcgtcatcgaccatccatccccggtcagacgccacgtgaagtggaagatggcccgcacgaagaagacaggggagattatgactgaggctgcaaaggaaatcgctaagaagattgccacacatggatcgttcgtcccccatcgacgtcaggatgttctcgccgctactattggacgtccagagcacactggacgtgtccgtgctgctggagctgtagcttacccagcagatcagggaccagctagaggagttcgtcacagagaaagtaacgaggcagtgcctcctaagcctctggttggtccctccagtcctcgagtgagcacaaaggggagttgtgttgatacctcaggaaacgatcctgagacgggtgactctgacaggtgcgacttgtacatagaagcagatcctgcccacctggttgccatggggagagtttatgaggaatccactgttgttcatagcactcctttgttgcctggccaagtaaaggtgagtgtggaggaggttacagatgcagatgctccagttcctgtacccactgatgaggtttccttagtggggcatgcacttcacaccatccttgcttggccgacacatctggtcaagtctttatcacagcaggtacttattgtccttaccatatctgtgtctccggcaaaaccacctccgaagcccgatctggaggtcgatgatccgctttatctgatgacattgatcatcccagagcttttcttgaggcattatcaggttagatgggatgccaccgtgttcggggtctttaatccagatttccccctctacataaagcacgaagacctctccgaaatcacacacggtggtcaatgtctcagcatatcaatgcatctcactgaaacatgtatgcgagtggggaattctgatatctatggattcctcgagccacagtccattcagaggtttgggcaatcacagtttgaatctgaaagttacataaagagttggatgcagagtacacaacgcgatgtctatcttggagcctacctaaatgggccagacaactaccttaaggggattatcaatag

SEQ ID NO: 6149 - DNA, 288 bp, Glycine max
  Peptide Sequence Number=SeqID_97834
atgtcgcggaacttcacggattgcttaacgatgggtgtcaagttcctcaaagcggtcaagcgaaggttgcatgccatcaaacaatggtccccggacgaaattaggatatctccgcatgcaactcactcgctgtccctggatgacaaaggcgcagaatttatctatgcgcgtttaccacccaactttctgctcttgaatgataaaggtgaaaatgcgggaccaactggttcccacatgtcatcgggcccgccgcctttggatgacaaaaggtgtagaagacgacgttag

SEQ ID NO: 6150 - DNA, 447 bp, Glycine max
  Peptide Sequence Number=SeqID_97835
atggcctttgctacatcacctagcccaccaaccttcaactataaccaaaccttagttcccattattggagcatccaaatgcaaactctattcatctcacaagacttgtgggagtatagagaataaccacggtaaatttcctcccgaaacaaagagaggagcatttactaatcgtggtaaaagaagtggaaagcaatggagcaataatgcttcaagctcctattgcaaattatgcaagaaaaataatcatgatacaaatgattgtcggtacaaatgcaaaaagtgcaaaaggcaactacactacgaaaaagattatttttacgaaaaaaagaagaagcaaattttctataaaataaagaatcccttgatcatactttgtactccgctttatcttctcaagaatcaagggatgtatggtatgctgatagtggttgttcaaaccacatga

SEQ ID NO: 6151 - DNA, 1077 bp, Glycine max
  Peptide Sequence Number=SeqID_97836
atgacatgtgagaaaagcataattatgccaaatggatatgaacacattatattcttatcgcaccttcatcatttccaacagtttctccctcctctctctcttgcaaaccttaggatacaatgccttggcgagctccaccaacaccgtcttgggcttcccgacgcgcacgacgagattggagtcgcacgcctggaggctacggtggaggtcggagatggagtcaatgaggaaggcggtgcggtaggggtcggtcttgtcgaagccagatgtcgacttgccgtagtcgaaggggtcaaagcagtagacggggaggacagagagggagtcgttgttggcggcggtgaggcactcattgtcgaggaggcggaggtcgttgcagaaccagacgagggcggcacggtggagggcggcggcattgaaagggtcacgggggcggtggggaacgagggagagaggggcgtggaggggattggcggggatggtgaatttgaaggaggttttggaaggaagaggaagagaagtggtggtggagagagaaagggagatgaaaatgaagatgaagagaaggctgtgataggatttaggagtgcattttcttggttggtcgaaatgacacttatcatatctctgctttctgaatatgttgttgcaaccattgaggctgcttcagattcttggggcatttctgttagcttcattagcataattttgttaccaattgtggggaacgctgcagaacatgttggctcaatcatatttgcttttaagaacaagttggacatatctttgggtgttgctatgggatctgcaactcaaatttctatgtttgtggttccatttagtgtggttattgcatggataatggggatagaaatggacttggatttcaatcttcttgaaactgggtgtcttgcttttacaattattgttacagcattcactttgcaggatggaacttcacactacctgaaaggagtgatcaagcatagagtagggtcaatttcggagctagaacataaattgggatggagaggtgcatcccctttaggtggaagccctgtctttgaaagtaattaa

SEQ ID NO: 6152 - DNA, 228 bp, Glycine max
  Peptide Sequence Number=SeqID_97837
atggctgaaaaggggagaagacccctgaagttctatctggaaatcgcgatgaacgcactaagcgcgccctgtgcgcttagcatgttcattgcagctgtcaaaactttgaatttccagatgaacgagctatgcggaccatgtcgcgctaagcgcgctaagcgcgccctatgcgctaagcctgagtgtctttttgttgaggcagagctaagggctcgcatgaagcgctaa

SEQ ID NO: 6153 - DNA, 180 bp, Glycine max
  Peptide Sequence Number=SeqID_97838
atggattctagagatggtggctcccatagaggcggcggcggtgcacctgcggtcgtgttgatgggaggccggataagcttggcaggagtgatcgacactccacagaattggcaaaggcccgtgattaaagccggaaaccccagtgccctgttggacatctccgggtccactggtgtctag

SEQ ID NO: 6154 - DNA, 1254 bp, Glycine max
  Peptide Sequence Number=SeqID_97839
aaaccgcgaagcgcagcctgctgcgctaagccccagatgctcactggactttacaacttcaagttgggcttagcggaagttagtcctttgaataaggctaagcatagtcgctgtgctaagcccttgttgagtgtcgagaaggttgagttaagcgtgccctgctgcactaagctcaactctctcactgtttttggagtttttgtagttaggctaagcgcgtcctgtgcgctaagcttgagtgtcattctgatggcatttaagaaaaggatggctccttctacaccttcccaagccagatatgacagatctaggttcacctctcaagaagcttgggagagatatactgatataattgtgccaaggaaactactaccagagagaaatgtagtagtatattacactgagtttgatgagttcaaggaggaactcgagagaagacactgggatgaggagctgactagttttgctgacgatagcatagatgttgccattgtgaaggaattttatgcaaacctctatgaccccgaagacaagtcacctaagcaggtgagggttagaggccatctgataaaatttgatgaagatactttgaatacctttctgaagaccccagtgattgtggaagagagggaaaatttgtgtgcttattccaggtttgcactcctgaggcctaatcctcaagagttggctgctaagctttgtatcccagggaggggattcaagctaaacgctgatggtcagcctttaaagatattaaggaagaacatgaccacattagctcagacatggagcgttctttccttttctaacttgattcctacctcccgcatatctgatgtcacattagatagagccaagttaatcaatggcatcatcatgaagatggatatgaatgttgggtacctcatctcccaccagatctctattactgcacaacatgattcatccaaacttggattccctgctttgatcacagctctgtgcaaggctagaggagtccaatcagattttagatccctagagagcctgagccctgccattaacttggcatacattaagaagaacttttggaatctagatgatccaacagtgacatttagagggccaaggaaggctaggggtaagagatcagaggtcctcactacttcagcagcaccaaagacagcaactccttcttcttccacagctccagcacctcccattttgactccagcacagactccagcaccttcttcttttactccatctacttag

SEQ ID NO: 6155 - DNA, 219 bp, Glycine max
  Peptide Sequence Number=SeqID_97840
atgcatgatgcgatcaagaacctaatggaaaggatccaaaagtccacttctagtgacaactcccgcaggatgttacacggtttatcagcgacaacgcatcatcaagagaggaaaactctagatgaggcttcactgttatcaagcgagtcgaagacccaacatgaccacagatcaacctccactccctatggctcacacagacccaggtatagggcctaa

SEQ ID NO: 6156 - DNA, 333 bp, Glycine max
  Peptide Sequence Number=SeqID_97841
atggcattggctgatattaattgcagagcatacataacaatggatttggtggtgttttctcaatctaaggtttctgttatacgtccctttttcgaggttaaggatctagaggctgagaagttgttggcaatggtgacagcgagcataggcaagtgtcaacaagagagagagaggggagggaatcacatcgaaagaggtaatcttgttgtcgtgcatgatgtagagggaactacacgtggtgaagataagagtggagggtgtagaagagtttcgattgggaaaggttggagagtttcgatttggaaggagaggaagttaatgagatgggattag

SEQ ID NO: 6157 - DNA, 291 bp, Glycine max
  Peptide Sequence Number=SeqID_97842
atgggatcaagtcaaacaccttcgcttaaaaagaggttctatcaagtcaaggtcaagagcctagggatcaccagtctaaaagagttagggcagttgatgggtcagctccagcggcaagcttttcgcaaagcttacgataaaatctgggacctagccatggtagaagtctccataggggtcattgcttccctcgcccaatattatgatcagccattgaggtgcttcacctttggggacttccagctatcacccatggtagaagaatttgaagagatcctagatgccctctag

SEQ ID NO: 6158 - DNA, 567 bp, Glycine max
  Peptide Sequence Number=SeqID_97843
atgccaaaggtgaagcgttttagaaatccacaaaaatcagcacctcaaccacaatgtccctcaccaagtgattccacacaagctcctgaagtcccaactggtaatgtccctctttctcatgaatcaacatctgaagttccagcaatgaatcctgaaatttcttccccaccaagtgattccacacaagctcctgaagtcccaactggtaatgtccctctttctcatgtatcaacatctgaagatccacaagaagatgaaacaactagacgtcatgttgggcgtgagtctacacactgttggactgttgaggcaatagactctgaagaaatgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaag

SEQ ID NO: 6159 - DNA, 351 bp, Glycine max
  Peptide Sequence Number=SeqID_97844
atggggctccgaaaaagggttgaggatggagaattgcatgcctgcaggtcgactctagaggcccacgcaatcactagcatggctccaagctcgaaggtggaggaacatgaacgaaaacgcaattcatggggctccgaaaaagggttgaggatggagaattgcactaagcaatcactacgcatggctccaaactcgtgggtggaggacgcagaacgaaaacgcaattcatggggctccgaaaaaggattgagaatggagaattgtactaagcaatcatacgcatggctccaaactcgtgggtggaggacgcatgaacgaaaacgcaattcatgggctctgaaaaagggttga

SEQ ID NO: 6160 - DNA, 246 bp, Glycine max
  Peptide Sequence Number=SeqID_97845
atggatgaatgcattgaactgatgaaagaacataatttggaaatgttggaatgcttgagtgcccacctggctgtagccatgactgattttgcacgttgttttcaaatcatcattgtcacgcgtgccttatggaataatacggaagttcgggccgagagcgacaccttgaccccccaaatttgtctcgccccagatatcaagattggggttcccacgataaaagatcccattgagacacaaccttag

SEQ ID NO: 6161 - DNA, 834 bp, Glycine max
  Peptide Sequence Number=SeqID_97846
atggcccaagatgacgcatccaatgaagttaactacatgggcaatcataatcatcaaggattccatcaaagaggaccacaaggattctatcagagcgataattttttgcaggagcacgattggagatattatccaagtaataacttcaaccaagggggttcaccctatcagcatcctagccagggttcgagtcagcaagagaagccgcctatcagtatagaggaaatgctattaagcttcatccaagagacaagggcaaacgctcaagagacgaaggcattcatccaggcaaacgctcaagagacaaaagcattcatccaggagacgagatcacatcaaaagagcacggatgcagctatcagaaacctggagatacaaataggccaactagctgagtcaactgctgaaaagcccactgaaaccttttcggtaaatgctgagatgaagcccaaagaggattgcaaggtaattttcactgagagagaagaggaagaaaagaaaactgaggaagatgtgcgtgatgaagaaggagaaaagaaggaaggaagagaaagaaatgaggagaaagcacaacaatgggagaagtactcacaagtagaaattcagcaagaaagtattctccaagtcaatacccctcctcatcaacttattgtcaagaaagaaagacatggagaacatgagaaagccttaagtgtcattctttccttgatcaccaccacttctcttgcaataacgtggaaggtgcttccagaatacacgagtttcatggcgtctctaactaagaggcgagaatgcaaggaagatgtgttctacgtgaccttcatgccaccttga

SEQ ID NO: 6162 - DNA, 123 bp, Glycine max
  Peptide Sequence Number=SeqID_97847
atgactgaaaaaggctttaaatacactctcagtataatgtcttttgagaggctatcatttactactgctaattggcgttgctgtggaagcgctttgattatatctttgaagcctcaaagtcag

SEQ ID NO: 6163 - DNA, 303 bp, Glycine max
  Peptide Sequence Number=SeqID_97848
atggtggttatatcactgtcaatgaaactcaaggaagagcactgttctattggtttttcgaggccactcacaaaccagaacaaaaacccattctcttatggctcaatggaggcggtggctggattaactcagcataacaatgcaaagcttattgctgattccagcttttccaagctttgtcacggcttagatgccaatgctggtccactcacaaattttgaggtccttgatttcttacgatctaaaggagcttcaaaggatccaacaagtgttattgccaaagtagcgcagtctgaatacaag

SEQ ID NO: 6164 - DNA, 480 bp, Glycine max
  Peptide Sequence Number=SeqID_97849
gaggaatatcaacattgtcgagatgaaatcttacaacattcgacagaggaaggcacatctacacaggattctcctaacactgctacttttgttaatgataatgaaatatatttgaatgttgttggaggtccaaattacaagaggaatgtgtacatgctaggtactttgagcaaaaggtttagttgctcaaaatcagctccatctacttctattgctcctgtggaagaccaaatagaggaaatgcgtgagacaattaataaattgaatgttgagcttttggaaaaggcaaataaggagaagacacttgaggaaaagatgttgcagctgatggagaatcatgaccaccaaagtcaggatatgcgacaaccgatgcaagaacaaagtgagcaaattcatcaacaaaatgagctaatgcagtgtatactacaacacttgcatattcagtctatcattccagctcctactccatcgactacatag

SEQ ID NO: 6165 - DNA, 505 bp, Glycine max
  Peptide Sequence Number=SeqID_97850
atgaagccattagactcagtttattttgattttccttggcaggggaagccaagaggtggctccactcatttaagggtaaagctgaagacccctaaagaggcaactgagctaattgagaatatcttacaggttgtaccatctgtggtgaggctcatgaaacaagccaatgtattcacattgaagaaaacactcaagaatttcactatatgggaaatcaacagagacaaggatatactcaaggaggattctcaggcttccagcagggtccttataattaacaaggacagtggagatcacaccctggcaatcaattcaacaaagaccagggttcaggtgggacaactagccaagaaaatagctgacaagtcatccaacagttttgtggcgaatacagaaaagaatcccaaggaggaatgcaaagctgtgatgacaaagagtaagaggtttgtggaggcagaggaagaggatagtgtcttgtccaagaagaaagctactgaaaagaaag

SEQ ID NO: 6166 - DNA, 351 bp, Glycine max
  Peptide Sequence Number=SeqID_97851
atgactttcgaatcgctcaaaagcaattttgataaagaaaatcattcaaataagggactttattatctccaagagctaagtacggaagaggccaacaagaggattcaatcttggagcaccaatgaacaattgcttgttggcaaagcctatgaatacattagaggtgttaagcctactgttagttggaaatctctccaagtttgggctcacattcgtgatttggctcttttctgtaggcgtttcacttctttacagtgcattactgactctttaatttggggcagatccaaatcaggtgttcaaggaaaattacgttgtttggctatagcaattacagtctactacatctga

SEQ ID NO: 6167 - DNA, 536 bp, Glycine max
  Peptide Sequence Number=SeqID_97852
acgggcatgcagaaagaattgtttcgaaaggaagtcgcgagagaaatatagtcaaagtaaacaatgatattgctgagacgggagaaagcaggaaaggaatgacaatctccggaaaactggggaatgaccatacgccctttgtggctgctagtgaagtggcaactggattgcctagtgaaattgaggttggattgctgctatcttgctcagtggattgtagccagctaaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacggttaccccgcctacttgactacttga

SEQ ID NO: 6168 - DNA, 2171 bp, Glycine max
  Peptide Sequence Number=SeqID_97853
gcgtagcagccgtgcgcatagggcggctcgagcaccagcagctggccgctgaagccgaccgcgctgccgctgatcagcggcttggcggcggcgatgcaggcggcattgacctcatgacgggtcgccatattgtcgcagcagtccagcaccagatcggcgcgggcgaccgcgtcgcgcagcgcttgcccctgcagccgctgcgccagcgggatggattccaccaacgggttcagcgcctgcaggtggcgttgcgccagcgccgccttgccggtggcggtatcggcgctgcggtagaggatttgccgctgcaggttggtgacatgcagctggtcgtcgtcggccagcagcagcgtgccgacgccggcggcggccagatacagcgaagccggggaaccgagcccgcccaaaccgacgatcagcaccgtggcgcgcttgagtttctcctggccttccgggccgacgtcctccagcagcagctggcggctgtagcgaaggaattcctgatcgttaagcatctccggcgcctgggtgatggcgctgaccaccgccacgctgccgacgccgcacgccagcaccgccggtacgcgatcgatgctgatcccgccgatcgccaccgtcgggtaatccgccaggccggcgatatggcgtttcaactccgccagcccctgcggcgccgaaggcatgtctttggtctgggtagggaagatgtgccccagcgcgatgtaggaaggtttcaccgccagcgcgcgtgccagctcggcgtcgtcatgggtggacacgcccagccgcagcccggcgcggtgaatggccgccagatcggtagtatcgagatcctcctggcccagatgcacgccgtaagcgccgtgcttgatcgccagccgccagtagtcgttgatgaacagccgcgcctgataacgctggcccagcgcgatggcggcggcgatatccgcttcgacctgctcgtcaggcaggtccttgatgcgcagctggatggtggtgacgccggcctccagcaggcgagcgatccattccacgctgtcgacgaccggggttgcggcgctgtgatacagctcgctgccgcgggcgcgaaactcgtccaagcgattttggtcagctccatgccgatctcacgatttcacggaaatgctggaaattttcgatggtgcgagcagaatttggccgcacatcgagccgccgcgcgacacgatgccggtcaggcgtttggcggtcattggcacgtagcgcagcagcacgccggcgtggatggtgaagtagtcgactccttgctccgcctgttccagcagcgtatcgcggaacatctcccaggtgaggttttccgccacgccgttgaccttctccagcgcctggtagatcggcacggtgccgatgggcaccgggctgttgcgcaggatccactcgcgggtttcgtgaatatagcggccggtagagagatccatcacggtgtccgcgccccagcgggtggaccacaccagcttctccacctcttcttcgatcgacgacgtgaccgccgagttgccgatattggcgttcaccttcaccaggaaattgcggccgatgatcatcggctccgcctccgggtgattgatgttggcgggaatgatggcgcggccggcggccacttcatggcgcacgaactccggcgtgatgttgtccggcaggttggcgccccagctttggcccgggtgctggtggcgcagcacctcgccgcgaatgcgctcgcgccccatgttttcacggatggcgatgaactccatctccggggtgacgatgccggcgcgggcatagtgcagctgggtcacgcgcctgcccggcagcgccttgcgcggcagcggcagatgttcgaagcgcagatgatccagcccctcgtccgccagccgctgttgggtgaagccggagctggcgccgctgagggtggcggtatcgccgcgcgcgtcgatccagccggcgcgcagtttggcgagaccggcgtgcacgtcgagcttggcctgcggatcgccgtaggggccggcggtgtcatacaccgggatcgcctcgttgggttcatactgcgggttgtctttgctgccgccgagcagggtcgggctgagctgaatttcgcgcatcggcacctggatatcgctgcgcgagccttgcagatagatacggcgtga

SEQ ID NO: 6169 - DNA, 171 bp, Glycine max
  Peptide Sequence Number=SeqID_97854
atgcagattcagaaggagacatatttattctggatgatagctgagctggcgaaatttgagagctccctaagtcatcatcggcttcatcagatgacatccgctttttgggtgttaaaggcaacctcacaacgggatcatggtcaactgtggcagatagaaattgttgcataa

SEQ ID NO: 6170 - DNA, 394 bp, Glycine max
  Peptide Sequence Number=SeqID_97855
catagcactcaaggcctcctcctcaatgcaagaagaagaagaagaagaagaagaatctgatgatgaagaggacttctcactctttgtgaagaagtttcataaattcgtcataaatagaagaatggagagaagccataacttcaacaatgggaagaaatcccaagaagtttctcctacacttaaatgctataagtgtaatcaacctggtcacataaaggcaaactgcccctcaaatgagtcatggcccgagaagaatgagaagaaaagatataaagaaagaagatccaagaaggtgtatattccttgggatgacaatgactcatccgatggttcagagaaggagatcaaccttctatccaaggactatgaaagtgatgagaacatttctcaagaa

SEQ ID NO: 6171 - DNA, 543 bp, Glycine max
  Peptide Sequence Number=SeqID_97856
atgccagagaagactagctccatgaagtgctttaaatgtcttggaagaggacacattacttctcaatgccccaccaagaaaaccatgattatggggggccaagacatttatagtagccaagatgaggctactacttcaccttcctctagtaaaagtgaagaagcaaaatgggaagaatctagtgaagagatctacccccaagaagaaggacaacctttaatggttaaggaggagtgtaaggaggtaagtgtcttctccaagagatttcaaagctcatttagagcacaaaatttcatgctcttctctccctctcccttcattcatctccttcttcctccaagctctcatccatggcctcctatggtgtggtgtctcctctctctcttcctttctccattccactgccattcatcttccaagaagcaaaggaatctattgatgaagaagatcctaggcctacaagttccaatggagcttacatcacgaagtagggttgaaaagagggaagttcgattacgtttcctccacaagtgccaatgctaa

SEQ ID NO: 6172 - DNA, 666 bp, Glycine max
  Peptide Sequence Number=SeqID_97857
atggtcttgaaagaagagttagttgcttgctcaaggtccaaaggaaacttgtctcagcgtttatgcgagacagagaccaacatgttagccatcgtcagcaagtaccaagaagaactaaatctagccatagcccacgagcataaagtggtggacgagtatgccctagtgtatgcggaaaaggaggctagaggaagggtgatcaaatcattacatcaagaggcaacaatgtggatggaccaatctgctcttaccttgaacgggagtcaagaacttccccgattgctagccaaggccaaagtgatggcagacacctactctgcccccgaggagatccacgaacttctcagctattatcggtgcgaatcaagtcactcccgcattttatctctagcatgcattcattttttacctactcctcacgtttggaatgagacaacttataacgtggccaccactgctgctgttagttcggctgccgaagcagacccaactctcccagccaccgcgcaccatcctctcccaaacgtggtaagacgagaaagaagcacactggggcacatcagcaacccccatttgggatacaaccgagtggcttacccttatggattaccacctaattacacaccaccagtcatgtgtgatgacgcgggtcatgtcccttcctga

SEQ ID NO: 6173 - DNA, 522 bp, Glycine max
  Peptide Sequence Number=SeqID_97858
atggcacaacctccacctcgtgagaggactctaagggaaatggctgcacctgatttcacctacgaaagcttgtgcatccaataccctgatgaggatgtcccatatgttcttaaaactggactgattcatttgcttcaaagtttcatggccttgcagtttagcgccagaaatgatgccatagtcattagaggagtgcatgaggtagctacaaacccatctacatcatctgaaactaagaagcttgaaggaaaactggatgcgttggtcaacttggtaatccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaaccctaa

SEQ ID NO: 6174 - DNA, 201 bp, Glycine max
  Peptide Sequence Number=SeqID_97859
atgaagatgctcttgataccacatgatgtagctccatgtggagcttgtaggccttggatcttcttcatcaatggagtcctttgcttcttgaagatgaatgacagcggaatggagaaggaagatgattggagatgccacttcaagaagaagatgagtcaagaagaagctcaccaccataggaagctatggataagagcttga

SEQ ID NO: 6175 - DNA, 174 bp, Glycine max
  Peptide Sequence Number=SeqID_97860
atggagaataagatgaagaacaagccttggatcatcttcatcaatggagtcctttgcttcttgaagatgaatgatagcggaatggagaaggaagatgattggagatgccacttcaagaagaagatgagtcaagaagaagctcaccaccataggaagctatggataagagcttga

SEQ ID NO: 6176 - DNA, 543 bp, Glycine max
  Peptide Sequence Number=SeqID_97861
gactcaaagtcctcgcttttatctttcacaagactcaaagtcctcgcctttagtctttcacaggactcaaagtcctcgcttttatctttcataggactcacgtcctcacctctatctttcataggactcaaaatcctctgtctttatgctttcataggactcaaagttctctatgaagaagaaaatgaagaagaagattcagatgatgaagaagacttctcactctttgtgaagaagtttcaaaaatttgttaagaaaagaagaatcgagaggcgtcagaactttaacaatggaagaagatcacaagaagactctcaagttcttagatgctacaaatgcaaccaacttggtcacatcaaagctaattgtccttcaaatgaagaatggcttgagaaaagtgataagaaaaggtatgatgaaagaaggaccaagaaggcctacattgcatgggatgacaatgattcatccgatggttcagaaaaagagatcaaccttcaaaccaaggattatgagagtgatgagaacatttctcaagaagattaa

SEQ ID NO: 6177 - DNA, 312 bp, Glycine max
  Peptide Sequence Number=SeqID_97862
atggatgttcttcagatagccaaccttagtgccacgcagctaggtaacaatccaaggtttccacccatcactatgaataatgatgcaagctccattggagcttgtaggcctaggatcttcttcatcaatggattcctttgcttcttggaagatgaatggcagcggaatggagaaaggaagagagagaggagacgccacttcaatgagaagatgagtctagaagaagctcaccaccataggaggccatggataagagcttggaggaagaaggagatgaatgaagggagagggagagaagagcacgaaaattag

SEQ ID NO: 6178 - DNA, 981 bp, Glycine max
  Peptide Sequence Number=SeqID_97863
atgctggggtcgcttacagttctcaccttagcggtcgccgtctggcggccctatgtttaccacccgagttctgcccctatcatcaaaaccatagagcttgagaagagcgaaatccgttctttgctgcctgaagccagtgaaccgattgaccaggcggcccaggaagatgaagccatcccgcaggatgagctggacgataaaaccgaaaacgaagcgggtatccacgaatacgttgtttcaaccggggacacgctcagcagcgtgctgaaccagtacggcatcgacatgggcaatatcagccagctggcggctgctgataaagatcttcgcaacctgaaaatcgggcaacagctctcctggacgttaaccgcggacggggatttgcaacgcctgacctgggaaatgtcccgccgtgaaacccgcacctacgatcgcactgcaaacggtttcaagatgaccagcgaagtgcagaagggcgactgggttaacagcgtactgaaaggtaccgtgggcgcgagctttgtctccagcgcgcgcgatgcaggattgaccagcgctgaaatcagctcggtgattaaagccatgcagtggcaaatggatttccgcaaactgaagaagggcgatgagttttccgtcctgatgtcccgcgaaatgctggatggcaagcgcgaacaaagccagctgctgggggtacgtctgcgctccgagggcaaagattactacgcgatccgtgccgaagacggtaagttctatgaccgcaccggtacgggacttgcgaaaggtttcctgcgcttcccgacagccaaacagttccgcgtctcctctaactttaacccgcgtcgcctgaacccggtcaccggacgcgtcgcgccgcaccgtggtgttgacttcgctatgccgcagggcacgccggtactggcggtaggggatggtgaagtggtggtcgccaaacgtagcggtgcagccggttattatgtcgcg

SEQ ID NO: 6179 - DNA, 341 bp, Glycine max
  Peptide Sequence Number=SeqID_97864
atgcaccgcctccacctcctcaggctgactcagttgggtcgtttgacagggagcggtatttacggaatttggttcgccagcaggcggccaaccacagggcgcacgtgcagacccatgactctctatatcagcttagcctcagcctgcagagccagggttttgcttcttttccatgccctacttcggatcagttcagggcagaggtcgcatggcccagagattggcctaaggcccaggctgcagaggcatccgcagaggctcccggcgagccagatgaggcccgcgaggatgaggagatgtcagatttgctcggcttcttgggagggagtggagccacatga

SEQ ID NO: 6180 - DNA, 114 bp, Glycine max
  Peptide Sequence Number=SeqID_97865
atgccattttttcaggctcctgagctgcatgtagaaatccataagcagggatttggtcagcagcagcaggcggcagcaacagctggatcttctacttctgcttcgggtacaaag

SEQ ID NO: 6181 - DNA, 255 bp, Glycine max
  Peptide Sequence Number=SeqID_97866
atgtatagaaaatacaatagcggacattggtcgttaatagccccgattgatatttttctattgacattgtggaatttcatttcaaaacgctggccgataatattttttacgtcgatgttggccagaaaagatgatcgatccaggtctaaacaagaagaatcaccggatgacgccgatcgaacatttcctaatagacatcgtcgaaatattatctgggaatgtatagaaaaaacaatagcggacattggtcgttaa

SEQ ID NO: 6182 - DNA, 219 bp, Glycine max
  Peptide Sequence Number=SeqID_97867
atgtcaatcaggacttgtaggaaagcttgggcagagcaaatgaggaaaatgagtgacaaatgtgaaagaaaagagccatttatagggacttgtaggatacaatttgagtggaattggatgcataaaaagctgttaaattgtgcagcaaaattgccaaattatgcaaaaaatggttgtgcagtgctagtcatgggaaaggtagtacatatcgtgttctag

SEQ ID NO: 6183 - DNA, 381 bp, Glycine max
  Peptide Sequence Number=SeqID_97868
atgggtaaagtagaggaggcgcaagagcagatgaaggccaacatggaggccatgaaagagcaattggccacaatgatggaggccatgatgagcatgaagaagataatggaagccagtgcggttgcaattgccgctaccagggctgttgctaaggcaaagatttgggaagtagggacgaccctcatgataggcaaattcaaaacaagcacgccttcccgccatatggcctgcctcccaactgtacaccacccaatgtggcatacactcccaataaggatgtcaataactccgctcccatactcattgaaagctgacaacctcatcatgcaaatgtctcttaaaccatgggggagacacatgaaatgccccaccacaatctag

SEQ ID NO: 6184 - DNA, 60 bp, Glycine max
  Peptide Sequence Number=SeqID_97869
tggttttctgatggatcaccgttagacgtggaggccatcacaacagttcgacagatatag

SEQ ID NO: 6185 - DNA, 465 bp, Glycine max
  Peptide Sequence Number=SeqID_97870
atggcatccaggaaaaggaaatgcaccgctttcaggcctcaagctcagatccttccagaaaggaatattaagatttatcataccgagtttgacgagtttaaggcaaagttggagaggcgtaacttggacaaacgtctcgccaatctccaagatggaagcatagatgtagctgtggtgaaggagttttattctaacttatacaacccggaagaccagagccctaagcaagtgaaggtaagaggaaatttaatcaagattgatgctgacagcctgaataccttcttagagaccccaatagttttggaggagggtgagacactacctacctattccagatttacgatgatgaggattgatcctcaagagtttgctgcccggctctacatccctagtaggggttttgttctgaatgcagagggccacccgtggaagcttctgaggaaagatctcaccactcttgcatag

SEQ ID NO: 6186 - DNA, 186 bp, Glycine max
  Peptide Sequence Number=SeqID_97871
gacatcgtgtccgacatcgtggatcctgcacaatctgttaaagatataacagctttatgcgtccagtattttcgggccagatgtcaggacattgtatccgacatcgtggatcctgcagcttcaatgcttttagcaattccagtattttcgagcaggatgtcctggacattgtatccgacatcgtga

SEQ ID NO: 6187 - DNA, 576 bp, Glycine max
  Peptide Sequence Number=SeqID_97872
atggatcgagttcaacatcaggttttcagcaaggtatatgggaagatttgggatctggcgatgaaagaagtgtccgctgaagccatcgcatctctcacccaatactatgaccaatcactcagatgcttcacttttgaggactttcagttagcaccaaccatagaggagttcaaagggatcttaggatgcccgataggaggaaggaaaccatgccttttttctgggtactatccttctatggtgagaacaataggagtagtcaagatcttggaacaaaaattagatcgagtgaagcaaagtaggaatggggtagggggaataccaaggaaatgcttggaggagaaggtggaaactctggccagccaaggagagtgggcatcattcatcggcgtattagcactgctagtgtttaggacagtactattttcgaatgtagacgggctggtggatctagcaacaatcgatgcttttcttgcttatcaccacgacaaagaaagcccgatcattgctgttttagcaaatgcgtatgatacattcgacttaagatgcgaaaagagcagtgtgaggattgtttga

SEQ ID NO: 6188 - DNA, 671 bp, Glycine max
  Peptide Sequence Number=SeqID_97873
ctatgccctgcttggcccccggcacggtggaggtcccgtagcgcgtcatgagcaccgggctaagaggcggttgagcaactcaagcgaaccgccctacccgttggcgggtcctggagtgcctgtcaagggcgctagcgcataccccgggaacgcagcagcgagggacaacccgcccatacacagccagcggggaggatggcactactggcaaagaccgtccggcgaaaacgccgcaggcgcgaagcgtggtaggccggtgccgggggagcatagcataggtaggaaagggagccaggacggtggaagagccagggggggccgggatttgcgaatgaatgctgggctgggccacctcgaatggcgtgagccgcatgcgggagacccgcacgtacgggcgatcgcggagtcactgaatgaagtcctccgtttctttcggaggtggagccaacgatccgctaagactaacgtatctacaactccatccccgagcggcagtcaaacggaggccgagtgcaccggaaaagaacgggaactgggtcgatctattctatggcgaagcatccgaagcataactgcacactcacacgatctttgccgagagataggagcattcggtggaaccggtgaactacacttgcttctggatagatgtgtgggacagagggctcgtg

SEQ ID NO: 6189 - DNA, 189 bp, Glycine max
  Peptide Sequence Number=SeqID_97874
atgaccattactaaaagcaaaaagatcgttgaaagtatcaagagagaattggaacgatgtgaagcagaaaagaagacattggaaaaaaggagactgtgtgcaaggaatcactggccagagcacaggatgagtctaccaagatatctgaaactatcacaaatgctaaatctaaagcttcttccatggtaa

SEQ ID NO: 6190 - DNA, 324 bp, Glycine max
  Peptide Sequence Number=SeqID_97875
atggagtggtttttccagatatctcacccattcatgataccgacccaggcaggtgaccagcccagacatgcacttgccccagaccatgaggactacatgcagccggccatcccacaggttccagtggcatttgacccccctcgacatgcagtggatgattacgaaggctatgagacaatcgcagaaaggttggagtgtgtactcaaccttaggatggtcactgtagggacagagttacatgatatcatgcaagattgcctgaggatcgccaggggggtgccagcgcagatggaagtgttagggctcgacaaagacggcgcatag

SEQ ID NO: 6191 - DNA, 354 bp, Glycine max
  Peptide Sequence Number=SeqID_97876
atggagaaatctgaaaagaaaaattttagtgaaaagaagatgaagaaggcctacatcacatgggatgacaatgatatggaatcatctgaggattcagaaaatgaagagataaacctgtgtctaatggctaaaatttatgaaagcgatgaagaggtaacatcttcaaataacaacttatccatttcttttgatgaattacaagatgcatttgctgatttgcatagagaatcaatcaaacttgcaaacaagtatggaaaagaaattaaagatttgaaaaactcacttgctaaattctctattggtaaaaataacctagatgtcattttaggaaaacaaagatgtgtctttgataag

SEQ ID NO: 6192 - DNA, 121 bp, Glycine max
  Peptide Sequence Number=SeqID_97877
atgtcgactgtgatgagaatcatgaaactggccaaatacaggctaaaggcccaagtggagaaggacgaaggcccaagtggagaaggacaaagcccccaagtggagaaggatgaaggctcaa

SEQ ID NO: 6193 - DNA, 174 bp, Glycine max
  Peptide Sequence Number=SeqID_97878
atgggtacaccaaatgaagatacatggcctggagtgacatcattgttggattttaaatcaacttttcccaaatggcagcctaagaacttgaaaactgtggttccaaatcttgagccagctggtcttgatcttctttgtaataaaaaaattgatgataaaaatgaatttggctag

SEQ ID NO: 6194 - DNA, 681 bp, Glycine max
  Peptide Sequence Number=SeqID_97879
atggtggtttgcaagccggcgcacctcttcctggatgagctcgatgtggcgtatgacgagcaagaggactacattgtgataaagcacacggctttgttcacgtccaccatcatgagcaagattctagcgaggcccaacgtgaagcgcttcaacgcggtggtggcgaaggacttgatcatgaaggaagggagggttgtgaccaacttggctctggtttcgatgaaccatgacacgcagtcttgcatggaccccaacgtgatggaggctaaggttgttgtgagctcttgtgggcacgatggacctttaagcgccactggggttaagaggttgaagagtattggcatgattgataacgttcctggaatgaaggctttggataccaagagtattggcatggttgttgtgaggctcactagggagattgtgctcggcatgattgtcactggcatggaggttgcagaaattggtggctccccaaggatgggtccctacttaagtatgatgtttaaacttactttcaaattgatggaacgtgtggagttgaaggcgttggggaggaacaatgcaattgatggaacatgtggagttggaacggaagaaccccatcttattttcgcttctacagttgagttccatgatggacttgagagcatgatgttggatcaagtggcctcggaataa

SEQ ID NO: 6195 - DNA, 255 bp, Glycine max
  Peptide Sequence Number=SeqID_97880
atgactcagctcaacatcgacctatcattaggatggaggatttcatggcacagtgaggctttcgcagcccaagagcctcagttagagccagagcctcagccggaggtagttctagaggccactccagtggctactccacaggcttcaccagttacttcacctattttggaggtggatggcgctgctgatgcggatacaaagagcacctgggacccatggcttgttacagctcaggatattcctcagccagcctag

SEQ ID NO: 6196 - DNA, 597 bp, Glycine max
  Peptide Sequence Number=SeqID_97881
acttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgaccatgaagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 6197 - DNA, 324 bp, Glycine max
  Peptide Sequence Number=SeqID_97882
ttcctttggacttagaaatagaagctacactaagaaggaacagggctgagaggagaaggaaactgttgcaagacagaacagttgcgtccattcttgaggaggagactcatttttctgattcattatcacctgattcaccatcatcaagggaatccgctaatcaacattctgaaactgctaccatggcagatgagcatgatcagaggactacccttgaggactattcaagtggcactgtaccacaaggtttcactagcattgcacgtccaaaagtgcaagcgcacaacattacctacccacattctttgatccatctgataccag

SEQ ID NO: 6198 - DNA, 339 bp, Glycine max
  Peptide Sequence Number=SeqID_97883
atggacgaggctaaagcagacaaactcaaccgcagagaacaatccaacggagagtcaaccattttttcaatccagaaatggacgccggagatgaagactgaattcaggctgatatggattcatatctggggtgttcccctggagatatgggacacaaagcactttcagaccttgctttcgacatttggagagattgttgacctcgacgaggagacagcggaccgttcgaggcttgacgtcgcgcggattctgattcgcacaaaggagaaaccaatcttctccaaatcgatgatggctatggttaatgacaatgagcatcacttgtttctgagagaggag

SEQ ID NO: 6199 - DNA, 85 bp, Glycine max
  Peptide Sequence Number=SeqID_97884
atggccttcctaaaagaatatgtccttgcccccatgggaactatatcacaatcaacttcatccttatatgtgccaatggagaaag

SEQ ID NO: 6200 - DNA, 123 bp, Glycine max
  Peptide Sequence Number=SeqID_97885
atggatcaaggattcaggaggagcaagagtaagcctacactttacatcaaggctcaagatgatcttatctacatgggaaacaatactaagatgatgatggagtttaaagaagacatgatgtag

SEQ ID NO: 6201 - DNA, 647 bp, Glycine max
  Peptide Sequence Number=SeqID_97886
agttcgacgagttcaagaaggaactcgagagaagacattgggatgagaacctgactgatttttctgatagtagcatagacatcactattgtgaaggagttttacgccaacctttatgatcccgaggataaatcacctaagcaggtgagggtgagaggtcacttagtgaaatttgatgaagatactcttaatacatttctgaagacccttgtagtgcaggaggagggggagaatttgtgtacttattccagatttgcactcctaaggtcggatcctcaggagttggctgctaagctctgtatcccagggaggggattcgagcttaatgttaatgggaagcctttgaagatactgaggaagaacatgaccactctagctcagacatggagcattctctccttttctaacctcattcctacctcccacacatctgatgtcaccttggacagagccaagttgatttatgtgacatttagagggccaaggaaggccaggggtaagagatcagaggtccccactacttcagcaccacctgagacaccagctcattcttcttccacaactccagtacctcccattcagactctagttattcatcctacatctacacagataccacttctagctcctttatctacaagaccataa

SEQ ID NO: 6202 - DNA, 258 bp, Glycine max
  Peptide Sequence Number=SeqID_97887
atgaaacataccccctccccccctcacacttattcccaaaacaattccaaagctccaaaattccttaagggtaaggtgaaatcatggctcatttggctagaggcttataagaacaaaatgcctaaatcatctcccaacatgcatgtgaagcaagaagtatcaacaagagtcaagccaaggatattgtgcaagcaatcaatgaggcaaaacacaccgaataaaatagatgatgatggctcaaattctcaccaagggtaa

SEQ ID NO: 6203 - DNA, 1146 bp, Glycine max
  Peptide Sequence Number=SeqID_97888
atggcattacaaattcatgaaggtcagaactttggatttggacgcctcttgttagcagtactatacgaatcgcttggtgaggcatgcgatgatctgaagaaatcaaaggatgggtcttccttcttagtatctgggcctatgtggcttctccagttgtggcttaatgccactttcgaacaagaaatgggattaataatcccacaagattatgctgaagaagttgcaaatcgctcgatcgaaggccagagagcacttcgattaacacccaagaccttcgatcaaaacccacaaaagctgttcctaaagtacatgaggatttttctgagctttgacaagtttcttccccaacatgctccattcattagtcgagaggtcggcccggcctggttcactgactattttcctgctgtcgatccggacaatgaagaagaagtgaacgaaatatggtcattttacttgaatccacagatcctgtcttgtcgtacagatgaaaactataacctgcatccttttgagttcaaccattcccacttctgcaccatagggtttgttacctggtgggagaaatattattcgggccgttcagttggagacactactatcatgatctccagacttgagagtggttttacacaaccaacggtcgagaatatccgctcaaaccttcaagctcgaggcaaaacaatcatgacaaagaaaattgctgaaacgtctcaagctgatgtgagacccaagaaacccactggggtgaagatccaagaatggaaacaagaagaaaaggaagaagaggaaagacctctcataagaaaaagaaaatcacctgcgacttcgaccaaatctgctgatcaaacagaggcaggcaattcccaggctcaaatgcctaagaagaaaaagaaagtgaagcaggtcgagcctgaaccttctgtgactgtcgagggtggtgagccagccaggaagaaaaagaaaaagaccaagtcttcaaaagaacaaggtgacaatcaacctgttgacgtccaaccaccttcgactgatgttgacggcactgaagcagaggctactccctctattgctgagaagggcaaccctgtcgagcaaccggacttaccacaagaacaacctactgtcgaggtatcattcttaatgtga

SEQ ID NO: 6204 - DNA, 55 bp, Glycine max
  Peptide Sequence Number=SeqID_97889
gcttgcaaaatcattgttgtttggtactcgaatgggcaccggagtcgaagtttag

SEQ ID NO: 6205 - DNA, 570 bp, Glycine max
  Peptide Sequence Number=SeqID_97890
atgccgatctccctctgcgaaagtatcgattggtctgtgccatcccgatataggggtcgcgctcacaagacacacagtggacctggaggagcccaacagggccctgcggtttccagttcgggttacgggcctctgtcagtcctatatgtccttactttcagaggactacatgtcctcactttcagaggactacaggtcctcaccttcagaggactacatgtcctcactttcagaggactacacgtcctcaccttcagaggactacacgtcctcactttcagaggactacatgtcctcacctttggagggctacacgtcctcacctttagaggattgcatgtcctcactttcagaggacttcacgtcctcaccttcagaggactacacgtcctcaacttcagagggttgcacgcccttgccttcagaggactagacgtcctcgccttcagaggactacacgtcctccactttagaggactacatgtcctcgtcttcagaggcctacgcgctctcaccttcagtgggctccacatccgcaccttaagagaatttaaggtcctctacccttaa

SEQ ID NO: 6206 - DNA, 1029 bp, Glycine max
  Peptide Sequence Number=SeqID_97891
gtacaacaaaatgtttctgtagaagaaataccctcatgtgctcgaacctctcctgctcctgagacggatgcagtgaatgttgaggaacagggtgaaggtcaaggtattggacccagcagtcctcagggatcgagtcagagaagttcatctgaagaacactttcccgatgaagaggccatacaagaggctgaagctggaggttcagacattttcccagtgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgaaattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaacgtgaagtcgagcgtctcaccaaagaggcgaaagaaggatcttctgagatcaaagcctgtgatgataatatctcctcctgggaggcaactattacaaatttgctgtctcaggtcgatgatctaaggcagaaaattgtaacagagcaggctaaacgcaaagaactccaggagaaggccgctgattcgattcagaagctggttgccgaaaaagggagggaaggcctgaaggcctttagtgcatctcaagcggtagcagatgaggcgagagctatggagagtgctgaccaggttttaagcaaagagatggccaccttgaagaagctatatgaggatttgatcatgacttag

SEQ ID NO: 6207 - DNA, 1677 bp, Glycine max
  Peptide Sequence Number=SeqID_97892
atggcactgaatctagatgatatcatgcgcatcgctcacctcgcccgtatcgaggcagttgataccacaggtattgaaccgatgtcgcactcacaagatgtgacacagcgtctgcgtgaagacgtggtcaccgccaccaaccagcgtgagctatttcaatccattgctccggcaacacaggatgataccctagccatgatcaacagcagtcttaaacagctaggccaacagttggccagcaagcaagtttccagcgtcgagctgacgcaagcctatttgcagcgcatggcgcagctcaatcctagcatcaatgcctacgtcaccatagacgaagccaaaacattggcacaggccaaagccgcggatgcgcgtatcgcagccggtgatttcggtccattgaccgggatcccgctggcacagaaagatattttctgtgccaagggttggcgcacgacatgtagctcgaaaatgctggagacatttatttctccgtacgatgcgcatgtgatcagccagtttgatgctgccggtgcggtcaatctgggcaagaccaacatggacgaatttgccatgggctcgtctaacgaaaccagttacttcggtggcgtgaaaaacccatgggatgttgaccgtgtaccaggcggtagttccggtggttcggcagccgcagtcgctgcgcgcttatgtgcggcagcgacggggaccgataccggcggatcaattcgtcagcccgcttccttgtgtggctttaccggtttgaagccgacgtatggcctggtgtcgcgttacggcatgattgcctttgcctccagcctggaccaggccggcccaatggctaaatcggcagaggactgtgccctgatgatgaacgtcatggccggctttgatgagcgtgattccaccagcgtcaaccgtgaaaaggaagattacacccgcggcctggacaagatgaaaggcgaacagccgctcaaaggtttacgtatcggcctgcctaaagagtactttgccgatggcctgaatgctgacgtggcaaaagtcattgaaaccgctattgccgaatacaaaaaactgggtgcagaaattgttgaagtcagtttgcctaataacaatctgtcgattccagtgtattacgtgctggctccggcagaggcttccagcaatctgtcacgctatgatggtgtgcgttacggtcaccgtgcagctgaatataacgacctcatggaaatgtacatgaagtcacgcgccgaaggctttggtgctgaggtgaagcgacgtatcctgattggtacctatgtgctgagcgcgggttactacgatgcttattacctcaaggcgcagaaaatccgtcgcctgattgcgcaggactttgtcgaagcgttcaagcattgtgatgtcattatggggcctgctgcgccttcgccagcctttaaagctggggagaagactagtgatccggtcgccatgtacctggaagatttgtacaccatcgccgtcaatttggcggggttgccaggcatgagtattcctgccggttttgccaccagtagcgaaggtaaagccttgccggtcggtttgcagattattggtaattattttgatgaggcgcgaatgctggacattggccacgcctatcagcaagtgacagactggcacacacgtatgccggagggaatttaa

SEQ ID NO: 6208 - DNA, 180 bp, Glycine max
  Peptide Sequence Number=SeqID_97893
gtcaataaagcggagatgcttctacttctgcctctgttggcatcatccaaagagaaagactcagtcttagtggttgccaatatagaagtgaggggaggcttatgcgacattgaaaaatacctgctttacgcgcttggttacccttaccctgagctttcagttgctgtggatccagcataa

SEQ ID NO: 6209 - DNA, 482 bp, Glycine max
  Peptide Sequence Number=SeqID_97894
cgaccgcaacgccaatctccccctgcaaaagtatcagttgggatcgcacccacaagacacccagtggacccggaaaagtccaacagggccctggggtttccagctctggttacgggcctctatcagtcctacagggtgcccgtacccccccggcaaggtcacgtcatcatagggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctagagttcacctcagctcatccacaaaaaggttagagcgttgcttacgacccatggccgaccaatag

SEQ ID NO: 6210 - DNA, 270 bp, Glycine max
  Peptide Sequence Number=SeqID_97895
atgatagaagcacgtcaaaagggggtacggaaaaaaaatgggggagatgcttgccacccagctcgcccaagcgagttaggttgcttcctccagaagcaaccgccttccggaggaattttctggaaggcccaaattgtgctacaaatgctttcttttgacttttggcatgtcatggaacttcacgaattgcctaacgatgggtgccaaatacctcaaagtagtcaaacgagggtcgcatcccaacaacggatgctccccggacgaaattag

SEQ ID NO: 6211 - DNA, 1092 bp, Glycine max
  Peptide Sequence Number=SeqID_97896
atgcacaagggttcttcgagtagaagccaacgacactccgaggctcaagatgctccaattcctttctccatttcctcctcctcattgttctcattggaagaacaatgtacacagtacacaaaactcttctcctctcattctatcattgaccctaagttcatagatatggatttcttttctgaagagagtttcgaatgcattcaagcatttcataactcaaatctcattccctttatgtctttaaaactgcctgtgtattctgaattggtaaaagccttttattctaaccttgaaattcaagaaagtaccttgatttttgaggtctatgggataaagatggtcattgaccaatccctcttctatgatttgacccaattgtctagtgatggtgtaccatttgaaggtgcactggatgatgattggaagtttgatttttttgtgcatgatgcccgtcggttggtttgcacgaaccaagcggatatgaccagaaggctgcttgccagttcattggctcttgaaagtcgcatcctccattatctaattgtccgtatcttactccccagatcttcaaaccttgcacaggtttctgaagaagatctaatagtcatgtgggcctttcataccgaccgacaaattgattgggcacacgtagtctggtatcgcatgcataagggattgcgattaaatgctcctttgccctatcctcacttagttaccttgttccttcaacattttaacatccctcttgattttgaaccatatgttccaatcaagagatctttcttgatcggtgctgctgtggttgcctcctttggttaccgcaaagagcgtgatggctcttgggtaaaaaagggtgctcaaccaaatgatgatgaaggatacttaccggttgaaggggactcttctctccttaagagtattttggacaggtttgatggacttcaaacctatgttggtgagaggtttgactccttggaacgtcaagtggacacacgattcgaggagatgaacttaaggattgcaaaggttgaagaagatgtcaccatcatttgcgactgctttgatttacctccactaccaccatcagtttag

SEQ ID NO: 6212 - DNA, 288 bp, Glycine max
  Peptide Sequence Number=SeqID_97897
atgttaagcactgatgagtgtggcagcggtgggaacttgggcgatggtgggagtatgcacgacgatgtgagtgtgcagggagagacaaatttcaacgatgttcacgcattcaaccagcaacctagctgtcataccctaatttcgtcaagggaccatccgttgttgggatgcgaccctcgtttgactactttgaggtacttggcacccattgttaggaaattcgtgaagttccgtgacatgccggaagtcaaaagaaagcgttgtagcacattccgtgaagttccgtga

SEQ ID NO: 6213 - DNA, 621 bp, Glycine max
  Peptide Sequence Number=SeqID_97898
atgggatcaagtcaaatgccttcacttaaaaagaggttctatcaagtcaaggtcaagaacctagggaccaccagtctaaaggagttagggcagttaatgggtcagctccagcggcaagcttttcgcaaaacttacggtaaaatctgggacctagccatggtagaagtctccacagagaccattgcctccctcgcccagtattatgatcagccgttgaggtgcttcacctttggggacttccagctatcacccatggtggaagaatttgaagagatcctaggatgctctctagggggaaggaaccctacctcgtctcaggtcctctttccgaatgtgaatgggtcagtggacctagcagcgatcgacgcttttctcgcctatcataaccacaaggaaagcccggttgtcgctatgctagccgacctatatgacaccttcgaccgaagattttcgcacctttttcgccaagaggtgaggcatgcttgcccgctagaaagccaccgttcatgcacagagaaaggaggggcaaattgggaccaactcttagcaagcaaagaaggagcatctgtcaactggttccctcgatggaaggaaggaagaaccggagttcttatttcatga

SEQ ID NO: 6214 - DNA, 139 bp, Glycine max
  Peptide Sequence Number=SeqID_97899
ctctgattacgagcctcctgtcaattttacggagtgcctgtcacccccaacaaggtcattaggccccgcattaaccaggcttcatcaagaagtactgcgcccccaggcaggcgcagggcaagacaccacagtagcctag

SEQ ID NO: 6215 - DNA, 1108 bp, Glycine max
  Peptide Sequence Number=SeqID_97900
ggtgttgacatattggtcatcagaactttcattcctgcaaacatggggatagcagatggatcaagttcgacatcaagccttcagcaaggcgtatgggaaaatatgggattcggccatggtagaagtgccgttgaagccatcacatccctcactcaatactacgaccaatcactcagatgcttcacttttagggaatttcagttgacaccaaccatagaagagtttgaggagatcttaggatgcccattagggggaaggaagtcgtacctctttgctagattctatcattctatggcaagaatagcaaaagcgatccagatctcggaacaagagctaaaccgagtgaagcaaaataggaatggggtgatagggataccaagaaagcacttggaggagaaggcagaagctttggcaaataaaagggagtggacctcattcattgacatattagcactattggtgtttggaactatactatttctgaatgtagacgggctagtggacctagcagcgatcgacacctatcttgcttatcaccatagcaagcaaagcctggtcatcaccattttggcagatacatatgatacactcgacttgaggtgcgagaagagcagtgcaagaattatctattgtacgcctactctttatgtgtggttggtctcccatgttttcgtcatgaaggagcgtccattagccggctcccccgatggaaagaaggaggggcaagagtgttatgctcgctaccctatgagaggtgcaccatcggaggagatcatcgcgtgtttcgttgcacgaggcttcaatgaagccaatgcgaagatacttcaaagagttcgtaaagcatggaatacagtggaaatgaaagataaggagcttaggggaagtagcaatggcatcatcggtggctatcacaagtggttgaattctaggacgcaagggataacttggctcccaaagctaaaaggcctaagtgggaaagaagctgaagtccctaaggaaagcaaagaagtgcaagctttgaaagcggaactcgaaaaaacaagagtgatcaaggagaagctaaagacggcagtcactagagtcaggaaagattgtgatgagctgagag

SEQ ID NO: 6216 - DNA, 492 bp, Glycine max
  Peptide Sequence Number=SeqID_97901
atggcgcagccgttctcttatcgctatccgctggtggatggtcaggggaactggggggcaccggacgatccgaaatccttcgcggcgatgcgttataccgaatctcgtctctctaaatatgccgaagtgctgctgggcgagctgggtcagggaaccgttgactgggtgccaaacttcgacggtacgatgcaggagccgaagatgctgcctgcgcgtctgccaaacatcctgctgaacggtaccaccggtattgcggtcggtatggcgacagatattccgccccacaacctgcgtgaagtggcgaaagccgccatcaccctgattgagcagcctaaaacgtcgctcgacgagctgctggatatcgttcaggggccggattatccgactgaagcggaaatcatcacctcgcgtgcggaaatccgcaaaatctaccagaacggtcgcggctccgtgcgcatgcgcgcggtgtggaataaagaagacggcgctgtg

SEQ ID NO: 6217 - DNA, 687 bp, Glycine max
  Peptide Sequence Number=SeqID_97902
atgtcctacccaaggatcataactccgacccttctctgccgaagtgtcagctggcaccctctagacccggataagtctaacagggccctggggtttccagcgttgatcacgggcctctgccagtcatttggggttcccatcacacctagtaaggtgatccggccaccgatcacccgagccttcattgagaagtattgcacgcctaggaaggcgcagggtgatgcgccacaggccgtagacgcaccgcgaccacctcatcaggctgatcccgctgggtcattaggcatggagcggtatctacagcacttggttcgccaacaggcggccaaccaccggggcctcagtcagcagggcctgggtttcgctccttttgcatgccctactccagatcagtttagggttgaggtcgaatggcccggagattggcccgaggaccagacggaggaggcacctacaggagttcccgatgatgcagaggacgcccgcatggatgagaagatggcagacttgctcggcttcttgggaggaagcggagccaccgcgcgtcttctcgctcggcagatggactcaagcagtgtgcttagcaggatgagccctcgctcagcgaacacgcacagctcatccttcttccagattctttctcgcgctcagccaaaggagtggtgcgctcagcagatgactcgttaa

SEQ ID NO: 6218 - DNA, 222 bp, Glycine max
  Peptide Sequence Number=SeqID_97903
atgagttgtacaggtttgctgagcgcaccgcttcatctcactaagcgcaacgcttcagttcatccactaagccaaaaatcactaacatgtgctaagcagtccataaagctttgcatgtctagggtttctagagagagaaaggtccaagttctagagagttttgagagattttgctatgtgaagatctgcagagaccaaagcttgaagcaggaaccagtttga

SEQ ID NO: 6219 - DNA, 1032 bp, Glycine max
  Peptide Sequence Number=SeqID_97904
atggattgggaccagctcttggccgggataggaagtagaacaattagttggttcccccgatggaaggaaggaagagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaagttccaagactatacaaagaatccataaggcatgggaaaccccgttaaggaaagatcaagagcttagaggcattcgtaatggcaccattggtgggtaccacgaatggatgaaagtcatatacgaggacgaagaagtccaaactctcaaaagcgagttaggaaaggcaaaacttgccaaggagaagttcaagttggccgctacacacgttcggaaggagtgcgccgggttacgggaagagaatgcaattaccgcaagagcccttgacagagaccaagagggctcgcaaggaagagtatggccggaacaatttcgcggagctctatggggtagcaatagtgaactcaagttgcgaagggaagaaagggaccagtcgcgagcacatagcatggttctgaaagaggagttgattgcttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaatgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 6220 - DNA, 90 bp, Glycine max
  Peptide Sequence Number=SeqID_97905
atggtgacaacaacaaaggtagaatccttggagtgggacttaagcatagcctccttagcgttagtcaactatgcgacaaaggctatctag

SEQ ID NO: 6221 - DNA, 420 bp, Glycine max
  Peptide Sequence Number=SeqID_97906
atgttttccaagaaggagggaatgatgagaatcatgaaactggccaaatacaggctaaaggcccaagtgaagaaggacgaaggcccaagtggagaaggacaaagcccccgagtggagaaggatgaaggcccaagtaatccttgtggcgtctacccagacttatcttccttcaccggaagtggcgtctaccctgacttatcttccttcaccggaagtggcgtctaccctgacttatcttccttcaccggaagtggcgtctaccataacttatcttccttaaccggaagtggcgtctaccctgacttatcttccttcaccggaagtggcgtcatccaaaccttcgtagcctgtatcaaacgatccgctcctactcaggttcacatcagactgtcattttttctgaccaatatcggtgaataa

SEQ ID NO: 6222 - DNA, 288 bp, Glycine max
  Peptide Sequence Number=SeqID_97907
atggccagtagtataatcaacaacatggacagtggagaaatcaccctggaaatcctttcaacaaagattagggtggaccatccacaaggccacagcaacaaaggccaagaagtccaagtgggacagctggctaagcaattggcagatcgactgtcaagcagctttggagctaacatcgagaagaatccgaaagaggagtgcaaggctgttatgaccaggagaagattggcaaacaatgtggatgaggaaaaaactaaggagaaaatggtgaaggatgacaaacaatag

SEQ ID NO: 6223 - DNA, 246 bp, Glycine max
  Peptide Sequence Number=SeqID_97908
atggctccgaaaaagctttccacgaagaggtctagtgttggatcaagtggcctcagaataattaagaagggggcaaagatccacaaggtgatgcaagctccattggagcttgtaggcctaggatcttcttcatcaatggattcctttgcttcttggaagataaatggcagcggaatggagaaggaagagagagaggagacgccacttcaaggagaagataagtctagaagaagctcaccaccatag

SEQ ID NO: 6224 - DNA, 420 bp, Glycine max
  Peptide Sequence Number=SeqID_97909
atggattcaaatgcttgtctaccacacttgctagtgttagcaataacattggtattggttagtcatgcaatgggagattcagctaaagacaaacagaaatgtgcagaatccctgacaggtgttgcaacgtgtctgccatatttgggtgctgacgcgaaagcacccacagcagattgttgcagttgtctcacacaagccatgaagaccaacaagaagtgtgtctgccttattctcaaagacagggatgatcctgaccttggcttaaagattaacatgacaattgctgttggtctcccttctctttgcaaaacacctgataatctctcagtgttctggcacgttcaatttctaattaagccttccttttttcttaaagaacactacactacagtgttatgtttccattttcctatgcaatga

SEQ ID NO: 6225 - DNA, 294 bp, Glycine max
  Peptide Sequence Number=SeqID_97910
atgacaaagttattagttggacatccatatgcaggtcaactgacaaaggacgagaaaattattgttgctgatatgacgaagttcatgcggtttcggtgtcttttcatgagagttgatgcactccccgaggttattgtcaccggcagagatttgtctttgatgaatgcagtgaaaactgtattcccggatgctacgaacttgttgtgtcggttccacattgacaagaatgtgaaggcaaagtgcaaaaccctagttgctcaaaagaatgcatgggattatgtgatggaggcttag

SEQ ID NO: 6226 - DNA, 330 bp, Glycine max
  Peptide Sequence Number=SeqID_97911
atggctcccgaagacctagagcaactgacaaaaaatcagggaccagctggaggaggactcgaactgcctcctaagcctgaggttggtccttctattgcttgtgtcagcacaaagaaaagttatgtcgatccctcggggcaaaactcagacacaagtgacttaaagaaatataggttgtatgtcgatgaaaatcctccctgcctagttgcccttataagagtttatgaggggtcgaacatcgtccacaacatccctttgggaaatgatcaagtcaaggtcggtgttgaggaagtccgagatgtcgacgctcgcgttcctatacctatttaa

SEQ ID NO: 6227 - DNA, 771 bp, Glycine max
  Peptide Sequence Number=SeqID_97912
atgggtaccagcctcgcctttctcgacaatctcggcaccaacttgctgatcgtgtttaaaaccgcgctgattgccgcgggcgccattctgagctgctcgctgctggcgctgtggctgctggatcgccgctggccgtggcggcagcagcatcgccagcagaatctgccgtcgcgctggcacatggtgctggagtcactcaagctgtgtgtggcggtgctggccggtttcctgctgggattaacccaatgggcgccgctgcgtcatgcctccaccctgagcgagatcgcgctggtggtgctgctgttcctggtgggcgtgcagctgcgcggcagcggcatgacgctgcgccagatcaccctgaaccggcgcggcatgacggtagcgctggtatccctgtgcggctcgctgggcggcggcgtgctggcggcgtggctgctcggcgtttcgctgtcaaccggactggcgctggccagcggcttcggctggtattcgctgtccggcattctgatgaccgaagcgtacggcccggtgatcggcagcgccgccttctttaacgatctgctgcgcgagctggctgcggtgttgctgattccggtgctggtcaaccgctaccgcagtatggcactcgggctaagcggtgccacgtcgatggatttcaccctgccgattctgcagcgtgccggcggaatggagattgtgcctgcggccatcgtgcacggttttatcatgaacctgctggcgccgatcctcatcgccctgttttccgcctga

SEQ ID NO: 6228 - DNA, 727 bp, Glycine max
  Peptide Sequence Number=SeqID_97913
atgaggggagcactgacggaagaaagcctgtctcctttccttgtgagagattttggtgcgcaaaatttcaaggttatacaaagagtccataaggcgtgggagagcccgttaaggaaagataaagaacttaggggcattcgtaatggcatcattggtggttatcatgaatggctgaaagttcgtacacgggacgtccggaaagagtgtgtcgggttacgagaagaaaatacagcaaccgcaaaagcccttgaacaagaaaccaagagggctcacaaggaagagcacgaccgtgacaaattccgtggagcattgtggggcagcaacagtgagctcaagcttcgaagggaagagagagaccgatcacgagcacatagcatggtcttgaaagaagagttagccacttgctcaaggtccaaaaggaacttgactcagcgtttgtccgagacagagaccaacatgttagctatcatcaccaagtatcaagaagaactaagccttgccacagcccacgtgcatagggtggcggacgagtatgcccaagtgtacgcagaaaaggaggctagaggaagggtgatcgactcgttacaccaagaggcaaccatgtggatggaccgatttgctcttaccttgaacgggagtcaagaacttccccgattgctagccaaggccaaagcaatggcggacacctactccgcccccgaggagatccatgaacttctcgactatt

SEQ ID NO: 6229 - DNA, 157 bp, Glycine max
  Peptide Sequence Number=SeqID_97914
atggatttgaggcttttagtcctcgcgggcaggatcgccttgggctaccttttgggagtacttaaggatgaacgcaagcggggatggggtcacgaccgaccgatcgttgctcttctctgtgcgaaacaagcagggaatgtcgctgcaaggcagcccc

SEQ ID NO: 6230 - DNA, 327 bp, Glycine max
  Peptide Sequence Number=SeqID_97915
atgaagaaacaacaatggaagagaagcggaagacaaaggagaagaggtgagaggaggcgccatccactagggaataagccatggaagaaggagcttcaccaccaagatgagccttggataacgaagcttggaaggatgcttcaatggaggaaaagaatagagggagagaaagagagaggggggagcacgaaatttgaaggaataaaagagggagagaagtggaactttgaagtatgtctcacaagactctcattcatcaaagttacaacaagtgttacacatgcttctatttatagaataggtagcttccttgagaagctttcttga

SEQ ID NO: 6231 - DNA, 375 bp, Glycine max
  Peptide Sequence Number=SeqID_97916
atgattcacaatgaatctggtgtttatttccaaagttccactccgatacccattcgagtactaaacgataatggttttcaaaccctcaaaaccagaatgcacaatacccttgaactaacagaagatcaatatttggatgaaatttactaccgacaaccattcgcaaatgcaagtagccaatttggctttcaaactatgcaattgaaaaatgatgatgatgttaagacaatgttaatgtgtaatgatcaatactcgtgtgttggcctgattgagttattatgtaccattggtagaacaccgaatggtatattaaacttacttcaagccactatgacccctactcatgatgccctgctatattacaacgagaggtag

SEQ ID NO: 6232 - DNA, 465 bp, Glycine max
  Peptide Sequence Number=SeqID_97917
atgtgggcatggaaacgatgcacgactttggctccaaagaggactcctcccgtgatccaaaataagccactcggacacaggtggttgcgacgtggaaatcagcatattgggaatgatgatctgattgtatttcgtcgcaagttggatatcatgaaacgacatgagtttctgtgggagtcttacacagcaactgttatgtcgtcgttgcctctgatatgtttggttggtagcgtagcatggcgaaaaacaaagatgtttgtcgacccaaacaatgctaacagagctatattggctgaagttgcggagacattacagtatatggtgtcaccgcaagggaggaacacatggaaagtggatgatctcgtgccttatgtggagaagatcacgattttatcagaagagcaagagagaatcactgagccagcggcacatggtccaacatcagagcatcgattcccaccgtag

SEQ ID NO: 6233 - DNA, 366 bp, Glycine max
  Peptide Sequence Number=SeqID_97918
atggagtcaccgcgaacatttaagtggttcggggtaaccttctgggtactgggaaacctgtcggtcttgaccaatcaagatttcttcaccaacgattttcggccagactatcatatccatgtggagatgaattttgagcaagggtgggcttcgattttggcccaacatctcaaggggtccttgaattttgacatgttgaaggaccagatgttgaaggccgatgactctatgaactcggtgcttcaagataacaagaagttggtaggggacaacaagaatctagaggatcgggtgcttgcactgacaatcgaggccaaggggttggagactcatgctgttaatgttgaggccttggttaggtcctag

SEQ ID NO: 6234 - DNA, 783 bp, Glycine max
  Peptide Sequence Number=SeqID_97919
atggcagaagaccgaccaccgatagtaactctagaggactactactctagcttctcaacaccacaatatttcaccaatattgcacgaccgaaagttcaagcgaccaatatttcatatccacattccttcattcagttgattcaaggcaatctcgtccatggtctaccgaataaagatatgtatgctcatctagctacatacagagagatatgtaatacggtgaagatcacaagggttccggaagatgctatctacctcaatttgttttctttttccttggccgatgaagcaaaaggatggcttcatttgtttaagggaaacagtttgagaacttgctctggatcgtttccatggcctactttgaagaacatctactcatggacccctgatgaagctatggagctaatagagaatatggaagctagtgattatgccattcttcgtgatagaccttatgcacctgcgaggaagagtcttcttgagctcaagtctcaagatgcattgttagctaaaaataaactcctacttgcttcatcccctatgatgcaagttagaggatgtaccctatgcggtagagctcgtgagtcaggtatgtgcatagctcaagaagatgcatctaaagaggtgggccaacttactaagcaattggctgaaaaatccactgtgaactttgtggcacacacagagaagaaccccaaggaggaatgcaaggatgtgagtgatgaggaagtggaggatgagaggaaagagaaagaggctgacaatataaagagaaagaattaa

SEQ ID NO: 6235 - DNA, 2484 bp, Glycine max
  Peptide Sequence Number=SeqID_97920
atgcagcaaggtgatccaacggtcctaagcttgaggcctggtggtggtcgtggcggtggaagcaggcttttcgctcactcgtcctcctcttcctctctctccgccgatctccctctctcgcgccctcatgcctctttctctctcaaggaatggaatactggagattcacggtttgagggtcatgagcgtgtgcgatataccagagatcagcttttacagcttaaagaggctgttgaggtccctgatgatattcttaagattaaacaagatatagaagctgaactttttggtgaagatccaagttggggccgtgctgaaagcaatcttcctcatcaattacaaaatcggtattctgagccagataaccgtgattggcgtggtcgttctggacaacctcctgctagtacagatgagagatcttgggaaaacctcagagataaccgagagtttggtaatagacagcaggatgctagtcaggttaatcgccatgaccaacttaattcccagtttgcaagaacacaaatctcttctatgcaagggtacatctattctgtgattatataccgtcaagcaagccatgagaaggccggtcaaggcagagcaaaaggtccagtcacagtggagcaaggtctagttgcggctgagcaatgtctagtggcagcaaaaaagagaagatgtggcaggaagggaggacctactcctacgctagtcaaggctgaggttccgtggtcagccagaaggggaagtctatctgaaaaggatcgtgtattgaagactgtgaaaggaatactcaataagttgactcctgagaaatttgatgtcctgaagggtcagttaatcgattctggcattacatcagctgacatcttaaaggatgtcatttcacttatttttgataaggctgttctagaaccaacattttgccccatgtatgctcatctgtgttctgatctaaatgaaaagctgcctccattcccatctgaagaacctggtgggaaagaaatcacctttaagagagtgctcttgaataattgccaggaggcttttgaaggtgctgaaaatctgagggaggaactaaaaaggatgactgtccctgagcgggagatggagcgtacggacaagggaaggctgctcaagctacgtacccttggaaatatccgtttaattggtgagctattgaagcagaagatggttcctgaaaagattgtccatcacattgttcaggagcttttaggatccccagacagcaaatcttgcccagttgaggaaaatgttgaagccatatgtcagtttttcaatactattggcaagcagcttgatgaaagtcctaaatcacggcgtataaatgatatttactttagccgattgaaagaattaagctcaaacctacaacttgtaccccggcttaggttcatgattcgggatgttatagagttgcgtgctagtaactgggttcctagacgggaagaggtcaaagccaaaaccattactgaaattcattcagaggcagaaaaaaatcttggtttgcggccaggagcaactgcaagtatgagaaattcccgtggcggtgttcaaggaaatgccagctctgggggctttcatattgctcgacctggtgctgggggtttgatgcctggaatgccagggaccaggaagatgcctggatttgataatgacaactgggagatgcctaagactagatctatgccaagaggagattcttcaggagttcaagctgctggatgcagcaactctgctttactttccaagtccacaaccctcaattcaaaactgctacctcaaggtagtggtggtattataagtggaagaaatagtgccctagtacatggaggtggtacattttctacttcctcaacaaacttttgtttaggtcctgaggcagcgcctcaactctcttcacctgctcctgttcctgtatcctctgagaagccacaacctccagctgcaagattgaatactgatgatctttgccgcagaactgtctctcttctagaagaatatttcagtgttcggcttttggaagaggcattacagtgtgtggaggaattaaaatctccttcttaccaccctgaggttgttaaggaagccatataccttgcacttgataaaagtccaccatgtgttgaaactgttgccaatctcattgagtatctgtatattaagaagattcttacccctttagacatagggactggctgtttgttatttggttctctgctggatgatattggcatagatttacctaaagcaccaagtaattttggtgagataattgggaaactaattttggctgggggattggattttaaggtggtgggagagattctcaagaaggtggatgatgacatgttccggagagcaatatttgacagtgtggtgggggccattagatctgcatccgagcaagccattttggatgcacaaacttctgatattgaggtctgccagagtcagctcaagtga

SEQ ID NO: 6236 - DNA, 156 bp, Glycine max
  Peptide Sequence Number=SeqID_97921
atgtcggctgaaaaatatcagtcgcggctttacagcccgatgttggctgttgttttgtctattcaatccctgaataatatttggatgatgcctccatctgttaactttcctggccgatgtcgtctagcatttttttcgatcagtatcggtgaataa

SEQ ID NO: 6237 - DNA, 399 bp, Glycine max
  Peptide Sequence Number=SeqID_97922
cgtgttcgcttcgtgcccctattcaagggacctatatgggagagagctaaaaaggttttagtgataatccctaaggtggtcatatctctcttgatggtctctagaggtatcttcctcttcgaagaacatattgcagcagatcacagattcacctctactccttatgttcccacgaacccggggaagccaactaaggagaaagtcatggtaaaacatttgcacaagattaaatggcctaactctctaaaaacagtccccagtggagtcgccaactgtcgcaacctacccttcggcgagagggcgacgcgtgactcgcgggtgcgtgttccaagaaaggaatacgtgcggagtcgccaccaacgtttatttgagggaaacgttggaaaaaccggaaaagac

SEQ ID NO: 6238 - DNA, 336 bp, Glycine max
  Peptide Sequence Number=SeqID_97923
atggttaaaaaggggggagggggaagttttcttcacccggacaccgtccccctcattttcaaagacacaaagctcacgagaactacgaaaacagcagcccccaagcttccattgttgatttttttgcttcccttttcacgctttgtgtcattcctaacaagggttgtaagggatggccctaggcctatggtgcattctgaagcgattggacgtgacactttgctcccattcccaatcaaaaattggaagaaagaaaaagaaagaaaactccctatcaaggatcggaagaaaatagaagaaatatgcagaaaggtcttaggactatacaatatctga

SEQ ID NO: 6239 - DNA, 195 bp, Glycine max
  Peptide Sequence Number=SeqID_97924
ttgagcctcagcctgcagagccagggttttacttcttttctgtgccctactccggatcagttcagggcagaggtcacatggcccggagattggccggaggcaccagcagaggctcccgacgaggcagatgaggcccgcgaggacgaggagatgaccgatttacttgatttcttaggagggagcagggccacatga

SEQ ID NO: 6240 - DNA, 96 bp, Glycine max
  Peptide Sequence Number=SeqID_97925
atgcggaaattgattaaggaaaggatggaaaataaggtggttaatttcgtgggtttagtgatggctggacagaaatatagaaatggcaataactga

SEQ ID NO: 6241 - DNA, 313 bp, Glycine max
  Peptide Sequence Number=SeqID_97926
atgactagaggcaatccatctgacttacaaccctttgatcctgagatagataggacatttcatagattagttagacatcatttagtaccttttgagcatcctgagcattctgttattggtgactttgagcattataattttgaacatcctgagagcatggcacaacctccaccccgtgagaggactctaagggaaatggatgcacctgatttcacctacgaaagcttgtgcatccaataccctgatgaggatgtcccatatgttcttaaaattggactgatccatttgcttccaaagtttgatggccttgcag

SEQ ID NO: 6242 - DNA, 360 bp, Glycine max
  Peptide Sequence Number=SeqID_97927
atggccttcaccaagaaaacaggggagatgacgactgaggccgcaaaggaaatcgctgagaagatcgattcctttgaggagcaggcatcacagggatccttcatcccccatggacgtcaggatgttctcatcgctgttattggacgtccaaagcaccctggatgtgtccgtgctgctggaggcggtgtctccatcaggcaatacttcggatcggctccatggacatcctgcaactcttcctcactgcctcctgaaaaattacagcagctgacccaacaaattaggaaccagttagaggagttaatcacagaaaaagtgactcggcagctcatggcatcgttcagccagatgcagtcctag

SEQ ID NO: 6243 - DNA, 489 bp, Glycine max
  Peptide Sequence Number=SeqID_97928
atggagcttgagaaagcccaagcggtcaaggaaaagttcaagtcagtagctgttaggatccgaaaagagaacaccgaactgagagacatcaacatagccaccaccaaggccttgcaacaagagaccaagagggcccgcaaggaagaatacggccggaacaacgaacttaagctccgaagagaggaaagggaccagtcgcgagtaaatggcatgattatgaaagatgaattgaagacttgcctaaggtcgatgaggagtttgtctcaacggttatgcgagaccgaaacaaacatgttggccatcatcagcaagtacaaagaagaattagatttggccaccgcccacgagcacaaagtggcggacgaatacgcccgagtgtacacggaaaaggaggctaggggaagggtgattgactcattacatcaagaaacgacgatgtggatggaccgatttgctcttactttgaatgggagtcaagatcttccctga

SEQ ID NO: 6244 - DNA, 234 bp, Glycine max
  Peptide Sequence Number=SeqID_97929
atgttactggagtatttgtatgtgaaaagctgtgatttttggattgatggggacccggcgttgagaggaacgaggataagggctacgtgggagtacgtgagctcaattggaggtgggcaacaggggatggtgggtttatacgtgatttgtggatgtggagaattgtcttgcaccattgctcgaccgccacctagtaccacatgtgatgggtaccccataatcctacaagcttga

SEQ ID NO: 6245 - DNA, 378 bp, Glycine max
  Peptide Sequence Number=SeqID_97930
atgcaacagggacagacagatattctcatagctaggttccttgaccctaactatggtgtcaaaacggtaaattttataataactcccctcacctatcgtgagttccccatcggttcctttttgcgtcacttagaggtccctatctctttcgcgcttgtcggtccaacgcaagtctctattacggaaaaacgaaaggaatttaatatggatttcaaaaacaaggtcaaaggtaacattcggggtcaaatacccctgtcaaaacataaagggctaaggggtgtttcggattctacaattgaaaacatcattttgaaatttcgatcacgccaatgtgaccggggttcagtgaatgccgcaaaaaaaacctcaatgttataa

SEQ ID NO: 6246 - DNA, 729 bp, Glycine max
  Peptide Sequence Number=SeqID_97931
atggtcaataccctcacctccagaggacttcacgtcctcacctttagaggactacacgtcctcaccttcagaggacgacacgtcctcgccttcaaagggtcatgtaccttcaacttcagaggactacacgtcctcgccgtcaaacagtcatgtaccttcaccttcatagggctacatgccctcaccttcagaggactgcacgtcctcaccttcggaggactgcacgtcctcaccttcggaggactacacgtcctcgccttgagaaggctacacgtcctcgtcgtcagagggctgcacgccctaaccttcagagggttgcacaccctcaccttcatagggctacatgccctcaccttcatagggctacatgccctcaccttcagaggactgcatgccctcaccttcagaggacagcacgtcctcaacttcggaggactgcacgtcctcaccttcggaggactgcacatcctcaccttcggaggactacacgccctcacctttagggggactatacgtcctcaccttcagaggactacatgtcctcgccatcagaggactacatgtccctcattttcaaagggcgacagaccctcacctttagaggactacacgtcgtctccttcagaggactacacgtcctcgccttcagaggacttcacgtcctcacctttagaggactacacgtcctcaccttcagagaacgacacgtcctcgccttcaaagggtcat

SEQ ID NO: 6247 - DNA, 129 bp, Glycine max
  Peptide Sequence Number=SeqID_97932
atggctagaatagtcgaatttcccgtcatcaacaatggtgccctcaaaagatggtccgtggcggcaatggctagcagcagcggtggtggatcaagcttatcgataccgtcgacctcgagggggggcccg

SEQ ID NO: 6248 - DNA, 339 bp, Glycine max
  Peptide Sequence Number=SeqID_97933
atgccacataaaggacaagggagtccatggaaatttgatagaaatgttacacatgatggttacaaaaatagatgtgctcttgttttgaacaattgcaccattgtgttaacacctcttcggcctgctgaggcctatgccaatcaaattagaattgtaagagagtgtaatttgagagaagaacaattgaacattcaagaaaaagagagaaaagaaaagaaaaatgagagtgagcaaaagaaagaaaagaataaaaaagaagacaaagaagagaaaaatatgaaagtgagtgcatttgcaaagaaaagagaggttgaaagtgctttgatggctagagagtag

SEQ ID NO: 6249 - DNA, 264 bp, Glycine max
  Peptide Sequence Number=SeqID_97934
atgagctgtacaggctccctaagtgcaccgcttcatctctctaagcgcaccacttcagttcatctgcttagcgagaaaggcgcgctaagccaaaaatcactaacgtgcgctaagtgcacgagcacgaacaaggccacctatttaagcctgaaatcagattttgtgaagggagtttggactgggattcagagctttgcatgtctaggttttctagagagagaaaggtctaagtttcagagagttttgagagattttgttgtgtga

SEQ ID NO: 6250 - DNA, 135 bp, Glycine max
  Peptide Sequence Number=SeqID_97935
atggcaccagtgactatgggatatgtactgtcaatgtcagattcaatgctggttgggtattgtgatgctgatagtgtctatgcctatatgttcttggtagaagtaggaatagtgggggcaagatacgcgggttag

SEQ ID NO: 6251 - DNA, 964 bp, Glycine max
  Peptide Sequence Number=SeqID_97936
atggaagagcacgacctcgacgccggcgtgcgccgcgtgctgctgggcgataacaaggtgtgcggcctgacccgcccggaagacgcgcaggccgcgcatcaggctggcgcgctgtatggcggcgtgatttttgccgccggttcgccgcgccaggttaacgaggcgcaggcgcaggcgttgatcgccgctgcgccactgaagtatgtcggcgtgttccgcaatcaggttatcagtgacgttgtcacgttagccgcgcgtttatcgcttgcggccgtccagttgcacggcgacgaagacaaagcctacgttgcggaactgcgccaggcgctgccagccagcgtgcgcatctggaaggcactgagcattaaagatcggttgccgccacgtgactggccgcacgttgatcgctacgtgctggataatggccagggtggcagcggtcagcgctttgactggtcgctgctgcagggtgaagacctggctgatgtgctgctggccggtggcctgagcgccgataactgcgtcgaagccgctcagctcggctgtgccggcctcgacttcaactccggcgtggaatccgcgccgggcatcaaagatgccagcaaagtcgcggcggaagaggacacgatgacgacattacttaatccctactttggcgaatttggcggccagtatgtgccgcagattttgatgccagcactgcgtcagctggaaacggcctttgttgaagcacagcgcgatccggcgtttcaggctgaattcactgacctgctgaaaaactacgccggtcgcccgacggccctgacgctgtgcagcaacctgaccaaaggcagcaaaacccgcctgtacctgaagcgcgaagacctgctgcacggcggcgcacacaaaactaaccaggtgctgggccaggcgctgctggcaaaacgcatgggcaaaaacgagatcatcgcggaaaccggcgccg

SEQ ID NO: 6252 - DNA, 739 bp, Glycine max
  Peptide Sequence Number=SeqID_97937
gaacgtcctgaattaaagttggtctcccacggaaggaaggttgagaaatttgggaggccagctcctgagattgaagggttagtcgatcccacaagattaactcctttgatcgcgtgttcagtagtcaccggtgatttgggagttatattcgcttttgtcgagaggtggcacaaggagactagcagcttctatcttttagtaggagagttgaccatcacactagatgatgtggcgtcactcctccatctgccgatcacaggcaccttccacagcttcgagcctctacatgtggacgaggcagtcatcatgttggtggagttgcttgatgtctcgggtgaggaggctagagctgagactaggaaatgcgaggcccgacagtggattgttgtagctcatgcttatctcctacacttggttggttgcactctttttgctaacaagagttcaacacatgctcatgtagttcatttggacgtttttcgagacttggctcagagtgagagctatgcctggggagctgccgcgctggtgcatatgtatgaccagtcaaatgaagcttctcagagcactagacaacagattgttgggtaccttactttattacaggcttatatgaagggattaacagcatcgccgtaccagacatgtatagatgctttgacgatcactaacgtgtgctggatgccttatggtgaccaccgaggagttagggcgtttgacctcatttcatgcttccagg

SEQ ID NO: 6253 - DNA, 585 bp, Glycine max
  Peptide Sequence Number=SeqID_97938
tcatccctgcgccagatgttcacgatgacccgatggaggcaccagcttttgtggaggacattcctgcggacgcaggcatagaggcggctgaggatcagcatcagggatttccgggtagtccgagcggcccatccgtgttgatagcgtatgcggatcatgttgcttgcagcgagcgttatgaattgaagctatcctctcatgggaggaaggtccacagtttaggcaggcctgtccctgccattgagggacttattgctggtacaggactaagtcctctgatcgcgtgttcgacgtctggtttccatctcctggtgggagagctcaccatcacattggatgacgtctcttctcttcttcatcttccggttattggcgacttacacgcatttgagcccttgcacgtggacgatgtggttcagatgcgggtggacttgttgatgcgccgatgccagaaaggtcattggacagctgcgggtcgcacatatcttcttcacctactgggttgcactctgtttgctaacaagagtgcaactgatgtccatgttgtctactttgaggccctttgtgacctcagtatgacagaga

SEQ ID NO: 6254 - DNA, 417 bp, Glycine max
  Peptide Sequence Number=SeqID_97939
atgaaacagacttctggtaatcgattacagtctacagaaaatccttcaaatggaagaaccatagaaaaagcaaaaaggcgtttcgacttcatccacagtcatcggaactcaaagtcatggatcatccaaggcgcagacaacccaaattcctccctccatatcatctcctacgttgttttccttggaagaacaacgtatctgtttatctccatgaaacttcctttttaccttgaattggttaaagctttttattctaacttggaaattcaagaagattcctttatttctgaagtttatgggattaagatggtcatagaccagtcccttttctttgaactcactcaattatccagtgatggtgtaccatttgagggtacacttgatgatgagtggaagtttgatttttctgtttctgat

SEQ ID NO: 6255 - DNA, 495 bp, Glycine max
  Peptide Sequence Number=SeqID_97940
atggatgtgaacaccataacaacagatgcaattttaaacttacttgaacgtcccagcatccctacacatgatgcggttttgtattacaacggaaggtggaacatgtcaccccaaaacaactttgtgggttacgcgttcaccggaataaatctgaaaaaatttgatattccaaaaggatgtagcatagatcaactgaaggatttgatcaagcaagtagcacctaaagggaatcctcctcatgggattcacgaatcccaagttgtaagaagtttgttttatcgacaacctagtcatttggagtattctgagaaagttttagaatttgaaattattgagctgaaatgtgatgacgacgtgctaaaggtgctggtagagtccaattactggaaacaatttgtgccaatagagattttggctctctttagtaaagtggttatggaaaatgaggacgatgtggttacgtccttacgtgatagaatactagttaaatgttag

SEQ ID NO: 6256 - DNA, 978 bp, Glycine max
  Peptide Sequence Number=SeqID_97941
atgtacgatcagcttaatgatgccaatctcagcaccagtcgacagcttgctggttacatcaccttgttacaatgttggatatacaagcactttccgtcagttgcagagtgcaatgttgatccgaactatgacgaggtgtcaccacatgcgtgtcgatggattgtgacaaagaagattgtgaagaatgtatctacagtgacgtacaggcaacgcctggatcgtctgaggatcccagatgtctattggatgccatatgcggagcaccgacctgtgcaggactttcattcgatttcgtgcttctcgggacagctccgttgggggcctgttgttgtcagatacagactagaaagggttatgcgccagttcggctatgtccagtgcattcctggacaccttgtccattcatgggtgtcatatgatgacatggacgatacatggacgcactactcagaccatctggcggcagcagatgatctatgtgttgtgccaggtcagtgtgcgcctgactacatagactggttctttgccatatcgcattcattcatgactgtgccacaaaatgatcctcctcgagatgcatatgagacgcagcccaatcatatccctcataaggcagcactgacatcgacacatgcggatcctgacgcgaatgagcctaaacatgcagtggaggcttgccatgcaatcacagaggtgttggagcagcatctaaatgcgccaagcacatcgacacatgaagaggtcatccaaaaatgcctcaggattgctaggggtgtcacagaagatcgtaatattctcctgcggatcaagttgatccatggaaaacttgcggatcaacttgatccgtgggcatttctggcattaagtggtgcaccagcaataacgctgggtgcacctagcaacaccttagttattagtatggttttagaatcaaggacaaagtcagaccatgatgacagaggccatcgattattataa

SEQ ID NO: 6257 - DNA, 1167 bp, Glycine max
  Peptide Sequence Number=SeqID_97942
ggaatcattcatggcacatgtgggagcatgccttcagttcttgaggataagtccaagttctctgtgcttggtctgtgtgtcactgaccctactactagtaatggcttgatgaatggggcggaagatgacaaaaagaagttctctgagtttggcaatgctttgcaagagggagatacggatagaaagaataactctaggagttgttgttgcttccagttagatggttcattgaggaaaagtagccaatatgttcttggaagaagtaattgggttctgctcatgtttgattctcctgaacagactgatgtaggaatacacaggcttccaaaattgcatcacattcattggaatggactaactgtgtcacaatatgatgttcacgtatgcttcaaattgaatgctgagttggctggagtacttggcatggcttctttgaatgcagtccagatatggtcaacactctggatctttgtgggttacatcttcaattatattattcaagggctttctgtcttaggaatcctttgtggattcactgttcctgctgctttggtcatagacatgattgcactggcaactttacacatttcaactcttcattggtttatttcacttgtatattcatcacagatacaggcattagctgccttgtggcggcttttcaggggtcggaaatggaatcctctgaggcagcggttagatagctttgactatactgtgaagcaacacattgttggatcacttttatttacaccacttctacttcttttaccaactacttctgttttctatatattctttagtatcatggacacaaccattaaccttgtctgtctactgattgaagtcactatttcgagtaatagtactgcttctccaagtgctgatattactgatgaaatgacctcatacaaggagtcattgcatctaaaggatttcaatagagaaaaatctagtaatctagtttctgctctccacagcaactacttgagcttagtttctgggtcaaccatctccacagtggctcatggaatactcattggacaaaggtgtgatatcctggtgccaagtgctcttatgaatgccatctatgcgtggcacccttctaccttcaccaatgccatggacgtctatgcactacaaagagtattggcgtgtttgtcatga

SEQ ID NO: 6258 - DNA, 664 bp, Glycine max
  Peptide Sequence Number=SeqID_97943
atgctaactccgaccaccggagtaccgaagcgccggccgcgatctggccggacgccgcttcagctcaagaacactcctgccgatcccattcatccttccgcgaagcccaagcccaagcccaagccgtatttcgagatttcattgatcgacaaagagaacaatccggttgccgccgtcgcggttctggtggcgcagccgccggagacgtcgctggcggaggagctcagcgcggtcaagaagaagctggagagaatgagagcggacaaagaaaaaacggagaaaatgctgaacgagaaacacgcaatactggacgcgaagatgaaggagatggaagagcgaggtgagattcagaagaacctcgagatcgaggttgaccggttgttccggttgaaggaactcaagtatcgctgcatgagagtttctccgatgagaacgcttagggagaaggaacaaggaaagatcgtgaacgaagcgccatcgcaatcggaggtgaaaacggaggaaacagtggcgtcggaatctgaatcggaatcggaatcggaatctgttggaggcgaatgccaagttctgcagagtccagggtatctaaacatggattatccagggtgggagaccttccaatatgaggagaaattatatgctaatgggaatcagcttgtagaag

SEQ ID NO: 6259 - DNA, 321 bp, Glycine max
  Peptide Sequence Number=SeqID_97944
atggtggttgcggtggtgacaatagtggagtgtgacaacggtggtggtggttgttatggtgacgagggtgaagtggtggcaacaacaatgatgatggtggttgcgatggtgacaatggtggagtgtgacgatgatggtggtggttgttatggtggtagtgattgttatggtgacgatggtagtggtggtgatgatgatggttgtggtgatggtggcggtggcaacaatgttaaaggcggtggtgacaggttagtgacagtgacaatggcgataactacaataataatggtggtggcatgggtggtgaggacgagggaatga

SEQ ID NO: 6260 - DNA, 309 bp, Glycine max
  Peptide Sequence Number=SeqID_97945
atggtggcaatccaaaaaaaatgccataaagagaagataactggaaaatggaagagaaaaggacaagggaagcgaaatggggttgcgagagagattgagaatagggaaggcaagatcactggaaactgcaggtcaccatatgtgaagtctttgccagcagagatggtttggaaagaagaaaacagagatggaggtgtgctgaaaaagaaaagagatggatgctggtctcctcaacatagacttttgttcattacggttttgctcaaacttatgggccaaaggtataaatattacccatacaaatgttaa

SEQ ID NO: 6261 - DNA, 498 bp, Glycine max
  Peptide Sequence Number=SeqID_97946
atggtggtagtgagagtgacaaagccatacacaatggtgatgtattgcagggagagatttgttgaagatgaaagtgtaattgggttgagggacgagggagtagaagaggtgaaggtaccagtgttgagcgttgcggtggttgacggcgacaaacgaggtacgcagaagatggacgaaaatgagtggatgtatgaaagtataatgtctgaacaagcggatatagattatgaaaatgaagaagcatgtggtacgaatgaaccacatgttgattgttccgatgcgttcaatacttctgaggatgttttgcggtggactcgattcgttgctcatgaaaacggatttgtggcggtgattttaaggtcggacacaaacacaggagtgacgagtataggtgtagaaaaaaagaatttatcagaagagatactgagactaggaaatgtgggtgtcccttcaagctttgttgcaagccagtggttggaggagaaggctggatggtga

SEQ ID NO: 6262 - DNA, 333 bp, Glycine max
  Peptide Sequence Number=SeqID_97947
atgtttacggatcaaataacaacaccgacagtcgaagacgaagagcttcttacctcgacaatgccgacgcggagggagaacaccaccctcaaaatgcctgggttactcaacaccaacggtggtgcggtcgcagaacacggactcccgacgcagaggaagaagacgacgctcacgggggaatgcggcacagaggacctcgacggtgggtcaagcttttctgaaaccagcaaccacttcacgcaaacaaacgaaaggaagaagaatgtggctgaggtgaggtcaggggtgaggaaggagaccaaaaccacttcacgccagcaaaaagaaaaaatg

SEQ ID NO: 6263 - DNA, 213 bp, Glycine max
  Peptide Sequence Number=SeqID_97948
atggttactcatgaatgtcctaaaactgtataccatagaatgaaaacaattggcgaagaaagccaaactttcctctctgtttcgggcagaaaactcagtaatggtgccatattacttgttgtagccattactgagtttaaagagaaacgcattgagcatgcggatgatctgactaaagcttggtctcaagtcaggatcttcaacccagcatga

SEQ ID NO: 6264 - DNA, 858 bp, Glycine max
  Peptide Sequence Number=SeqID_97949
atgggcaagtctgtagttgagaagctactttggatggcaattgtgtgcttggtgctgggtgtaatttccattactcccaaggcccaagcagcagtgacatgcaaccaggtggtgagcaacctcaccccatgcatttcttatgtgctcaatggtggcaaaaccgtgcctggcccttgctgcaatgggatcaagaccctctttaacctcgctcactccacaccagaccgccaaaccgtttgcaagtgcataaagaacgctgttagtgcgttccattatggcaagtccaatgtggaccgtgctgctgctcttcctaagcagtgtggggttaacattccttaccagatcagcccttccaccgactgtaccagtaattcggatattgagaatgaccatggaacaggtcctggcacgagcttctgcaatgaagtttcaaccaaaaagatcaagacctacaactacgcagcatacaccctcttccgtcgaaagcccaccaagctcaaacatccctccgagcccgagcgcaattttcacgacgaagaatcagaattaccgttccatgagagagtgaatgtcgataaggatagtgattttgcttccaattcaagcacgcccccgagaaacgctttgcttttaactcgctgtagatccgcgccgtacagatcttcctctttggctagtaggttccggagttctcccgttaaggaccaagaaacggagtttccaattccgaacacgacggaacaacaacacacttccgaggaaccccaaacggaacccgaattaggttttctcagagaaaaaattgcttcactcaccgaaccgaaaaaggttgaggaagttgaaacagagagaaattga

SEQ ID NO: 6265 - DNA, 1800 bp, Glycine max
  Peptide Sequence Number=SeqID_97950
atggaggagcacgtgccagcattgcacactgctatcaacgctgtgaaggcattaggtagaggctttgatgtgaactgcgatacgaggttgctgtattgcaaaggagtggcagggtccagggtggtccatgttgatgaagaacacgtgagggacttgtggttgtacgatgatgtggttgttcccaatgtttcaatggacattgttaagaactctcaggagcatgtggggcgtcgcagttctggagtctgtagttaccaggagatggtggaatatttcaatcagaaggctaatatatcacaaagctttcctcttgggacatttaattctgcgtttagcttcactggttcaaaacacattgatgctactgagacaaaatctctttcttcagatgggttttatattcccctcgcaaaggttcagcttacaaatgcccacttaacattgcaagaaaatgtcaaaagggatattccagtgaattgggatccaccatccttggcaagctttattgaaaactttgggacacatgtcattacatccataactattggtggtaaggatgttatttttgttaaacaccaccgtagttcacctttgtcaacattggagataaagaactatattcaagacattggaaaccagaggttctctgacatcaataaccatacaagttcacttcaaacaaaattcaaggataaggctagtttcactttaattccgattccttatagtgatttgattcaggttgttgatcccttttcattcaataatcaagagatacaccctcaatctgcatctggaacttatctaagtgggaaatttaactcttttcttaacttccttggatacacccaggatgtcagagtcattttcagaaggagaggaggagatgatttggaacaagaccacagtatgtggctcagaactgtttggtcttccccggatgtcattcagatgactttctgtcctataacagatctcattgatgaagttcctggcaaggaacaattgactcacgctattggtctctatcttgaatataaacctcccattgaagaacttagatatttcttagagtttcaaattgctcacgtttgggctcctcttcatgaaaggattcctggacaacaaaggaaggaacctatttgcccatctttacaattcagcataatgggccagaaactttatgttagccaagagcagatcacagttgggcgtttgccagtaaccggcctacgtctgtttcttgaaggaagcaagcagaatcgtttgagtgttcatcttcaacacttatcatctcttccaaagatccttaggccatattgggacacagatgtaaccattggtgctcccaagtggcagggacccgaggagcaagacagccggtggttcgagcccgttaagtggaagaatttttctcatgtgagcacagcacccgttgagaatcctgaaacgtttataggggagttctctggcatctatgtggttaccggggtgcagcttggagtgtgggatttcggaccgcgaagcgtgttgtacatgaagctcttgttttcgaggttacctggttgcacaatcagaagatcattctgggatcacacccccaccaaccctgataactcgagctttggttccagagagaacaacaccacaggaagcaagttgttcaagtatgttgacttgtctgaaatgagcaaagggccacaagatcctcctggacattggttagttactggtggaaaacttggtgttgagaaagggaaaattgttctgagggtgaaatattcgttgctaagttactga

SEQ ID NO: 6266 - DNA, 903 bp, Glycine max
  Peptide Sequence Number=SeqID_97951
atggctactacttctttctacatgaccataccaatcttcaaaattcgcttcttcttgttcttatgcttttttgggataggttcttctcaattgtcctctgatttttactccacaacgtgtcccaatgcactttcaaccattaagagcgtagtggactctgctggatgtgatgcatcagtgctattaaacgatacaacaagtttcacaggtgaacagacggcacgtggcaacgttaattccataaggggttttggtgtaatagacaacatcaagtctcaagttgagagcttatgccctggtgttgtttcttgtgctgatattctcgctgtggctgcaagggactctgttgttgctcttggtggacctagttggacagtgcaattgggcagaagagactcaaccactgcaagtttaagttctgcaaactcagacttgccccgttttgatttaagtctacaacaacttagcgataatttccaaaacaaaggtctcaccaccgcagaaatggttgctctgtcaggagggcacacaattgggcaagctcaatgttcaactttcagaacaaggatttataacgagaccaacatagattcctcttttgcaacatcattgcaagcaaattgtccaagcgtgggtggtgacagcaatttggcccctcttgacagcagccaaaacacctttgacaatgcttacttcaaggatttgcagagccaaaagggtctcttgcacactgatcaagtgctcttcaatggaggatccactgactctcaagtaaatggttatgccagcgacccttcaagcttcaacactgactttgccaatgcaatgattaaaatggggaacattagcccacttactggctctagtggcgaaatcaggaccaactgttggaaaaccaattaa

SEQ ID NO: 6267 - DNA, 153 bp, Glycine max
  Peptide Sequence Number=SeqID_97952
atgggtgttggtggcctaatccgggacgcagtgggtaaatggaggtttggatttttccaacatataggcgttggtgatcctacagtggcggagattgtggctatcaaggttcctcgtgaagcaaaccaggttgcggacacactagcatcctag

SEQ ID NO: 6268 - DNA, 549 bp, Glycine max
  Peptide Sequence Number=SeqID_97953
atggtgccattggaaccacctgatactgacgcggcggtgaggagcggcaatgccatagtcagtgacaaggatggtgcaatgtcgttggacttcgaggaggacgacaaattgttctcgaaattctctatcacagcacaagcctttgatcatttgtgcaagccctgggagaaggtcttgagtggcgggccctggatggtgtttgatcactatcttgttgttcgtcctttgttgccgaacattgtcgcgtcagaagcgaagatcgaaaagacagtggtttggatacactttcctggtctaggggagtgtcaacagtctaaagggagcaatgaggtggatgggatttcgaatgattcacaacccaccgagccaagcagcaatgaggtggcggtgtggagtgtgaaaccaaggacggaaaagggtatagatcatgggggaggcttaggagtgggtgtcgtgagtgcgtctcaaggaccaagtcatgcttcgttaggtggtggcgatgaagagggatcctcgtcgatgcctagggatgttgttgtgagccattaa

SEQ ID NO: 6269 - DNA, 231 bp, Glycine max
  Peptide Sequence Number=SeqID_97954
atggcacatgcacaacccgaaccagttgatggctccttgttgcgcttacaagacaaccatttttcaaatcaagtgtgggaagaccaagagagaatgatttgtccgaggtatgattctgtttgggtttttacgtacttggatcgaatacataatcagcaaaatttccagcaacttcccgttgatgctgatgatgttttgtcattgcacaacatgctagagctcatatcatga

SEQ ID NO: 6270 - DNA, 1044 bp, Glycine max
  Peptide Sequence Number=SeqID_97955
atggaattgcctgatacaatcagtacagccatgtacaaagggagattctgcactagtggtggagttaagtctcagcttggttatgttgaaacagatccatctggtcgatatggtcgtttcagggatgttctggggaaaggagcaatgaagactgtgtatagggcatttgatgagttactagggattgaagtggcttggaaccaagtcaagcttggtgatgtctttcactcaccagagcaactccagcgcctttattcagaggttcatctccttaagcacctcaaccatgactctatgatgatcttctatggttcttggatcgatgtcaacaacaaaacctttaactttgtcactgaattgttcacctccggcacccttagagagtataggcagaagtacaagagagttgatatcacagcagttaagaattgggctcgccagattctaagtggtttggagtatttacacagccataatcctcctgtgatacatagagatctcaaatgtgacaacatctttgtcaatggccatcaggggagggtcaagattggtgatttaggcctggcagctatacttaaaagctcccaacatgcacacagtgtcatagagatgcttacttttgagttcccatacagtgagtgtgccaacccagctcaaatatacaagaaagttacttcgggaaagatacctgaagctttttacagaatcgaaaatttggaagcccagaagtttgtgggaaaatgtttggcaaatgtctcagagagaccatcagcgaaggagctcttgttggaccctttcttagccatggaacaacttgaaattcaattgccaccaagcataccagcattatttacaaataaatctttcaagcttagttgccctgcaccatttcccagtgagcatcgcgatcaaacaaagagcgcggatatgacaatcaccgggtcaataaacgaagaggacaacactgttttccttaaagttcggatatctgacataatgggtatgcacaatttcatcccacattttgcagtaatcttacaataa

SEQ ID NO: 6271 - DNA, 192 bp, Glycine max
  Peptide Sequence Number=SeqID_97956
atgttggactttaaaagtgatagagttaggaacttggtggtacaaggagtgtcatttagggaaagtttttggtttagagttgctttcgaagatggtgaggagaaaaacactctgtccataatgggtcaaggtgacctgacaatttccagtgagctcatagaattctctaagtttcgtccatccagcaagtag

SEQ ID NO: 6272 - DNA, 126 bp, Glycine max
  Peptide Sequence Number=SeqID_97957
atgtcctccttcaaagtcaacaaaattctaactggtggtgcttgtgctagttattccctcagtcctattttgatgtgggaatggcatgatcaaattgcttcaaactaccaaacgatcagattttga

SEQ ID NO: 6273 - DNA, 189 bp, Glycine max
  Peptide Sequence Number=SeqID_97958
atggagaaagatgcattgcacgaaaacagtacaaatggaggcttcaatcccttctctttctctctgatgtttgggactctatcagaggaaaaaattgaggaatctcaggaacttgttagagatgttgctatcgctatcggaagacacgtgagcccgcttagaggcttcgatgatctacctcaagcatga

SEQ ID NO: 6274 - DNA, 525 bp, Glycine max
  Peptide Sequence Number=SeqID_97959
atggcttcaaagcgcatcctcaaggagctcaaggacttgcagaaagacccaccaacttcttgcagcgctggtccagtagctgaggacatgttccattggcaagcaacaataatgggtcctgctgatagtccttatgctggaggtgtattcctagtcactattcacttccctccggattatcctttcaagcctcctaaggttgcctttaggactaaggtgtttcacccgaacatcaatagcaatggtagcatttgtcttgatatcctgaaggagcagtggagccctgcactcaccatctctaaggggtccatagagacccccaaaaagctccctagtagggcccgggaaaatggtggagggcattggcagctatcaagggatgtactgctttctatctgctcattgctgactgatccaaatcctgatgatccacttgttccggaaatcgctcacatgtacaaaactgaccgggccaagtatgaggccactgcacgcagctggacccagaagtatgccatgggctga

SEQ ID NO: 6275 - DNA, 1005 bp, Glycine max
  Peptide Sequence Number=SeqID_97960
atggcatcggctttgatctcgcgttcttcgcgtaggtttctcaaaccttgttcttcttcggtatctctttaccctgccatcttcaatcctgtgatttcttctcaacaatcggcaagccaaaacccctctcaaaatcccccattcaagctaccccagctccaaagtttcaattttgagttccgtaaaactactgggtctctctcaagtttccaccttgttgcgcacgtgtccacgtggccttccaaggagaacaagaaccaccaaagtggtggtaatgtgagtagtagttgggttgaattgtacttgcctaggaaggttcagccctatgctcgccttgctcgccttgataagccaattgggacatggttgcttctatggccttgtatgtggtcaattaccctggctactaccccaggtcaccttcctgattttaaaatgttggctctgtttggatgtggggctttgcttttaagaggtgccggatgtactattaatgatctccttgatcgggatattgatacaatggcaagtccgtgttttgggtgcctcatccttgttgcttgtcttctcctatcccctcatgaagagcctcaagcctttcttgggttgacctttaactggggggctttgttaggatgggcagcaattaaaggaagtctggatccatctattgtgctgccactctatgcctctggagtattttggactcttgtgtatgatactatctacgcacatcaggacaaagaagatgacctgaaagtgggagttaaatcaacagctttgcgctttggtgattcaacaaaggagtggattacggggtttgggattgcatgccttggtggtcttgctgttagtggatttaatgctgaaataggctggccatattatgcatctctagcagttgcgtctggacacttgggctggcaaatatggacagtcgacctttcttcacgcgctgactgcaataggaagtatgttagggaggttcattgcataaactcgtga

SEQ ID NO: 6276 - DNA, 1047 bp, Glycine max
  Peptide Sequence Number=SeqID_97961
atggtgaaactagcttctaaggagcctctttgtggcaaagttcctttggtgcatatctatgattctatcctaaaggttaaagatgtctggaatgggatggattgggatcttcacaagctttattctactcttcctcaatctgctgctgctgatgttgtcagtgttaaacccatgctggtggtaagccttccggatttgtggatctgggagccttgtgtttcatgcactttttcagttagtgcaatctataaatggcttcaagggagctgttttatagtggggctagctggaattggatttggaagcttaaactccctgcgaacatccaattctttgtgtggcagctttgccacaaagcaataccaacctgatctttgcttatggcccgtggtattattcttgatgacacttgcccggtttatcagaatcaccaggaaactattgagcagtatttactccgatgtgattatgctcatgatgtttggagggcttgtggttgatcgtcctcgtggggatgactggattgcttggatcaagcaagcttctcatagatttgggaacatggtccctattgtcttgtgcactaaatggtgcaacagaaatgatgttgagatgattgtcttaaatgtggatgagagtgttaccattgatgtcagaaaagctgggtatggaggcctttgcacgaaccatagtggtgactttttggttggtataccggataagtatttggacaagacaagaaggcggacacctaatgtgacataccctatgaagttgggtaccctttcggccatatgccttcttattctatataacatgtctcagtcttttgcatatacaagtggaacaattgggttttatggttatgctggggatactattatcatgcactctgagatcatggcagtcttttctgactctaagcatgttgatgacttgattagagatgggtgccctcagcaacatctttatgctaatgagcttcacactatccatagggattggaatttggattattcagttcgaccgcaacctcagggaggataa

SEQ ID NO: 6277 - DNA, 165 bp, Glycine max
  Peptide Sequence Number=SeqID_97962
atgactgatgatgcatctaaagaggtctggcaggaggtatcattgaagcataaggtggactgtctagctctatcagtggatgacatgagagccttcatcttcgctgctcttcaacaactctcgcatcctaagattgaagtgtttgttttggagaaggtgcaatga

SEQ ID NO: 6278 - DNA, 317 bp, Glycine max
  Peptide Sequence Number=SeqID_97963
atgccggctctgagaattcatggatatgccttggctgtttcgttttgtcttatcaccttcatagcagcctcactaccaacagacccttcagaagttgatgccctgatagagatcaagaatagtttgattgatcctaagaacaatcttaagaactggaataaaggagatccatgtgcagcaaactggactggtgtttggtgttttgatcagaagggggatgatgggtacttccatgttcgtgagatgaatttcatgtggaacgacttgacaggcacaataccaaaggagattggaaatattaaatcattgaaactctt

SEQ ID NO: 6279 - DNA, 349 bp, Glycine max
  Peptide Sequence Number=SeqID_97964
atggtggtggtgctaatagtagtggttggtgttgctagtgtcgatagtggtgacgatgatgatgttgctcatgatggttgtgccaatggcaatgatgggggtggtgatgatattgatgatatgtcaaaagagcaagggccgctgcatcgccgcccggatatagtgaaaagtaagcaagggttcccacattttcgtgaacaggtgtgggtaaagaagctagttcatgacaggaggattcgctttggtacatggaatataggcacacttactggaaaatctatggaaatagtggatgttatagtgaggaggaagatcaattttatgtgcctacaagaaactaagtggacag

SEQ ID NO: 6280 - DNA, 1035 bp, Glycine max
  Peptide Sequence Number=SeqID_97965
atggctatgttgcgtttatcaccactctctggtcaaaaccatgcactttctttcccatcatcaccatcaccaccacctaagcttcagaaccgtcctctgtatctcaccaatttgcctcatttgccccaaaggttgaaactttccttcgccggcggcgacggcggagatggggtgggacgtggtggcggtggcggtggcggaggtgaaagctggggtgatgaaggaaaacccaaagattcatcttttggaattttgggtctttttctgaacggttggagatcaagggttgccgctgatccacaattccctttcaaggttttgatggaggagttggtgggtgtgagtgcttgtgtattaggtgacatggcttcaaggcctaattttgggttgaatgaacttgactttgtcttttcaactttggtggttggggcaatcctcaatttcactctcatgtatctattggcacctaccatgacatcatcagcagcatcaaatctacccgccctatttgcttcatgccccaagagtcacatgtttgagcctggtgccttttctcttttggataggttaggaaccttggtgtacaaagggaccattttttctgttgttggctttggtgctggactagttggaaccacactttcaaatgggctgatcaagatgaggaagaagatggatccaacctttgagaccccaaacaagcctccaccaacctttttgaatgctctaacttgggctggtcacatgggggttagcagcaatttgaggtaccagactctgaatggagttgagttcatgttggagagggtgcttaaccccttggctttcaagtcctcagtgttggtgctgaggtgtgtgaacaatgttattgggggcatgtcttttgtggtgctggcaaggttgactggggcacagagtgttggaggggagcagaagaaggagaatgaggttgctttgattgctgagaaggagaagttggagtcagagagggaagaagggttgcagaataatcagtcgacagcaccatcaaagtga

SEQ ID NO: 6281 - DNA, 688 bp, Glycine max
  Peptide Sequence Number=SeqID_97966
atgaaggcaggagaagcggggcggtttagagtagcggccgtcgcagccgctaaagcggcggcgcggggcgggttctggacgcaaaatttcgcgcgctctccattgaagctgcgactgcaacctcgacctgcgactccgacgactccgtccggcgactccgatgaccccctccggcgactctgcacccggcaaagctgcaacccgacgagtcttcgtcctgcgactgtgtcgcgccaccaccccttgcttgaggggtcttcgttgttcaagcctaccgatgatagggtagatgccttttggaaatggaacagtttaaaggataaaaataacaggaagagtgtaacctgtgattttggtcacaaaacgactacgggaggaatttctagagcaaaaagacatcaacttcaaataaaaggagatgtaggttcttgtaaaaaagtaccggaggatgttaaattagaaatgattgctgcttatgagaagaaaatagttgaaactgcagcatacatggaggcaatgcaagaagaagacgaggaagaggaagatgggatcctagagattgcaagacttaaaagtggaaaaaagcgtccagcaacatcaaatgaagcctcctcaactgcttccaataagaggatcacaactaaaaaaggccctattgattttttgttctccaaagcacctgaagaaa

SEQ ID NO: 6282 - DNA, 123 bp, Glycine max
  Peptide Sequence Number=SeqID_97967
atgggagatacattgagaaagatgatgcaccaaagctcttttctttctcttgaacttcctgatgggggaggtgctgctcaacgtgaggtctccttttctgacaagatgtttggacatggataa

SEQ ID NO: 6283 - DNA, 1323 bp, Glycine max
  Peptide Sequence Number=SeqID_97968
atggaaggcaacaacaacaacaacaacaacaacgctgacgtgttcagaccttctgtggggccctcctcctcgccgaactcgaggagatactcggggattttatcggcgtcgaacctcattcaggcaccgctatcggcgctgctggaatattccggcatccttccgtcacggtcgtccaaccaacacagccagcccagctccgacgccgccaacaatgacggcgaggtttcgattaggatcatcggcccggcggaacaggagcagagggaggaacaacagctgcagcagacccctcctcccggattggtcgtcggactctcgcattcccagaacgacaccgttttggcatcggggtcgccgcgcggcgacgccgagggcgcggcggggaccgagggcgccgccgctggaggggacggtgcagggagggattcatcttaccagagatatgacattcagcatgccgccaggtggattgagcaggttttgccgttttcgttgcttctgttggtggttttcattaggcagcatttgcaagggttttttgtgaccatttggattgctgctgtgcttttcaagtccaatgatattctaaggaaacaaactgcgttgaagggggagaggaagatgctggttttggttgggatttctgttgggttcgcgcttcatgtggttggtgtctactggtggtatcagaatgatgatctaatgtatccattgatcatgcttcctcccaaggatataccgcctttctggcacgcgattttcatcatcatggtcaatgatactttggttcgccaggctgcaatggtattcaagtgtatattgttgatgtattacaagaatagcagaggccgaaattatcgtaagcagggtcaaatgctgactttagttgaatacctcctcctgctttaccgtgccttgttgccaacaccagtttggtatcgtttcttcctgaacaaagaatatggaagcctcttttcatcactgatgacaggattgtatctaacatttaaactcacgtctgttgttgaaaaggtgcaatccttctttgctgcagtgaaagcattgtcgcgtaaagaaatgcactatggggcttatgcaacatcagagcaggtcaatgcagctggtgatctttgtgctatttgccaggagaagatgcatgctcccatcttactacgttgtaaacatattttctgtgaagattgcgtatcagagtggtttgagagagaaaggacctgcccattgtgcagggctttggtaaaacccgcagaccttaggtcatttggggatggctctactagcttgtttttccagttattctga

SEQ ID NO: 6284 - DNA, 1731 bp, Glycine max
  Peptide Sequence Number=SeqID_97969
atgaaattgggttttgtgtgtgaattccaagcagaaactgatgagaggatttgctttttgaatgtttgccctgatgaaatcattcggagcctcttctacaataagaacaacgactcgctcattacagtatctgtttatgcttctgagaacttcagctctttgaaatgcagggggaagccggatgctgggtttcctcttttccaatctgaatctttgaaatggcctggatttgttgagtttgatgatgtcaatggaaaggtcctaacttattctgcacaagattgtatttacaaggtctttgatcttaagaactacaccatgctatactcgattttagataggaatgttcaagaaatcaagatcagcggtcatattcccctaaagattatatccattgaagatggcacagttctcaaagtgttcaaccatctacttcatcggaataagaaggtggacttcatagagcaatttaatgaaaagcttctagtcaagcaagaaaatgagaaccttcagattcttgatgttcacaattctgagctgatggaggtaagcaggacggagttcatgactccatcagcatttatctttctatacgataatcaattgttccttactttcagaaatcgaacagtttctgtttggaacttccacggggagcttgttacttcatttgaggatcaccagttgtggcacccagactgcaacacgaacaacatatacataacaagtgatcaggatctcattatgtcttactgcaaggcagattctgatgatcaatggattgaaggcactgctggatccattaatgtcagcaatatcttgaccgggaaatgtgtggcgaaaataattgcaacaagtagcagtgccaaggcagacgagtgcagcagtagtggttgcagctgcaagcaaagtgattcatgcctaatgaggaattcagttgcggaggctttggaggacatcactgccctcttttatgaggaagacagaaatgagatctatacggggaacaggcatggtcttgttcatgtatgtggtgagaatggaaaagataagtatgcttttggtgaagtggtgagaatggaaagaaggaagcatggaggtttaaagaaggagagtagtgacaataacgataacaatgacaacaacatcaatttcttcaagatgcttcaaagcggcgaggtttgttcaaagcctcatcgtgcctttgcctctgttactatctctcacagattttgcaacatgcacttgacgcaccaatatgacacttatgatccctccaaaaagatgatggtcttggttgtctaccagtctaaaatggacggattggggagaggggcaagcatgggtcttggtctccctccttcaacatccttcctatcggtcaagttgtgccttggtgacttgttggtcatgggttcgaatccggaaacagcctctttgcatatgcaagggaaaggctgcgtacaacatccctcccccataccttcgcatagcgaagagcctctgggcaatggggagaatcagttgtttcttactttcagaaatggagcattatctgtttggaatttctgtagggagcttgttacccaatttgaggatcaccagtttgtgacaaggttaggctgcaatacaaacaacacatacataacaagagatcaagatttcattatctcttactgcaaggcagattctgatgatcaatggatggaaggcaatggtaaccgtctttga

SEQ ID NO: 6285 - DNA, 441 bp, Glycine max
  Peptide Sequence Number=SeqID_97970
atggcgtcccgaagaggtggagtctcactcccagacagacctagcaacaactcaagctccgtcctcgcgaagatctcgcgctcctccatcgtcacccgcggcaaggaagtcgccgatgacgctgcattcgtcgccaagaagctcctccgtagcactggcaaggccgcttttgctgttggaatacctgaagcggaaatttcgaacttgataaagacccttcggggattcaatgacacaaaaattgaattcaagctggcaaatgttcagaaaatatggcaaagattcttgtatcgtgattctgttttgcttgaagctgaaaggcagaaaactgctattggacatgttgatgattgggcagttgaattcttaaagctgacagaggatgatgcctttgccactttaatacaggtacttttattctttttggcaaactatttttga

SEQ ID NO: 6286 - DNA, 348 bp, Glycine max
  Peptide Sequence Number=SeqID_97971
atggggtttccagaaaaagaaagcactgagccagacgaggtcattttcgcttcacggatcaaagaaacactaaagaagagaagaggaagacacaagatcaaccaacgaggcggcgcgtggtggtcacgcgtcggtgtttggcatgaacgtgaacggcgcgtggagaagtttccggtcaagcgaccagttgggttaggttgtgctcttcgaggcgcaccaaaccctgtaatttccgaccgaaatggtggccggagtgaagacggctggcggcggacggcggcgcagacaacggcggacggcggcggatacgacccgctctggtaccaacttgaagctttgaatatgtga

SEQ ID NO: 6287 - DNA, 600 bp, Glycine max
  Peptide Sequence Number=SeqID_97972
atgagctatataagcaagctggaaaaaaaccctggtcaaagtagcatttcacacttccagggactgggtgatgagatagaggcaggagatgatagggggaagctagccgattttgctgcccttgcccattctgccatcatactgcttctattgtactctactggaagtctcagatgtagtagttgcttattttcaagcttgttcagaattctagggagtgcaactagaggatcgcatcgtcctatcatgaatcttcatgaaagaagtctaagtgttttagcatgtcgctatgtggatgaggttataattggtgccccatgggagatttccaaagatatgctcactacatttaacatctcattagttgttcatggaaccattgcagaaagtaatgattttcagaaggaagaatgcaatccatatgctgttcctattagcatgggcatcttcaaagttttagaaagtcctttagatataactactactacaataattagaaggattgtttcaaatcatgaggcataccagaaccgaaataagaagaagggtgaaagtgagaaaagatactacgagggcaagagtcatgtgtctgaagaataa

SEQ ID NO: 6288 - DNA, 2418 bp, Glycine max
  Peptide Sequence Number=SeqID_97973
atggctgcttgtgctttgttcagtgctggcggtaacattaccgaagatggcaatgttaatggaagtggaagtgcttctagtactcctttgacaagtgcctctaactctagcagcatgagcaacgaagaaaaaaaacacaacctacatggtggtggcatcatgccacagcctcattgtgaaagaaaaatggtgagaaaaagaatggcttctgagatggaagttaacgttcacgcaactccaccacacaactcttcctccacaacaagtgattatcctaggtttcctcgtcgaagcagcaccaacatgaacatgttagaaaaagggtccaccagtaccaccacagcaacaacaacaacattagccgaagataacgttgctattccaaattaccccactgtgacggtcacaaccaactactccactatgttgctaccttcatccaccaccaccactatcaattcctctggtgttgctccaaactacatcactcaccaccaacaccatcatttccaaggactcgttgaaagccaggaccatcagcaaaaccctgtgcctgcagtttgtggattctcagggttaccactttttccatctcaaagccaaagaaaccgagacagcaacaacacccccaccaccaacaacataagaaacagtggtggaaatattgttgacgtggttgcttcttcttcttcttcttcttccatggatgacacttcagcagcagcagcaacaagtggttggatcgatggtatattgaaggatctcattcacagttccaacagtgtttcgattcctcaactaatcagcaacgtgagggagatcatatacccttgcaaccccaaccttgcaatggttcttgaatacaggttgcgtcttcttctcactgagtctacaacacaaaacaaaagaggcacagaaggggtgcctcttcctccttctgtttcctcagtgaagctcacgagcaaccgtgttgtcgatggcattgttcctaatttgcacttcacagatgcttcaggtggtgctgtggttgtgaatcagcacatgttgtccaattggggtgtgcctcaaatcactcatcaccatgataacaacaccaacaccaacaccaacaatagcaacaacccttcagtttctttggttactttgccttcaccaacaccgccgctaccaccacctcattattcaccaccacaagagaagcaccctcaagaagaggatctagcagcaaccagcacggctgaggtggcactttcaagaaagaagaaagaggagctgcgtgaacagaagaagaaagacgaagagggtttgcatcttctcactttgctgcttcagtgtgcagaagcggtttcatctgagaatctagaagatgccaacaagatgctgctggagatttctcagttgtcaacacccttcggcacttcagcacagcgtgtggcagcatatttctcagaagccatatcagcaaggttggtgagttcatgcttagggatatatgccactttgccacacactcaccaaagccacaaggtggcttcggcttttcaagtgttcaatggtattagtcctttcgtgaagttctcacacttcacagcaaaccaagctattcaagaagctttcgagagggaagagagggtgcacatcatagatcttgacataatgcaagggttgcagtggcctggtttgtttcacattctagcttcaagacctggtggagcaccttatgtgaggctcacagggcttggtacctctatggaagcacttgaagccacgggaaaacgcttgtctgattttgcaaacaaacttggccttccctttgagttcttccctgtggctgagaaagttgggaaccttgaccctgagaggctcaatgtttgcaaaaccgaagctgttgctgttcactggttgcaacattccctctatgatgtcactggctcagacaccaacaccttgtggctcttgcagaggctggcacctaaagtggtgactgtggtggagcaggacctaagcaacactggttcattcttggggaggtttgtggaagccatacactactactcagcattatttgactctcttgggtcaagctatggggaggagagtgaggagaggcatgtggtggaacagcaactattgtctagggagattcgaaatgtgctagctgttggggggccatcaaggactggagagccaaagtttcataactggagggaaaagcttcaacagtgtgggtttagaggcatatctctagctggtaatgctgccacacaagctagtctactccttggtatgttcccatctgagggctataccttggtggaggacaatggcattcttaaacttggttggaaggacctttgcttgctcactgcttcagcttggagaccacccttccatagtgccattacccatcacaactag

SEQ ID NO: 6289 - DNA, 180 bp, Glycine max
  Peptide Sequence Number=SeqID_97974
atgctgggtgcacgtagcaactcccccgagataatcatattgggtatcccctcgtttctaggcccagtcctggttccagggcacataacaacctattggctatggttcattttgcgacagctagaagccatcgaaactcatagcggaaagtttcgatgtaaatacaatacaatggagtga

SEQ ID NO: 6290 - DNA, 693 bp, Glycine max
  Peptide Sequence Number=SeqID_97975
atgcttgatgatggctttctacaacctgttctaaatttgatttctaattcagggactgacatcattctttggcatggaaaaactgggaagagtgttgggcatgttgatacaaatcaattgaaaaataacatggctactatatcacccaatggtcgttttattgcagcagcagcatttactgcagacgtgaagatctgggagattgtatatgctaaggatggatctgtgaaggaagttttaaatgttatgcagcttaaggggcataagagtgctgtgacttggttatgctttatgccaaactctgagcaaataatcactgcatccaaggatggttcaatgagactatggaatatcaatgttcgttatcatcttgatgaggatccgaagacgctgaaggtgttcctaattcctcttcatgattcttccggtactacactgcactatgaccgcctgagtgtttcccctgatggaaaaattttggctgcgacccatggctccacactgcagtggttatgtgttgagactggaaaggttctggatacagctgaaaaagcccatgatagtgacatttcatgcatttcatgggctcctaaacccattccaatgggaaatgaacaagttttggttttagccacagccagtgctgacaagaaagtgaagttgtgggcatctccatctatcccttcatcatga

SEQ ID NO: 6291 - DNA, 387 bp, Glycine max
  Peptide Sequence Number=SeqID_97976
atgagtagtggtaacgggggtggtggtagtagtagtggtactggtagcccttgtggagcttgcaagttcttaaggagaaagtgtgtttcgggttgtatctttgctccgtactttgattcggagcaaggtacaagccattttgctgcggtgcacaaggtttttggggccagcaatgtctccaagctccttcttagcattccagtgcataggaggcttgatacggtcatcaccatttgttatgaagcacaatcaaggatcagagatccagtttatggctgtgttgcccacatctttgcccttcagcaacagtttttcttttccctgcacactaagctaaccaagttaaccaggggaatcatagaactgaatgatcagtatcataattag

SEQ ID NO: 6292 - DNA, 2460 bp, Glycine max
  Peptide Sequence Number=SeqID_97977
atggtaaatggacttcttaaaactgcccaaggtgtccctcttggtgcaacgaccacagttttgccacctcgagcggaaacactaaaacatgaagccatgaagtgcttagttgctgttttaaaatcaatgggagagtggatgaacaaacaattgcgcattccagatcctcattcaggcaagaaagttgataatggccatgaagctggagttcttcccatggcaaatgggaatgaagaagagccagttgaaggatcagacactcattctgaaatctccaatgaggcttctgaggtttcaactattgagcaaagccgggcttataaactgaaacttcaggaagaattcctcatcaatgccaacaaagtgggtaattcaccagaggaaatagctgcttttcttaaagatgcatctgggttgaacaagactttcattggtgattatctaggagaaagggaagagttatccttgaaagtaatgcatgcatatgtggattcttttgactttcaagggatggagtttgatgaggcaatcagggcctttcttcaaggctttagattgcctggtgaggcacagaaaattgatcgaatcatggaaaagtttgcagaacgatattgcaaatgtaatccaaaagtcttttctagtgctgatacagcatatgtccttgcatattctgtgatactgcttaataccgatgcccacaatcctatggtgaaaaacaagatgtcggctgaagatttcataaaaaataatcgtggcatagatgatggaaaagatgtaccagaggaatacttaaggtctttgtatgaacggatatctagaaatgagatcaaaatgaaagaagttgatctggaatcccagcaaaaacaggctgtgaactctaacagactttcaggcttggatagtatattgaatattgtggtccggaagcatggggaagacagtaatatggagaccacaactgatgttgtaatcctaagattcatgattgaggtgtgctgggcaccaatgttagctgccttcagtgttcctcttaatcaaagtgatgatgaaattgtaatagcactttgtcttaaaggcttccattatgctattcatgtaacttctgtaatgtccatgaagactcacagagatgcctttgtgacttcattagcaagatgggaattacttacaagaagcttgggagcatatcttgaacatctacatcttctaggagaaggggccccacctgatgccacattctttacatttcctcaaaatgattctgaaaaaacaaaacaagcgaaatcaactattctccccgttttgaagaaaaagggacctgggaggatgcaatatgcagctgccacagtgatgcggggttcatatgatagcactggaatcagcagtaatacttctggagctgtcacatcggaacaggcattcacaacagcagcatatgatgaccacaaaaacattgtactcttggcttttgaaattatggagaagattattcgagattactttcctcacatcactgagactgaaaccaccacctttacagattgtgtgaattgtctaattgcattcaccaatagtagatttaacaaagagattagtctaaatgccattgctttccttcgattctgtgcaccaaaactagcagaaggagaccttggatcttcatcaatgaataacaagtctgagataaggcaaagcgccttgaaagtcctgtttgaaaccttatgcaaccatggccacctcttttcactacctttatgggaaagagtatttgaatcagtcctatttccaatatttgattatgttcttcatgctattgatccttcagggagtagtacctcagaggtcaatgaagtagagactgatggtcagcttgatcaagatgcatggctttacgagacatgcgcattagccctccaattggttgtagatctttttgtcaacttctataacaccatcaatccacttttaagaaaggtgttgatgctcctggtaagctttataaagcgccctcatcaaagcctggctggcattggtattgctgcatttgttcgtttgatgagtaatgctggggagctgttttctgataagaagtgtggaaactttgtgactgtcaatcatgagcatgcttcaatggctgaagatgacagggatcctgctgagtctggctcacatgataatttagaaagcccgaggactcaaaatctttatgcatatttatctgatgcaaagtgccgagcttctgttcagcttttattgatccaggcggtgttggagatctataacatgtaccgatctcgactttcagcaaaaaccatactagtcttgtttgaggctttgcatgatgtggcattacatgctcacaagattaacagcaatattattttacgttcaaagttacaagagtttggctctatgactcaaatgcaagaccctccactgttacgcctggagaatgcatga

SEQ ID NO: 6293 - DNA, 1212 bp, Glycine max
  Peptide Sequence Number=SeqID_97978
gcttcgtcggattccgatcttccttttttcttcctcaagtcatggccacactcaagagcgtctgcttcagaggatccacctttcccgtttgcccctccaatttcacgaacactagaaacaccaggtttctctgaagtgaaaaagcctctaataaggggcatgcatgagttaggggatattagcttttggattgaaccacttgaatttgaatcaacactgtacgcaccctttgcacttcagagcgtactggtgaatagttcagatagattgcggtgttttgtgcggacttctccagaggacataaaggctctgagattgataactgccattaaaactccatacctacctgatggtcgttttgatcttgaagcatatgatgacttggtgaatatgcagattggacaaggggctgaaggtgttattgttggtgggacaactggtgaaggccaattaatgagctgggaagagcacataatgcttattgctcatacagtcaactgttttggtgggaaaattaaggttattggaaatactggaagcaactccaccagggaagcaattcatgccactgagcagggttttgctgttggaatgcatgctgcccttcacataaacccttactatggcaaaacctccttggatggtatggttgctcactttcaaagtgtgctttccatgggacccacaataatctacaatgtgcctgcacggaccggtcaagacattcctccgcatgtaattcaaaccttagctgaaagtgttaacctggctggtgtcaaggagtgtgtgggaaatgaccgaatcaaacagtatacagatgatggaattgttgtgtggagtgggaatgatgatcaatgtcatgatgctagatggggttatggggctaccggagtggtatctgttgcgagcaacctggttcccggtttaatgcgagaactcatgtttggcggtgtaaaccctactctaaattctaaactcttgcctctgattgactggcttttccacatgccaaaccccattggtttgaacactgctcttgctcaacttggggtcatcagacccgtttttaggctaccttttgtacctctccctgtggacaaaaggatagagtttgccaatttggtgaaggaaattggtcgagagcattttgttggaaataaagttgttgaggttcttgatgatgatgactttttcttggttagtcgttattaa

SEQ ID NO: 6294 - DNA, 129 bp, Glycine max
  Peptide Sequence Number=SeqID_97979
atggaaagtgtacttagcaaaaatggacatttctacgtgtctgtctacgtccacacccgatcgatgctccacgaactcaaacgatatttctcgaaaaagaggataatcggcatgagggaagagtcgtga

SEQ ID NO: 6295 - DNA, 654 bp, Glycine max
  Peptide Sequence Number=SeqID_97980
atgcagttgaggtttcagcttcaggggagaagctctgtaacgaagggaaaacaagggagggttaaggagacagagggtgttttgaatggagcagtttattctcactgccatggcttcttctcagttcagaagattctcagtgcttacaccaccatcaccgccgatgccattgctcgcttccagaacaagatgcacggtatcacgcacatggatgctgccctggacgcaatgcgtccacttggatttaggacacaactgattcttcgaacggttaatgagcttctcgatgagcttcttcaggtgtatggtggaaatcaaggatggtgctttattgaagaggcctattacaagctcctaatggaggccctacttagcaaacaacaaggttctgcagaatataagtttggtaatcttggaactgggcgtggcacatccgtgcttgaaatggttgctgcctttgaaaaagcttccggcaagaaaattccattaaaaatgtgtcccagaagacccggggatgctactgctgtatatgcatctacggacaaggctgagaaagaacttggttggaaggcaaaatacggtatagaggaaatgtgcagggatttgtggaattggacaagcaaaaatccatggggataccaggggaagcattaa

SEQ ID NO: 6296 - DNA, 246 bp, Glycine max
  Peptide Sequence Number=SeqID_97981
atggataacctctctatccttccaagggagaagttccagaagcaagaaggagtggttcagaaaatttatagtcaaattgtctcatgcctttccattgagagagaaaggaaaagcacagagtctagtgtactccattggtacacagtttcatctcaccgtattagtcaacttgatgaacttcctcaagtgttgcgtaggatcttcatggatagtgccactgaatgggttgttctcgagcatttgtag

SEQ ID NO: 6297 - DNA, 864 bp, Glycine max
  Peptide Sequence Number=SeqID_97982
atggactacctcacaacacttctgctactgattagcatagtgagtgcaagcattattcgcatattcattcgtagatttgaatctgtaaggcttccaccagggccacgtccatttcctatcataggaaacatcttagaacttggcataaatccacacaaatcacccaccaaattgtccaagatttatggacctcttatgactttgaaacttgatagcattaccaccatagtcatttcctcccctcaagtagctaaacaagtattgcataaaaatggccatgtcttttctagtagaacaatcccacattcagtgcaagcacttgaccatcatagattttctattgtgtggttgcccccatcacccaaatggaggaaccttagaagagtttgtgctacaaaagtattctctccacaacttcttgactccactcaaatccttcgccaacaaaaggttcatgatttattggattttgtgaaagaaagatgcaagaaaggtgaggttattggattttgtgaaagaaagatgcaaaaaatcttggtcaatgtgtgggccataggaagagatccaaccatttgggagaatccagaaatgtttatgcctgaaagatttttggagtgtgagattgattttaaaggtcatgactttgaactcattccttttgggacaggcaaaaggatatgtcctggattgccattagctcataggtcaatgcatttaatggtggcatcccttgtgcataactttgaatggaagctagctgacgggttagtgccagaaaacatgaacatggaggagcaatatggaataagcataaagagggtccaatcccttctagttgaagccatttcaatcaagcacgattag

SEQ ID NO: 6298 - DNA, 998 bp, Glycine max
  Peptide Sequence Number=SeqID_97983
atggcgggaaggggcgccgacagcaaaattcttggaggaactggagggaagatctttatccccaaccggaggaacaaagaggggaggagatacggatttgttcgcctcaaaggagtagcagatgcgagaagtgttgaaaaagaccttgataatagtttcattcgggggctaaaattacacgttaatattcccaaatacggacgtggtgaggcgatgaaggaacaaactcaacacaagcttacgggtgaaaaggcggccatggctgtaaataagtcaaatcactcgagtagggaagacaaccacttcgctggtgatgacagaacatggtctaggctttcgttgaacatctcggagaaagacaaggttcgttatcaaaacgtctgggttggtagactgaagaagttggagattttcaaaagattggaagaggaagtagcttggcatgtaggtccaggcatttcggccaaatacctgggtgatgatatggcccttcttctcggcctatcagataagagagcagctgagatcatacgagaagagaccgaacagtcttcatcactactcgtttggattcgctgttggggtatcccggtgcttgcgtggaagacggaatatatgcgtaggatggtggcggcagtgggtgatctcgtcgacgttgacgacgatgtggagcacatgcagcgtctagatcgcgccagggtcctggttaggacaccgtggccgccgttaattcagcacgtcacgctcgtccagattgatggcatgagtcattgcgtctacatcgtcgaagaaaatgggggtatggagctaaccggtaaccgccatgggaggagcttttggggttcatctgaagaagttctttccgatgtagcagatgatgacatggacactgtttgttcatggtcgacagggatacctctgtcaaggggtgccggagaacctgttggtgaccctatcgttgaacgccatgacacgcagtcaccacctttacccactgg

SEQ ID NO: 6299 - DNA, 900 bp, Glycine max
  Peptide Sequence Number=SeqID_97984
atggtggttgtgggatctattcatggtatcagtctcttcactcatgatagtaaggttgctagggtgttgcatcttttctacaggttggttgtccagccaaatacatctagagctcacacatttgcggaagaattcctagcatgtggtggcatagaaactcttcttgttctgctccagagggaagctaaagctggagatagttgtgttctggaatcattgtcaatgaatcctgaacctcaaaaatctgagattgatagtggtaatgaaatgacaaaaggaagtcaggaggatgatgggtcaaaggacaaaagtgaagccatcatacaagacaatgaccaaggttttctatctgttgatagtggtagtagccctgatcctagttctcctgatgttaacagtgacaggatatttgcctctgaaattccttctgccaagaatttgggaggcataagtctatccattagtgcagacagtgctagaaaaaatgtttacaatgttgataaaagtgatggcattgttgttgggatcataggtctcttaggtgctttagtagcttcaggacatctgagatttggttcccgtgctggtcctgatacaacaagcaaccttttgggtgttggactccatgacaaaggtggtactatgtttgaagacaaggtttctcttctactttatgctttacagaaggcttttcaagcagcacccaacaggctaatgactaacaatgtttacacagctttgttggctgcctcgatcaatgcctcttctgcagaggatgggctaaacttttatgattctggtcatcgctttgagcattcacaacttttattggtgcttttgcgttcccttccatttgcacctaggccactacagagcagagcactgcaggtattagcctaa

SEQ ID NO: 6300 - DNA, 339 bp, Glycine max
  Peptide Sequence Number=SeqID_97985
atgactgcactgaatccggatcagcgaaaaacgctatcggatcttgctcggacgacgaattcaagcaatcgaatcgactcggatcgcctcgcattgcgagaacggatcaagaaacagaagatctctccgcaacgccgcgcgcattcatgcacgattcgatcgaagcttgcaaagtcaaaggaaaaaaaacgcacggatcgtaacgaaaccgacattgctgcttcggatatgcgtaaggcaaagaagaatgaaatagtggttacagttagcgtaccttctagaagactccggcacggagtggcgttcgcttccgatcgtctgttccgatcaaggatttga

SEQ ID NO: 6301 - DNA, 1179 bp, Glycine max
  Peptide Sequence Number=SeqID_97986
atggtctcacgaaaacgccaagccgtgcctgcacaaggaggagaatccacctgggattcttctcggttcacttctgagatcgcttggcacaggtaccaagataacgttcacctccggaacattctaccggagaggaacgtggagctggcccccggtatgtttgatgattttcttagggagctccagaggaggcagtggcaccgggtactgaccaaactcccggagaagcaaattgatgttgccctggtcaaggagttctactccaacatttatgacccagaggatggatcccataaatactgcagggtgcgaggacatgttatcaggtttgacgctgagacgatcaatgacttcctcgacaccccagtgatcttggctgatggagaggactattcggtgtactcccagtacctacatacgtacccagaccatcaggccatcacaacagccctgtgcatacctgggggtggatttgttctaaacgctgatggcgccccctggaagctattgaggaaggatctgacgacgctcgcacagacctggagcgtactctcttattttaaccttgcccctacttctcacacttctgatttgaatgttgacagagcgcgactgatatacgggttggtgatgaagatggacatggacctgggcagtttcattttcgatcagatcacccagatcgcccagtccaacacctccagacttgggttcccagcgttgatcacagcactttgtgacgctcagggggtcgtctctgacaccttgacctttgagtcattgagtcctgtgattaacttggcttacataaagaagaactgttggaatcccgcagatccatccatcacatttccaggggcccgtcgtactcgtgccagagccaccgcaccagatgccctacctccttcacagccaccatcccaggctgtgcatcatcaacagacatccactttagctccgctagacacacatagccaaatgctccagtccttatatcagggacaacagatcatcatacaggacttgcatcgactgtctcttcacctgaagatggacccaccactcacgaccccagaggcctatgttcagcaggttgcatggccaggagtccagccctctactaataggggggggggggggggagccttttggagtccaagacaccatggttggagctga

SEQ ID NO: 6302 - DNA, 109 bp, Glycine max
  Peptide Sequence Number=SeqID_97987
gatgtgggccaggcttctatcttcaacaaatctgtccagctttacgattgttaaggctgtctctgaagacaaaaggcaagaagaagcaaacggtcatgtccctgagtaa

SEQ ID NO: 6303 - DNA, 654 bp, Glycine max
  Peptide Sequence Number=SeqID_97988
atgaaggcatattatgataagaagctacagaggaaagaattccagccaggacagcaggtattactctttaactcaaggctaaggctattcccagcccaacaggtgcaaacaacagcagtaggggcacaaacagcagaaaaggagtgggctacacgaagccacacgcttagcgctcatataggcgctaagcgcgcatatgatgtcatctgcgctcagcacgtacacccactgagcgcccagggaataccaagggacacttcccttggtgcgcttagcggctcctgcgcgctaagcgcgtataccataactgttgggcagttgcccaacccctcaacttccctctgctcgtttttaaattacaacgacatcaatttttctccctttcccctttcctgcgcattcttactccctttgcactctttctctgcgttttcctgcgaacatactcaccttcctagtcctttcacgcaattttcacgaaaagaggtaccatcacgctatgccctacaaagaggcttagcgagaacaggcaacttcaataagaaaggggagcacgctaatcctgcccaaacagcaaatggaacaccatgcaccgaggcgctaaacacgctcatgactttaacaaacgcgctaagcgcgcaaccatggcgctaa

SEQ ID NO: 6304 - DNA, 687 bp, Glycine max
  Peptide Sequence Number=SeqID_97989
atggacctagacttgggcaacttcatttctttgcagatcagtcagatcgcccagtgcagcacttccaggcttgggtttctagtgatgatcacaacgctgtgtgacattcagggggttgtctctgataccctgatttttgagtcacccagtcctgtgatcaaccttacttatattcggaagaactgctggaaccccgccgacctatctatcacatttccaggggtccaccgcacacgcaccagagccccagcatcagcatcagaggcttcttttcctcctcagcctccttctcagccttcatctcaggcacctattcctccaccggcatccacttcagcattgttggatatgcatggacagatgcccagatggatccacctctcacgactccataggcctatattcagcaggtcgcatggccaggagcccagccctctactcatagtggggggtagccttctggagccgaagccagagccggagaggatgctgcagttgatgaagaccttattgctgacttggcagcaacaaattggggcccatgggcagatctgggccaaagctgcacatgatcttagttttctatgtctttatcttgttctgaatggtacaacacttgagatgctactgatcattggagaaacactggttctggaagcaaaagtcaagtcaagaaatggaacatga

SEQ ID NO: 6305 - DNA, 360 bp, Glycine max
  Peptide Sequence Number=SeqID_97990
atggattcctctggggcaagaagagctgacttaagagccaaggcaaaagctatggcagagaagcctcgggttctgcttgctgcttgtggaagtgtttgtgcagtaaaatttgggaatgtttgtcgtagttttgcagaatgggcagtggtgaaggtagttctcacaaaatcagctttgcgttttattgatgaacaaacacttccccaggatgtaactgtatatcgtgatgagaaagattggagaacttggaaaaagctaggtgatcctatgcttcacattgagctctgtaattgggctgaaatcatggtcattgctccattgtcagcaaatactcttagcaaggtaatcaatcaaacttga

SEQ ID NO: 6306 - DNA, 1683 bp, Glycine max
  Peptide Sequence Number=SeqID_97991
atgagggtcgaggagcatactaccaactcaagaatccaaacaggtgatgtgtatcataggtcaacacaacatgtcacccctctcaggacatatgccaatgtggtagcctcaacagcaacagacgccggacagaggaagcaatttcaaccccgatataccaaccaaaggcactcacaatcgacagtccaactcgaagtacaatgggaggaaaagaaatggcttacagaagcatgggcgacgatactccttcttggactttcagactccaaagcagaggaaataatcaaagatgaagcacagcatggcacatctccgttccactcgttagaaaagtggaaccagaggacaaggccaggttacagagtgatatgggctcagtgctggggaattcccctagaggtgtgggacatagggagtatatggaagatagtagttgcggttggggagcttgtcgaagttgacgatgatgttgaggatttcagaagactagacagggcacgagttctcatcagaactccatggagcccgttttttcaccacacagtgcaagtaacgattggaggggagatccacatggtgtctatcattgaagaagcttcagctgatgcaagaacgcgcgctaatcgatttcgcatggcaatggagttgtcggaggacatacactccgatgacctcgataccgacgctgagtttgattcggtgccggcaggtcaccctttcttttgccagccaaacaaccccgacgacgaaggaatgcagagcctccccggagacggaagggacaacaccgataatacccatcgcgcgctgttacccgacatcccaagatcaaacggaagtccgatgggtaataccctacagacatctggcctcgaaaaccgtgagcgacctgaacctgggaaagcaaaggtgcctccacttgcgccacaaatccctgcatacccgcatgcacaattagggaaagtcaacaaagacgaggctggaaagaggaaagaagcaaagaccaggggtgtctcttcagaagtggaagagagagcagttttcgctgataaggaaagagacgttgaaggccaaaaggatgatgaccaacacagaaatatagggccaaaaaatatctcagcagctttgccacgtaagagtcacataaggggtattgaagaaaataaaaagttgggccatcttaaccaaaaaccagcaggcccaatacctcaggaaagtagtaggaagggctcaatgcagtcagtaattgtgtgtgacatacagcaacctccttgtgggccaacaaatcaaatgggcctccctaatcagatcagcgccaacagcaaacaacaggaaaataacacccatgttattcataattccagttgcagcaacgaatgtaaagtttttgttagaagaaaggtgtggaatcagaaacagggccaacagaggggtcatcaactcccccagggcaagtctccaactttggacatggcctcaacatctacaggccatggaaagcagcctgataacaacagtacagacaaggcagaaaactctaagggaacctctgaaaatacaagacaagtggcatcatctcaatgggaggtagcaaaaatactgggggtaatcaacaactcagtccatgaagctatcatcaacaagatagatgaaatggagaaaagagacacaaaggaggcttag

SEQ ID NO: 6307 - DNA, 597 bp, Glycine max
  Peptide Sequence Number=SeqID_97992
atggagaggctgtgcaaacaatccttttttatgtctatgccaaaccatgcaatgtcaccaatctatgaagcacggggacacatgttaggtggcattccctgtttacggtactgcacaaggatagcgacggggatgggatggatacggccagggaacggacgtcggtgttttagaatccaacgaaggtgtgagaaggttcacagaggaatctgcgaagtctcatcggaacacggaaacaaatgtttcctttcctttttatatgcctcaccaactgattggtcaataagaacttccttgtgcgttgaccacgacactcacgctaagcgcgcatttccacctggatcaagtgatcacgcaataagtgcaggatgtgtacttatcgcactagctcatgacaattgtcttccaaagtggcttcttgcgctaagcagcttgcttgagctgagcgattttgactcgttgagggaagagatcgccctgagcacgacacttcagttcatgaatcctcttccaagcatttgctacaactctacaaaaaatataacgagaattactctaaaaaccattaactttagtatctcctggataaaaatttag

SEQ ID NO: 6308 - DNA, 855 bp, Glycine max
  Peptide Sequence Number=SeqID_97993
atgacaggctgttacttccctgtgaccttcgatcggtcccgcagtcgcaggggtagcctcagaaagtttaaaaatttcatgtacataattcagaaaatgctttttcaaaagacaaaaagggagtgcaggaagcaactgcgaagtgcaggaagcaatagcctaagagctataaacccaacaagtgtttataatagcccaattacttgttcatctaaacatcggagaagagaaagtcataaagggcctccggttgtgtgctttggggagatgatgatcaatctggtccccacagtagcaagagtgtcccttgcagatgcagccgcctataagaaattcccttctggagccactgccaatgttgctgttggaatttctagacttggaggctcagcagctttcattggcaaggccacgatatttcattatggttcagtaagtttgattaaggagccttgtaggtcagctcaccttgcagcaatgaatgctgccaaagtgtctggctgcatcctttcttatgccgcaaatttggcattgccactatggccatcaaaggaggctgctagacagggcattatgagtatctggaactacgctgacatcattaaggtaagtgtggatgaaattcgactcttgactgaaggcgatgatccttatgatgacgtagtgatcatgaagaagctgcaccattacaatctcaagcttctgcttgtcaccgaaggagcacgaggctgtagagactacaccaaggttctgatccataacaaaatcttgcatgatctctattctgcttatgttcacaagcataatgctataataaatgctactgataggaacttggtattaaggggtgtctaa

SEQ ID NO: 6309 - DNA, 303 bp, Glycine max
  Peptide Sequence Number=SeqID_97994
atggatgaattgcttttggtgtttcaaaatccgtaccgccagctacacacaacaagatcatggaacttcattggtttacctccaacagccaagagaaaattgaaatcagagagtgacataattgttgctctttcggatacaggcagggttcacgccttaaaagcttcaaggaagatggatttggttcaccaacatgatggaaaggatcttgtagccactatgcaaatttctcaggctgcaataagtaaattctctttccttgtatacattgtcactgcattctcagtgataaagaatctttaa

SEQ ID NO: 6310 - DNA, 1032 bp, Glycine max
  Peptide Sequence Number=SeqID_97995
atggaagggagaatgggactgttgtttcttgttgtattaggtgctgcttgggcatgtgatgcaagggaactggctaactctgaaacttctgaactaagcataaaaccggatgtgtgtgcactttgtgaggaatatattaccaaggcacttgattatctacatgaaaacaagactgagacagagatcattagtatcctgcacaacacttgccaccagcttccttctttcaagcagaagtgcgttgctttggtggactattatgttcctcttttcttctcggaagtagctacaattcagcctggagaattctgccacaaagtcaatctctgtcaggacattgcacatatttccttgaaagttcaagaagatagctgtgagttttgcaaagatactgtttcaactctattggagaagttgaaggagagtgacactaagctagagataattgagacattactgaaggtgtgcaattcagtggagaagtatgcaaataagaaaagtaactactatactttcattgataattgttctggaggtatattaggcctaagacatggtccatggtccacaggagacacacttatgaagttgatgcccgtggatttgctaggggcatccagcagaattgctggtgcacccagcaaattttcaaaatcacaaaaatgcccttcagcgtttttggcaaacttcttccgtggagtcccacggaagatttcttccgcgagtgtcaacggaagaagaactgcggaagaaccttcttccgtggaattacgcggaagaacttcttccgcgagagtcaacggacgaaggttcttccgtggaattccacggaagaagttacacacactccagtcacacacttcttcctctatccatttctctaactctgaccatgcaattggcgttgatctcattgcattctctgtagaaatgacgaacaaggccaaaggaaaagacaaggaggtcaccggaaaaggttctaccgacaggtgcaaggacgccttcgacgatgacaagaccggtggcggctga

SEQ ID NO: 6311 - DNA, 345 bp, Glycine max
  Peptide Sequence Number=SeqID_97996
atgacattctatgcaggtttctcatcgacaagaatgtcaaggaaaaattatgtcatggatgcctggggaagtttggttgattgttgttccgagcatcagttcgatgattgccttaagaagtttgaaatttcttgttcaccatggcccatgtttgttgcctatgttaacaaaacgtggataattccccataaggaaaaatttgttacagcatggacgaatgatgcacttaggaaacacaacaacaaacaggtagatgcaagctccattggagcttgtaggcctaggatcttcttcatcaatggattcctttacttcttggaagatgaatggcagcggaatgaataa

SEQ ID NO: 6312 - DNA, 415 bp, Glycine max
  Peptide Sequence Number=SeqID_97997
atggctttggaatggtggtcccagaggaagcgttttgtacctgtcaaggttcctgggttgtgggaccttcatcttccctatgaagagaaggttgggccccaggccaggctaccctctccaaaaactgctcaatggaaagcatggatcctggaggcgccaccacctgtaaactctgaagtcaaattaatgctcgggctcaagcgctcaaaagtgaggttgtttgagacaacccttccggctcgacatagggcaatgatcagagcaggaaacccaagtcaagaagagttagattgggctatagaagttgtctggccagaaatgagcactcctatgttcatgtccatgcaagagactaagccaaagattagcctagctctatccattgtcagtcagatgtgtgagatatgggggccag

SEQ ID NO: 6313 - DNA, 1845 bp, Glycine max
  Peptide Sequence Number=SeqID_97998
atgcaaaccaaacccattcacaacaccccaacatacattcctccacccataaggccatcaccaccggtgcaccaaccgcctccctctataccacctaccaaacctcgtgcagtatctatatccgcacctaatactcctgttgccgtaccaattcctccaattgtagagcctgatgactccaatgctgcctattatgactaccaattcttgttcatatcacaaagatccgaaacaagtcaacccgtcactctaagcaccgtggaaggcgtgatcccagccgatttcccatccggcacgtactacctaaccggaccggggcttctggccgatgatcacgggtccacggtgcaccccctagatggccatggttaccttagggcattcacttttgataacgctactaagaacgtcaagtacatggctaagtacattaagacggatgcacacgtggaggagcatgacccaaagacggacaagtggaaatttacacatagaggcccattttccgtgttgaagggtggaaaaaaggttgggaacactaaggtcatgaaaaatgtggctaacaccagtgtactaaagtggggggaaaagctcctgtgcatgtgggaaggtggggaaccgtatgaaatccaagctggtacgttagatacgattggacggtacaacatgatggatggtgctgatttggaaaatcatgatgagagcaaagatggtgttgatgtatgggaggttgctgctaacctattgaagcctatattatatggagtgtttaagatgcccccaaggagactcttgtctcactataaggttgattctagaagaaacaggctactcaccgtgtcttgcaatgctgaagacatgttgcttccacgcagtaattttacatttgccgaatatgactcaaattttaatgtagtacagaagcaagttttcagaatcccagatcacttgatgatccatgattgggctgtaacggatacccactatatagtatttgccaatcgcataaaacttgatgtactgggatccattgcagcagtgtatgggatgtctccaatggtatcagcattaagggtaaacccaagtaagagcacatcccccatatacctgattcctaggtttccagacaaaaataaagacaaagagagagattggagagtaccatttgaagcaccttcacagttgtggctgctccatgttggcaatgcctttgaaattagataccctcatcggaatttggacatacaaatacaagctgctgcttgctcttaccagtggttcaatttcagcaagttatttggatacgactggcaaaagaagaagctggacccatcaataatgaatgtaaaaggtggaaatgagttattgccccatcttgttcaggtgtctataaaattagattctgactacaattgccaagaatgtgatgtgaaaccgatgaagaaatggcagaaatcctcagattttcctgctaccaacccaacgttttcaggcaagaagaacaaatatctctatgcagcaactaccttaggatctcgcaaaacattgccatgtttccctttcgataccgttgtgaaattagacctagagagtgataattctgcccaaacttggactgctggaagtagaagatttattggtgaacctatttttgttcccaaaggtgacgaagaagatgatggctatcttcttgttgttgagtatgccgtttcaatgaatagatgttacctcgttatcttggacccaaaaaggataggagcagataatgcccttattgcaagaatcgaaattccgagccacttgaattttcctctaggttttcatggtttctgggcagctaattag

SEQ ID NO: 6314 - DNA, 522 bp, Glycine max
  Peptide Sequence Number=SeqID_97999
atgttttttcacaagagatggtcccgagaaagcttccatcaaagaggtccaggaaggacgccactagagaaggctccagcgctgcccaaccagctgacacggattttgacagccaccgattctggagcgctgagcatcagtagtgcttcgagaccatcaagggatggaggagatagtcatggagttttacaccaatgcctagcctaccgaggagggagctcgggatatgcgctcctgggccattgctcagcttttgtgtataccggggcagtatttcgcccggaccgctgggacaatgttgttgcttggttctttttcttgcacaataatcccaaaaactacttcaaagaaatagttaacattgctttaaagggattcaaagataaacacggaagtaaatccaaggcaaatgctaaatggattccagttaaatgtaataagcaaaaaggaagcactgtttatggctattacttcatgcattggatgtcaaccatagtcctagaagatttcaaggataattga

SEQ ID NO: 6315 - DNA, 126 bp, Glycine max
  Peptide Sequence Number=SeqID_98000
atgaccacagatcgacctccacttcctatgtctcacacaggcccgggtcgacaagggtgttgcccttgctcttatatatcctcaggtgcgatgaagaattcatacctacgtagttctttaaagtga

SEQ ID NO: 6316 - DNA, 193 bp, Glycine max
  Peptide Sequence Number=SeqID_98001
gatcccacagactgtatttggcctgtttcatgattctcatcagtttctctctgggttccttgttgaaccaattatcagacttatcaaggtaatccttgtggcgtctacccagacttatcttccttcactggaagtggcgtctaccatgacttatcttccttcactggaagtggcgtcatccaaaccttcgtag

SEQ ID NO: 6317 - DNA, 78 bp, Glycine max
  Peptide Sequence Number=SeqID_98002
atgtgtaaggttaagtggtggctggacagaaatatagaaatggcaataactgaagctacagggctccaaatgaggtga

SEQ ID NO: 6318 - DNA, 273 bp, Glycine max
  Peptide Sequence Number=SeqID_98003
atgccttacctcttggcgaaaaaggcgagaaaagcgtcgatcgctgctaggtccaccaacccatccacattcggaaagaaaactcctccgaagatcaacactgcgagaacgtctatgaatggggtggttggaataccaagaaagtatttggaggctaaagcaagaatcttggcaggtaaaggcgaatgggccccgcgaagttattgcgtagcgctgttcgccaattctccatcctccacttttattcggagacccatgaatttaattgcctag

SEQ ID NO: 6319 - DNA, 492 bp, Glycine max
  Peptide Sequence Number=SeqID_98004
atggacatcctggcactcttgatcatcggggtggtcctctttccaaatgtggatgggttggtggatcgggcaacgattgatgtttttctcgccttttacgactacaaggaaagcccggttgtcactatcttggccgatctatatgacacgtttgaccgaagatgtgagaagagtagtgcaagaatcgtttgctgtacaccggccctctacatatggttggtttcacacctttttcaccaagaggtgagacacgtttgcccgctagaaggccaccgctcatgcaccgagaaaaaggaggcaaactgggaccaaatcttagcaagcaaagaaggagggtctgtcaattggttcccccgatggaaagaaggaagaactgggattcttatttcgtgtggggaattcccaaatgttcccttgatggggacgaggggttgcattaattacaatctcgtcctcgctgatgcaatcctaccccctaaggacattagatag

SEQ ID NO: 6320 - DNA, 210 bp, Glycine max
  Peptide Sequence Number=SeqID_98005
atggaccaccagcagcaaggcgcacaacacccaaggggtgcaaactacccaacagttatgatccacccaagggtaagatgtgaatcaaggggacatgacccttgggaacagtcacaaccaaccattatgatccgcctaaggggtgcaaggtcaggagatgcgaatcaagggggcatgacccttgggaacagtcacaatcattcagaatag

SEQ ID NO: 6321 - DNA, 99 bp, Glycine max
  Peptide Sequence Number=SeqID_98006
atggttcagcctaaaaatatgaataagaaggttaagtggtggctggacagaaatatagaaatggcaataactgaagctacagggctccaaatgaggtga

SEQ ID NO: 6322 - DNA, 486 bp, Glycine max
  Peptide Sequence Number=SeqID_98007
atggcacgcagagacaaattatggtcattctgcgcccttttgtcatccagaggcggcgagcccgatgacatgcgaagacaaattatggtcattccggacactttttcgccattcagacacgatcgtgtccgatggcacgcaaagatggtcattctgcgccttttgtcatccagaggcggtgagcccgatgacatgcggagacaaattatggtcattccggacaccttttcgccattcagacacgatcgtgttagatggcacgcagagacaaattatggtcattatgcgcccttttgtcatccagaggtggtgagcccgatgacatgcggagacaaattatggtcattctgcaccttttgccatccagatacgatcgtgtccgatggcacacagagacaaattatggtcattctgcgcctgtcataccctaatttcgtccggggacctttgctcgatgacgtgcgaccattctttggtcctcgtgag

SEQ ID NO: 6323 - DNA, 163 bp, Glycine max
  Peptide Sequence Number=SeqID_98008
gtcgactctagaggatcccacctccattccactgccattcatcttccaagaagcaaaggaatccattgatgaagaagatcctaggcctacaagctccaatggagcttacatcaaaattctcctttgcgctaagcgtgctaaagctgcgcttagaagtggataa

SEQ ID NO: 6324 - DNA, 450 bp, Glycine max
  Peptide Sequence Number=SeqID_98009
atgctaccccgacctgtgagaagtcaggtagcatgtggagacactatatacggtaatccacacacatttcaaagacaaaaatgtcttcagtcattgcatgccttcaaaggcaacaatgtcctcacacatttcgaagacaaaaatttcttcagtcattgcattccttcaaaaggcgacaatgaccctcatttacatttcgaagatggcaatgtcttcagtcattgcatgccttcaaaggtgacaatgtcctcatctacatttcaaagacgacaatgtcttcagtcattgcatgccttcaaaggtgacaatgtcctcatctacatttcaaagacgacaatgtcttcagtcattgcatgccttcaaaaggcgacaatgtcttcatttgcatttcaaagacaacaatgtcttcacctcaaaaacttcaatatctatttcccctatgctctgtag

SEQ ID NO: 6325 - DNA, 114 bp, Glycine max
  Peptide Sequence Number=SeqID_98010
atgggcttgaaatctaccctaaggctcatgagaaccctagggtcttcccttggatctctagccaatctacttggagtcttctacccaatgcccttgcgggctcacatggggtga

SEQ ID NO: 6326 - DNA, 1113 bp, Glycine max
  Peptide Sequence Number=SeqID_98011
atgattacccgagggcaaaaggtgacggagatttccgagcagcttaacctgagcccgaaaaccgttaatagctatcgctatcgcatgttcagcaagttgaacatcagtggtgacgtagagttaacgcatctggccatacgccatggcctgttcaatgcggagccgttaatcagtagcacggtgatctatgttggtaaagccaaagaccttaaaaaacgcctgagcagctatttccgcacgcaggtgggaagccgtaagaccgaagtgctggtcagcaacatccataatattgatgtcacggtcacccataccgagaccgaagcgctgctgctggagcacaactacatcaagttgtatcagccgcgctacaacgtgctgctgcgcgatgataagtcgtacccctatattttccttagcggcgatccgcatccgcgcctggcgatgcaccgcggtgccaaacacgctaaaggcgaatactttggtccgtttcccaacggctatgcggtgcgtgaaaccctggcgctgctgcaaaaggtgtttccgattcgccagtgcgagaacagcgtctaccgcaaccgctcgcgcccgtgcctgcagtatcagattggccgttgcctcggcccctgcgtcgccggcctggtgagcgaagaggaatatgcgcagcaaaccgactatgtgcggctgtttctggccggtaaagacgatcaggtaattaatcagctggtgcagcgtatggagcaggccagcgtgggcctgcgcttcgaagaggcggcacacctgcgggaccagattcaggcggtgcggcggattacagagaaacagttcgtctccaatcagggcgatgatctcgacgtgatgggcgtggcctatgacgccggcatggcctgtctgcacgtgctgtttatccggcagggcaaagtgctgggtagccgcagctatttcccgaaggtgccggcggacacggaactcaccgaagtggtgcagacgtttgtcggacagttctatctgcagggcagcgaagcgcgtaccttaccggcggacatcctgctggacttcaatctgcctgagcgggaactgctggccgcatcgctgagcgaactggccgggcgcaag

SEQ ID NO: 6327 - DNA, 234 bp, Glycine max
  Peptide Sequence Number=SeqID_98012
atgggtgttaagtacctcgacgcggtcaagcgaatgttgcatcccaccaaacagatggttattaggagatgcattccagaccatgagatcgactcggtcctgcaattctgtcattcttccacaccaagtggccatcttggcatacagaggacagctcgcaaggcggctcactttcatggagacagcaaatgcctcaataacccatgttgttctatgaggtgtttgatgtctggg

SEQ ID NO: 6328 - DNA, 246 bp, Glycine max
  Peptide Sequence Number=SeqID_98013
atgcaaaggttgggacttgtgttagttgtttatgatgatgtctctagaatatgtccagtggatttaatgatgaaatatgtgcaatttcagtgggctaagcatgcatccatcgttaagcgcagcttcagcgcgcttagcgcgatagaagaatctggtagagcatcaatatcaaggttgcttgctaagcacgagatcagtgcgctaagcgcgagggtggcgctaagctcagtgcatgactggcactaa

SEQ ID NO: 6329 - DNA, 495 bp, Glycine max
  Peptide Sequence Number=SeqID_98014
atggagagaagtatgatagatgcttccagtggtggagcccttggagacatgacccttgctgaagctagaaatttaattgagaagatggcttcaaactcccagcaatttagtgccagaagtgatgctattgtcattagaggagtgcatgaagtagccacgaattcatcttcatcagctgagactaagaagcttgaaggtaaactagatgccttagttaacccgcagcaacaacaacaacaacagccttactttcagaatgttgttggcccaagcagaccatacgttcctgcaccaatccagcagcaacaacaacaacagcaacaaccccagaaacaacaaacagttgaggctcctccgcaaccttcccttgaagaacttgtgaggcatatgactatgcaaaacatgcagttccaacaagagaccagagcctccattcagagcttaactaatcagatgggacaattggctacacagttaaataaacaacagtcctag

SEQ ID NO: 6330 - DNA, 474 bp, Glycine max
  Peptide Sequence Number=SeqID_98015
atggctccgagaaagctttccgcaaagagatctaggaaggacgccacggctgaagggactagtgccgctcccgagttcgaaaaccatcatttcaggagcgcggagcaccagcagcatttcgaggccatcaagggatggtcattccaccgagagagacgcgtccagctcagggacaatgagtacacagatttccaggaagagatagctcgctggcgttggacgtcgctgatcactcccatggtcaagtttgacccagatgtagtcttagagttttatgccaatgcttggcccacggaggagggcgtgcgggacatgcggtcatgggtaaggggccagtggattccttttgattcagacgccctcagccagttcctgggagacccgctagtgttagaggagggccaggagtgcgagtatagtcagagaaggaacagggccgatgatgcaatcctaccccgcaaaggcattggatag

SEQ ID NO: 6331 - DNA, 545 bp, Glycine max
  Peptide Sequence Number=SeqID_98016
atgggggcagcttggctaatgttgcagagaattatgcttttgcataatcggcttagcgagaggctgcctgctaagcctaacaatttccgcaacagatgtgtgctaagctcagtagggttacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 6332 - DNA, 789 bp, Glycine max
  Peptide Sequence Number=SeqID_98017
gcgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcgacgcaagaatttttttttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcatgcgaaggatgtccaaatgttctccttgatgggaacaaggggttgtattaattataatcccgtcctcgccataagacagcatggctaccccatgagaggagtgccatcagacgaaagcatctcgcctttcatcgcacggggtttcagtgactacaacgcaagggacagagagcttaggggaagcagtaatgggatcatcagcggctatcataagtggctgagagtccggacacaaggattggattgtctcccaaatctaaagactgtgagagacaatgaggttaaagcttcgaaagaaagtgatgaggtacaagcgctaaaggaaaagcttgaaagagcccgggtagtcaaagagaagttcaagtccatagccatcaaagtctga

SEQ ID NO: 6333 - DNA, 1782 bp, Glycine max
  Peptide Sequence Number=SeqID_98018
atggcatttaaaggctatttccttatcggcctcattgctattgttgttgtcacttccaaagttacatgcgaattagaagcagaaacagtttcacctattattgacatttcactcaatcggaacagtttccctgaaggcttcatctttggggcaggatcttcctcgtaccagttcgaaggtgcagcaatggaaggtggtagagaaccaagtgtatgggataccttcacccataattatccagctaagatcaaggatagaagcaacggagacgtggcaattgactcatatcaccactacaaggaagatgttggcatgatgaaggatatgaatttggattcatatagattttccatttcttggtcaaggattctcccaaaaggaaagctaagtggaggtataaatcaagaaggaatcaactattacaacaaccttatcaatgagctactagctaatggtatacaaccactcgtcactctttttcattgggatcttcctcaagcattagaagacgagtacggcggcttcttaagtccacttatagtgaaagattttcgggactatgcggaaatttgcttcaaggaatttggtgatagggtgaagtattgggttactttgaacgagccatggagttacagtcagcatggttatgcaaatggaggaatggcaccaggtcgttgttctgcttggttaaattcaaattgcactggaggtgattctgcaacagagccttatttggttacacatcaccaacttcttgctcatgcagcagttgttcgtgtgtacaagaccaagtatcaggtgtctcaaaagggttcaataggcataactttggtagctaattggtttataccgctcagagataccaaatctgatcaaaaggctgctgaaagagcaattgacttcatgtatggatggtttatggatccattaacaaccggagactatccaaaaagcatgcgatctcttgtgagaacaagattgccaaagtttactacagagcaatccaaactacttattggttcatttgattttattggcctaaattattactctacaacatatgcctctgatgcacctcagctaagcaatgctagacctaattacataacagattctcttgtcagtccagcatttgaacgcgatggaaaacctatcggtataaagattgcttctgaatggatatatgtttatcctagaggaattcgtgaccttttattatataccaaggaaaagtacaataatcctttgatttacatcactgaaaatgggtcagctcctccagatatgcagagaaggaaagaagcaaagcaaataaggaatattctagtaacagaatgtttgtccctgagggagcacatacgacaagcaggatttgatgctgatttcctaatttctctctcaagcgtagtccttcaggtatgttggcttcctcacccttctcttgctgttggtgcttcctgcgtattcctatcactgttgctttgcgttttgtctctttttgttatctcagccattaccattactcgttccaacaccaatgcactcattcatgaggtttcttatctcaaccggagcagtttcccgctaggctttattttcgggacagcatcctcagcatatcagtatgaaggtgctgcaagtgaaggtggaaaaggaccgagtatatgggatactttcactcataaatacccagttggcaacaaacagcgaacatgtgggaggggagaacctgagtttgatttccacataacacatattcagggagaagaagaggagctttaa

SEQ ID NO: 6334 - DNA, 480 bp, Glycine max
  Peptide Sequence Number=SeqID_98019
atggtcattgagaaacgaaatgctaacatccaaaatctcatttatggttatggggggggtttcatcagcagactctccttctccgaaaacaccgagactttttcaagtctcacaagttatcaagaactacgtaggtctgagttcctcattggaggatacgtagggagcaaaagccttgcttttgtcgaccacactgctttctgttaccatgacccaagagctggtagcccgcggagataccttacggttatccgcacccttgtgtcatccagaggcggcgggcccgatgacacacggagataccttacggttatccgcgcccttgtgtcatccagaggcggtgggcccgatgacacgcggagataccttacggttatccgcacccttttgtcatccagaggcggcgggcccgatgacacgcagagacaaaatttggtcattctgcacccttgtgtcatccagaggcggcgggcccgatga

SEQ ID NO: 6335 - DNA, 207 bp, Glycine max
  Peptide Sequence Number=SeqID_98020
atggttcctccacctgcctcgcctcctcctcctcttcctcctcctcctcttccttcaaacgcatcagcttcaccgtctgccgtgaagcggacacgaaaagcctcacgtctacgatccttgtctaccagaccacctggtgctgacagaccagtgttccacgttgatcctactaaggcaaggctgacgatccccacaggaagaaattaa

SEQ ID NO: 6336 - DNA, 615 bp, Glycine max
  Peptide Sequence Number=SeqID_98021
atgccctcgccttcagaggactacacgcctaacctttcaggggtctgcacgtccttgccttcagtgggctacacgtccttgcctttagaggactacacgtccaagccttcagagagggctacacgtcttcaccttgaggactacacgcctcaccttcagaggattacacgtcctcaccttcagaggactacatgtctcaccttcagaggactacacaacctcgccttccgagggctagacgccctcgccttcagaggagtacacatcctccccttgagagggctacaccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaagaggactacacaacctcgccttccgtagggctagacgccctcgccttcagaggagtacacatcctcccctttctgagagggtacatgccctcgccttcgaggactacaccctaacctttcaggggtctgcacgtccttgccttcagtgggctacacgtccttgcctttag

SEQ ID NO: 6337 - DNA, 312 bp, Glycine max
  Peptide Sequence Number=SeqID_98022
atggcttccatgatggaggccatgttaggaatgagacaactcatggagaaaaacatggccatcgctaccgctgttagttcggctaccgaagcagacccaactctcctagctaccgcgcaccatcctcccccaaacgcggtaggacgagaaaggagcgggctggggcacaacaacaacccccatttgggatacaaccgggtggcttacccttatggattaccgcataattacacgctgccagtcatgcatgatgatgcgggtcatgtatcttcccccatccttgaaggggagcctcctcgacagcccgacgag

SEQ ID NO: 6338 - DNA, 81 bp, Glycine max
  Peptide Sequence Number=SeqID_98023
atggcgactccactggggatcacactcctaagtggtggtgagataagtcctacacccggacttgagggaaacataagatag

SEQ ID NO: 6339 - DNA, 171 bp, Glycine max
  Peptide Sequence Number=SeqID_98024
atggggggggggggggggtttggttgtttgggaaaactgccaggaaaccacattacaagcgaaacctcaaagagagttgggcttcgtcctcaaaaggaaacaacaccagaaaatctagtcttccatggattcaaacagaaaacgcaattgaaacatgaagcaaaaacgtaa

SEQ ID NO: 6340 - DNA, 123 bp, Glycine max
  Peptide Sequence Number=SeqID_98025
atgtcggccaggaaagatgaccgatccaggctaaaggcccaagtggagaaggacgaatgcctaagtggagaaggacaaagcccccgagtggagaaggatgaaggcccaagtggagaaggatga

SEQ ID NO: 6341 - DNA, 249 bp, Glycine max
  Peptide Sequence Number=SeqID_98026
atgagccatctactacctgagcaagacgttcacgacatgcgagatgaactactcgttgctacagaggacgtgttgtgccttggcatggacagctcaccgtttgaggtagtatatgctgagtgtcgcaacctacccttcggcgggagggtgacgcatgactcgcgggtgcgtgttccaaggaaggaatacgcgcgagttgccaccaacgtttatttgaggaaaacgtcagaaaaactggaaaagacgtga

SEQ ID NO: 6342 - DNA, 144 bp, Glycine max
  Peptide Sequence Number=SeqID_98027
atgtccgattcacttgcatcatatatcgagagtgatgcaatcctccctaggaagggaccaatcacaagaaccatgagcaagaggctccaagaagattgggctagagctgctgaagaaggccctagggttctcatgaaccttagg

SEQ ID NO: 6343 - DNA, 289 bp, Glycine max
  Peptide Sequence Number=SeqID_98028
ggcttcaactctagggtgggtggtggctgaacagtgggaggaaccagggtatgagaagaaaaaggttcctcagcctgtacctcataaagcaagtcaaaagtatatgtacttcctacaacatggtaagtgcattctgactctaaaaaatcaacatcaagaggtacaacacccagaaaatcagaaccagactcaaattcagattcattctcagcataaaaatcagatacaggatcaaattcaaactcagattcagattcaatgcataaggaatgacaagtatgcagattag

SEQ ID NO: 6344 - DNA, 592 bp, Glycine max
  Peptide Sequence Number=SeqID_98029
atgaagattgttatctctattccactaataaattgtgattttgctggaggagagcatcacaaggacaattgctatttttattccataaataactttgatcgaaggcaggaaccagccatgtacaactattatgagaaagggagagcacctgatcttgaaagtgtattggtagacttcatgacgtaccaagctagctctaaaggcgattgttattccatgcaacagcagggaactcagtttgaaaaggactattcttttgcaaattatcaatgggagtcagaatggaaaccttattatcacaatgaagcagaaggattgtctaatcttgatgacttgctaatgcaattcatggatactgtagattcaatgcaacaagattttaaaagaactgaaactcagcttggcaagttggtagatgacatgactaaagttgtggacagaagagaagaagagtatgcaaagattgaagcacatgaagaaagcattcttcaagttaccacaatccatcatcaattgatcaacgaagaagaaaaggatgaagtttccagtactccagaatatccttgcatggcaactgcttgttatgttgtag

SEQ ID NO: 6345 - DNA, 165 bp, Glycine max
  Peptide Sequence Number=SeqID_98030
atggtcattctgtgcattttgtcatccagaggcggcgagcccgatgacatggggagatacaattatggtcatccgcgcctttcgtcaatcgagaggaacgaattcgacagttccgctggcgtggagattgaacggccgaatggtgtttcgctcgaacgaaattag

SEQ ID NO: 6346 - DNA, 801 bp, Glycine max
  Peptide Sequence Number=SeqID_98031
atggagttctatgcaaatgcctggcccacggaagaaggagtcatggataagcgttcctgggggcatcctttggtcctagaggaggggcagcattgtgaatacaccgacagaagaagccaagtctcaggttttgatgaagaggccataggccagctactgtgctccccgggacaggattttgcacagagcgtggcaagaagcaacatccttcctagtgaccataattctgatctcccgctgcctaaatgccagttggtctatgctatcctgacccagatcagtgttcatgtaacacaacttatctcagatgccatctaccagtttgtaggtatcgcacctccgagacacccagtggacccaaaaaagtccaacagggcactgggatttccagcattgatcacaggtctctgccagttctatgggccggggcaggaccagcagcaacaaccagttggagacgcaccaccgccacctccagttcagccaccatctctagagtccatctcagcttacatgcagaggatggaactctacatgcagcatttggctgaccagcaggcagcaaaccataggggccaggtgcagttgaacgatagcttctatcagtatacactgcagcagcagcaccaagaccccagcccttacccgtggcctactctcgagcagttcagagccaccgttgcatggtctggggacaggcctaattttcaagcgggggcaggtctcactgaggccccaggagatgaagatggagttgaggaagatggaaacatggcagatgtgatggatttcttcctttga

SEQ ID NO: 6347 - DNA, 303 bp, Glycine max
  Peptide Sequence Number=SeqID_98032
atgggtgaagtagaggagatacaagagaagatgaaggccaacatggaggccattaaagagaaaatggccacaatgatggaggccatgatgagcgtgaagaagataatggaagccaatgcggttgcaattgccgctaccagcgttgttgctaaggtgcaaattcaaaacgagcacgccttcccgccatatggcttgcctctcaactatacgccacccaatgtggcgtacactcccaataagaatgtcaataactccactcctatacccattgagagccagcaaccccaaactgatcatgcacat

SEQ ID NO: 6348 - DNA, 213 bp, Glycine max
  Peptide Sequence Number=SeqID_98033
atgaatagcacaagttttcaaggtttggaaaaccagaaaacttcagaaagcttttggtacaaagaagaagaagaaattcaaagagattcaaggcttgtaaaggattgtaatgaaatgatgggaaaagaattaaattgtcatcatcaaaaagggggagattgtagaagcaaagactttgtctttgatgttttgatgatgatcgtgatgatttga

SEQ ID NO: 6349 - DNA, 288 bp, Glycine max
  Peptide Sequence Number=SeqID_98034
atgggtcaacttcaacggtatgcattccacaaagcctttggtaagatttgggacctagctacgatagaagtctccgtggaagcgattgcatcccttagccaatattatgaccaacccttgaggtgcttcacatttgaggatttccagctagtgccgactttggaagagtttgaagaaatcccgagatgcccgctgggaggaaggaaaccatatcttttctcagggttctatccctccatggctagagttgccaaggtagtgaaaatctcgacacaagagttggaccgg

SEQ ID NO: 6350 - DNA, 384 bp, Glycine max
  Peptide Sequence Number=SeqID_98035
atggcttatttcctcctggataagaattttgcgaaactaacaaatctttttgataccggcagcggtgagatatttgacatctattctcacatgagaattgaattaatttcattcatcaaagactctcttagtgaggagaatcctgagctatgcacaattttggatagggtcctaactaggactaatagcacaactaaggatcttatagtgagtctttgcgaagatctcttgccaaaagaatgtactatactgtcggttctatgcttcaaattttggcaagaaaaatacagttttatgtattcgtttatccagctgatcagccaggtaggtcgggtatgctcttacctagatcgaccagtcttgtacagcagtgggatcctctag

SEQ ID NO: 6351 - DNA, 54 bp, Glycine max
  Peptide Sequence Number=SeqID_98036
atggccgaccagcaggcgaccaagtccaaagccaaaggtagaaaaataccttag

SEQ ID NO: 6352 - DNA, 216 bp, Glycine max
  Peptide Sequence Number=SeqID_98037
atgtgggatggaccgatttgctcttactttgaatgggagtcaagaacttcctcggttgctagccaaggacaaagcaatggtggacacctactccgccctcaaggagatccacggactcctcagctattgaaaaacgccataactaaatgcgccccaaggcatccctatcgcaccagatccaaatctaggacgatgggtgaccaagaggagatatag

SEQ ID NO: 6353 - DNA, 719 bp, Glycine max
  Peptide Sequence Number=SeqID_98038
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggacaagcgtacctgttgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 6354 - DNA, 435 bp, Glycine max
  Peptide Sequence Number=SeqID_98039
atgaagcaaagggaaactatagaagatgtgcagaaaagatttacacatattgtaaaccatctcatgggtcttggaaatatttttcaagaagaagagatcaatgtcaaggagctgaaatctgtcaacaaaacatggcaaccaaaggtcatagctatttctatatcaaaagaccttgccaccatgacacatgctaaattgtttgggaagttgagggaatatgacatggacttgacaagaatggctgaagaagaagctatagataagaaaaacaaaggtttagcattgaagacaagaattccatccattcagaaaagtaaggagggaatgttcaacaagttcctcaagaaaaagaagaactatggaagcatcacctttcagcctaagaagaatttcatgaaagagaactatcttcctccaatggattcacttgcttaa

SEQ ID NO: 6355 - DNA, 189 bp, Glycine max
  Peptide Sequence Number=SeqID_98040
atgtgggattatgtcattgatgcctgggggagtttggttgattgtcctttcgagcatcagtttgatgatttccttaagaagtttgaaattgcttgttcaccatggccaatgtttgttaactatgtcaaccaaacatggacaattccccacaaagaaaaatttgttaaagcctggacgaataagggttga

SEQ ID NO: 6356 - DNA, 1035 bp, Glycine max
  Peptide Sequence Number=SeqID_98041
atggctcaacctccacctcatgagaggactcttagggagatggctgcacctgacttcacttatgaaagcttgtgcattcaatatcctgatgagggtgttccatatgttctcaagactggactaatacatttgctgcccaagtttcatggtcttgcaggtgaagatcctcataagcatcttaaggagttctatattgtttgttccaccatgaagccccctgatgtccaggaagatcatatctttttaaaggcttttccccattctctagaaggagtggcaaaaaagattggttgtactaccttgctcccagatccatctccagctgggatgaccttaagagggtgttcttggagaaattcttccctgcatctaggaccactgccattagaaaagacatttcagggattgagcaacatggagaggagtatgattgatgctgccagtggtggagcccttggtgatatgacgcctgctgaggctaggaatttgattgagaagatggctcccaactcccaacaattcagtgcaagaaatgatgctattgtccttagaggagtccatgaggtggccacagattcatcttcatctgctgaaaataaaaagcttgagggaaaacttgatgccttggccaacctagtaactcagcttgctatgaatcagaaatctgcatctgcacatattgcaagaaatgctgctggtcgaagcaagccatatgttcctcctccaatgcaccagcagcagcaacaacaacaaagacaacaagcaactgaggctcctcctcaaccttccttagaaaagttagtgagacaagcgaccacccagaatatgcaatttcagcaagagacaagagccttcattcagagtctaacaaatcagatggggcagatggctactcagttaaaccaagctcagtcccaaaattttgacaaattgccttcaaaaactatgcagaatccaagaaatgttagtgccatcaccttgaggtctggcaagcaatttgaaatgcctccaccagtagcagcagctacaccttaa

SEQ ID NO: 6357 - DNA, 414 bp, Glycine max
  Peptide Sequence Number=SeqID_98042
atggagaggagtctgattgatgctgccagtggtggagctcttggtgatatgacttctgttgaggctaggaatctgattgaaaagatggcttccaactcccaacaattcagtacaataaatgatgctattgtccttagaggagtccatgatgtggccacagattcatcttcatctgctgaaaataagaagcttgagggaaaacttgatgccttggtcaacctacaatctagagtcaatgagcaacctgaagcctatgctgcaaacatttattatagaccccctcagcaacaaaaccaacaacagcagaataattatgatctttcaaacagcagatccaatccaggttggaggaaacatccaaatctgagatgggcaaatcctccacaacaacaacaacctgtccctcccttctag

SEQ ID NO: 6358 - DNA, 192 bp, Glycine max
  Peptide Sequence Number=SeqID_98043
atggctgaggagccaagaagagttactctggaagactactcaagctcaagtgtgccgcaattctttattagtattacacgaccggagtggcatctccaatcacctttcctccttctgcattccactgtcattgatcttcaagaagcaaaggactccattgatgaagaagatccaaggcctacaagcttgtag

SEQ ID NO: 6359 - DNA, 135 bp, Glycine max
  Peptide Sequence Number=SeqID_98044
atgggggggggggggaaaactgccagggaaccacattacaagcgaaacctcaaagagagttgggcttcgtcctcaaaaggaaacaacaccagaaaatctagccttccatggattcaaacaaaaaaacgcaaatga

SEQ ID NO: 6360 - DNA, 411 bp, Glycine max
  Peptide Sequence Number=SeqID_98045
atgcaatcacagggacttgcactgcctctggagcctgaggttggtcccctagctgcctgtgttagcacaaaagggagttgcgttgatccctcaccgaccgatccaaagacgggtgactcagacaaatgcgggctgtacatcgaagaaaatccttcccgcctggttgtcctaggaaaagtttatgagggatccacagttgttcacaacatccctttgttgcatggccacgtgaaggttggtgttgagaaggttaaagatgcagaggctcccgttcctgtacccattgacgaggttcaactagtggggcaggcactgaacactttccttgcttggccgacatatctcgtgaagcgtgtattagaacaagcaactgtgtctccatcaaagcctccagataggccggatcctgag

SEQ ID NO: 6361 - DNA, 1225 bp, Glycine max
  Peptide Sequence Number=SeqID_98046
atgcaggtgttgctcaatacgccgctcgacgacagcggcgtgacgttgtcggcgctgacgccgcagcacaagcaggccgagctgcagttctatttgccgattaaccggttgttgcaggcgaaggcgctcgatgccctggtgaagcgttacgatccgctttccgcccgctgcccggcgctagattttcatcaggtgcagggcatgctgaaaggctttatcgacctggtgttctgctggcagggcaaatactacctgctggactacaagtccaactggctgggggaagacagtagcgcctatacccggccggcgatggagcaggcgatggcggagcatcgttacgatctgcaataccagctgtatacgctggcgctgcatcgttatctgcgtcatcggttaccggattacgattaccggcgccattttggcgggcggcgaagctgcggcgacggaggaaggatcatgatcgcactgctggagcaggcggtggcgcttggcgtgctgcgcccgcttgacgtgcagttcgcccgcgtggtggcgagcgaagacgagcccgatattttgctggccgccgcctgcctgagcgcagaggcgggagccggtcacgtctgcctgatgctggaacagctgcaggcggacacgctgtttgaagggcgccagccggcgttggcgctggcggtgtgggaggcggccgggcgaccggatagcgcgcgttggcagcagcgtttggcggccagcgcggcggttggggacggcagcggcgctacgccgctggtgctgcgcggaccgcgcctgtatctgcagcgcatgtggcaaaacgaaggcgaagtggcggcgtttatcggcggtgaaggcgaatcgctggcggtgccggaggctgagctgcgcactattctcgaccgtttgttcggcgcggcgagcgacgaacccgattggcagaagatcgccgccgcagtggccgccacgcggcgcattgcggtcatttccggcgggccgggcaccggtaaaaccaccaccgtcgccaaactgttggcggcgctggtgcagctggatgaaagcgcgcgcttgcgcatccagctggcggcgccgaccggcaaggcggcggcgcgcctgacggagtcgcttggcagcgccagccgccagctggcgttgaccccggcgcagcaggcgctgttcccgacggaggcggcaacgttgcaccgtctgttgggggcgcaaccgagca

SEQ ID NO: 6362 - DNA, 471 bp, Glycine max
  Peptide Sequence Number=SeqID_98047
atggctactcagttgaaccaagctcagtcccaaaattctaacaaattgccttcacaaactgtgcataatccaaaaaatgtgagtgccatcaccttgaggtctggcaaccaaattcaagtgccttcaccagtagcagcacctgcacctgaacctgtcaagcttcattctacacctgaaaaagaggatgagatagttgcacaaaagagaaagctttctaacaaaaaatttcatgcaggtggaccttcttctagtaattctgacttaccgcagcctcttatccctcttccattcccacctagagaaatttcaaacaaaaaaatggaagaagcggaaaaggagatagagggttttataggcgctttatcaaggattttagcaaaatggcccttccactatccaatctgttacaaaaggaggtggagttttgatggaagcttgcttgtggagcttctatggaggctggatctttga

SEQ ID NO: 6363 - DNA, 759 bp, Glycine max
  Peptide Sequence Number=SeqID_98048
atgacgctgaacggggcggaagcggtgagcctccgcgtgcagattagaccccctttgcctggcgatgcgcgtgaagccaggatgtggcaagccagctggcctccagcgccacctttagctggcgcagcagccacatacagccaaaggtcagcagcagtttggaatcaggccgggcatcagctggtcgagaatcgactgcacggtggtgaccgtggttttgccggtctggtcggtgatgcgggataccaccagcggcacgttgacgtgtgtccacttattgaccagcgcccccatgacaaacaggccgagtatcgatgccccctcggtcagtttttgcaggaagccgccgcccatatcgctgacgatatccacccctttgcgatagccataagccacgccgtaatagcgggtcagcatgcgcgcaatgttaaacaggaagaagaacagcagcggaccgagcaggctgccgctcatcgcgataccggcacccagcgcggcgaacaccggacgcacggtcccccagaaaatcgggtcgcccacgccagccagcggccccatcaggcccactttgatgccgttaatggcaccgtcatcgatcgctgccccgttggcgcgctgctcttccatggccatggtcacgccgagcactggcgcggccacgtaaggatgggtgttgaagaactcaaggtgacgcttaatcgcctgcttgcgttcgtcgttgttttccggatccaggcgacggatcaccggcaccattga

SEQ ID NO: 6364 - DNA, 225 bp, Glycine max
  Peptide Sequence Number=SeqID_98049
atggctaaaccatgtacagagttgtcgaaaggagtaaaaaggaggggggcaatagtaacttggttaaggcatgaagggataggaagtgatcgcacatttaagttactaaccaaatctttgggcctgctctcctattccacacaaaacagaagggaagagaaggggaaaggccagatcaaccaaaaccaatttcctacaaagtctaaccttagaaagtcctattga

SEQ ID NO: 6365 - DNA, 181 bp, Glycine max
  Peptide Sequence Number=SeqID_98050
atggatgccttggaaatttatttgaatgaagtagaaatgcaaatagaaataaaggtgaaaattgtcaagtgtgaaagaggtagcgagtacaatggaaggtatgatgaaactaagcaacacctaggtccatttgctaaactccttcaaaaatgtggtatttgtatgcaatacataatgttag

SEQ ID NO: 6366 - DNA, 473 bp, Glycine max
  Peptide Sequence Number=SeqID_98051
gtatgccacccaccaggcaccctctagacccagataagtctaacagggccctgggattttcggcattgatcacgggcctctgccagtcgttcggggttcctatcaccccagccttcatcaagaagtattgcacgcctaggcaggtgcagggtgatgcacctcaggccacagacgcaccgccaccacctcatcaggccgatctcactggatcactaagcatggagcgttatctacaacacttgatacatgaatatctttaccggttcagccccagtcaacaggggcagggtttcgctccttttgcatgccctactccagagcagtttggggctgaggtcgcatggcccggagattggcccgaggcccaggcaggggaggagcccgcaggatcccctggtgaggcagaggaggcccgtatggatgaagaaatgatggacttgcttggtttcttgggaggaagaggagccacgtga

SEQ ID NO: 6367 - DNA, 129 bp, Glycine max
  Peptide Sequence Number=SeqID_98052
atggataagagcttgaaggaaggagaagatgagtggagggagagggagagaaagaacacgaaattttatgcctcaaataagcccactaatccaagatcaagtccaagattctccactaagtgtgcttag

SEQ ID NO: 6368 - DNA, 351 bp, Glycine max
  Peptide Sequence Number=SeqID_98053
atgggcccgaaatctaccctaaggctcatgagaaccctaaggccttctcttgcatttttggcccagtcttcttggagtcttctatccaatgcccttgggggggtaggattgcatcatttgtacaaagataattggacccaaccttggcccatgggctcagaaatctaccctaaggctcatgagaaccctaaggcattctcttgcatttttggcccaatcttcttggagtcttctatccaatgcccttggggggtaggattgcatcaagtggtgtactcagctgatggctcgctaagcgggcagattggcttagcgagcaaatcaaaatcaacacttcataaacttgcctaa

SEQ ID NO: 6369 - DNA, 222 bp, Glycine max
  Peptide Sequence Number=SeqID_98054
atggtcattttttggaactttcgagacctaaactcgcccattctagcatctggcttgcttgggccatgggaaagctttagccttaagcaatcagctcgccagggcgagctggtaccttcaagcctaagcaattggctcgcctgggtgagcttcccctgcaccaaatggccttttcctataaatagccacgcaggggaatgtttcaggggtttgaaaatctaa

SEQ ID NO: 6370 - DNA, 852 bp, Glycine max
  Peptide Sequence Number=SeqID_98055
aaccatcgaagaagcgaaagggcacttcgagtcggagtcaacggcattccgagtcataggaaacaacggatacggtacacaaatctcttttcgtctcgttcgattattgatccaaaattcattgatatggatttcttttcaaatgagagttttgaatgcattcaagcatttgaaaactccaatcttattcctttcatgtctttaaaattgcctgtttattctaatttagtcaaagccttctattcaaacttagaaatccaagaaggcaccctaatgtctgaagtttatgggattaagatggtcattggccaatccctattctatgatttaacccaatttccaagtgaaggtgtaccatttgaaggtacactgattgacgattggaagtttgatttttctatgcatgatgtccgccggttggtttgcaccaaccaagtggatatgaccgaaaggcttcttgccggttcattggcttttgaaagccgcatccttcattatctaattgttcgcatcttgcttccaagatcttcaaaccttgcacaggtttctaaagaagatctcattgttatgtggacttttcataaaggtctacaaattgattgggcacatcttgttagatatcgcatgcataaggcattgcgattgaatgctccattgccatatccacatctagtcaccctcttccttcaacactttaacatccctcttgactctgaaccctatgttccaatcaagagatcctttctaataggcacttcaatcattgcatcctttggttatcaaaaagagcatgatggctcttgggtgaaaaagggtgctcgacatgttggtgaagaaggacatgatggataa

SEQ ID NO: 6371 - DNA, 81 bp, Glycine max
  Peptide Sequence Number=SeqID_98056
atggaggagaagcatggcacatgggaagcttccttgagaagcaaggaaggttgggaagctagaggaagaaagcttccttga

SEQ ID NO: 6372 - DNA, 195 bp, Glycine max
  Peptide Sequence Number=SeqID_98057
atgggttttcgcttacctggcatcaggaagacatcaattgctgcaaaccaagcatcttccaaatctgtggaggtgccaaagggctaccttgtagtctatgttggagacaaaatgaggcggtttcttatccccgcattaattgccgtaattctgttggagatacagggcaaccttgataaggttgttaattactaa

SEQ ID NO: 6373 - DNA, 191 bp, Glycine max
  Peptide Sequence Number=SeqID_98058
aagatcctgaagaggtcccagaggagctacctcctgagcctgctgtggatgctcttgactttccagaggatgatgaggacccactccctgacgtggattctctagaggatatcatgtcagcatctgagccaaactctacagaggagagcggccctggagggacagcgaatagtgaagactcttcatcatag

SEQ ID NO: 6374 - DNA, 495 bp, Glycine max
  Peptide Sequence Number=SeqID_98059
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgattgagacgtgggaggcgaaaattggcgaacgtccggatgctgaagtgatggcagagcggaaagagcattattcagcgcccgttcctgaccgtgtggcttacctgaccgccggtatcgactcccagctggaatcaagcttatcgataccgtcgacctcgagggggggcccggtaccagcttttgttccctttagtgagggttaa

SEQ ID NO: 6375 - DNA, 171 bp, Glycine max
  Peptide Sequence Number=SeqID_98060
atggcagaatcatcgaagaagagaaagggatcatcctccaccaccgctgctgctggccatcgccgccacaaaccatctgaagcacccacagcacctatccatcctcccttatcatctccaagatcatccactctgttttcttccgatgatcaacgtctatggctgaaatga

SEQ ID NO: 6376 - DNA, 459 bp, Glycine max
  Peptide Sequence Number=SeqID_98061
atgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaacgaagaaaagggttgccaagttcatgaggaggtccactctccccgataagatatatgttgtttctcaggatggggttatctctgttatcgtcgagaagcttccaccaccggagcccaagaccattcagaatctgttaagcttgaagctcatagtccttcaagtgcccaggaatgttgctccttcttttgggcctcgtaacttgatgttcgaagttactattcgtaacattcccgcgatcttcaattag

SEQ ID NO: 6377 - DNA, 765 bp, Glycine max
  Peptide Sequence Number=SeqID_98062
atgaaacttcaagtacgcattgtgcagcagaagggttccatacttcaaaggaagtatactatccaagctgcaacggatcacaaacatgtagcggatttaagggatgtgacattagagcggtgcaatgaactgcagggtgagtactgcatcgatactaccacagttaggtgcatggcatggtttagtgcagcagtttcctctggggtccctcttgtttttgtcaatatccaaacagaacaaattccctccatggaggagactcatttcttgaaaagggaaatagctactagcaagcaaaaaatcaacaatgctaaccaaataatgcatggtataaggttgtggtttttgcctggactagcagaaatttcagttgtgttaatccctcaacctggcgaagctcgctttggcatggaaattaaacgaactgaagagggctttgtgtacatatattcagtgatgaggggttcaccagctgatcgtgctggggtgagagaaatgtatgaagagtcaagtgcaaataggttccttctggtgatatcaaggttgcaatgcaagagcataatgccaacgagtgcttgttctgctggccttgtgcattgttgtgaccaatctgaaatgaaggacattctcacttcagctatagaccaatatgagacaattcaggtgcatgtcatggcctggccgaaccaaactcgtccctctccaattcctgatgttggttgtttagcggccctgctacatccaaaaagcgattcatcattatga

SEQ ID NO: 6378 - DNA, 504 bp, Glycine max
  Peptide Sequence Number=SeqID_98063
atgtcatggaatccccttggtccattcctttcgtcatctatgttcaaagccttaggtcttggggacgttgaagtgcgccaccgcaaaggaggccttggggttttcgaagcctttctctacgctctgagccgctggactattggggcggaggatatccctttggctgactttgctatttcgaatcagaccagttctaggggaaacagacgatgcggtggtggcattgaaggacatgactctcaattggcgtctcgcaccgaagcttgcggcagaagcgacaccactgcaactgccctcaacaaaaaacgtgtggctgctgacgccgttagcgatgacggactcaccgtgaagtgtcaaaatgttctggcagcgacaacgttggtcttcaacatcagagagaagaaagaagggaagaaaaggagagagaataggaggaaaagggtaactggggaaagacaagaagaaaaggataaaaagaaagaaaaaatagccatcagagattag

SEQ ID NO: 6379 - DNA, 267 bp, Glycine max
  Peptide Sequence Number=SeqID_98064
atggcttacactcacattccggattcaacaagcgattctcctcaaatttcagtcagcccgtatcaattagacttcacactttatgcttcggggtcatacaatgctcaatggaatgccccagggcttctccgcgacaagcacacgttgcgttcgagtcgtattcttggagaaatggaggttgatgaacctcggctagggttatggctaccattgaattatcaagtagatatgggagcaagtcagcataggacactggaattggggtga

SEQ ID NO: 6380 - DNA, 405 bp, Glycine max
  Peptide Sequence Number=SeqID_98065
atggttgtgtatgtgattgttggaattcttggaagtattgttgatggagcagcctatggatttcttccaccaatatttgctacttttaaagctatacatgaaggaaaagtgacaaattttaccacgggcatgttattctatgttccaaatcctgttttggttataattaatgttgaacctaaggaattgggaatcccaactaaagcatattatgtcgttgaagaggttaaagagaatgccactcaaaaaagtcaaaaggtgtttgtgcatgtgccatttaagattgctgctcatgaagttgaggaaatagccttgaaaggtttggatgcaagacttaaagagatcaggggttaccttgaccttgttattgatggaaagcttccattaaaccatgagatcctgtag

SEQ ID NO: 6381 - DNA, 507 bp, Glycine max
  Peptide Sequence Number=SeqID_98066
atgggaggatacgtaggagcaaaagcctcgcttttgtcgaccgcgccgctttctgttaccatgacccaagagctggtagcccgcggagacaccttacggttatccgcacctcgtcatttagtgaccccaagtgtgattgatgagcagaggccaatgtggtcatctgcgccttttccggagatgtcagcattttccgatggagacttttcaagtctcacaagttatccagaactacaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 6382 - DNA, 443 bp, Glycine max
  Peptide Sequence Number=SeqID_98067
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataattcaagatgaaagaaagaaaatccgagaggaagaaagaagaaaaataatgaaagaaatgaaaagagaaaaatatgtctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggataacttagattgggaaataagggaagagcaacaacttaaaaagaa

SEQ ID NO: 6383 - DNA, 692 bp, Glycine max
  Peptide Sequence Number=SeqID_98068
tgtatgatggtgttcatgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggtggtcggatgggaaatggatttcgtggtgcaagcggaaggtatcttaaatgagatttgtttgaatagtcttaatcgtgacactgggtttgaaatggggatggcaacgaatgagattcaaaatgatgatgaggttctagctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaggctgcaccg

SEQ ID NO: 6384 - DNA, 297 bp, Glycine max
  Peptide Sequence Number=SeqID_98069
gcaagactcgccaaggagaagttcaaatcagctgctacacacatccggaaggagtgcaccgaggtgaaacttcctgcttttattgttgaccacagagtggtacctggagatatgtcgcgggggtcaggagagcttggggacatcaggcgagctcctggcagtcaacagataaaaggaacaaagaccacaaagcaaggaggcttgtgggggctggccagctgtgaattttgtgtgatatgtggattatggcctctggtaatcgattaccaagggtgggtaatcgattacaaggcttaa

SEQ ID NO: 6385 - DNA, 393 bp, Glycine max
  Peptide Sequence Number=SeqID_98070
atgactaatgcaaactgtccacaagaatcattgcattcagcctcaaacgggaatctaagacaaatatcgacatcaacagttgtttatgtaactaatttggaattctgggtttcgggggtgcttatgctttattattgtagttggaggtatgacagattcattttatctgtgattcattgttatctgaggcttttggattggagagggatggtcttcaaccaacagtcttgtttggccattgttgattccatggagtttgttgaatcaaaccctctcttccaaaaccccaaatccatgtcttattttatgcttctcctccaacttggtgtgggattggcgtttggagggctgatttgtaaggacaagtctggttgtgcttggaatagctcctaa

SEQ ID NO: 6386 - DNA, 95 bp, Glycine max
  Peptide Sequence Number=SeqID_98071
ggatggaagcgaatgaaggataggatcacgaccgaccaagcgccaccccttcccggcgctaaacaagcagagaacgtcgctgcagggcaacccca

SEQ ID NO: 6387 - DNA, 1077 bp, Glycine max
  Peptide Sequence Number=SeqID_98072
atggatatcaaacagcggctgcacgacggcgaaatcgtctgcttcggtctcgatccctactgcatgatgctggagcgcgtgacgcgctatctgaccagcgtcgatgacaccgcgcgccttgatttggtgcgccgctgtttttacctcaaagtgtgcgaaaatctctccagcgaggagcagcatccgcgcgcgggctggcggcgtgaaatcctgtcgcagctggtgaaagagtggggctgggacgatgagaagctggcggtgctggataatcgcgcgcagtggaaaatcgaacgggtgcgcgaggcgcacaacgagctgctggatgcgatgatgcagagctatcgcaacgtgatccgttttgcccgtcgcaacaatttaagcgtcagcgccagcccgcaggacattggcgtgctgacgcgtaaattgtacgccgcgtttgaagcgctgccgggcaaagtcacgctggtgaacccgcaaatctcgcccgatctgtcggaagagaatctgacctttattcatgtgccggccgggcgcgccaaccgtgccggctggtatctgtataaccagtcgccagacatgagctcaatcatcagccatcagccgctggaatataaccgctatctcaacaagttagtggcatgggcgtggttcaacggactgctgacgcgtaaaacccgtctgcacatcaagggcaacgagttctgcgatctgccgcgcctgcaggagctggtcaacgatgtgtccagccacttcccgctgcgtctgccggcgccgacgccaaaagcgctctacagcccgtgcgaaatccggcatctggcgatcatcgttaacctcgaacacgatccgacctcggcgttccgcaatcaggtggtgcacttcgacttccgtaagctggatgtattcagctttggtcagcagcagcagtgcctgatcggcagcatcgatctgctgtaccgcaactcgtggaacgaagtgcgacgccgcaccgccggacacggtggaagtattctgctacagccagcatctgcgcggtctgattcgtacccgcgtgcagcagctggtgtcggaatgcattga

SEQ ID NO: 6388 - DNA, 486 bp, Glycine max
  Peptide Sequence Number=SeqID_98073
atggtcttccttgtgcatgcgagctatctaggtatgctgttggaaacatcccacttgattcaatccatatgttttggaggagacttagtttttcagatcaagggttatgtgaagccgaagtcaccatcaaggaagagatcgagaccatatctaaaagattttaggaacttgatgtttgtggtaaagttactctcaagagtaaacttcgagaaattgcataccttgatcaaaactctatgggtgctcctccgtcaaaggtcaacactaaagggtttcattgaccacattgtggatgtgaaagcagacgataactgtggatatcggtccattgccgctttgttaggtatgggtgaagattcttggtcgttggtgcgcaacgaattgattaaagaacttggcaaatggtcgcatgactacatcaacctcttcggtggcacagagagatttgaagaattaaggttagtgtggacaagtggatggatataa

SEQ ID NO: 6389 - DNA, 291 bp, Glycine max
  Peptide Sequence Number=SeqID_98074
atgcctaccttttgcgtgtgtgcattttgctgctgtgcctcaagtactttctgcatcttccttgcttcttcttgcattccatcacaatccaagctaagcgccaatatgcttctatttttcagtcctttgaataaggctaagcgcagctgctacgctaagcccttgttgtgtgtcaaggaggctaagcacgccctgtgcgctaagcctaagggtcattttggtgaggctgagcttagcgcgccctgctacgctaagctcagacccttttctattttgaaaattgtgatttag

SEQ ID NO: 6390 - DNA, 901 bp, Glycine max
  Peptide Sequence Number=SeqID_98075
atggagtggtggtagattagaatatagggccacacctcatggtgacttggtcggatataggtctcgtatagatcatatggagaaccatgagttttcttgggtcccatatagaggatttgaagaaaacctacccagatgtgcatatagagacatggagatttggtttgcatctactgcaattatttgtttctcgattgtcgaatggcatcaaacaaatcgggtgaagctacagtgtggattacaacaagatatccctgttgatcccgtgaatcttgatctacttcaccaaattgacatgcgaagcaatcattacactgattggatggaataccatgcggagtggattaatatctggaaaaacaaacacatcgatgttttagcagggcaatgggttgaaggaatagtgacacatacaccagcgtatatggaatggtataggaaaaacactactttgttcttgtctgttgcacaacaactacatgatccacgcacaacaattacccataatgttgcagggtcaggtgttgaacaaacacattttgaaattccacattctcagtcaatgtattttactccttcacctgttcatcaaacttttggccacactggcgagtcagtcaccgcaaccactcatgaatggatgattgatttatttggcgtcgatttcaatacaccaaattcagcggcatcatattcagctactttacaacagttcgatgcaccacattcgtttggagaacaaggtcaaagttcttcagctacaacaaccaacattgaaaatactaacatagaacaacaacatcatcatgatgtgagagaaccagtcatactggaaagaagaaatccgccacgtaatcggcgtccaccaccttgtgggactggtcatcgtcttggtcattga

SEQ ID NO: 6391 - DNA, 375 bp, Glycine max
  Peptide Sequence Number=SeqID_98076
atgtggctccgcatgccaccagacccttgggtcacgcatttcgtttctaaacgaccatttagaggaaacactgggtctaacaaagataggagaaaatcactcaaagtgtatcaatctcacacagtgcttggcgagaaagtcgctagcgcacaggattttgtcggcaatcaaagggagaggaccactttaggtcgtggtttcctttttcttgggcaaggattgacattctcaccgtgggtcaaggtttatgataagttgggtttttggctcaaggcttgtagaacggctggtcatgatatatgtcagggtttggccagcggttcggggataaaggggatgtcctacattatttccatgatacacatgcaacaatga

SEQ ID NO: 6392 - DNA, 799 bp, Glycine max
  Peptide Sequence Number=SeqID_98077
catcttcagaggactacacatcctcaccatcagagggtcgcacggcctcatcttcagaggactacatgtcctcacctttagagagctgcagttcttcaccatcagagggttgcacgtcctcccattcagagggctgcacgtcctcaccatcagagggctacacgccctcacctgcagaggactgcacgcccttcctatcagagggctacacgccctcacctttagaggactacacgtccttaccatcagagggcttcacgccctaacctgcagaggactgcacgtcctcaccatcagagggctgcacgccctcacctttagaggactacacgtcctcgccatcaaagggctgcaggccctcatcttcagaggactacatgtccttgccatcagagggtcgcaccccttcatcttcagaggactacacgtagggttgcacgtcctcgccatcagagggctgcacgccctaaccttcagagggctccacgtcctcaccatcagagggctgcacgccctcacctgcagagggatgcacgtcctaactatcagagggctgcacgctctcaccttcagaggaccatacgtcctcgacatcagagggctggacgccctcacctttagaggactacacgtcctcgccatcagagggctgcacgccctaacctgcagaggattgcacgtcctcaccatcagagggctgcacgccctcgccatcagagggctgcacgccctatcctttggaggactacatgtcctcgcaatcagagggctgcacaccctcacctttagaggactacat

SEQ ID NO: 6393 - DNA, 177 bp, Glycine max
  Peptide Sequence Number=SeqID_98078
atgatccttatgtttgctcatattttgcttgtgggccagttatcttacttcaagctgtataacatcaatattcatgaacccaaggctgctcattccaaaggttggggcaagctttggctggaggtgaattctcttttagtcctcaaggcttttaatgttatcactgtggctccttag

SEQ ID NO: 6394 - DNA, 569 bp, Glycine max
  Peptide Sequence Number=SeqID_98079
atgtcggctttgaaagagcaaatggcttccatgatggatgccatgttaggaatgaggcaacttatggagaataacgtggccaccgctgccgctgttagttcggctgccgaagtagacccaactctcccagctaccgcccatcctctcccaagcgtggtaggacaagaaagaagcacacttgggcacatcagcaacccccatttgggatacaatcgagtggcttacccttatggattaccacctaattacacgccaccagtcatgcatgatgacacgggtcatgtcccttcccccatccttgaaggggagcctcctcgacagtcggacgaggttcacgaggatcgtagagagtatgcccaaggagacatcaatttctaccccctagtccccatcgaggggccggcacccaatacactacctcagcccaacctcacgggagaacctcgaaacctcccagcacagccaatattcttttccatagaaggaccgcccctggcagcggaagaaagaaggaaactcgatctcatcgaagagagattgagagctgttgaaggctttggcgactatcc

SEQ ID NO: 6395 - DNA, 461 bp, Glycine max
  Peptide Sequence Number=SeqID_98080
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaatgtgttaagacaaagatctcagacagttaaacctttgatactttgtgaatggggatacaaaagaattctcaggcgggagaagggagacacaaaagaattcaggcggttagtcctttgttcttttggaaaagagagaagagagacacaaaaagaattcaggcagttagtccttggcgaattctttttggcaaagggagaagggaatgaaaaagatgaatag

SEQ ID NO: 6396 - DNA, 538 bp, Glycine max
  Peptide Sequence Number=SeqID_98081
atgattggtgtgctagttagacgtgttcctctatactcacacccgatcgatattttaggagttcagacgtttacgaccatccctgaaatccctcaactctcggaagaatcatccaagatgagaactagacaaacctctaagcttattaatgtcattgacaaggacagtgacaaaacttcagaacaagcatctgaagaaggattttctggtcagctaaaaggatggtggaataattatctcactaatgatgaaaaatcaaggatttacagcgctattaagatggatcttaacaggaaagtcattacaaatgacgataatgaagggatccctgacactgtcaatacccttatttttacaatcgcccaacatttcattccatcattatggaaggataggtcagcagaattactatccaatcttaagtgtaggactttagtagactttagatggtatagagatatcttcctcactagagtttacactagggaagataaccaacaacctttctggaaggagaaattcctagcttctaagatca

SEQ ID NO: 6397 - DNA, 222 bp, Glycine max
  Peptide Sequence Number=SeqID_98082
atggcaacagagaaaggctacggaggtttggatgacgccacttccggtgaaggaagaaaagtcagggtagacgccacaaggattaccttgataagtctgagattggttcaacaaggaactcagagagaaactctcaccaaattttatcaaatgccaaaagtccctttattgaaaacaaaaacaaatacttatagtgtatctgaacaaaaagataaaaattga

SEQ ID NO: 6398 - DNA, 477 bp, Glycine max
  Peptide Sequence Number=SeqID_98083
atggtggcattagaaacaatgaatgttgttggttccctgacttcgtgttatgtagcaacagtctctaatattgtgttgtcagtggttgtgttattaaccctggaattcatgactcctcttttcaagccccgaactgctattctagggaagattcctaggactactgtctatagaaacattcaacaatatccagaagctagtaagattccaggtgtactgattccgttaaccgacatagacacaagtggcatccaagcctttcaagagttacacagcagtcttgagaagaagggtgttgagcttgttttggcaaatcctgggccagcagtgacagacaagctttacgcatccagttttgccaacacgattggcgaggacaagatcttcctcactgttgcagaggttgttgcatattgttctccaaagctggttgaggacccttgtaaaatatatatgaattttgttgtcggggaatag

SEQ ID NO: 6399 - DNA, 237 bp, Glycine max
  Peptide Sequence Number=SeqID_98084
atggtcaccataaccccagccaaggttcctcaacctccatttttccaaggatacaacttgaacgcaacatgttcttatcatggaggagtcccagggcattccattgagcattgtatgaccttaaacataagaatctgcatagtttctttcattttgccttgctacaaggtcgtgacaaaagacaacaataaataccttagagccctacgctggggcaatgaaaggcaccatgcatga

SEQ ID NO: 6400 - DNA, 96 bp, Glycine max
  Peptide Sequence Number=SeqID_98085
atgggacaggtgggttttgtggccgatttaggggcagcccttgtggatgattgggtgtttttggctggtagagtggtcggtaatgagaaagagtga

SEQ ID NO: 6401 - DNA, 237 bp, Glycine max
  Peptide Sequence Number=SeqID_98086
atggggtacgtcccaacaatcaaccaattttcaaaaaatagcttaagggggtccccccgccatttttatttgggaaaattggccaccccccccccccccccccacggtgatcagcctgagtctcatgggagttccaaaccaagtgacacaccccctagtacaagtattcctccgcataaggaactacaagtacttactggaaaagtttataccatttcccgtgtcattgaggcatga

SEQ ID NO: 6402 - DNA, 468 bp, Glycine max
  Peptide Sequence Number=SeqID_98087
atgggccagccggatgcgcgattcgtccatggtcttgctgaccggcagcagccgcacgccggccgggtcgcggccgacgcgccggcaggcggcgtccatgcgcgcgtggatgacggccaggttgtggcggaagtcctcgacgctcagcgcctgcggatagcggccgtgctgatcagtgtagcggggcgggcgcaggcgtcgcggcaggcggccattgagcgcggcatgggcgagcaggccgatcaccaggccccagaaggcgccgccgatgccgaacagcttgatgttggccgctgccgccaggaaggtgatcagcgaggcctcgcgtgtttttggatcggccagggcgccggccaggctgccgccgatggtgcccagcagcgccaggcccgccagggtggtgatgaaggtggcgggcagggccatgaacagggcggccagcgtcacgccgaacacgccgaccaggat

SEQ ID NO: 6403 - DNA, 588 bp, Glycine max
  Peptide Sequence Number=SeqID_98088
atgcagcagaaacgacatcctcatgctcagtcatcttcacaaccaacaattaactacacttcggaatatgatagttcgggctctaattttttaactgcctatgaggattgtcaatctccaactaatcaacctgtaatcaacactgaaggatattctgatcttggtgatcaacacatgcaatgtaaatattgtaatgcacaaatgtggtatgatgaaagaatatcaaaagataaaaattatgggagtccaaggttcagcttatgttgtggagatggcaaagttgaactaccattattacaaaatccaccccaatatctccaacaacttctgtttgatgataatacaattgatagtaaaaattatcaacataacttacgagcatacaacatgatgtttgcctttacttctgctggtattaagctagacaaaaaaattaatgattcgagaggacctcctacaattacaatacagggccaaccatgccacagaataggcagtctattaccaatgtctggaaaaaatgcaaatttgcacagctatatatctttgacagagaaaatgaagtgcaaaatagaattaatgccatga

SEQ ID NO: 6404 - DNA, 274 bp, Glycine max
  Peptide Sequence Number=SeqID_98089
gtgaggacgtgtagtcctctgaaggtgatgatgtatagtcctctgaaggtgagggcgtgtagccctatgaaggcgagggcgtgcatccctatgaaggcgagggtgtgtagccctctaaaggagaggacgtgtagtcctctaaaggtgagaacgtgtagtcctctgaaggcgaggacgtgcagtcctttaaagtcggaggaaaaactggaggaatctcagggaaccgctagagatgccgctatcgttgtcggaaaacacgcgagtccgcttagag

SEQ ID NO: 6405 - DNA, 436 bp, Glycine max
  Peptide Sequence Number=SeqID_98090
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgaccccaggcttcccattcatcctactaggatgactgagaaaactggggcaaatgaagagg

SEQ ID NO: 6406 - DNA, 270 bp, Glycine max
  Peptide Sequence Number=SeqID_98091
atgacaccaggacacgcatcagatcctctgcctgatggtcatgccccacagccccgagtcgtccctcaggccccgcaaacggatatccctcatgtgccggagccaggagcatcgtcgacatctgtggaggagcttagacatgcagtggaagtttgtgatgagattgctgagagattggagcgccatctgagtctaggggtggtcacgccagggtcatcgacacatgaggtgatcgaagaatgcctcaggatggccaggagcgtgacatag

SEQ ID NO: 6407 - DNA, 390 bp, Glycine max
  Peptide Sequence Number=SeqID_98092
atgcatggcatgctgttccaactctgcgttcatgtcctcatatttgtgatgctcgctttcttttattgcttgattgcttggcagcttttcaaaatcttccggatagtcaccgcgccattcatagccatcagggaaactgccctcttccctcaagatggtccgtcttgcttttgcttgatggaaactagggttcaagttcagacttttcaaaatcaagacatggcgggggcaggattcgaacctacaatcttcagcttgctaactagggttggcagcaaaattcttcgcgaccccataacatacgaaaaagtttctgagttcataagcccccttagagagaggggcgactttgtagtaattgcgaatgagcaagtagggggcggcaactaa

SEQ ID NO: 6408 - DNA, 381 bp, Glycine max
  Peptide Sequence Number=SeqID_98093
atggtctctggtaatcgattaccaagggggtgtaatcgattaccaggcttgaaaacgaggtcaggaagctatgagggcttttggcttagaattaaaggcagcaggttgtggaggcctctgaggaatgagtcactggtaatcgattaccagatcgtgatggcggcgcagctaatccatgatcgagtggagatggagtgcctagagggagcttgggagaccctcgaaggcaatgcgaggtgccgatttcggggcacgattcgattcacggctacttctttggtgcatctagatgaacccgtgcgcacgcttcagcgtactgtggagtggatactacccacgcctacaccataccgtctagtggagccagtccaagtgattgag

SEQ ID NO: 6409 - DNA, 243 bp, Glycine max
  Peptide Sequence Number=SeqID_98094
gactcacagggttcctttatcgcccatggacatcaggatgtactgattgctgccattaggcgaccagaacaccctggtcgtgtgcgtgctgttggagccggtgtcacgatcaagcaatactttggaccggctccaaggacctcccacacgtcttcctccatggctcctaaagacctggaggagttgacacaacaaattagggaccagctggaggagtcgatcacaaaaaaagtgactcgataa

SEQ ID NO: 6410 - DNA, 203 bp, Glycine max
  Peptide Sequence Number=SeqID_98095
ggggaggaggttgccgcccagctcgcccaggcgaccttagctcgcccaggcgagctgggcggcaacctcctccccctttttcctataaataggctgaagggggctgttctaaggatccctcagccccctggctatgtatttcagctgttttgggttttcgcccgttcttcatcgttcttcatccgttcttcgttcttcaacgg

SEQ ID NO: 6411 - DNA, 281 bp, Glycine max
  Peptide Sequence Number=SeqID_98096
gactgatagaggcccgtaaccagagctggaaaccccagggccctgtgggacttttccgggtccactgggtgtcttgtggaatgttgctaagtagcaacgtcatctatatctacgtaagagtggtcatgttggtgcgcatgatccgcactcgtctctttgcagcggcacaggtgaaatcttgccccggtatgcatagtagctgtgtgatagcctccctctctggttgtgctcgcacagttggccctcctccaatatcagggggtggcccaggaaccgtttaa

SEQ ID NO: 6412 - DNA, 464 bp, Glycine max
  Peptide Sequence Number=SeqID_98097
gactctgccaatcgttcggagtccccgttgcacctagcaaggtgattcggccgcccatcacccggacttttattgagaagtattgcatgcagagacaggcccagggtgatgctccacaggccgcagacgcgccaacacctcatcaggctggcccagttggatcatttgatacggagcagtatttacggcatttggttcgccagcaggcggccaaccatcgggcgcatgtacagacccatgactgtctttaccagttgagcctcagcctgcagagccagggttttacttcttttccatgccctactccggatcagttcagggcagaggtcgtgtggcccggagattggcctgaggcccgggcaggagaggcaccagcaaaggctcccgacgaggcagatgaggcccgcgaggatgaagagatgaccgatttgcttgatttcttgggagggagcagagccacatga

SEQ ID NO: 6413 - DNA, 309 bp, Glycine max
  Peptide Sequence Number=SeqID_98098
ctctctctctccctcacgttgccattttcttcttcttcattctccattgaagctccaagcaaagcttcaacctttggccatcatttctgctcccaaatcgcgaaaggagggcattttccggagtcgtggagagttttctgcctttgctctgttttgcttggctatgatagcttgtgctatttgaatgttgtttttgcttggatgttgtggaagcttgggaggattgatggggacccggtgttgagagaaacgaggatatgggctatgtgggagtacgtgagctcagatggaggtgggcaacaggggatg

SEQ ID NO: 6414 - DNA, 323 bp, Glycine max
  Peptide Sequence Number=SeqID_98099
atgatgaagctgcccgtttgatcaaacaacttacagttgtgcaatcgggagaaggtggaagtcagactcctttatgggattctgcttctcactatagtaatattaattggagtcatcctgaccaagaagatatttgcggtttagatatgggatcaacttttgatatgggtcaagaattatatgttgggatgatcaaagaagatccatcgctcaagatttctttgattcaagagaggatcaatggaatgtttaattacaacatttcttacaggaaagcgtggaaggcgaagcaaaaggcaataacaattgaatatggcgactag

SEQ ID NO: 6415 - DNA, 1297 bp, Glycine max
  Peptide Sequence Number=SeqID_98100
aacaacattcgtatcgaagaagacctgttaggaacacgtgaagtccccgcagacgcttactacggagttcacactctgcgtgcgattgaaaacttctacatcagcaacagcaaaatcagcgatgtccccgagttcgttcgcggcatggtgatggtgaaaaaggccgcggcgatggccaacaaagaactcaaaaccatcccgcgcaaaatcgccgacgtgatcatccaggcctgcgacgaggtgctggataaaggcaaatgcatggatcagttcccggtggacgtgttccagggcggcgcaggcacctcgctgaacatgaacaccaacgaagtgctggcgaacatcggcctggagctgatgggccaccaaaaaggcgaataccagtacctgaacccgaacgatcacctcaataagtgccagtccaccaacgacgcctacccgaccgggttccgcatcgcggtgtacgcctccaaccagaagctgatcgacgccatcaaccagctgcgcgaaggcttcgaccgcaaggcgaaagagttcgaaaccatcctgaaaatgggccgcacccagctgcaggacgcggtaccgatgaccctcggccaggagttccacgccttcagcgtgctgctgaacgaagagacccgcaacctgcaccgcaccgcggagctgctgctggaagtgaacctgggcgccaccgccatcggcaccgcgctcaacaccccggaaggctatcagccgctggcggtgcaaaaactggcggaagtcagcggcctgccggtggtgccggcggaagacctgatcgaggccacctccgactgcggcgcctacgtgatggtgcacagcgcgctcaaacgcctggcggtgaaactgtccaaaatctgcaacgacctgcgcctgctctcctccggcccgcgcgccggcctgaacgaaatcaacctgccggagctgcaggcggggtcgtccatcatgccggccaaagtgaacccggtagtgccggaagtggtcaatcaggtgtgtttcacggtgattggcaacgacacttgcgttaccatggcggccgaagcgggccagctgcagctgaacgtgatggagccggtgattggccaggcgctgtttgagtcgatcagcatcctgaccaacgcctgctacaacctgctggaaaaatgcgtgaacggcatcaccgccaacaaagcggtctgtgaagcctacgtgttcaactccatcggtatcgtcacttacctcaacccgtacatcggccatcacaacggcgatatcgtcgggaaaatttgtgctgaaaccg

SEQ ID NO: 6416 - DNA, 99 bp, Glycine max
  Peptide Sequence Number=SeqID_98101
ttattaccatggtacccaaggcatgcaactaagaaagcggtgcaaactttcacaattctttgtgactttgatggcagagaaaaagaatgcaaggcatga

SEQ ID NO: 6417 - DNA, 1368 bp, Glycine max
  Peptide Sequence Number=SeqID_98102
atgggtgacgaggtgcgcatttacgccgtgcgcccggcacccggcgcaatggacaccacgtgcgtacagttcgcgagtgccgatctgggcgcttccgagtcgcgcgcgctgtttgtcgatccttataccctggcgatcaagggtgatatgacggtgtacggcacctccggcgtgctgccgctgcgcacctggctggacaagttgcacagcagcctgctgctcggcgatctggggcgcaactacagcgagctggcggcctcttggctgtgggtggccgcgctgggcggcatggcgctgtggctggcgacgcggccgaagcgcaagctgaaaaggtcaaaagggggcttcgccgccagccgccattggcatatcacgctgggtgtggcgctgctggccgggctgctgttcttctcggctaccgggctgacctggtcgcagtgggccggcggcaacatcgacgcgctgcgggccaacctgggctggctgacgccgcaggtcaacacctgcctgcaggccgatgcaccgcagacgccggccgatccgcacgccgagcatcgcgggatgatgccggggatgaagatgggccctgccgcgcagagcaatgcgctgaacggcgactgggatcgggcgctacacgctgcgcgcgccgctggaatagacgccgttaaggttgagctgcgccagccgaaaggcgagggcaaagcctggacggtaaccgaagtggatcgcactgctgctggcggcgttcggccttgggctgtgcttgatgattgcgctgggttaccgcatgtggtggagtcgccgcccggcggcgggggcgcagcatccggtgcatacgctggttgccgcctggctggcgctttccctgccggcgcgtgccggcacgctgctggtggcagcggcgctgggttattgcctgccggtgatgggcgtgagcctcgcggcgttgctgctggtggacgtgtggcgctggcgcggccaacggcaaggccaccgggacgaaatgccggaagcggccgcccgccgtgccgaggtgcgcaagttccgcgcggcggtggcgacggtggcggtggcggtcggctgcgtgatgggccgagcgatcctcggcggcaccgtcgagcaattccagctgccgatcggcgcctggagcgcccagatggtgatcatgcagagcctgatggtgctgctgtatacgctggtgttcaccctgctgctttccattccgctgtggtatttcttcctgggggagaaagaggggcggtgagaaggcgtccggcatgccttcgggcatgccggatatttgggaatgtggctcaagcgcgtatcatcttggtcaggcaggataatcagcgagaactcgaccactga

SEQ ID NO: 6418 - DNA, 321 bp, Glycine max
  Peptide Sequence Number=SeqID_98103
atggagaattgcactaagcaatcactacgcatggctccaactcgtgggtggaggatcatgaatgaaaatgcatttcatggggctacgaaaaagggtagagaatggagaattgcactaagcaatcactacgcatggctccaaactcgggttgatgaatggagaattgcactaagcaatcactacgcatggctcgaaactcgtgggtggaggatgcatgaacgaaaacgcaattcatggggctccgaaaaagggttgagaatggagaattgcactaagcaatcactacgcatgactccaaactcgtgggtggaggacgcatga

SEQ ID NO: 6419 - DNA, 690 bp, Glycine max
  Peptide Sequence Number=SeqID_98104
ccggatgccgcgcacagccagtttaccgctgtgccacagccagcggcggagagcgtcagcgacgacgcgttcttactgtttgccgccgacggctttgcgccctctgctgcactgttgcaggaagtggcaacgctcagccatcagcgcccggagctcaactgcatgctggtttcactggcaccgcgcgcactgagcagcggcctgcagccgtcgctgcagctgtttcagcagctgcaggcgcagcgcctgtggcagcagaataactatgcggtcatcctgcgcgccgcgctggtgaaaaatgccgctccgctggtgcgcattcaggatgtgatgctggccggcctgttaaatacgcaaacggtatggctgctggatgcccgcgcggagcatcaagtcaccacggttaatccgccgcccagctatcagcaatttatgacggagtatgaaaaggtcacccgtttgtcacactttattccggagcgaaaccgctatcgccagagttatttacgcagcgggttattacagctggtacagcaggaattaaacgctgaaacgcagttctctaataatgtgcggcacgcggtgcgctactttgccgatcagttttcaccgcagagcacaatggaaaaactgttactgaaacagcccgacctctatttctcactgatgaaaatgagaaaaagccgctga

SEQ ID NO: 6420 - DNA, 432 bp, Glycine max
  Peptide Sequence Number=SeqID_98105
atgcccttgtggggtaggattgcatcagtctacaccacagaatttgatgaattcttagatgagctggatagaagacactggagggaggagttgactgactttcaggacggcaacatcgatgttgccattgtaaaagaattctatgcaaacctctatgaccccaaggacaaatcacctaagcaggagttagctgctaagctttgtatcccaatgaggggattcgagcttaatgttgatagttatccagtgaatattttgaggaagaacatgaccactcttgctcaaacttggagcgttctttccttttcaaaccttattcccacttcccacacttttgatgtcactcttgacagagccagactcatttatggcatcatcatgaagatggacatgaatgtgggtacttcatctcccaccagatctccctcatag

SEQ ID NO: 6421 - DNA, 495 bp, Glycine max
  Peptide Sequence Number=SeqID_98106
atgatctaccattcatgttttaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgtgccattgatttagatgaattagctgttgcggcgctcttctcttttctaaagcaaggaatttcctttcattcataa

SEQ ID NO: 6422 - DNA, 348 bp, Glycine max
  Peptide Sequence Number=SeqID_98107
atggcggcgcagctaatccatgatcgagtggagatggagtgcctagagggagcttgggacaccctcgaaggcaatacgaggtgccgattacggggcacgattcgattcacagcgacttcattggtgcatccagaggaacccgcgcgcacgcttcagcacactgtggagtggatattacccatgcctacaccataccgtctagtggagccagtccaactgatcgagggtgatgaggacccactcattgaggtggattctcccgaggaagtcatgtcggcatctgaggcagactctacgaaggatagtggcccgagagagatggcgaccagtggaggctcttcatcatag

SEQ ID NO: 6423 - DNA, 411 bp, Glycine max
  Peptide Sequence Number=SeqID_98108
atggaccatttcaagtgcttgaaagaatcaatgacaatgcttacaaagttgagctgcccggtgaatggagaatccgatttgaggacaaatccttctcaagagggagagaatgatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgttagtgggtcattactaaaatctgctgtaaagcttctatataagctgagccattttatcaataaacacaagttgagttttattcagaaaattagagtttatctctttatctttgtgagagtgattctcctaaattcttga

SEQ ID NO: 6424 - DNA, 2247 bp, Glycine max
  Peptide Sequence Number=SeqID_98109
atgggcaaggagtggtattttgctggaagatcatctaagagaggtgtaggaggaggtgctgaggctgaaacacaagccccttctggttgcatgtgtgctgtttttcagttctttgatttccatccttttcactttcccaacataaaccaacaacaccaacaagatcaacaagcctcttttaagccaccctcatgcacctcagaagaccacaccacagtctcaaaaggtgctgaagcacctaggaacagcttagaggcagaggatggtgatggtacagtttcatctctctcatcaaaagaagatgattttaaaattcctaagaatattatacaaattaagacaagtggagccacaagaacaagtggtggaaatttgaatgacttgtcctcagaactcaccagctctccagggacaaagacaccaactttagtggcaaggttaatgggtttggatcttcttccaggtgcaaactcaccctctttttcttcttcatgtctttcaactccaaacacacaagacaatgtgccacatcttcaccaccacctgaggcacaagcaacatgtccaaaccaagcacaggaacagcgtagatagtagtgacatttcagccacaagatctttgcctgagacaccaagaatctcctcagcaagaagatcagatgttgatcatcaccacagactctcactccaaatcataaaggaaaacatgaaccttggtgaggatttggagctccctaggctctcattttccaaaaggaagagtgatgagaacaatggcaggagtccaagccactatgccaggcaaattgtcaaacaggctaaggaaagtgtgagcagaaaagttgggcaagacatcaccaacacaactctcaaagcaagagaagaaaatgcaggccaattcagaagcaaaaagtctcccaaaacatcatcactgaaagcaattgatgaaactgaaaccagcccaaataaacactcaaaccaatcttcctactccccaaggcttagattcattgacaaacacaaaccaagcacaacaacaacatcaacagcaccatcaccactcaccccaaaagatcaaaacatgctgaaactaccaccacctccttctccagttaacactcaccaacctcagcttccaagagttttaacaaaaccaaagcttcaagcagtggtgccagaacagaaagagtttcatcagaacaacaaatctgttccaaaatgcaaaaaggctaccaatgaaaaaaagttcaactcaaggctcatcaaaaggcctccacagacatcagacatcatcagaaacaagcaagaagaaccattcatcattcgtcccacatcgcctactagagccagtgacatcaaaaacaccaaaagcaagaaaaatcatccattgtcaagcaatctcctcaacaacatcagcaatgtaccaaatcttctacctgtcaagacagacccttctccttcggcaaccaaaattccttccaaacaggtctgtgatagtcgtcatcaagagtccaaaagcagttcacagttatctagttgtgcgcgccagaggtacaaacaagaagaaacaacaaccacactactcgctacccgagataacaacggtgccttcttctcctcctccaccgtcacccaccctcccaccccacaagagcttcagtacatcacagcaatccttgcacgtaccactgccctaaactcacagggtacccccactacagtttccttaaaccagcccctcgacccatcaatcttccaccacctcgaacaccccgccggcgacaaagatcgcaactttgccccgaaagaccaactgggtcaccgttggaatcggagattactgttcgatttggttgacgaggttctgagggagattctggagtctcaagagggagagagagaaaagaggctttggtttttgaagggtggtatttgtaaccaaagagggaggagcgttgaagggttggtgaagagggtgtggaagagggttgaggagttcccacgtgccaagtgtgaggtgttggaggacattgatgagttgattgacctgcagagagagaaagatggtgagagaatggaagaagaaggggaagaactggttgcagagattgaagggaacatatgggacacgttagtccatgaaacggttatagttatggattgttgggaaaatgctaaaaaagaaaaattattactatatgatgattccaaaatatcatcacatgtttgcagtctcagtcaattttaa

SEQ ID NO: 6425 - DNA, 633 bp, Glycine max
  Peptide Sequence Number=SeqID_98110
atgagagctcaacccgttacatgccttagatgtctatttctaggtgtaagagagagctcaacccatcacattcgtccatgctctgttgtgagggatattaacaaaatcattgagaggtatcgccaatgtcgttacagcaagtcgcagactgacgattcattggaacacgattcacagagttcataccatgaattcttgaaattaagagcgaaatatgaatcacttgagctgacacaaaggcattttcaaggagaagaacttgagccacttagctttaaagatttgcagagccttgagaaacaactagacataacgctcgcactaactcgacagcatcaaacgaagaaactcttggcacgagcagatgaattacgcgaaaaggaaaaaattactacctgtaaggttcacaagttggaggatcttaacaaacaattagagtccaaggaaaaagatgaattctcaagcttcatccttgacaataacaattacattcaagtgcatgctacacaaggtttggaatgggtttctcactaccttggttatggttttatggttatgttatctattgctagtgacaatggtatcttgtacattcaagtatttgggagttttttaacttcttctaatctatag

SEQ ID NO: 6426 - DNA, 63 bp, Glycine max
  Peptide Sequence Number=SeqID_98111
atggtccatgacatcttggtcaaagtgaaactggaagtaacagggacatcaatagtgctaaat

SEQ ID NO: 6427 - DNA, 375 bp, Glycine max
  Peptide Sequence Number=SeqID_98112
atggataatgaagagggcgtgcaggaacagatgaaggccgatctatcggccttgaaagatcaaatggcttccatctcggaggtcatgttaaaactccagaaaaccatagaggataaagccaccgcaaccgcctccaacagaaacacggccgtgttcggtcgaaggtatagtccgcaagcttatccttatggcctgcctccggacttcaccccccgtgccaccccggaagatttaagccaagcccctacttttgaggggcaactcccaccttatgaagactatcctgggcaagacgatggggaaggagatacccatcttggccccctactccacctcaagatccatccccgcatgaattaccccagccgaacatag

SEQ ID NO: 6428 - DNA, 99 bp, Glycine max
  Peptide Sequence Number=SeqID_98113
atgggtgccaagtacctcgaagtggtcaaacgagggtcgcatcccaacaatggttggtccccggacgaaattagggaattaatgaaacattgggcttaa

SEQ ID NO: 6429 - DNA, 720 bp, Glycine max
  Peptide Sequence Number=SeqID_98114
atgggtagaggcgaatgggccccgttcatagacattctcgcactgttgatcttcgaaggagtcctctttccaaatgtggatgggttggtggacctagcagctatcgatgcttttctcgcctatcatgaccgcaaggaaagctcggttgtcgctatactagccgatctatatgacaccttcgaccgaagatgtgagaaaagcagtacgaggattgtttgctgtactctggctctctatgtatggttggttttgcacctttttcgccaagtgaggcatgcttgctcgctagaaagccaccgttcatgcacagagaaaggaggggcaaattgggaccgactcttagcaaacaaagaaggagcgtctgtcaactggttccctcgatggaaagaaggaagaaccggagttcttattttgtgcggaggattcccaaatgttcccttgatggggacaaggggttgcatcagttacaatcccgttcttgctataagacaacttggctaccctatgagaggggcaccactaaaggaagagctcgcacctattattgcacgaggtttcaataaaaccaacgtggaggcacttcagaaggtccgcaaggcgtgggagacggtgcaaaagaaggagaaagaactcaggggcagtaatagcgagcttaggctccggagagaggagagggaccaatcacgagtagacagtttgatcttgaaggatgagttgaag

SEQ ID NO: 6430 - DNA, 204 bp, Glycine max
  Peptide Sequence Number=SeqID_98115
atgatgacaaaggtgatgacaaaaagctcaaagatcaatcaaagaacaactcaagagaatccaagatcaatcaagaacaattcaagagttcaagacaagaatcaagaagaattcaagactcaagaagaaagtctagagacaagaatcaagattcaaggatcaagatcaagattcaagaatgaagagaagattcaatcaagataa

SEQ ID NO: 6431 - DNA, 231 bp, Glycine max
  Peptide Sequence Number=SeqID_98116
atggagggtacatcctttgtggtacaagtagagggtacatctacttgggttgttgtaactgagaacaagagagggtacatctcttatggatcagttcaggtggagggtacatccacttggttgttcaaagagaacaagggagggtacatcccttgtggatctttgcttgtaaaggattttacaaggttgaaaagaaatctaaaggaccgcaggtttctctttgagtcctag

SEQ ID NO: 6432 - DNA, 102 bp, Glycine max
  Peptide Sequence Number=SeqID_98117
tcgaagtacttccgtaacgcttccgtaagcgattctgtggaaattcttcatcgttcttcgtcgttcttcaccgttcttcatccattcttcgttcttcaacgg

SEQ ID NO: 6433 - DNA, 729 bp, Glycine max
  Peptide Sequence Number=SeqID_98118
atgagtgactggatcgtgccgcagtggccggcgccggtgcgcgtgcaggcttattcgaccacgcggcacggcggcgttagcgcggcgccatgggattccctcaacctcggcgcgcacgtcggggacgaggcggatcgcgtgatgcacaatcgtcagcgcgtggtagagcaacttgcgctaccggcgatgccgcagtggctggagcaggtgcacggccagacggtggcgcgtctgccggcggctgcgtccctgccgcgagccgatgcggcgataacgcgggaaagtggcgtggtgtgtgcagtgatgaccggcgactgtctgccggtgctgttttgcagccatgatggcagcgaagttgccgcggcacatgccggctggcgcgggttgtgtcatggggtgctggagcagacgctggcacagtttcactgcccggcgagcgagattcatgcctggctcggtccggcgattggtccgcaggcatttgaagtgggggctgaggtgcgcagtgcgttcctggcgcaggatgccgctgccgatgcggcttttcgcccggccggtgagaaatattttgccgatatctggctgctggcaacccagcgtctgcaggccgctggcgtgcgttctgtcacggctgatgcgcgctgcacctatcaggaaagcgccgattttttctccttccgacgcgacggaatcaccgggcgtatggcaactttgatttggctgagataa

SEQ ID NO: 6434 - DNA, 457 bp, Glycine max
  Peptide Sequence Number=SeqID_98119
atggcgtctccatgtcagggccttttcagtcagcacagagtgtggaagaaggggagagcgacagtcagtgaaatgccccaggccaggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 6435 - DNA, 500 bp, Glycine max
  Peptide Sequence Number=SeqID_98120
atgccccaccacaatctagcggactttgagccttgccttatatatgccattgaagggcaaacagttggtggtatacccatgccaaacactttgaagggccctcagtttcgcccacaaccacaacccttgcattttggggtgggaagagcccctcctgctatggctgaaaagggaaagttagatcatatagaggaaaggctcaaggacatagaaggaggcgaagattatgcctttgctaacctagaagagttgttcctagtacccaaacatggttattcccaagttcaagctcaagtagcgcccccaataacagagaaagagattatcacaatgatagtagacatgttactagtgttctattatggaaatggtggtgtcgcaacctacccttttgcgggccagcgaggcgaggctcacgggtgcgctttccaaaggaggaaatgcgcggattcgccaccaacgtttatttgtggaaacatcggaaaaaccgaaggaaaccg

SEQ ID NO: 6436 - DNA, 588 bp, Glycine max
  Peptide Sequence Number=SeqID_98121
atgagaggggcaccactagaggaagagctcgcacctattattgcacgaagtttcaatagcaccaacgcggaggcacttcagaaggtctgcaaggcatgggagatggtgcaaaagaaggacaaggaactcagaggcagtaacaacgagcccatcgatggctaccgtaggtggttgaaagcacacatgcaaggtctggattggctctcgagtttgagaatcactaagggggtggaagttgaagctctggtggaggatgaagaggtgcaggccctcagggcagaactcgagaaagcccaaacaatcaaggaaaagttcaaatcagcagctcttaagatccgaaaggagaatgccaaactgagagacgtaaatatagccgccaccaaggccttggaacaaaaggaccaaaaggcaatgctgtggatggaccgatttgctcttactttgaatgggagtcaagaacttccccaattgctggccaaggccaaagcaatggcggacgcctactccgcccccgaggagatccacagacttctcagctattgtcagcatatgatagacttaatggcccatataattaggaaccactag

SEQ ID NO: 6437 - DNA, 372 bp, Glycine max
  Peptide Sequence Number=SeqID_98122
atgcatatgacacagatgcaatttacgaatatgggagcccgagaaactgtctccttcttagatacaacgtctaggggtagcaaagtgccccaacgtatgtctaggggatccccagtggagtcgccaactgtggcaacctacccttccgcgggagggcgacgcgagactcgcaggatgcgtgttccacgaaaggaatacgcgcggagtagccaccaacgtttatttgaggaaaacgtcggaaaaaccggaaaagacgcgatctacgaacttttaagtgaaaggttcgggagttgtatttacgcacagggaagggtgtttccctttgctcctacgtattcctcaatttgcgatgaggaaatcagacctacgtag

SEQ ID NO: 6438 - DNA, 132 bp, Glycine max
  Peptide Sequence Number=SeqID_98123
atgacaagacaagacaaaccacatactagcttaaaggagcactcaaaccaggtgacccccaaggcctacactccgaagagtccgtcagggtctctccctcctgattcaggtccaacccagaaaatattttag

SEQ ID NO: 6439 - DNA, 366 bp, Glycine max
  Peptide Sequence Number=SeqID_98124
atggtgaaagttggaacctcttacgtgccgatcaacgtctcattttcgccaaaagttggcccagggcttcccggtatcaacagggacaccagttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 6440 - DNA, 468 bp, Glycine max
  Peptide Sequence Number=SeqID_98125
atgcatgtggagaaaaatgtatgtgacagtgtcattgggatgctccttaacattcaaggcaagacgaaagatggtcttgtaaatcatgaagattttgatgatgtcaagaagaattttcttgacaaaggggcagaatgtggatcatccattgttttgatgatgtcaaaaagaaatcacttgattgccatcatcaaaaaggaggagaatgtgaaggtgacttgggcacgaattttgaagagagttttgcttgttgaaaatgtcttatcctctcaaaaggaaatgaaagagatattccaagagaacttcattgccaaatgctctctcaaaagaaactctcaggcaaacacttgcatatccattaagagtttctccatggacttcaattgtaatatccttctcttcaagaaagaattcttctttttttcttctctttcaaagagattgattaagggactaagggtctcttaa

SEQ ID NO: 6441 - DNA, 732 bp, Glycine max
  Peptide Sequence Number=SeqID_98126
tgtatgactagaggcaatccatctgacttacaaccctttgaccctgagatagataggacatttcatagattagttaggcatcattttataccttttgatcatcctgagcattccattactggtgaatttgtgcattctgttattggtgattttgaacatcctgatttggagcattataattttgagcattctgattctgagcattctgattttgcacattctgagaacatggcacaacctccatcccgtgagaggactctaagggaaatggctgcacctgatttcacctacgaaagcttgtgcatccaataccctgatgaggatggagtggcaaaggactggttgtattaccttgctccaaggtccatcacgagctgggatgaccttaagagagtattcttagaaaaaaatttccctgcttccaggaccacagccatcaggaaggatatctcaggactcagtaatatggagaaaagtatgatagatgctgccagtggtggagcccttggagacatgactcttgctgaagccagaaatttaattgagaagatggcttccaactctcagcagtttagcgccagaaatgatgccatagtcattagaggagtgcatgaggtagctacaaactcagctgcatcatctgagactaagaagcttgaaggaaaactggatgcattggttaacttggtaacccaactggccttgaatcagaaatttgtacctgttgcaagg

SEQ ID NO: 6442 - DNA, 372 bp, Glycine max
  Peptide Sequence Number=SeqID_98127
atgggtttaggagaagaagtattagctcaagaagatgagaggggtagatgttttgagcctgaaacctctgaggatgagtggcagaagtctcgaactagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaagctgtgaattcatttcgtcaggtgctacttacaagagatctgcttccagattcccatgatgattatcatgaaatgctgagagattcagtaaatgcgctattaaaggattgttcgtctaaattgccattctttgatgtttga

SEQ ID NO: 6443 - DNA, 273 bp, Glycine max
  Peptide Sequence Number=SeqID_98128
atggaggagttgattaacaaaacacaactctctcccaaatctaatcccaacgtcatcacttcagctggagggctccataatagaatctcacttcctgcaccctactgctgtcattctgttcccacaaacaaggttcgcgatcatcacagtaattatggaggccacccagtcgtgtaccataactcccccccccccctcggtcatcaacctgggccacaagggagttccctaccaggtgatgcaccccctagtacaaagtacatattgccatag

SEQ ID NO: 6444 - DNA, 171 bp, Glycine max
  Peptide Sequence Number=SeqID_98129
atggaggttgaggaaccctggcagcgattatggctaccattgcattatcaagcatgccttgtggctgatttggggatgacttttgtggatgattgggtgatgggtaataagaagggtcgatattggctgagcgatgacatttttgggttggtaggaagtttggccatgtag

SEQ ID NO: 6445 - DNA, 168 bp, Glycine max
  Peptide Sequence Number=SeqID_98130
atgaagcatagctccaaactcgaaggtggaggacacatgaacagcgctaggcaattacattcatggggttaccgaaaaaggggagaatggaggattgccttgagggcaatcatgaagcatagctccaaactcgaaggtggaggacacatgaacagcgctaggcaatga

SEQ ID NO: 6446 - DNA, 87 bp, Glycine max
  Peptide Sequence Number=SeqID_98131
atggcttctatggacaccttctgctatggttcaactctaagatctttccaacctcttgccggtttgatttgttcccatgcttactaa

SEQ ID NO: 6447 - DNA, 2298 bp, Glycine max
  Peptide Sequence Number=SeqID_98132
atgtcggagactcttggatgtttgcctgctgcacttctattgttcgcatcccatgcaagtccattgcagcttgtgagtcatctgccgggagtaggtacagtcattgcacacctcgcatgcaaagcgggagtccgaacgccaggcaatgtggtggtcaggggcagtgatgttgccagaacgctgaatgcgcaggtagatgaacgccttgtgcagggcttcagcatgtcaattgccggcgaggccttggaaggaggaggccttgggccatgcaggtgtccaattgcggccagggacttgcagcaggaaggcagccaggcacagcagagtaatgctgcactgagcacaatgcacagtcttccgcagttattgggaggctggaaattcgcacaggagtgtttcatgtacatcactgaccaagggtgccattcaggtggaacttccatcaagcttaagcttgtactttcgaattcgaacgctggaatttttgccttgcttggcaaacacttgcgtatccctgtgtctgacgctgacgatgacgggatactccccagcgatcagaatacccgtgaaaagctggtatcagatgtcctaaaatgtacagatgagcccaagtcatctgaagcacacctcataatcaagcgcaaaatggacaatgagaaacacttcggcttcgcaattccgcaattgcatggatccatgcaacttaggggtcgagatgaaatattcagcagccgtccatggaagccttcacagagcgagcacggaatgcagaccagacaggagcgttccatcaaacttccggcaaccaagaatgctctgccagtggggcacttgcgcactttgtgccagaagcacccattcgagccgaagatgggaccacaaaacagcacagcctgcgaattgtgctgttgcactgtgtgcgactttgaggcaagcatctgcacgaaatggggacagcccgatgcacaggggtgtctgaattggaccactgtaatgcccacccacactggagggaacattacgcaacggagcacgggtttactaattcctgtattgcactcggcattcatctctgatgtttccggaatgcacatcatgctcgtggcacatctctggactggtgcacattgcaaggacggccagagcgcgccaatgccggctgcccacttcccggcaattaataggccccaagcaggcacgccacaacagccagctggagctgcccttgagcccagggctgcgccaggagggaaggagccggccgccttgggcggcactaaggacggcgctaggcagaagccggcgcccactcaattggacacctgctatgcatcatcgcttaccatactagaagctgatgcgcgcactgcggcgcaggttggctacaccatcggtcacccaaggggcctcaaaaaaatttgcctcgaagatcagcctcaacccttgaggagcgggaagaaattgttgtttgccaatccacctctggagaaaatgagcgcccggaaaatctattgcaagactgcaacaaggcagggccatgatggagaaaccttacagtcaatgccagaaggcatcaagcctctcgtaggcgcgacaagcagcaatgatggacgtgtcagccctgtattaagcacacgagctgggtctcctcttgcccacgctgatgctcccaagaagaaacctgaggatcccgtgcgtgggcgagaggttgaccattctgtggtggtccccgaggacgagcctgcccatgggccactacgcgcatgggtcagcttcaaccagcaaggtggacctgcaccggcggagccgttggcggcgggcctagcacttgtggcacgcacatcgcctgccaatcaaagctctgcaacaatggccttgccaggcgcaggggaacgaccaggcacttttggctggccatggccaagcatacatttcacaaaacctgaaggcctatacaccttagacacgtttctagggacgtgccaattggtgtacacctcctgtcaagcaatctacatgtactttggtgccgcgtccggctatggcaaacaatttaatgaaacggacgagtgtaaatttgtggttaaggccttctctacagcaatcttgaagccaatggaagggtttctagcactaaagatcaacaaaattgtgaacgggattgttcaagccttgacagttgctgccttcctagcattcgcttttggtggctacacaacttggggaaaggcaattttttatgtgcttggcagcattgcatgtatcaatgctgctatgggcaagaacggggcttactag

SEQ ID NO: 6448 - DNA, 321 bp, Glycine max
  Peptide Sequence Number=SeqID_98133
atggacccgaagaagtccaatagggtcttggagttgccagctcggattatgggcctctgtcagttctacggagtgcctgtcacccccagcaaggtcatcaagccccctactaaccaaactttcatcaagaagtactgcgcccccaggcaggcgcagggcgagacaccacagcagcctggggatggccggcacaggcaacagacgcaccgccgtcacctccaaagcccctcagctcatctacaaaagctggagcgttgcctacgacctgtggtcgaccagcaggcgaccaagtccaaagccaaagataagaaaaagtactag

SEQ ID NO: 6449 - DNA, 168 bp, Glycine max
  Peptide Sequence Number=SeqID_98134
atgagcgccaagccgaaattcacttatgcacgcaaagggagccgagttgtggacagggctagtttagcgtattatcacgagggatcagggattaggctagactatcacgaggaatcggggtttagcatttcaggagacaccatagaacacatgagcattgttaagtag

SEQ ID NO: 6450 - DNA, 1030 bp, Glycine max
  Peptide Sequence Number=SeqID_98135
gtcgactctagaggatcccaccgtgttcgccttcaaaggactacacggcctaaccttcagagggctacacgccctctccttaaaaggactacacgtcttcgactttagagggctacacaccctcgcctttagaggtgtacacaccctcgccttcagaggactacatgtcctgaccttcagaggactacacctcctgaccgtcagagggcaacacgccctcacgttaaaaggactacacggcctcatcttcaaagggctacacaccatcaccttcagaggaatacacgtcctcgcctttagaggactacacgtcctcaccatcagaggactacacgtcctcccctttagagggctacacgccctcacctttagacgactacacgtcctcgctttcataggactacatgtcctccccttcagtggagtacacgtcctcaccttccgaggagtacacatcctcgccttcagaggactacacgtgctcgcctttaaaggactagacatcctcggcttcagagggctacacagagtcaacttcagaggactacatgtcttcacctccagagggctacacgccctcactttcagaggactacacgtcctcgccttcagagggctacacatccttgccttcagagggctacacgccctcaccttcaatggactaccggtgctcgccttaagaggagtacacggccttaccttcagagggctacacgccctcaccttaaaaggactacaggtcctcgcctttagagggctacacaccctcgcctttagaggtgtacatgcccttgcctttagaggactacatgtcctcaccttcagaggactacacgtcttgaccttcagagggcaacacgccctcaccttaaaaggcctacacgccctcgccttccaagggctacacaccctcaccttcagaggactactcatccttgccttcaaaggactacacgtcctcaacttcagaggactacacgtccttaccttaagagtgctacacacccttaccttcagaggactacac

SEQ ID NO: 6451 - DNA, 95 bp, Glycine max
  Peptide Sequence Number=SeqID_98136
atggaaatatcctcattccatcaattccctgatgaatcactcagtgaggcgctcaactgtttccacgggctactcagaaagacacctacacatag

SEQ ID NO: 6452 - DNA, 546 bp, Glycine max
  Peptide Sequence Number=SeqID_98137
cgcccacaaagacacccagtggacccggaggagcccaaacagggccctggggtttccaactctggttacgggcctctgtcagtcctacagggcgcccgtccctccagcaagttcatgccatcatggcatagggatcacgcccgctacacacccagtggatctggagaagtccaacagggtcctggggtttccagctctgattatgggcctctggcgagacaccacagcagcctggggatggccgacagtaggcaacagacgcaccaccaccacctccaaagcccctcagctcatctacaaaagctggagcgttgcctacgacctgtggtcgaccagatcttcttcatcaacggattcctttgcttcttggaagatgaatggcagcggaatggagaaagggagagagagaagagacgccacttcaaggagaagataagtctagaagaagctcaccaccataggaggccatggataagagcttggaggaagaaggagatgaatgaagggagagggagagaagagcacgaaattttgtgctctaaatga

SEQ ID NO: 6453 - DNA, 270 bp, Glycine max
  Peptide Sequence Number=SeqID_98138
atggaggggatactacctaaacctactccatatcgactagttgagccggttcaagtgatagaggtgtcatcctctgaagaggatcttgaagatgacccagaggagttacctcctgaacctgctgtggacgcccttgacttacctgaggatgatgaagacccactccctgatgttgattccccagaggatattatgtcagcatctgaggcagaatctacagaggagagcggccctggagggacagcgaatagtgaccactcttcatcgtag

SEQ ID NO: 6454 - DNA, 330 bp, Glycine max
  Peptide Sequence Number=SeqID_98139
atgtatccaaatttacaaccatttctcccaagaaaagtggacatgttacatacggtgacaacaatatcagtaaaatctcaaaagagttctaattttgaaattgtagaagcaaagcttcttgatgaatcaagattgattcaaagatgttttgatgataacaaagatgatgacaaaggtgatgacaaaaaatgtcaatcaaagaatgagttcaagatagaatcaagaacacttcaagattcaagaggaaagttgaagaacacttcaagattcaagaggaaagttgatttcaaaattcaagactcaagattcaagaatcaagagaagacttaa

SEQ ID NO: 6455 - DNA, 498 bp, Glycine max
  Peptide Sequence Number=SeqID_98140
tcctcttttaaatggttgaaccatcattcgatgctgctactgcaagtgcaacgaggaaaaataagacagacccaggctgaaaatattgtcattcaccggtggaaggagatagaaacaccattgtttcttccaagaaaagatattgatgtgtgcaataacaaccaacaattgaagcaaagatataatgcaagagatgaaattgatccaatttctcttaatgatattgatgtgtgcaatgaatggctcgtgggagagatggatcaagatggtgataatgatgctggaaatgatttggtatttgaagatgatgatgctctaaattgggcaactgtgtatcaggcttcgggggttggagagtgtaggatgtatactaggcgtaaaaaacaaaaaacaacaagtgttactactgcccaaacttctaaaaaacaggcaatggttgttggatcttcatcaagaaagcaaaaaacagtccaagaaaatgatgaggatctagattga

SEQ ID NO: 6456 - DNA, 480 bp, Glycine max
  Peptide Sequence Number=SeqID_98141
atggttactatgatggtggataccttgcctgtattctactatgagaaattagtgggctacatgcctgctagcttcgcggacttggttttcaccggagaaaggatcgaggtgggtttgaaaagagggaagtttaattacgtctccccaataggtgccagtggtaggaggactggaacagctggggcaaaaaagaaagagggggatgcccatactgggctcttcctacatagcgctcgcctagccaagggcacctatgcctccccaggggggagctcctcaggctccagctccaacccggcctcactcgaccaacaacgcccaccttggctcgggatccaacacggcaaggaacttctttccaaggcaggctcagattttcaccccgatcccaatgacgtatggggacctcttaccatctctcatcgccaaccaactggccatggccacttggtcgaacagtgcttggccttgaagaacaag

SEQ ID NO: 6457 - DNA, 1107 bp, Glycine max
  Peptide Sequence Number=SeqID_98142
ctgccgcgagacggcggagcggggctctatcccgacgcggaggcccacggatccgcacccggcatcgaggcgacgaaggacgccgccgagggtgttctcggtatcgagatcccgtattacgtcttcgtcgacatgcatggtttcgcggagctcgtcgatgcgctcggcggcgtggagatcaccgtcaccgagcggctgccgaagggaggtccgccggagggctggaccggcaccgacgtgaacgagtgggcgatcggctggatcgaaccggggaagcagcgcatgaacggcgacaccgcgcagtggtacgcgcggtcgcggtacaccaccgacgactgggatcggatgaaacgtcagcgcgaactgcaggaggccatcctggcgcaattcacgccgcagaccgtgctcacccgattcaacgaagtggccgcagcggggacggcgctgatcagcaccgacctcccttcggacaagctcccggagttcttcgatctgatgctcaaggcgaaggagcagccggtgacgaccatcgagctcactccggaaagctgcaccctccgacggagagcccgacccccgcgccctgaccgcatcggcttcgaccgcatgcatcggcgcgggacgccggtgtgcggcagtgtggcgcgccgtcgcagcggtgcgatgccggtgtcgggcgacgtcggtgtggcgcgccgtcgaagcggcgtgacggcgatgcggtgcgggcgatgtcgaggcgcgacaaagcccacggccggcgctcgccgcgacgaccgtgggcttccggcgaaatcaccggatgtaccagacgacggtgatcggagggggagggatcaccgtcgtccagtcgaccgccgcgcgaacggcagccggactcaggcgcgcttgcggcgcgcggctccgacggcgaccaatgcgccgccggcgacgagtgctgcggcccctccgccgaggatccacggcgagacgctgccaccggtgagcgcgagttcgagaccttcgcccgtgagcggcagttcggcaccggcgggtgcgacggcaggatcgtggtcgcagctcgccgctgcgtcgttgccgtgcgagaccgtgatcgtggccgtgtag

SEQ ID NO: 6458 - DNA, 177 bp, Glycine max
  Peptide Sequence Number=SeqID_98143
atggtgattttctaccatggagatgcagcggaagataaaggagaaaaggagcttaaccaccaagagagtgccttggataagaagcttagagaggaagcttcaatggaggaaaagaatgagagagagggagggcacgaaattgaaggagaaaaagagggagagaagttgaactttgaa

SEQ ID NO: 6459 - DNA, 210 bp, Glycine max
  Peptide Sequence Number=SeqID_98144
atgactaatgaaaaagaaccattaaggaaaaactggtacatagataacgggtgctcaaaacatatgatgggagatgcatcaaagttcacacatatctctcccaagaaaaacgggcatgtaacttatggtgacaacaacaaaggtagaatttatggaagcaatgacttccaagattattttgatgatgccaaagaatcaagagttaagtaa

SEQ ID NO: 6460 - DNA, 486 bp, Glycine max
  Peptide Sequence Number=SeqID_98145
atggaagggttagtggacctagcagcgattgacgctttcctcgcctttcatcatggcaaggaaagcccggtcgtcgccattttggccatgattctatcttcattcgaaggatgtcccatgagaggaacgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagctttggaagaaagtgatgaggtacaagccctaaaggcagagcttgaaagagcctgggtagtcgaagagaagttcaagtccatagccatcaaaggcagcaattccgaagaggtgaaaggaatcatcacgggtcaaaggcatgatcttgaaggacgagctaaaggttttccttag

SEQ ID NO: 6461 - DNA, 213 bp, Glycine max
  Peptide Sequence Number=SeqID_98146
atgtcagaattcacaagcaattgtcctcctcaatttttagccaacctgcatcaattagactttgcacgttatgtttcagggtcatacaatgctcaatggaaagcctcggaactgctccatgataagcacatgttgcattcgagttgtatcctcgagaaaatgaaggttgatgaacctttgttgggttatggctaccattgcattattgagtag

SEQ ID NO: 6462 - DNA, 141 bp, Glycine max
  Peptide Sequence Number=SeqID_98147
atgactgaagcacgtcaaaagggggtacggaaacaaaataggggaggagcttgccacccagctcgcccaggcgagcaaggttgcttcctccagaagcaaccgccttctgaggaagaaactggaaggcccaagtgggcctga

SEQ ID NO: 6463 - DNA, 246 bp, Glycine max
  Peptide Sequence Number=SeqID_98148
atgtgtcgtaacctacccctttgcgggcgagcgaggcgaggctcacaggtgcgtcttccaaaggaggaaaatgcatggagtcgccaacaacgtttatttgtggaaaacgttggaaaaaaccgaaggaaaccagtcatgaagaatattccagatttgggacttgtatttacgtttgaggaaggtcgacaaaagcggggttcttgctcctacgtaccctccatcgaagaggaaatcagacctacatag

SEQ ID NO: 6464 - DNA, 672 bp, Glycine max
  Peptide Sequence Number=SeqID_98149
atggtggccaaagatcaactaactatgaaagataagagggatgaggaagaaaaactagaaaaacaaaagaaaaagaatgatagtaaggccttgtcttcaaaggctaggggaagggaaatatcccttagcactgtcatacctcttgagcttgaggttattcctcaactaaaggagttattggatgagggtattatgaggcaccaaatccctatgataggtggtatgatgaatgtgttgagtggtgcaaccttattttgtaaaatcacccatgcatccaacacctttatgattgacatacatagggactcattaggtaggaataatcaacatgaaaatacaaaaaaagcaccactcattcagttggtgaggaaccatgttacctcatgggaagatgcccaggaaatgggttttcagaccttaccttactccaacataccagacaccactaatatatatgtttttattctttttacatgtgttgagggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 6465 - DNA, 519 bp, Glycine max
  Peptide Sequence Number=SeqID_98150
atgggtggtggtgcatggccgttcttagttggtggagtgatttgtctggttaattccgataacgaacgagaccttaacctgctaaatagcccagccgactttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaatggcttacgaacggggcggagatttcctggaagatgccaggaagatacttaa

SEQ ID NO: 6466 - DNA, 1099 bp, Glycine max
  Peptide Sequence Number=SeqID_98151
atgaggacatgtagtcctctgaaggcgtggacgtgcaatcctctgaagacgagggcgtgcagccctcttaagacgaaggcatgtagccctctgaaggcgtgggcatgtaatcctccaaaggtgagggcgtgtagccctctaaagctgagggcgtgcagccctctgaaggctagagcgtgtagccctctgaaggcgaggacgtgcaatcctctgaaggcgaggatgtgtagccctcggaaggcaagggcgtgtagccaaccgaaggcgagggtgtgcaaccctcagaaggcgagggcgtgtggccctcggaaggcgaggacgtgcggccctcagaaggggaggacgtgccaccctcttagggcgaggacatgcggccctctgaaggcaaagacatgcagccctctgaaggcgaggacgtgcagccctctaaaggcgaggggcgagggcatggagccctctgaaggcgaggacgtgcagtcctctgaaggcgaggaaagccgtcctctgaaggcaagaacgtgcaatcctttgaaggtgaggatgtgtaacactctaaaagtgagggcgtgctgccctctgatggcgattacatgcagtcttttgaaggcgaggacgtgcagacctctaaaggcgaaggcgtgtagccctttgatggcgaggacatgcagtcctctgaaggtgagggcgtgcagccctctaatggggaggatgtgcagtcatcttaaggggagggcgtgtagccctctgaaggcgaggacacgcagtcttctaaaggcgaggacacgcagtcctttgaaggtgaggatgcgtagtcctctgaaggcgagggcgtgcaaccctcttaaggcgagggtgtccagccctctaaaggcgaggaggtgcatccctcttaaggcgagaggcgaggacatgcagcccgcggaaggcgatggcgtgcagccctcagaaggcgaggacatgtggccctcggaaggcaaggacgtgcggccctttgaaggtgaggacatgtggccctctgaaggcgaggtcgtgcggccctttgaaggcaaggacgtgctgccctctgaaggcgagaacgtgcaaccctctgaaggagagg

SEQ ID NO: 6467 - DNA, 252 bp, Glycine max
  Peptide Sequence Number=SeqID_98152
atgtggagcccactgaaagtgaggacacgtagccctataaaggcgaggatgtgcagtcctctgaaggcaaggacgtgcagtcctcaaaaggcgagggcatgtagccctctgaaggtgagggcatgtagccctctaaaagtgaggatgtgtagtcctctgaaggtgagggcgtgtagccctcagaaggcgtgtagtcctctgaaggcaaaggcgtgtagccctctgaaggcgaggacgtgcagtcctctagag

SEQ ID NO: 6468 - DNA, 81 bp, Glycine max
  Peptide Sequence Number=SeqID_98153
atggttggtttatgtccatcatcgtggtacccaacacataggaaaatgctaggatcatgcatgagtgaacatgacatgtga

SEQ ID NO: 6469 - DNA, 90 bp, Glycine max
  Peptide Sequence Number=SeqID_98154
atggattgcgcgacaattagtgttaagcagctcaattcggatggcaagaatccagatgttggcaaacaattgtccccggacgaaattagg

SEQ ID NO: 6470 - DNA, 204 bp, Glycine max
  Peptide Sequence Number=SeqID_98155
atgggttcgaatccggaaacagcctctttgcatatatgcaagggtaaggctgcgtacaacatccctcccccataccttcgcatagcgaagagcctctgggcaatggggagtcctaggaaaggagtggagaagaaggctggactctggagggttctgagttatgggaggaagggtttgcgtagaggagatgttaactggcaatga

SEQ ID NO: 6471 - DNA, 93 bp, Glycine max
  Peptide Sequence Number=SeqID_98156
atgtctagtgagattatcgaaaggcgtctcaaaaagcttggaataaggttgacccttagcaacctcattaaccctgatgacgatgaagcttag

SEQ ID NO: 6472 - DNA, 222 bp, Glycine max
  Peptide Sequence Number=SeqID_98157
atgctctcgggaacggaagcttcgagcacactccagacatcttctcaaagatcccaacgacctaatttcgagaagatccaacggttaacgaaggctggacagcgtttttaccgaggcagcttcatgcagcttcctcaagaagcttcattaagaggcttcttcaagaagcttccccgtggcttctttgagaagctttctcaagaggattctttgagaagctag

SEQ ID NO: 6473 - DNA, 147 bp, Glycine max
  Peptide Sequence Number=SeqID_98158
atgggtgtccaagcacctcacaaggaccaaaagaatggtcgcatgtcatcaagcaaaggtccccggacgaaattagggagtaataagccttctggtaatcgattacaggatgttgtaatcgattacaggctgcctgttcttgtgtaa

SEQ ID NO: 6474 - DNA, 282 bp, Glycine max
  Peptide Sequence Number=SeqID_98159
atgtcgcaacatgcccttttccgggcgtgcgaggcgaggctcacgggtgcgctttccaaaggaggaaagatgcgcgaagtcgccaccaacgtttatttgtgggaaacgtcggaaaaaccgaaggaaaccggaaccgatccggaaaacaacaaagaccacatttcccagtcaagagggtccgcacttgatggtgaagaacacattggagaatggaggattgcactaggcaatcactacgcatggctccaaactcgttggtggaggatgcatgaacgaccataa

SEQ ID NO: 6475 - DNA, 783 bp, Glycine max
  Peptide Sequence Number=SeqID_98160
atggcaaagtttgacccagatgtagtcctagagttttacgccaatgcttggcccacgaaggagggagtgcgggacatgcgatcatgggtaaggggccagtggaatccttttgatgcagacgccctcagccagtttttgggagacccgctagtgttagaggagggccagaagtgcgagtttagtcagagaaggaaccgggccgatggatttgacgaggaggccattgcccagctgttatgcattccgggtcaggattttgcccagaccgctgccgggagacgggtgcggatcatgcgcaccagcatgaccaccttgactcagatgtggatgatgttgctgctcagcaacgtcctgcccaacgatcataactccgacctccctctgctgaagtgtatgccacctactaggcatcctctagacccagataagtctaacagggccctggggtttccagcgttgatcacgggtctctgccagtcattcggggttcccgtcacacctagtaaggcgcagggtgatgatgcaccgcaggccgtagacgcaccgccaccacctcatcaggctgatccagctgggtcatttgtcatggagcgagccagggttttgctccttttgcgtcctactctagatcagttcagggctgaggttgcatggcccagagattggcctgaggcccaggcaagggaggcgcccgcaaaggctcccgatgacgcggaggaggcccgcatggatgaggagatgacaaatttactcggtttcttgggagggagtggagccacgtga

SEQ ID NO: 6476 - DNA, 192 bp, Glycine max
  Peptide Sequence Number=SeqID_98161
atggaccctacaagaataaaggttattcctaagtggcctactccaccaagtgttgaggaaagaatccctgagtttcaagaacctctggatttgaggtcaaatccttttcaagggggagggaaacatgatgtagctccattggagcttggagtccttggatcttcttcatcaatggagtcctttgcttcttga

SEQ ID NO: 6477 - DNA, 289 bp, Glycine max
  Peptide Sequence Number=SeqID_98162
atgatccaagagctggtagcccgcggagataccttacggttatccgcacccttttgtcatccagaggcggtgggcccgatgacaagcagagacaaaatttggtcattctgcacccttgtatcatccagaggcggcgggcacgatgatacgcggagataccttacggttatccgcacccttttgtcatccagaggcggcgggcccgatgacaagcagagacaaaatttggtcattctgcacccttgtatcatccagaggcggcgggcggaagtttgggagataccttacg

SEQ ID NO: 6478 - DNA, 774 bp, Glycine max
  Peptide Sequence Number=SeqID_98163
atggtcattctgcaccttttgtcatcaagaggcggcgaggctgatgacttgcggagacaaattattgtcatccgtacaccattatgctatctagagacaatcgagtccggtggcacgcagagacaaataatggtcatgctgcaacttttgtcatcaagaggcggcgagcccgatgacatgtggagacaaattatggtaatccgcacactttttcggcatccaaagacgatcgagtccgatggcacgcagagacaaattatggtcattctgcaccttttgtcatctacaggatgcgagctcgatggcatgcgcagacaaattatggtcatccgcacacctttttgccatccagagacgatcgagtccggtggcacgcagagacaaataatggtcattctacaccttttgtcatcaagaggcggcgagcccgatgacatgtggagacaaattatggtaatccgcacactttttcggcatccaaagacgatcgagtccgatggcacgcagagacaaattatggtcattctgcaccttttgtcatctacaggcggcgagctcgatgacatgcgcagacaaattatggtcatccgcacacctttttgccatccagagacgatcgagtccaatggcacgcagagacaaataatggtcattctacaccttttgtcatcaagaggcggcgagccctatgacatgcgtagacaaattatggcatccgcacacctttttggcatccagagacgatcgagtccgatggcacgcagagacaaataa

SEQ ID NO: 6479 - DNA, 173 bp, Glycine max
  Peptide Sequence Number=SeqID_98164
tcgcgggtgaccatgacttgtcgttcccagaatttcacaaattgcctaatgatgggtgccaagcacctcacaaggaccaaagaaaggtcgcacgtgaccatgacttgtcgttcccggaatttcacaaattgcctaatgatgggtgccaagcacctcacaaggaccaaagaaag

SEQ ID NO: 6480 - DNA, 624 bp, Glycine max
  Peptide Sequence Number=SeqID_98165
atgactacacgtcctcgccttcatagggctatacaccctcaccttcagaggactatatgtcctcgccttcacaggagggctccaaccctcgccttcagagaactatacgtcctcatcttaagaggacttcacgtcctcaacatcagaggactacacgtcctcgccatcagacgactacacatccttacctttagagggcagcagaccctctcctttagaggactacacgtcctcacctatagagaactacacgtcctttccttcagagggctacacgcccttaccttgaaaggtctacacaccctcgcctttagagggctacacgccctcgccttcagaggactccacgtccttgccatcagaggactgcatgtcctccccttcaatgggacacacgccctcgccttcaaaggaatatacgtcctcctcttctgggggctacacgtcctcgcctttagaggactacacgtcatccccttaacaggactaacttcctcggcgtcagaggacttcacatgcttagatttagagggcgacacgccctcgccttcagaggagtgcacgtcctcaccttcagaggactacacgtactcgccttcagagggctacatgccctcgccttga

SEQ ID NO: 6481 - DNA, 315 bp, Glycine max
  Peptide Sequence Number=SeqID_98166
atggattcctttgcttcttggaagatgagtggctgcagaatggagaaggaagagagagagatagggagccccacttcaaaggagaatatgagtctagaagaagctcacccccataggaggccatggataagagcttggaggaagaaggagatgaatgaagggagagggagagaagaacacgaaattttatgttctaagagagctctgaaattcggcccaaaatctaccctaaggctcatgagaaccctagggccttctcttgcatctttggcccaatcttcttggagtcttctatccaatgcccttggggggtag

SEQ ID NO: 6482 - DNA, 422 bp, Glycine max
  Peptide Sequence Number=SeqID_98167
atgggggcatcaaaagatgagaaactgttgatacatttcctccaagaaagtcttactggggcagctgccacccggatgcaactacagaacatggataaaaaggggcatgaatccttcaaagaatatgcccaaagatggaaggatatggtagcccaagcggtgcccccaatgacggaaagggagatgataacagtgatagtagacacattaccagtgatcgaagtgggtctgaaaagaggcaaatttgatcatcctgctctgacaaatgagaaaactagggcaaatgaagaggatgagaatgaggaaggaacccatgttgtggttgtcattcctacatggccaaacttcccaccagcccaacaatgtcatcgctcagccaatatcggcccttttcattacccaccacccagtcatccacaaag

SEQ ID NO: 6483 - DNA, 354 bp, Glycine max
  Peptide Sequence Number=SeqID_98168
atgatttcaagattgagtcaagaccaattcaagaatcaagagaaatattcaagagaaagtttcatcaagaagattcaagattcaagaataatcaagatcaagattcaagactcaaagattcaagaatcaagagaagacttaatcaagataaagggtacatctacttgggttgttgtgactgagaacaagagagggtacatctcttggggatcagttctagtggagggtacatccactaggttgttcaaagagaacaagggagggtacatcccttgtggatctttgcttgtaaaggattttacaaggttgaaaagaaatctcaaggaccgcaggttgcttggggactggatgtag

SEQ ID NO: 6484 - DNA, 183 bp, Glycine max
  Peptide Sequence Number=SeqID_98169
atggtgattttccaccatggatatgcagccgaagacaaaggaaaagaggtagcttccttgagaagctttcttgagaaaacttccttgagaagcaagagcttagctacacacacccctctaataactaagctcacctccttgagaagcttccttgagaagattcctaaagaagctggagcttag

SEQ ID NO: 6485 - DNA, 418 bp, Glycine max
  Peptide Sequence Number=SeqID_98170
ggtttgcgccccctacgaggggttccttggactcggagaagtccaacagggccctagggttcctggctctgatcaccaggccctcattaaccgggctttcaacgagaagttttgtgcccctaggcaggcgcagggtgaggcaccacagcagcctggggacgaccagcagggggcaacagacgcatcaccaccaccttcaggtaggagaccaaccacccatgcaagtacgagcaggtactgggcccatgatcgacaaatcgtcatcacgcgtccggctcaagacgttaaagaagcgctactaggaggcaacctagaattggctgcgaagaagctccctgcgacaaggtccaggaagggcaccattgaagagggttccaatgcgaccccgcaatccgacacaggcttcgacaaacactga

SEQ ID NO: 6486 - DNA, 231 bp, Glycine max
  Peptide Sequence Number=SeqID_98171
atggacaagtggatggatattacggatatgggatacgtcattgtttcacgatacaacgtgattgttgtttctttttcacaacaacaaagcatgacattttttcctcttagaagtcagccgccaccagattcttctatgcattgtgtaatatgcattggtcatgtgtatgaaaatcattttgtacaggtgaaccatgaacataaaattttattagcattgacgtttctataa

SEQ ID NO: 6487 - DNA, 300 bp, Glycine max
  Peptide Sequence Number=SeqID_98172
atgcaccgcaggcccgcacatgcaccaccaccacctcatcaggctgatcctgctgagtcattaggcatggagcagtatctacaacacttgctcagcctcagtcagcagggccagggtttcgtttcttttgcgtgccctactccagatcaatttaggattgaggtcgcatggcccggagaatggcccgaggcccaggcagaggaggcgcctgcaggagcacccggcgatgcagaggaggcccgcatgaatgaggagatgacagacttgctcggtttcttgggaggaagcagagccgcgtga

SEQ ID NO: 6488 - DNA, 207 bp, Glycine max
  Peptide Sequence Number=SeqID_98173
atgttaaaacgaaaggatgtacctcaatcgataagtggcagagacgaactcgacaaagatgaactccacaatgtgcttgcagtgacggcagggaggaagcagggaatgcaacatagaagcataaagcaaagacggtggagagtgtcaatgctgatgcagaagcctttggtgatcactggaaagttcagattgctctatgcattctaa

SEQ ID NO: 6489 - DNA, 180 bp, Glycine max
  Peptide Sequence Number=SeqID_98174
atggcccaaaaatacatcatgaagcatagccaacaaaacatgttatccaatgaaacaaaaccccccacacttattcccaaaacaattccaaaattccttaagggtaaggaagcatcaacaagaatcaagccaaggctattgtgcaagcaatcaatggggcaaaacacaccaaatgattaa

SEQ ID NO: 6490 - DNA, 204 bp, Glycine max
  Peptide Sequence Number=SeqID_98175
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggttatacacaggaaaaatgataatttctaaagaattgggaaatgacatttaa

SEQ ID NO: 6491 - DNA, 342 bp, Glycine max
  Peptide Sequence Number=SeqID_98176
atgctggcgatgttcctgagagggcgtaggcctactacctcaacccgtaggctacgcgttcatcagatgactacggagggacgtgatatggctgaggacgtcgctgacatgactgatgatgaacgtcctgatttgaagttagtgtcacatgggaggaaggtgacactgattgggaggtcagtgcctgagattgaaggcctggtggctgccataggattaagtccactgatagattgttcagttattactggcgatcctggacttatatccgcatttgtggagaggtggcacagtgagactagcaccttccctcgaagagagattgttgccgagataacgtag

SEQ ID NO: 6492 - DNA, 138 bp, Glycine max
  Peptide Sequence Number=SeqID_98177
gcttcctcagccaggtttgggcagaatagcggagcagttaagccccggactgtggaaaaaggagtatcccgaacctacaccgaggtattgacggcgattctcaaatatcgcagaacagaacagaatgggatacgatga

SEQ ID NO: 6493 - DNA, 225 bp, Glycine max
  Peptide Sequence Number=SeqID_98178
atgaagatgctcttgataccacatgatgtggctccatgtggagctttggaatggagaaggaagagagagaggagacgccacttcaaggagaagatgtgtctagaagaagctcaccaccataggaggccatggataagagcttggaggaaggagatgaatgaagggagaggaagagaagaacacgaaattttgtgctctaaaagagctccaaaatttgaattttaa

SEQ ID NO: 6494 - DNA, 573 bp, Glycine max
  Peptide Sequence Number=SeqID_98179
atggatgttgcgctaagcgagccctgtgcgcttagcgcgtatcagcggctatgcccaacacaagagcgcttagcgaagaacgaagaagcagagaaaggagccaagttctcaacttttagagagattagggagcttttgagtgattgtgcggtgccaagaggtggaggagacatcccccctcctgtgaactttagcattaggaaatatattgtttccttagaacttgatagagtagggctagataactgcattgctagggatagggtatcttccgcaggtgaattggttccattggaattagaaatggaagccacctttagaagaaacaacgtagagagaaaaagaaagcttttgcacgacagaacaatagcatcaatccttgaagaggctcacttttctgagtcatcatcttctaattcacctacatccaaggattctcaaacagcagaatttgaagccgaagtcatggttgaagagcaacctcgacgagtgaccttggaagattactcaagtacttcagtgctgcaatatttctcaagtgttgcgcggccagaggttcaggcacaaaattga

SEQ ID NO: 6495 - DNA, 321 bp, Glycine max
  Peptide Sequence Number=SeqID_98180
atgattttccggcagggggctgttttgcacgtaaagtgcatgcatgcctcaagcaaaccgccagtgggactggcgagttcgctgtctgtgaaggaatcgccactgggaatggcgatattcgcatgcaaggggaaccgccagtttgattggcgagttccatcacgtaggctcagggctaggagtcaagccatgcaggtgcagcaggccatgcaggagggaatcgtcatttgcattggcgggttgcgttttgcgggaatcgccagcctggctggcgctttgtggcagaaaggactcactagttgcactggcgagttgctttaa

SEQ ID NO: 6496 - DNA, 531 bp, Glycine max
  Peptide Sequence Number=SeqID_98181
atgtgtgctatgtttgaatgcctaagtgatgtttgctcgggcaaacaagcttggaaattcaaagtacaagttattcgaatgtggagcgtgtatcttgttggagagcccaagaaaccattttcaactgagatgcttttgattgacttggttcaaagatacatgccaatgcttagaaggtttaacgaatgggtgaaagagggggttgtatatgtaatgagctttcttggtgtcactgccaattctagttcttctagggtaacgcatgactacaaattgttatttcatgtcaagaccagtattacaacatgccttgatttgacattgccgcaaaatggacttaccattatgaaggctgaggaagttaaaaacacagaggggggactgtacattgtgctctttatgacaagtatgttaacattttgggtgaaatctcttgatgctaatgaacttcctgttattgtcattcagtttactaaaatcaagacctacaaaggtgaggtggtggtgcaaaaatgcgatgagcacatctag

SEQ ID NO: 6497 - DNA, 465 bp, Glycine max
  Peptide Sequence Number=SeqID_98182
atgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtattattaggcgccaaatcccaaaaataggtggtgtgatgaatgctttgggtggtgcaacactcttttgtaaaatcactcgtgcacccaacatcttcatgatttgtgtacatagggactcgttaggggttcccatgaaccctaagagaataaaggtcattcctgagtggcccgctccaccaagtgtgttgagggaaaaagcccagagtttcaagaacctcgggatttga

SEQ ID NO: 6498 - DNA, 396 bp, Glycine max
  Peptide Sequence Number=SeqID_98183
atgtctcctccacctctaggacctcacaatcactcacaaactcatctcaagctctcaggacggcttcctcttcaagctctggtctctacagatcttcacacaacaaaatctctcaaactctctggaacttggacctttctctctctagaactctctagacacacagaagcttcaagaaaaggccaaactccccctctaaatttgatttcaggcttaaataggtggctttgttcatgctccggatggactgaagtgatgcgcttagtgggatggcccttcgctcagcgaacaagcacaactcatccttcttccagattcttccttgtgcttagccgaggaatgttgtgctcagcaaatggctcgctaagccaacagattggcttagcgagagggtga

SEQ ID NO: 6499 - DNA, 483 bp, Glycine max
  Peptide Sequence Number=SeqID_98184
atgtggtcatctgcgccctttccggagatgtcagcatcttccggtggagactttttcaagtctcacaagttatctagaactacaggcggcgggcccgatgacatgcgcagacaaaatttggtcattccgcacccctttgccattcagacacagtcgtgtccgatggcacggagacaaaatttggtcattctgcacgctttgtcatccagaggcggcgggcccgatgacatgcggagacaaaatttggtcattccacacccctttgccattcagacacagtcgtgtccgatggcgcgcagagacaaaatttggtcattctgcaccctttgtcatccagaggcggcaggcccgatgacatgcggagacaaaatttggtcattccgcacccctttgccattcagacacagtcgtgtccgatggtgcgcagagagaaaatttggtcattctgcaccctttgtcatccagaggcggcgggcccgatga

SEQ ID NO: 6500 - DNA, 207 bp, Glycine max
  Peptide Sequence Number=SeqID_98185
atggcacatcacacagagattataatcgattactgtcgcaacgtgcccttttgcgggcgagcgaaggcggggctcacgggtgcgctttccaaaggaggaaagatgcgcggagtcgccaccaacgtttatttgtggaaaacgtcgggaaaaccgaagaaaaccggtcaaaataaaaattctaggttcgggagttgtatttacgcttga

SEQ ID NO: 6501 - DNA, 525 bp, Glycine max
  Peptide Sequence Number=SeqID_98186
atgagcagaggcggtcatcgggcccgatgtcaagcagatacttatggttattctgcaagtctgtgtcatccagaggcggcgggcccgatgatacgcggagataccttacggttatccgcacccttttgtcatccagaggcggtgggcccgatgacaggcagagacaaaatttggtcattctgcacccttgtgtcatccagaggcggcgggcccgatgacacgcggagataccttacggttatccgcacccttgtgtcatccagaggcggcgggcccgatgacagcggagataccttacggttatccgcacccttttgtcatccagaggcggcgggcccgatgacaagcagagacaaaatttggtcattctgcacccttgtgtcatccagaggcggcgggcccgatgacacgcggagataccttacggttatttgcacccttgtgtcatccagaggcggcgggcccgatgatacgcggaaatacccgagtggttatccgtataaaccattcttttgctatctgtaa

SEQ ID NO: 6502 - DNA, 683 bp, Glycine max
  Peptide Sequence Number=SeqID_98187
gagcaaaagccctgcttttgtcgaccaccccactttttgttaccgtgacccaagagtctggtggcatgcagagacacccgacggtaaccgacacacaaagaccaatgtggtcatctgcaccctttctggagatgtcagcatcttttggatacgtaggagcaaaagccctacttttgtcgaccaccccacctttggttaccatgacccaagagtctggtggcatgcagagacacccgacggtaagccacaaacaccctttgctatccagcgacctgagagttcggtagcatgcgaagacacccgacgcgacccgagagtccggtggcattcggagacacccaacggtaacccgcaaacaccttttgctatccagcgacccgagagtccgatagcatgcggagacacccgaaggcggagatacccaagtggttatctgtacaaaacgatttctgttaatcctgacccgagaagtcaggtggcaggcggagatacccaagtggttatccgtacaaaacgatttctgttaatcctaacccgagaacgtgcagagactaacgtcgtcatatgcaccctttgtcaactaggggcaagcgagcctgttgacacgcagagactaacgtcgtcttctgcacctttgtcatccagaaacggcgagtccgatgacatgcggagatacccaagtg

SEQ ID NO: 6503 - DNA, 628 bp, Glycine max
  Peptide Sequence Number=SeqID_98188
taccctcaccttcagagcgctacacgccgccctcgccatcagaggactacacgtccttgcctttagagggctacacgccctcaccttcagaggactacccgtcctcgtcttcagaaggctacacgccctcgccatcagaaggctgcacgccttcgccttcagaggactacacgtcctcgcctttagaggactgcacgtcctcgccttcaaagggctacatgccctagcctttagagggctgcatcccttagccttcataggactacacgtcctccccttcagagggctacacgccttcgccttcagaggaatacacgtcctctccttcagagggctacacgccctcgccttcagaggactacacgtcctcaccttcagaggtctacacgccctcaccttcacaggactacccgtcctcgtcttcagaaggctacacactctcgccataagagggctgcacgccttcgcctttagaggactacacgtcctcgcctttagaggactgcacgtcctcgccttcaaagggctacatgccccagcctttagagggctgcatcccctagccttcagaggactacacgtcctccccttcagagggctacacgccttcgccttcagaggaatacac

SEQ ID NO: 6504 - DNA, 1617 bp, Glycine max
  Peptide Sequence Number=SeqID_98189
atgactcaagtcgctaaaaaactactggtaacgtgcgccctgccgtacgcaaacggctctatccacttaggtcacatgcttgaacacattcaggctgacgtgtgggtccgttaccagcgaatgcgtggcaatcaggtgttcttcatctgtgcggacgacgcccacggcacgccgatcatgctgaaagcccagcagctgggtatcgcgccggagcagatgattgcggaaatgaagcaggagcatgagaccgatttcgcgggtttcaacatcagctatgacaattatcactccacgcacggcgacgaaaaccgccagctgtctgagctgatttacacgcgcctgaaagagaacggtttcattaaaaaccgcaccatttcgcagctgtacgatccggaaaaaggcatgttcctgcctgaccgcttcgtcaaaggcacctgtccgaaatgtaaatcgcccgatcagtacggcgataactgcgaagtgtgcggcgcgacttacagcccgaccgagctgattgagccgaaatcggtggtgtcaggtgcgacgccggtgatgcgcgattctgaacacttcttcttcgatctgccgtccttcagcgcgatgctgcaggcgtggacgcgctccggcgcgctgcaggagcaggtggcgaacaagatgcaggagtggtttgaagccggtttgcaacagtgggatatctcccgcgatgcgccgtacttcggcttcgagatccctggcgcgccgggcaaatacttctacgtctggctggatgcgccaatcggctacatggggtcgttcaagaacctgtgcgacaagcgtggcgacaccgtcagcttcgacgaatactggaagaaagattccacggccgagttgtaccacttcatcggcaaagacatcgtttacttccacagcctgttctggccggccatgctggaaggcagcaacttccgcaagccaaccaacctgttcgtgcatggctacgtaaccgtcaacggcgcgaagatgtccaagtcccgcgggacattcattaaagccagcacctggctgaaccacttcgacgcggacagcctgcgttattactacactgcgaagctctcttcgcgcatcgacgatatcgacctgaatctggaagatttcgtgcagcgcgtgaacgccgacatcgttaacaaggtagtgaacctggcgtcccgtaacgcaggatttatcgccaaacgctttgacggcgtgctttctgccgaactggccgatcctgagctgtataaaaccttcaccgatgccgccgctgcgattggcgaagcctgggaaagccgtgaattcggtaaagcgattcgtgaaatcatggcgctggccgatgttgccaaccgctatgtggacgagcaggctccgtgggtggtcgcgaaacaggaaggccgtgatgccgatctgcaggccatctgcaccatgggtctgaacatgttccgcgtgctgatgacctggctgaagccggtactgccgcagctggcagcccgtgccgaagcgttcctgaacaccgaactgagctgggatgctatccagcagccgctgctcggccacaaggtgaacaccttcaaagcgctgtacaaccgcattgagatgaaacag

SEQ ID NO: 6505 - DNA, 225 bp, Glycine max
  Peptide Sequence Number=SeqID_98190
atgccaccttttgctttgaaaacacaaaaccaaatcattgttgcttgcatggctatacataacttcattcaaagaaatgacaagagtgatggagaatttgattcactagatgaagataacgaatatatagatagtaatgaggatgaaagtgaagttggtcctagtactacaacatgggaagaatcggatgctcaaagtaaatggaatgatttagagaatctctaa

SEQ ID NO: 6506 - DNA, 402 bp, Glycine max
  Peptide Sequence Number=SeqID_98191
cagaattttgcacaagtgcagaaaaatgcttgtgcgtggttggctgtggaaagtctagtgcagaatgagttctggatgtttgctagtatatcccaacggtcaaaatgcaggcttatacactatagacttccacttgagaggattgatggggacccggtgttgagagaaacgaggatatgggctacgtgggagtacgcgagctcagttggaggtgggcaacaggggatggtgggtttatgcgcgcattgtggatgtggaaaaacttgttgtgcaccatcgcccgaccgccacctaagtggtacctggagatatgtcgcgggggtcaggagaccttggggacgtcaggtggggtgctattgcccaaaaccaagcttgactaatcccgacccaacccgggcatag

SEQ ID NO: 6507 - DNA, 276 bp, Glycine max
  Peptide Sequence Number=SeqID_98192
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttgatagggaataccccaatggtatatctgaacaacattgtggatgggtgtgtagcccgtattgctgctaaattggagtacatgcaagcgtgctgtagtgtcaaagataggcatggaattccttga

SEQ ID NO: 6508 - DNA, 261 bp, Glycine max
  Peptide Sequence Number=SeqID_98193
atggacgaagaccagtggatgtatgatagtatgatgtctgaagaagttgatatgaatgttgaaaatgaggaagatgttagcgttaaattgtttgcaagtcgtgatggagttttacaatgggctcgatcattggctcatgacattggatttgttgccgttataataaggtcagacaccaatactggtgttcgaggaagagccttatttctgttgatagcttgtgaaaggagtggtgagtataggcctaagaaacataatttg

SEQ ID NO: 6509 - DNA, 294 bp, Glycine max
  misc_feature (40)..(40): n is a, c, g, or t
  Peptide Sequence Number=SeqID_98194
atggccctcattattggaaaaccatttggtggtggccatnacccgggaaggtcttctagtcactataccccaagtggtacaactcaaatgccacgtgcgcataccacagtgcagcccccggacacaacattgattcttgcctgccattcaaaagagggccccaatattaagacgaatccactagccagtcatggaggatctagcataaacgccatcgaaaaggataggccatcagggtcaaagagattagaagatgtggctacatccagaagattcatctaccagtctcagtag

SEQ ID NO: 6510 - DNA, 452 bp, Glycine max
  Peptide Sequence Number=SeqID_98195
aattattaggagtcagaccacaggaaggcgaacttgaaggcagtgtggtaaaattaagttggctggctcaccatttttctcacataaatattgatgacggtaacgttgaacaattacaaaggtttacccgtgcatggatcattcgattcataagaggtgtcctctttgttaacaaaagcagtagcagagtttccttaagcatgtatgcgtgggacctgttgtgcttgcgtatttacatagagagatgtgcagcgccatcgattacaaagttaaatcaatcggaggaacgatgcacgactttggctccaaagaggacgcctcccgtaatagaaaataaatcactcggacacaggtggctgcgacgtggaaatcaacatattggcaatgatgatcttagagtttttcgtcgcaaattggatctcatgaaacaacatgaggtaagaagatcgtaa

SEQ ID NO: 6511 - DNA, 171 bp, Glycine max
  Peptide Sequence Number=SeqID_98196
atggtaattgtggcttctcgggagaattggatgaatgcatcaaagatgcacttgctattgctagtaccaccccggactgtggaacaaaggagtatcccgtacctacaccgaggtattgacggcgattctcaaatatcgcagaacagaacagaatgggatacgatgagatag

SEQ ID NO: 6512 - DNA, 246 bp, Glycine max
  Peptide Sequence Number=SeqID_98197
atgggaacagaaggagtggaggtgaatttgtggtcatattgggtctccgacttgcttgataacagagaaccctcatttagagtttttctttttgataacatatttttgttggtagtccctactgccgcaatatgttttttcgaaggggatgatgcctctagaaaccatcaagagagatatgaccaccttggggcacaaagcgaacacgctgcgcgccttttaaacactgccatgcatattacctaa

SEQ ID NO: 6513 - DNA, 453 bp, Glycine max
  Peptide Sequence Number=SeqID_98198
atggctacaccacccagctcccctcctcctccttctccgactgattcaacatcacattccccttctaccataaagaggacaagaaaagtgacccggctgagatcaatggctactagaccagttaggacaaagagaccccgggtccatgtggatcctgcaactgggaaaaccgacggtccctacagaaaaaagttaagaacatatttggggatcgtcgctcgcaataagtctgatttgacatcgaaatgggcacttatagccgataaggacggtgtcgatgacactgtatgcaaaaagtacgacattagcaaggagaagtggacccaattttgtcagagccacagagacccttcatgggagttgatggaggagaagaaaaagaaacaattggaggaagccgttaaatccggaagcactgacaccatcattgatcctccatctcccatcaaatga

SEQ ID NO: 6514 - DNA, 348 bp, Glycine max
  Peptide Sequence Number=SeqID_98199
atggaagatcaagtagacaaggctacaaccattactattgagttggatggtggtgatggtgcctttgaaaatcacaaagcctcaagaaatcgaaaggtcaagccaatacgactatcaatggatgttgatgctacgctttcttcaaccaattttatcatggttgttgaagaacacaaagacagtgtaagaaaaagggggagaaagggttttgattttgaggaaaatggaccaactgctttgtgcattaaatttcctttagaaggtgtattgaactttgaaaataagccaaagactagattgtgttgtgcttcctaccttgaagattgtgatgttgctgccattggataa

SEQ ID NO: 6515 - DNA, 660 bp, Glycine max
  Peptide Sequence Number=SeqID_98200
atggagcagtcagaagggttcagtaaagctggatcggatcggttgatttttaagttgaagaggtctctgtatggattgaagcagtctccaagccttgatgatgctcgggaagattcacacttcagagaccctcaacccaagaaatcaaggtggagattgttgtgcatggctcatattttatgggttggacaaatgttagagcaaagcgtaaaggccacctattgttgggttatgaagcaggttgggggtgcggcgtttctgatcccatacatggctatccgattgaatgatgctgatgatgagagtgttacaagaaaactttcacagtttggctcagtgatgacaaatggtgctccaattgttggagtgattggtgggagtgcatgcattgtatctctattgtgggctctttttggtcgaatggatgcaaattttgggggcatagcagatagatgggactacttggtgggttatcttggatcagaaaggctggcttatgctttcatatgggatatatgtctttacataattttccagccttggttgattggagacaacctccagaatgtccaggaaaacaaggttgttgtagtgaagtatcttagatatgtacccgtgattggcttaattgcgtatctattttgcttggaccctaaagag

SEQ ID NO: 6516 - DNA, 405 bp, Glycine max
  Peptide Sequence Number=SeqID_98201
atgaaggggaaggggcaaagggttcagagagtttatagaggaagaaaaacgaagggagatgaaggaaaaagaagaaaagcgaagctgaggcattgccgaattgtgaagatatgttttggaaaatttgggaagctcaataaatctatacggtttcctgaaatactcgacttggcacctttcatgagtgggactagtgatttgcctatatacaggctatatggggttgttgttcacatggatatcatgaatgctgctttttcgagtcattgtgtgtgctatgtgaagaatttacaaagaaggtggttcaaggttgatgacagtgtgggtctaacagccaatgactacatcaattgggtagggcttaggaaattgcgccagagacttaggattgcatcaaattactaa

SEQ ID NO: 6517 - DNA, 858 bp, Glycine max
  Peptide Sequence Number=SeqID_98202
atgtgtcctcacaggagatggctccgagaaagctctctgccaagaggtcctggaaagacacaactggagagggttatagtgcggccccataggccaatgtggacttcgatacacacaggttccggagcgcggaacaccagcagcgatttgaaaccattaaaggaaggccaacagtgcgagtatagccaaaggaggagtcaggcctcaagctttgatgaggaggctattagccagttgttgtgcgtgccagggcaggacttttcccggaccgcagtggggaaaagggtgcggatcatgcacacaagcatgaccactctcatgcaaatctggatgacgttgctgcttagcaacattctcctcagtgaccataactcagacctccccataccgaagtgccagctggtctacgccatactgacacagtttgtagggattgcacctacgagacacccggtggacccggagaagtccaacaaggccttgggatttcctgctttgattacaggcctcttactgcatgcccaggcaagcatagggccaggcaccacaccagccagaggagggccaacaacaggcagctacagacgcaccaccgccacctccagagtccacctctactcacctatagagcaagcggccaaccataggggtcaggtatggttgaatgagagcttttatcagtacaccctacatcagcagagccaggatcccagcccttacgcgtggcctactcctaagcagtctgaagccgtagtggcatggcctagagattggcccaattttcagacaggggcagggctcgcagggacctccggagatggagacggagctcaggaagatgatgacatggccgattga

SEQ ID NO: 6518 - DNA, 477 bp, Glycine max
  Peptide Sequence Number=SeqID_98203
atggctagtgtgatcaatttatcctgctaccatcatcatcatattcatcttcttagtcctagacctttcttgttgcccttgcatcctttgggggaaattaatatccaccaaacttttattggctatacaaatggtcgtagggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgctctatttgcttatttctttcctgggctgttattttcaaggatttcttctaa

SEQ ID NO: 6519 - DNA, 209 bp, Glycine max
  Peptide Sequence Number=SeqID_98204
ggcgctcaacccctgatgaagaaggcaacctaccagttgaagataattccactcttcttcgaaggcttatggacaagtttaatgccatggaactgcaagtcgacatgcggttcgatgccatggaatcaaggatcaccaaagttgaagaagatgtctccttcattcgtacttgctttgatccaccaccaccgcctccatcatcatcttag

SEQ ID NO: 6520 - DNA, 663 bp, Glycine max
  Peptide Sequence Number=SeqID_98205
atgcaatctcagggacttgcagtgcctcttgagcctctggttggtcttggtccctccggtcctcgagtgagcacaaaggggagttgtgttgatccctcaggaaatgatcctgagaccggtgactctgacaggtgcggcttgtacatagaagcagatcctgcccgcctggtttccatcgggagagtttatgagggatccactgttgttcataacactcctttgttgcttggccaagtaaaggtgagtgtggaggaggttagagatgtagatgctccagttcctgtacccactgatgaggtttccttagtggggcaggcacttcacaccttccttgcttggccgacacatctggtcaagtctttatcacagcaggttagatgggatgccaccgtgttcggggtcgttaatccagatttccccctgtacataaagcacgaagacctctccgaaatcacacacggtggtcaatgtctcaacatatcagtgttacagttgtggattctgcatctcactgaaacatgtatgcgagcggggaattctgatatctatggattcctcgagcctcagtccattcagaggtctgggcaatcgcagtttgaatctgaaagttccactgcagcggacattggcagatggtggtcatcctgcccaaggaacacttag

SEQ ID NO: 6521 - DNA, 222 bp, Glycine max
  Peptide Sequence Number=SeqID_98206
atgttaagtagggaatggcagcccaaggaacacgagatggaacttcaacgcctcaatcagaatgaagaaaatggcaaaaagaagagaagcacaacccttaaagcctcatcttcaatacaagaagaaaacgaagaagaagattcagatgatgaagaagatttttctttctttgttaagaaatttcagaaattcatcaagaaaagaagaattgacaggtgttag

SEQ ID NO: 6522 - DNA, 390 bp, Glycine max
  Peptide Sequence Number=SeqID_98207
atggtttgcaccaaccaagcggatatgaccagaaggcttcttgccggttcattggcattcgaatgccgcatcatgcactacatgattgtgcgcatcctaccccctagatcatccaaccttgcacagtctgagccctttgttaaagtcaagagatctttctctatcggtgcgaatgtggtctcctcttttggatatcacaaagagagggatggttcttgggtgaagaaggatacaccagcacaggctgtagaagatcgttctccatcaccacctccacaaagagatcattcttcatctcttatgcacaacattcttgacagattggatggactccacaccttcgttggtgagcgttttgattccttggacagccgcattgatgctacttga

SEQ ID NO: 6523 - DNA, 448 bp, Glycine max
  Peptide Sequence Number=SeqID_98208
tcaaggtgttccttttgagggcactctagttgatgactggaaacatgtttattctagtcatgatgctcgaaaaatggtctgccatgaccatgctgacatgacaggcagattgctcgctgggtcatttacctttgagtgtcacatcatgcactgtattctttgtcgaattttgcttcctaggtccattaatcttgcccaagcctctgaggaggatttaatcttgttgtgggctcttcaaactgatgatgaaccttttgtcaaagttaaacgctcttttgctattggtgttggtgctgttacatcttttggttataaaaaatatatggatggtcagtgggtgcacaagcaagacctaccacctcccattcccagtgagcatacaccatctccaccaccgcaacgggatacctcttcttctctcttgactgacgtcctcactgaactctga

SEQ ID NO: 6524 - DNA, 360 bp, Glycine max
  Peptide Sequence Number=SeqID_98209
atggctagcttagtagacatccaagaaaaccacaggaatttcgggctaggctataagcccatgcggactaatatgagaagaagcgtcttagaaagaaggaatagaggcatgggcccgcaactaagaccacaagtgagagaggcccttccttgtcacatcaacaagagcttcgtaagtgtaggcttgagacgtgaagagcaagttgccatgatacacgacgaagcccctcaagaacattcaagtccgacgacgagtcctgtgaaggtactaatatcgaggacccaaccgtcgattttgaacgagaagcggatcgacttgaggatgaagaagacaaagatatggggttttccccagagctag

SEQ ID NO: 6525 - DNA, 667 bp, Glycine max
  Peptide Sequence Number=SeqID_98210
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcgtcacagaaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatg

SEQ ID NO: 6526 - DNA, 551 bp, Glycine max
  Peptide Sequence Number=SeqID_98211
tcaaggtgttccttttgagggcaccattgttgataactggaaatttgattattctagtcatgatgctcgctgcatggtctgcaatgaccaggctgacatgaccagtagattacttgttgggtcattaacttttgattgtcgtatcatgcattatatcattgtttgcattttgcttccacgatcctcaaaccttgctcaagtctctgaggaggatttgattctgatgtgggcttttcaaactggtcgtcagatcgactgggcccatctagttcagtttcgaatgcataaggcattacgggccaatgcacctctaccgtatccccaccttgttactctttttcttcatcacttcaatgttcctttggatgatgaaccatatgtcaaggttaaaaggtctttctccattggtaccagtgtgtttacctcctttggttaccaaaaggatgttgatggtcagtggattcacaaacaagacttgcctccacctattccatacgagcgtaccccatctcctccaccacaaaagggtgattccactgttggatcaagtg

SEQ ID NO: 6527 - DNA, 555 bp, Glycine max
  Peptide Sequence Number=SeqID_98212
atgtctgtcatagaattatgtgttgaagttgatgttgcgggtgcttctgcaattaatttgacaaattcattgttatcatgcggaaataatatgtctcataatgaatcgggtagtgcaacagttggaacaaattcagaagaagattttgatgatgatgattatttaatatctaattcatacgctgaggactcattagatgaggatgaggatattaatgaaatgtctgacacagatgatgaagctgtccgtttgatcgaaccacttatagttgtgcaatcgggagaaggtggaagtcagactccattttgggattctgcttctcactatagtaatattaattggagtcatcctgaccaagaagaaatttgcggtttagatatgggatcaaattttaatatgggtaaagaattatatgtggggatgatcaaagaagatccgtcactcaagatttctttgattcaagagaggatcaatggaatgtttaattacaacatttcttacagaaaagcgtggaaggcaaagcaaaaggcaataacaattgaatatggcgattga

SEQ ID NO: 6528 - DNA, 208 bp, Glycine max
  Peptide Sequence Number=SeqID_98213
atataatatcgaaattcccaacggtgagaatgctcgtaattgggttgcgaacgtggtgctcaaatttcacgacgatctaacggtgaacgagtctgagatcgtcgtttttctgagacaggttaggtggcctacgggaaaaagagaggattttgggagaagagagaagaaacaacattgtgaggcagaggaggatgaggagtcagtctga

SEQ ID NO: 6529 - DNA, 209 bp, Glycine max
  Peptide Sequence Number=SeqID_98214
atgtcacgaaactttatggattacgcaaccaccccctctttgacttctggaatgttacggaactttatggattgcgcaataatgcttcctttcgactcccgacatgtcgcggaacttcacggattgcctaacgatgggtgtcaagttcctcgaagcggtcatgcgaaggtcacatcccaccacacagatggtccctggacaatattagg

SEQ ID NO: 6530 - DNA, 432 bp, Glycine max
  Peptide Sequence Number=SeqID_98215
atgaaggccgacatggaggccatgaaagagcaaatgaccacaatgatggaagccatgatgagtatgagaaaaatgattgaggtcaacacggctacagtcgttaccgcaagtaccgccagtgaggtggacccgactcacccatttggcctcaatcaagtaaatcgtttagtctcggatatggtaggtcagggaggcagagcattggaaagtatgggcggcccccattttgtgcaggtccagagcaagcattcctttccaccatatggcttgcctcccaactatacaccacccaatgttgcatacgctcccgatgagaatgtcgataactctgctcccatacccattgagagccaacaacctcaatctggtcatgcacaggtccctcgacccccatgggagagacacatgaagtaccttgagaccacactctag

SEQ ID NO: 6531 - DNA, 210 bp, Glycine max
  Peptide Sequence Number=SeqID_98216
aacagtgctttaaagggtcttgatgatgctccacagcctaaatcaaaggctccttctaggtggatcgtcgtcaagatgtccatcatcattttaggaagtttcaggaataattgggaagcgtattttaacgatcctagaccattggagccagagagattaaaggcgttgcggatccagtgggcacagtattatcttcgagttacatattag

SEQ ID NO: 6532 - DNA, 270 bp, Glycine max
  Peptide Sequence Number=SeqID_98217
atggaagaggagtttcaccaccaagaatgtgccttggatacgaagcttgaagaggatgctttaatggatgaaaagaaagagagaaggggggagcacaaaattgaaggaataaaagagggagaaaagtggaactttgaagattgcatcaacaaacaatatagtagagtacaaggcatgtgccctaggaatccgagcggcgatcgacgtaggggtcaggttgctcgtagtatacgaggactcggcattggtaattcatcaactgaagggtga

SEQ ID NO: 6533 - DNA, 219 bp, Glycine max
  Peptide Sequence Number=SeqID_98218
atgcgcttagcccacatatggaccgctaagcgcatgttagtgatttttgacttagcgcgcctttctcgcttagcggatgaactgaagcggctttatagcatggcaaataatgtctctgaagtgaatgaggaaggttctataggaggagttggaactgatggagctggtaagggagtgggagctaaagctagtatgggaggaatatcagaagatgaataa

SEQ ID NO: 6534 - DNA, 339 bp, Glycine max
  Peptide Sequence Number=SeqID_98219
atggattcttcgttgatagagtggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtagatctactccaggagaattagtaatgtgtcaggagaaattggtacaagaagccgtggatacacttcttgataatggaatccgcggacaaccgatgagggaccggtcataa

SEQ ID NO: 6535 - DNA, 514 bp, Glycine max
  Peptide Sequence Number=SeqID_98220
gaaatggcttcgaggaagctttctgcaaaaagatctaggagggacgtcgcggctgaagggaccagtgccatttgacagccatcgtttcaggagcgctgagcaccagcagcatttcgaagccatcaaaggatggttgttccaccgagagagacgcgtccagctcagggacgatgagtacgtagattttcaagaagagatagctcgccggtgttggatgtcgctggtcactcccatggctaagtttgacccagatatagtcctagagttttacgctaatgcttggcccacggaggagggcgtgcgggacatgcggtcatgggtaaggggccagtggattccttttgatgcaaacgccctcagccagttcctgggtgacctgctagtgttagaggagggccaggagtgcgagtttagtcagaggaggaaccggaccgatggatttgacgaggaggtcatcgcccagccgatatgcatacggggccaggatttttctcggaccgctgccgggaggcag

SEQ ID NO: 6536 - DNA, 198 bp, Glycine max
  Peptide Sequence Number=SeqID_98221
atggggcaaaacacaccgaataaaatagatgatgatggctcaaaatctcaccaagggaaaaacattagtcaccacatgatgcaatcctaccccgcaaaggcattggatagaagactccaagtagattgggccagagatccaagggaaggccctagggttctcatgagccttagggtagattttgagcccatgggctaa

SEQ ID NO: 6537 - DNA, 305 bp, Glycine max
  Peptide Sequence Number=SeqID_98222
atggctccggatagaatgcaactacagaacatgtgtaaaaaggagcatgaatctttcaaagaatacgcccaaaggatgatggattacatgccttcaagatttgcctatttggttttctccggtgaaaggatcaaagtgggtttgaaaagaggcaaatttgatcatcctggggcaaatggagagaataagaaggaaggaggaacctatgttgtgactgttgtgcctacatggccaaatttcccaccaactcaacaatgtcaatactcaaccaatatcagcccttctcattacccaccaccctgcca

SEQ ID NO: 6538 - DNA, 229 bp, Glycine max
  Peptide Sequence Number=SeqID_98223
atgacttctactcatgatgccctgctatattacaacgagaggtggaacatgtcatgccaacacgactttgtgggttactcgttcacaggaaaaaattcaaaaagatttgacattccttcgggatgtagcatcaatggactgaaggatgtgatcaagtcattctgggtattcaaaaaagttatcaaacttgaaattattgaggtgaaaactaacaatgacgtgcttgaag

SEQ ID NO: 6539 - DNA, 456 bp, Glycine max
  Peptide Sequence Number=SeqID_98224
atgggttctgaaggttccactgtcgtcgttcctaggaatttcagattattggaagagcttgagagaggtgagaagggaattggagatggaactgttagctacggaatggatgatgctgatgatatctacatgcagtcctggactgggactattattggcccccctggtggcgttcatgaagggcgtatctaccagctgaaattattttgtggcaaggattatccagacaatccaccaactgttagatttcagactaggattaacatgacttgtgtcaaccaagaaactggagtggttgagccacatttgtttcctatgcttgctaattggcaaagagagtgtacaatggaagacattttgatgcaattgaagaaagaaatgatgtctccacaaaatcggaagctagctcagccacctgaaggtgtgtcaatcttatttctgattgttgttacttga

SEQ ID NO: 6540 - DNA, 459 bp, Glycine max
  Peptide Sequence Number=SeqID_98225
atgggtagaagtcgagaaaaaccttcaaagatggaaattgatctctctttgaagatagatacagatgatgagcataatgaagaagtagatgagagagtgaaagaggataacgaggaagaaatggcacagactccagataataacaaggaattagaagtccatgaagccacagctggtgaaatagaagacgatgcatcagtggtagaaacatctttgcaagataacacaaaagcaaaagcggcaaatttacgtaagggggcttattttaaaaactatttacggattggggtttgttttaaaactaatgacggagggggtctgttcttgggtgtaacccgccattgccaatggcggcaaaggtggagagaggctggtatcgttactggtagtggcgatataggtggagagaggctcgctgaccgtgatggcgagatagggcaagggcaatctcgccgttag

SEQ ID NO: 6541 - DNA, 756 bp, Glycine max
  Peptide Sequence Number=SeqID_98226
atggaggttcctcggaatccgaatggttgtgacattgttgcatggccaggttacacatgcaacattccaaacgaaattccaagagataccataatcatttgtcaaccactaggacttgctcagggactcaatactacttctaagactgaagtcccgcgccgttgcacgaccacaacctccaaccgccgtcgaagcttggtcgtcctcccaccgccgtcgcacgagggagcaccccacgccactgtacgtcgtcgcgccaaccaccaggccgccgccgccttgatttttgcagtgattgttactgctgctgctgctgctgttgttgttatggcagtggtggagaaggaaaagcttcaggaagaatctgtaatccgccgcttctaccagattattcttagttgggactactttgctctcctcaaggaatctaaggcaaattcacttctttcccttactctttttcctttcttgaagctgaaaaacaaggagaagaaagggactgcggtgtcgacactcgtgaaggtgaagcaacgctacaaagatgttgatgattacattgccacatacgaacccctcgtctttgaagaagccaaatcccagatcattaaggagaaagaggaggaagaggcacttgccagtggagagtggactattaaagctctcggccagtggagatatagggctggttgggtggataagaaagaagggaatgaggaaaaggttgcgggttcgattcttccagctaacaaaaactaa

SEQ ID NO: 6542 - DNA, 844 bp, Glycine max
  Peptide Sequence Number=SeqID_98227
atgaaattctcagccatccaggaaaacaataaaagaaaggatcatgaaatttctctctcacttcaagacattgcgaccaccagcggtgaaggaccatcgagaattaatgagatctttaacaaacaaattcgccaaagtgctccatctcctccacacactactgatcatgatgatagtttaagcgagagtgaattgggtttatcactaaggttgcaaccaagcacaagtcatcataaagaaagtgatgtgggaaataacaataaggaagacaaaaatgatcaacaattggcaagttttgcatcagtgcagaacaaactacagcggacacatgagttgcctggtattactacccatgctgctttccctcctaacagaaaggctagggtttcggttagagcaagatgtgaagctgccacaatgaatgatgggtgccaatggagaaaatatgggcagaaaattgcaaaaggaaatccatgtccacgagcctattatcgttgcactgtagccccaggctgccctgttaggaaacaggtgcaaagatgtatagatgacatgtccatactaatcacaacctatgaagggacacataaccatccactccctgtgggtgcaactgctatggcttccacagcttctgcagcagcttccttcatgttgctagactcaagcaaccccatttcagatggcacctcaagcttcactcaagcaccatttccttacaacaccttccaccctctaaacccagcttcaaatttcaggagcataagccctagtgatccatccaaagggattgttcttgatctcactagcaacctcactgaaccacccatacgtttttccacgg

SEQ ID NO: 6543 - DNA, 147 bp, Glycine max
  Peptide Sequence Number=SeqID_98228
atgaaaaatcacatccacatggctagaagcaatctcaaatgtagagagaaagggttagatccacatttcaaacttggtttcaaacatgcacagcactacaccggtcacggtcctcgaaattcaaccaagagtgttcggtttcattaa

SEQ ID NO: 6544 - DNA, 255 bp, Glycine max
  Peptide Sequence Number=SeqID_98229
atggtatcagagtcaattctgtccgatggtgtggataatgtcgctagtcctcactttgtggtgataagccctgactcgaggaggcatgttgcgagtcctacatcgagtcggtacctttcgaatgtttggttgaactttaacatggtatcagagccagttttgttcggtggtgtggatagtgccgctagccctcgctttgtggtgacgagccctgactcgaggggacgtgttgtgagtcccacatcgggtgattaa

SEQ ID NO: 6545 - DNA, 1074 bp, Glycine max
  Peptide Sequence Number=SeqID_98230
atggcaaaaggtagcaggggaagacacaggattgcttctcgtcaattcagagtgactccatacccactggcttcttgcaaaagggacatttgtgaggacatgtgccaaaagaaatgttctaaggctttggaaaagaaagagttggaagatgttacgtgttctgtgtgcatggaatatccacacaatgctgttcttcttctttgttcttctcatgacaagggttgccgtccctatatgtgtggaactagctttcgtcattctaactgtcttgatcagtacaagaaagcttatactaaagtaatttcacctaataggcaacctatgcaaggcactccaggtgtgctacaagattcaaacttgcctcttgagaagagtgaagccacagagcttgcatgtcctctatgcaggggtcaggtgaaaggttggactgttgtggaacctgttcgggactatctgaatgcaaagaaaagaggctgcatgcaggatgactgcttgtatgttgggagctataaggagttgaagaagcatgtgcgggcagagcatccgtcggcacggccacggatggtggatcctgctgatgaacagaaatggagatggctcgagtgggagcgtgaaagagaagatgttatcagcacagttacatcagcaatgcctggggcagtagtttttggagattatgttatagaaggtcatcataatgactttgatacagatgaagaggagggttcaggtaatgcagaaagaaatggaagatttcagatgggtttagaggcaatgaatttcttcctcctgttgcatgcagttcggcaagggaatgagcttaacaaccttggtagacggctgaggcctgagctgacccacaacaacagggttgcaggtcagaatgcagctgccgtgctggatatttcagatgaagacaatgataatgatggcaggtacaatgaagataatgatgatggtggtgtatctttggttagtcgtctccacggccatggcggtggcagagttttattgggtcgttctggtaggaggcgtagatgtagagaagcacgtgcaaggattggagatagttga

SEQ ID NO: 6546 - DNA, 867 bp, Glycine max
  Peptide Sequence Number=SeqID_98231
atgacaattcagtgtgagaatggacatattgcttgctctatttgctgtgtgagactcagtaacaagtgtcccatgtgttcaatgcccattgggtataaccgttgccgggctattgagaaggtcttggagtgtattaaaatgtcatgcccgaatgcaaattatggctgcaaagagacacttagttacagcaagaaaaacgaacatgagaaggaatgcatctatctgccatgttcatgcccttttactggttgtgattttattgcctcatccaaggagttattcctccactttagccatagacatgtaggctctggaacacagtttacatatgataaatttttcactgtcttcttaagtattaaccagagaacagttgttcttaaagagaaaagtgatggtaatctgttcgttgttcacaataacctcgagcatctggggaacatagtccgcattagctgcattggtcccaagtccacgacagagtttcagtatgaagtcttggctaggcatcaaggaaacgctttgattctacaatcttttaccaagattgtgcaagggcaatatactgatgctccatctattgttgttggtaaagtttttgttcacagtcacagtgcgcagagcttttcattggattatagtgggtattgtggtaacgaaatgtactttataccttcggcattctactggagaattctttatttagagatatctatattatatcaaagatcctattcatcgggtcctgtgttttctgatcctcatccatctgtttacccatgttttgttcatttgccaacatccagtaaaaccaatttgagcctcattcagctcaagactgagttgagttgggtcctgaaagcttaa

SEQ ID NO: 6547 - DNA, 1620 bp, Glycine max
  Peptide Sequence Number=SeqID_98232
atgatgcgtctaatctcatattttgccgctattgtagttgctcttttattttcatttataccttcttcagcagatactcaagaaaactttgttcaatgtctttacaattatccccatgataacaccaccacctcaatctccaaggttgtttacactcaaaccaactcctcatactcgtctatactagatttttccattcaaaatcttagattttataatgtaacctcaaaacccctagtgattgtaacaccgctggaagtttcccacgtacaagccacaataatctgttcccaacgccacaacatgcagattcgaatccgaagtggaggccacgattacgagggtctttcatacgtatcccaggttccatttgtcgtccttgacctcataaaccttcgagaaatcaaagtggacgtagaaaaccgcactgcatgggttcaagctggtgcaaccattggtgaactttacttcagcattagccagaaaagcaacacactagggttcccagcaggtgtgtgccctactgtgggcactggtggcaacatcggtggtggtggctatggattcatgttgcgcaagtacggtcttgctgctgataatgtaattgatgctgaaatagttgatgtgaacggtaatcttcttgatagaaaagccatgggtgaggatctgttttgggccattagaggaggtggcggagcaagctttggagtcattgtggcttggaaggtaaaactagtcccagttccatcaactgtgacagtgtttagggttccaaggacattggaacagaatgcaaccgagataattcataagtggcagctagtggcaaataaacttgacgataacctgatgattaggatccacctggcaagggtaacttcaagtaaaaatgggaagccaacggtagaagcccaatttgagtccacgtatcttggaggtgtggatcagctcattcccttgatgcaaaagagattcccagagttaggtttggtaaaagaagattgtactgagacgagttggataggttcagttctcttcatgggtaattttacaatcagcggtccccctgaagttttgctgaacagaacgcaattagttggtgtgttaaactacaaagcaaaatccgattatgtgagagatcccattcctgatgttgggttagaagtgttatggcccttgttttatgaagatgaggctcaagctgcttttgttcaattctctccttatggaggtaggatgtatgagatttcggaatctgaaattccattcccacatagatctggaaacttatttcatattcagtatggggtgtattggaaaggggaagggaatgaggaagcacaaaagcacattaactggattagaagaatgtacagttatatggaaccttatgtttcaaagtctcctagagctgcatattttaattacagagaccttgacattggggcaaataacaacaatggatacacaagttacgaccaagccagcgtttggggccttaagtatttcctgaacaactttaagagattggcaacagtgaagacaaaagttgatcctctaaacttcttcagaaacgagcagagcataccttctcttatatccaagggacgcaaattatag

SEQ ID NO: 6548 - DNA, 1620 bp, Glycine max
  Peptide Sequence Number=SeqID_98233
atggaaaaatcaaattccctaccatttctttctgttattgttcttcttcttcatgtctctaactctctaactaccccaacaagagagtccattcacgacacttttcttcattgtcttcaaagccacacaacaaaccaaccagatcatgtttcaaacatagtctatgcgcaaaccaacacatcctacacctcagttcttcgagcctttgctagaaatgccaggttcagcgccccctccacgcaaaagccattactcattgtcacacctctcagtgaaaaccaagtacaagccactgtggtgtgcgccaaaagcattggccttcaactcaaaatcagaagtggtggccatgattttgaaggtgtttcatacatctcccaggtaccttttatcatccttgacatgttcaattttcaagatgtcacagtggacgtgcaaaatgagattgctgtgattcaagctggtgcaagtcttggacaagtttattacaggatttgggagaagagtaaagttcatggctttcctgcaggggcttgtcccactgtaggggttggtggccacttgagtggaggagggtatggtaacatgataagaaaatatgggttatctgttgatcatgttgttgatgctaaaattgttgatgtcaaaggtaggattcttgacaaggaatccatgggggaagatcttttctgggcaattagaggaggtggaggagcaagttttggtgtcatcttatcatacacagttaaacttgttccagtgccagaaaatgttacagtttttcaaattgacaagactttggaggaaaatgccaccgatctagttgttcaatggcaaaaggttgccccacacacagatgataggctttacttgaggcttgtcttacaacctgtaagttccaattttgtgaagggaaagaaaaccataagagcttcagttgaggctttgtttctaggagaagctgatgaacttgtcaaattgttggggcaggagtttcctttgctgggactgaaaaaagagctttgtcatgaaatgaggtggattgattctgtggtttggtgggctaattacaacgatggatcctcagttaatgcacttcttgaccgaaatcattactcggtgcattccaacaaaaggaaatctgattatgttcagaccccaatttccaaagatgggtttacatggatatggaaaaagatgattgaattgggaaaagttagcattgttttcaacccttatggagggaaaatgaatgaggtcccttctgatgctactccatttcctcaccgtgcagggaatctttacaagattcagtacactgtgagttggcaagaaccaggtgctgctgtggaaaaaagttttttgagtcagattagagtgctacacaattacatgaccccttttgtgtccaagaatccaaggagtgcatactttaactacagggaccttgatattggtatcaatagccatggtaaggataactttgaagatggaaaagtttatggtatcaagtacttcaataaaaattttgaaaggttggtgaaggttaagagtgccattgatccagaaaactttttctggaatgaacagagcattccaacatatccaagaagcaatgcgtaa

SEQ ID NO: 6549 - DNA, 483 bp, Glycine max
  Peptide Sequence Number=SeqID_98234
atgcctctggtactaggcgacatcaatcttgttgcacaaaaagagaatggagcattggaaacaaagcctaatgataataagctggatagggaagctttatgcggtgaaatctcaatcgcgattcttcaagcgttcgagacgctggttcaagtggtcgatcctgacgacgaggttggtgacggagtagaggagccagtagaagaggagtgcggcggcgatgaggagggcgttgcgttggctcttcatgatagatttctggtggcgaaggtgctcggaaggggtgcaggaatctccctcacagctaggcctggtttcgtacttccaatatatgtccatgaaaaggaacaggcagaaaggcaccaccgagaggaacggcttcagaaggttccgggtcaccgcgatcagaccctttcggagagcttccaggcccgggatggtgaggagaataaccattatggcctctgcggccgcgacgtaccctag

SEQ ID NO: 6550 - DNA, 819 bp, Glycine max
  Peptide Sequence Number=SeqID_98235
tacatgacttacacacctttctctctctgcccctccgattccgacctcgccgaatccctaatcctccgcggctgccaccccctcccccgccgccgctgcttctccaaaacaccacagaaacaaattcccccaaattccctccctaaaaaccccttcccttcctccctccctgacaacgctgtaatttgggatcattaccaatgcaaatcgttcgattgcttgaataaacaaaaccctaacctcggcttccaaccttctcgtgatatttcgaggttcaattcgtataagactgatttggatctcccgatccagcagctgtttcagatcgcggcggccgcgaagtcggtgctgcgcctcggcctcgacgtcggcggcggcaccggctccttcgccgcagcgatgaggctccgcaacgtgaccgtggtaaccacgaccatgaacgtggtggcgccgaacagcgaggccgtcgcgctgcgggggctcgtgccgctgcacatgccactgcagcagcggcttccgctgttcgacggcgtcctggatctagtgcggtgcgggcgcgccgtgaaccggtggattccgttgacggtgatggagtttctgctgctggatgttgatagggtgctgaggggaggagggtacctttgggtggatcattttttcagcaaaggggtggaccttgagaaggtgtatgcgcctttgatcgggaaattggggtacaagaaggtgaagtgggcgacggggaataagaccgatgccggtggggtaaaaaatggggaagtttacttgactgcgttgctgcagaagcctgtgtccagatga

SEQ ID NO: 6551 - DNA, 822 bp, Glycine max
  Peptide Sequence Number=SeqID_98236
atgactatttcaagcctcttttcagcggcaaaaatgattttcttccacttaattatggatgttccccctatatataaaggtggcaaacaatccccattcttgaacagcagcatcagaattcagaaacaaaacatcaacggtagtctattagacaacacccctaaaatcattaatatggtcactcgtgcacacttcttttgcctcatggctctcaccttcactctagccttggcagctgatcacagtccacttcaggatttctgtgtggcagaccccaaaagtcaagtgctagtaaatggattggcttgcaaggaccctacactagtaaaggccaatgacttcttcttcagaggacttcacctagaaggaaacacatcaaacccagtaggatccaaggtggctccagttacagtttcacagctaccaggactaaacactttaggaatttcacttgcccgcattgactttgcaccgtggggcacaaaccctcctcacactcaccctcgtgccaccgaaatcctcaccgtgatcgaaggcactcttgaagttggtttcgtgacatcaaaccccggaaaccgccatgtcaccaaagtgctgcaaaagggtgatgtgtttgtcttccctgtgggacttgtgcactaccagagaaatgtgggttatggcaatgctgttgccattgcagctctcagcagccaaaacccgggggttatcactattgctaatgctgtgttcggggccacgccagacattgctagtgatgttcttgccaaggcttttcaagtggacaaagatgttgttgctgatttaaagtccaagttctag

SEQ ID NO: 6552 - DNA, 945 bp, Glycine max
  Peptide Sequence Number=SeqID_98237
atgggatgtaataagctttacggtcaaatgatcatgaataagaggagacgactattgcaaggaggaatccgattagaggaacaagagaaaaatgttcaatgtgtactgattgctcatgacaaggttgtgttggaacgtgaaaggcatagcagcgttgatttcaccatcgctgtggttttctttttctctattgaggttgtcattgggagcactcaacctaaccattcaagttgtgaaaccacatcgcaagaaaattcacaagcgatggatccgaagctgaaagaggtttctcagctcttcgatcgcttcaaggcttcgtttctccggaacgacttcgataactgttccaatctcctttctcagctaaagatcgattctgttgctttatttagttttgtgtttgaaaatttgaatttggcttgggatatatatgagcatgctgttgtccttagtgtgaaaattgaggatcaagatgctttcgaaagggatttcttccagttgaagccttattatacagatgcctgcaatcgtcttccaccatctcctcaggagtaccctatactgggtctcaacctgttgagactacttgtgcagaataggattgctgagttccatactgagttggaattgctttcatctgctgctcttgagaatccttgcattaagcatgccgtggagttagaacaatcttttatggaaggggcttacaatcgtgtcttgagtgcacggcagacagtgccacatgatacatacgtttatttcatggatcttttggcaaagactgtcagagatgaaatagcaggttgcagtgagaaggcctatgactatctttcaattaaggatgccaagcaaatgttgctgttctcctcagaccaggaactcctggaatatattaaagagtgcatgaaaatggacatgaaattgagacttgctgttgaaccttag

SEQ ID NO: 6553 - DNA, 1152 bp, Glycine max
  Peptide Sequence Number=SeqID_98238
atggaaaaggagcctctgctcccatatttcagccccagaaagaagcctcaaccatttccaccactatgccccttaccagaacacgacgaaatcgttcttcctatgaccccttcggaattcaaggaccgtctcatctttggtccttctccttcctctgcttccccaagagacccttcacctctggctgatgccttaacactctcttacaattccccaaaatgcccctcctcttcaaactcacaggactatgcatcaccgccactatttgattcccaacaacagcaaccgctcaactcttggctccttgaccccaattacgagtcatggcggaaaacgaaccttcaccgatcgaaaaccgcgccggccatggccgtgatcagcgatttcaacccccacaccgccgtgcaaagaccccagtttgccagccagagtattgtccgccagggtgttattcttcttgctctttatttggcattaggggttgtcatttattggttcaatcgtcataattttacagccaccgagactcatcctgtagttgatgcattgtatttttgtatagtgacaatgtgcacaatagggtatggtgacatcactcccaatagtacagccactaagcttttctctatattgtttgtgttggtggggtttggatttatagacatattgttgagtgggatggttagctatgtgcttgatttgcaggagaatcatatgttgacggcggtgaaggggaggaggggtgagaaggatggaaagtcttatataattgatgtgaagaaagggaggatgaggattcggttgaaggtggcgctggctttgggggttgtggtgatttgtactggggtaggtgtgggggttatgcattttgtggagaagcttggatggttggattcgttttatctttcggttatgtcggttaccacggttgggtatggagaccacgcgttcaagaccatgcacggtcggatctttgctgcgatttggttgcttgtgtcgacgcttgctgtggcccgggcgtttctctatctggctgaggccagagtggataagcgtcataggaggatggcaaagtggattcttggtcaggatatgactgtttctgagtttctagcagcagacattgacaataatggctttgtgaggtactga

SEQ ID NO: 6554 - DNA, 2487 bp, Glycine max
  Peptide Sequence Number=SeqID_98239
atggcgtcgaagctgagaacgtgcttcatgtgctggaacctgagcggtttcaactgcgttaaccaccacaacggcagaaatagggtagtgcgagtttcgtttccagcttcttgcgaaatgcgacaccgcgccaccttcagttcacagcataagagacaacagatcaagccttccgcagagggaggtctccgtcagaatcaagatgaagaagacgatgctgccgaggtttcgttgaacaacgatgattctgtggagaatttgaatgacgcaaccgcgcctttggccataaacataaatggagcagagcaggctgaacagttatctggtaggcaacttgaggatttgctgggaatgataaaaaatgcagagaaaaacattcttcttttaaacgaggctagagttcgttcacttgaagatcttgaaaagattcttgcagaaaaggaagcattgcaaggagaaattaatgtcttagagacgaggttggctgagactgatgcacagattaaagttgccaaccaggaaaagatacatgtggagctcttggaggggcagttagagaaactgcgtaatgagttggcccaaaaggaaagtactgaaggaaaatattctgaattgcatgaccttcaaaatggaggtttgagtgatgcaaaccctctaagtcataatgatagcattcattccctaactgaggagcttaattcattaagagcagaaaatgcctctttgaagaatactatagaatcatttaaaacacagcttagtgataccaagaataatgatgaacgtttggtggcattggaaaaggaacggtcctctttggaatcagccctaaaagacttggaatcgaaactatcaatctctcaggatgatgtatcaaaaatttctacgcttacagttgaatacaaggatttgtgggataaggttgaaaatttgcaatcattgctagataaagcaaccaaacaagctgatcaagctgttattgtgctgcaacaaaaccaggatcttcgaaggaaggttgataaattggaagaatctcttgaagaagctaatatctataagctatcatctgataaactgcaaaaatatagtgaactaatgcaacaaaagttaaaactattggaggaccgtcttcaaaaaacagatgaagagataaattcttatgttcagctatatcagcagtcagtgaaggaatttcaagatacacttgatactctgaaagaagaaagcaagaaagggaatttagaagaaccggtggaagatatgccatgggaattttggagtcaactgttacttctaattgatggttggaaactagaaaagaaaatatcagtagatgatgcaagtcttttgcgggaaaaggtgtggaagagagacaggcgtattattgatacatatatagcttgcaaaaaacagagtgaacaggaggctatttctgcgtttcttgggcttttatcatctgcaacaagtcctggattacatgtgattcatattgcagcagagatggcaccagtagctaaggttggtggtttgggggatgttgtcagtggtctaggtaaagcactgcaaaagaaaggacaccttgttgaaattgtgcttcccaaatatgattgtatgcaatatgaccgtgtctgtgacttacgggctttggatgtgctgatagattcatactttgatcgtcaattatacaaaaataaaatctgggttggcactgttgaaggccttcctgtttatttcattgagccccatcatcctgataagttcttctggagaggagaattttatggcgagcgtgatgatttcagacgattttcattttttagccgtgcagctcttgagtttcttcttcgagctggcaagaagccagatatcattcattgccatgattggcagacagcattcattgctcctctgtactgggaaatatttgccccaaaaaaaggattaaattcagctaggatatgctttacatgccacaactttgagtatcaaggaactgcagcagcttcagagttagaatcatgtggtcttgaaagccaccgtctaaacagaaaagatagaatgcaggacaactcatcacatgatagagttaattctgtcaagggtggaattgttttctcaaacattgtgacaacagtttcacctacttacgcccaagaagtgagaactgaagagggaggacgtggtctccattcaacactctctgtccactccaaaaagttaattggtattattaatggtattgatactgatgcatggaatcctgccaccgatgcatttcttccagtccagtacaatgcaaccgatcttcaaggaaaagcagagaataagcaagccttgggaaggaacctaggtctttcatctacagatgttaggagacctttgaatgataagtctaaggctaactgcacttgtgtgctttatgtaacatttgagatgaatataccaagactctttcaaatagctttatcttgtgaaatctatctataa

SEQ ID NO: 6555 - DNA, 459 bp, Glycine max
  Peptide Sequence Number=SeqID_98240
atggcgaatggcaaaacactgtggaaggtcaaaattccgccatataaacacgccattgtgccgccatggcgggctttccttcataaatttcctgaggcggttggcaaaaagtccgtcccgccattctgccatggcgctgccttggccgtttcctttccttgcttctggcttgatttattgttccatgttcaacttcaatatactgctatttactttacatgtagcactgccaatgaatctttcattgtggctatatttaaaagccaactgcatctttcttatatggaaagtcttatcttcaaatttattatgtttactattggcaatgcatctggaaagaagtggatatcaatgactaatgaggtgctcatccctttatttctcattttcttccttttagcatatagatgtaataccgaagtagcagaactgtgtcctctgattagaattctggggtga

SEQ ID NO: 6556 - DNA, 292 bp, Glycine max
  Peptide Sequence Number=SeqID_98241
atgtgggacaaaggaactaagaccacaaactctaacactatattgatttggatgaagataagcaaatgtaggtgttgtagttggggaacccaaggctctataaaaccccacactatctcatccttgcaacaacagcaacaaagccttgtcctaatagatgaggtcagctacatggattacatgatgccattcagatcgattaaagaccaaagtttcatcgatgttatctaccataaaatctgctctgccattttgccatggcaccgccatttaacaatgcaagaagctagag

SEQ ID NO: 6557 - DNA, 171 bp, Glycine max
  Peptide Sequence Number=SeqID_98242
atggcttcaaagagagagagaatcttgaaagcgacgttgttgaagaaggaaactggcaaagaggaaagcctcttccacttgaatgcagcacccagggtttttttaatggtgagaagaaggagtggaaggaatgcgtatttatatattacgagatacgagattgttaagtga

SEQ ID NO: 6558 - DNA, 297 bp, Glycine max
  Peptide Sequence Number=SeqID_98243
atgggaagcgaggatgcgaaagatccgttcaaaggggtggattggaaggccgttggtggcgagatgcagcaaaatccgagtgctaaaccagcattgaagaaacgattaccaaagaaagttagggaaattcctgaattctatttccttccacgatggccgctacccaaagccattttattctgcagcgcatgcattggtggtggtgtagctgctggaatgcttttagagacctggattgaaaagaaagttaaagattttgttgaaagtggtgcaccaaattggtacccgtcaatttaa

SEQ ID NO: 6559 - DNA, 843 bp, Glycine max
  Peptide Sequence Number=SeqID_98244
atgaggaatgcgcagcttggttggactcgtcaaaaagtgttccatgtattgattggctcttctaatttgggttacgtcatttatttggcattgacacttgttgctgcctgcaagggatggacctgttggtcgcattcttgtggttttgtatttatggctttccccaaagtacttttttttgcagcatttcttcttcttttatccttctgggttgacctttgccatcaggcagatgatgatgatgactatgaaggaagtttttgtgataaccctttgctggaaaagacttcaaatgaatcaaatttagcaagcatagatagccatagaaagtgttttcctttttggtttgctcgtgttggaaatcggcaaaagattgtgattttggttactttgctagttttcatcatcgtggttgcttttgctgtagtaatctggattgggttaggaaagaatcccattgattctgaagtggcagctcggtgtcgagcaatgctagaacccggatacatatgtatgtattcagctgactatctagaaggcatgcttagtatccaactaaatggaaagggtatgtttggctgttatttaaatttgtgccttggtgacttgttggtcatgggttcgaatccggaaacagcctctttgcatatgcaagggcaaggctgcgtacaatatccctcccccataccttcgcatagcgaagagcctctgggcaatgggcggtcccttaactgcttgtggccttctgagaagcattggtgcctgctaggcagcaaccaagttgctttctatttgatgtcagaatatgatgtctcaaatgctttgatcccaattataggctaa

SEQ ID NO: 6560 - DNA, 273 bp, Glycine max
  Peptide Sequence Number=SeqID_98245
atggagtgctgcaagattgctatagttctcaccatctacattatggctatgttggtttttgctcactgttgtgtggctgagaatgtagctgaagatgttgctgcaattccacccacaccaatggaaagtgcaggggtgcatctttgtgcctcagctgtttttgtagtcactgcttttgtggttgctattagcctctcccaggaggtagccccaagagaagaaaagcctccagtgcaacttctccatgtctttccaggttcaacttcttactga

SEQ ID NO: 6561 - DNA, 2751 bp, Glycine max
  Peptide Sequence Number=SeqID_98246
atggcgggttcttcgatcatggagaacctcttccagcgcacgctcgaggatctgatcaaaggcttgcgcctccaactcatcggcgaatccaccttcatctccaatgccacggaggagatccgccgcgaggtcaaatccaccgaccagcacaccaaatccatcgccctccaaaaactctcctacctctccgctgtgcacgccgtcgacatgtcgtgggcgtgcttccacgttgtggaggtcatgtcctcctccaagttcgcgcacaagaggatcggttaccacgccgcgtcgcagtccttcaacgacaacactccggtgctcctcctcatcaccaaccagctccgcaaggacctctcctccaccaaccacttcgaggtaagcctcgccctcgatttgctctcgcgaatcgccactctcgacctcgctcgcgatttgacccccgaggtcttcaaattgctctccaccgctagggttttcattaggaagaaggctattgccgtcgttctcagggttttcgataagtaccccgacgcagttagggtttgcttcaagcgtttggttgagaatcttgaaagttcggatcctcaggttgtgaccgccgtaatcggggttttctgcgagctggctgccaaggatcctgggtcataccttccattggcgcccgagttttataggattttggttgattcgaagaacaattgggttttgattaaggtgctgaaggtgtttgctaagttggctcccttggaacctaggttggggaagaggattgttgagcctgtctgtgaccatatggggcggtctggggccaagtccttggtgtttgagtgtgttaggactgtgctcactagcttgagtgattatgagtctgctgttaagctcgccgttgagaaggttagggaattgttggtcgatcaggatcccaatcttagatatcttggcctgcaggcgctttcggttgccacacccgagcacttgtgggcggtgattgagaataaggaagcggtggttaagtcgttgagtgatgatgattcgaatatcaagatcgagtcactgcgattgttgatggccatggtgtctgagagccatgtggcggatatctccagggtgttgctcaattatgcgttgaagtctgacccggaattttctaatcagattttgggttccattttgacaacgtgttgtagaaatgtgtatgagattgttgttgactttgattggtacgtgtctcttcttggagaaatggcgatgattcctaattgccaaaagggggaggagattgagactcagcttgttgatattggtatgagagttaaggatgctagaatgcagcttgttcgggttgggcgtgatctgttgattgatcctgcattactgggtaatgtgcacttgcataggatattgtgtgctgctgcttggattgctggagagtatgttgaggttgcggccaacccctttgaactcatggatgcactcctacaacctcgtaccagtctcttgccaccatcaataagagcagtttatattaattctgcttttaaaattttaattttctgcctggactgttacattctgcaaaatgaaggttctgcatcttggtattctgataatttggctgggggacagtcagatttgttaagtgtaaaaaatgacactgaggctgctgaattggcaacgtgtgaaggatcaaatgatgaacagcatgaggattttaacccaaggaatgcaactgaatcttctgaggatctttctgttaaaaatgacatagatagagttgccactcatggtcaagcatctacacctcctactgtcttggggaagaagaattccatgcatgaatctattgtaagcctattgaatcgaattgaattaatttttggcccgctaatagcaaaccaggatgttgaagtgctggagagagcacaaaacttactttcccttgttcagttgattaaagaagaaataattgataatttagtccagagtgtggtggacattgcaaacaagaaagttactcgagttacagctattatcaatttgttgcgtgatgcttttactacagaacttggtccggtctcaacaagtgcacagggaagaattgttgtgccggatggattagttcttaaagaaaatcttgatgacttacaagcgatgtgtggtgatattgaactaccttcatcaagttcatttggcacaggagtccctcaccttaccactacttcggacacttcttcatctaatcttctgaaaaatgaagagtcagggccattgaaggaatccacatccttgattgagcatcgtaagcggcatgaattatattatcttccttccgagaagagtgagattgtttcagatgagtatcctcctgcaaaaaaggacaaaaaaagggcaaaccaaacaaagcccaggcttgcattggtgagattggatgatggagatgtggcaccaatttcagtcaaaagaccagagccaagggatgattctctttctggtgccataaaagatgttcttctaagaagcgaaaccggaccatgtatgtctggaagcagtcgtagcaaaaatcatggtcatagtcatactaaagagagaagacacagaggaaaagaaaagattgttgagggggaagagcatgatcagagggaaaagaaaaagagtggccattgccgtgggaggcgaaaaactcatcaaagagcaaagtcacccgtgaacgtggtttctcacaccccagtaattccagattttcttttgtag

SEQ ID NO: 6562 - DNA, 558 bp, Glycine max
  Peptide Sequence Number=SeqID_98247
atgtttttccacatagtactggagcgaaatatgcagcttcatccacgctactttggtcgtaaccttcgcgataatctcgtttccaagcttatgaaagacgtggaaggcacttgcagtggccgacatggatttgtggtggcagttacagggatagagaacatagggaaagggctaattcgtgatggaacagggtttgtgacatttccagttaagtaccaatgtgttgtcttcagaccgtttaagggagagatcttggaagcagttgttactatggtgaacaagatgggattttttgctgaagctggacctgtccaaatctttgtttcaacccatttgattccggatgatatggagttccagtctggagacatgccaaattacactacatcagatggatcagttaagattcaaaaagatagtgaagtgagactaaagataattgggactcgagtggatgctacagaaattctcatgatcactgtcttagcagtagtttttgtgaatatcatgaaaattggtttacatttctggaatgctagtttatgctccgattgctag

SEQ ID NO: 6563 - DNA, 633 bp, Glycine max
  Peptide Sequence Number=SeqID_98248
atgcctcttcagatcaaccctttacgatccaattcaaccttcttcttctctcttttcttatccttcttcctatggacagcacaagtatgccatctcaaccacacgttctacctgctcttcccctattactgggatgttttgaaggagattcagaatttttgcaaattttcgacgaggactgtgaggtgcatgcagggaaatgctgatagtttcggtgggaatctcagcacccatttaaggttttttcattttgatcaccaaaacgatagcagtgaagtgccatatcgaatatgcatggaaaagtgtgaaagtgtagttgtagtttcagcaatattcaatgaccacgacaagatccggcaacctaggggccttgggtcccaaacactacaaaatgtttgtttcttcatgttcatagatgatattacactcaaaggacttgaataccttgggttaatttcaacaaaatccagagaatacaagataggagtgtggaggattgtgaaggtttcaaaagaggatttgtatcagaacccagcaatgaatggggttataccaaaatatttattccataggctattcccatattccccaattcagtatttggatagatgcaaagttgcaactaatggttga

SEQ ID NO: 6564 - DNA, 1015 bp, Glycine max
  Peptide Sequence Number=SeqID_98249
atggccgacgatccaatgcccacgcgctggtctttccaggacttcaaattgtgttatgatgctaagtttggtagaaagaaagtcgcggagaacggagatgatgctgccggtaaagcggtcagcaatggaaatggaaattcagtgacagtggccattgtgtccaatggcaacaaaagggcatcggaaatggctgtttatgagcagtttcgaagcgaggggcagaatcagattcacacaaatggctttgtgccgacccttacagatgaaaggccgcagaagtctttgcttccaccctttgaatctgcggaaatgcgagctttagcagagagcttaagtagggatatcattcgtggaagtccagatgtgaagtgggaaagcatcaaggggttagagaatgccaaacgtttactgaaagaggctgttgtgatgccgattaagtatcccaagttggtacttcactggtctgttatcaccatggaagggtatcctcctttttggcccaccggggacaggaaaggtgattcagagaagttagtgaaagtgttatttgaacttgcaaggcatcatgcaccctcaacaatatttcttgacgaaattgatgcaatcattagtcaacgtggtgaagctcgcagtgaacacgaagctagtagacggttgaaaacagagcttctcattcagatccttgtaccacttccagaaccagttgcgagaagagcaatgttcgaggaactccttcctcaacagcctggcgaggaatcgatcccctatgatatactggaggataagacagaaggatattcgggatcggatatccgattactctgtaaagagacagcaatgcaacccttaagacgcttaatgtcacaacttgagcagaaccaggatgtggtgcctgaagaagagttgccaaaagttgggccaatcagatctgaagatatagagacagctttgagaaacacaaggccatctgctcatctccatgcccacaaatatgacaagttcaatgctgattatg

SEQ ID NO: 6565 - DNA, 255 bp, Glycine max
  Peptide Sequence Number=SeqID_98250
atggattcaaacgtctgcctcaaatccttccaaatggagaagaagaagatggagaacaacagcaggagtccgcgagagggttgcatggattttgcagttcacagccaagtgataaagattaaggaagaaattgagaaaataaagcacccttcacttcagctacacatgaggcgtgcccttctcagagatgtcaaccgcctccgctctcgctcacccctcggatttgcagacagagagagagctatccttacttag

SEQ ID NO: 6566 - DNA, 1689 bp, Glycine max
  Peptide Sequence Number=SeqID_98251
atggaggcaaagggtgtgcggttcttagcgtatcaatcaatattttcgagcgttggatctggggacttcgatggggtgaagaaactggtggaggaagtgaagaaggaagaagggtcatcgctctctgatgtgatgtctcttcagaacgatgctggagagactgcgctatacatcgctgcagagaataatctgcaagagatgttcagcttcttgctcagcatctgtcactttgaggtcgtcaagattcgctccaaggctgatatgaacgcctttcatgttgctgccaagcgtggcaatctagcaccaattcagaaaaaagataataaaaaagcagttgaggtagttcggacacgtacaaaggagtggaaatgttggggcacacgttccaatgtaaatccaacggatattgtgagggagcttttgaatatttggcctgaggtctgcaagttatgtgactcctcaaacaccagtcctctatattctgctgcagttcaagatcacttggatgtggtggatgctatcttggatgtcgatgtcagttccatgttcatagttaggaaaaacggcaaaacttcactgcacaatgctgctaggtatggtgtccatcgtattgtaaaaacacttattgctcgggatccaggaatagtatgcatcaaagataaaaaaggtcaaactgcactgcatatggcggttaaaggacagtgtacttcagttgtggaggagatattactagctgatccttctattttgaatgagcgagataagaagggtaatacagctcttcacatggctacaaggaaatgccgttcacagatagtgggccttttgctaagctattctgctgtggatgttaatgccatcaacaagcagcaggaaacagccttggatttggcagataaactgccatatggagattcagctttggaaataaaggaagcccttgcagaatatggtgctaagcatgccaggtatgttggcaaagaagatgacgcaatggaacttaaaagaactgttagtgatataaagcatgaggtgcagtcacaacttatacaaaatgaaacgacacgacgacgggtttctggtattgccaaggagttgaagaaacttcatagagaagcagttcaaaacaccattaattctgtcacattggttgctgtactttttgcctcaatagcattcttagccatcttcaatttgccgggtcaatatataacggacgaaggaaaagagattgggaaagctaaaatagccgatcatgttagtttccaagtcttctgccttctgaattctacatctcttttcatttctcttgccgttgttgtagttcaaattactttggtagcctgggacacaagggctcaaaagcagattgtgtcggtggttaacaagttgatgtgggctgcatgtgcttgcacttgtggtgcttttctagcaatagcttttgaggttgttggaaagaaaacatggatggctatcaccatcacccttttgggggtacctgttctagttggcactctagcaagcatgtgctactttgtttttcgacaacatttcggcattttccgcagtgattcccagagacgcatcaagagagcaagtggaagcaaatctttctcatggtcttactctgcaaatatatcagatttggatgaatacaattctgacattgagaagatctatgccctgtga

SEQ ID NO: 6567 - DNA, 1536 bp, Glycine max
  Peptide Sequence Number=SeqID_98252
atggccgacgctctctcgttgattccggcagccgtgcttcgcaaccttgctgacaagctctacgagaagcgcaaaaatgctgctcttgatattgaggggatagtgaagcagctagctactgctggggatcatgataaaataacggctgtgatcaatttgttgactacggaatttacttattcaccacaagccaaccatcggaagggaggattgataggattagcagctgcaactgttgggttgacttctgaagcagctcagcatcttgagcaaattgtgccccctgtgttaaattcattctctgaccaagatagcagagttcgttattatgcttgcgaagcactttataacatagccaaggttgtgagaggggattttattatttttttcaaccagatctttgatgccttatgcaagctttctgcagactcagatgccaatgtacaaagtgctgctcacctcttagataggcttgtgaaggatattgtgaccgaaagtgatcagttcagtattgaagaattcataccactgctgagggagcgcatgaatgtgttgaatccatatgtccgtcagtttttggtaggatggattactgtattggatagtgtcccagatattgatatgctggggtttcttcctgattttcttgatggcttatttaatatgttgagtgattcgagtcatgagatacgtcaacaagctgattcagctctttcagagtttcttcaagagattaaaaactccccaagctgtgcttcattttcaactactactttgacacaaaagcaaagttttttgttcatttatcattttctgactcgagcagtgctactcttgaagtctgtagattatggtcgcatggctgaaatcctggtacagagggcaggttctccagatgaattcactaggctaacagctatcacatggataaatgagtttgtcaagcttggtggagaccagcttgttccatattatgctgacattcttggagccattttgccttgtatagcagataaagaagagaaaattagagttgttgctcgtgaaaccaatgaagagctacgtgccctcaaagcagatccagctgaagcgtttgatgtaggagcaatcctctccattgccaggaggcaattatctagtgaactggaggctactcgaatcgaagctttgcactggatatcaacccttttaaacaaatatcgtaccgaggttttggaatttctgaatgacatatttgacaccctgctcaaggcactttcagatccatctgatgaggttgttcttctagttcttgatgttcatgcatgcattgcaaaagatcctcagcactttcggcaacttgttgtcttcctagtgcacaatttccgggtagacaattcccttttggagaagcgtggtgctttgataattcgtcgactttgtgtgcttttgaatgctgagagagtctaccgtgaactttctacaatactagaagcggaatctgacttggattttgcatcaattatggttcagctgtataaaaaactttttgaataa

SEQ ID NO: 6568 - DNA, 1500 bp, Glycine max
  Peptide Sequence Number=SeqID_98253
atggtcgcaagaagaaaagtccttaacttgttatcaaccttaattccccaccacgccaatgcattttctcgtcacccgcacgaccacaacccctttaccaaaatccccaaaaccctttttagggtttattatggaacccaatcatcagcatcgaaactccccgaatatgagatgccatcggtgacgtggggcgtgatccagggtcgcaaggagaagctcgtttcgcgagtaatcatcttcgattacctcaagggtttgggaatcatccccgacgaattgcacgacctcgagcttccctccaccgtcgacgtcatgcgcgagcgcgtcgagtttctccagaaattaggtctcaccgtcgacgacatcaacaactaccctctaatgttggggtgcagtgtcagaaaaaacatgatccccgtcttggggtacttggaaaaaattgggatcgcaaggcccaagcttggtggatttgttaagaattacccgcaggtattgcatgctagtgtcattgttgagcttgctcctgttgttaagttccttagggggcttgatgtggagaaagatgatattggctatgtgttgcaaaagtaccctgaacttcttggcttcaagcttgagggtactatgagcacttcagtggcttatcttgttagtattggtgtgaaccctagagatattggtccaatggtcactcagtatccttatttattagggatgagagttgggactgtgataaagccgatgattgattacttggtcgatttagggctgccgaagaaggttttggccaggatgttggagaagagagcttatgttcttggctatgatcttgaagagactgtgaaacccaatgtggaatgtttgattagctttggtgttgggagggattgtttggcttcgattattgctcaatatccgcagattctcgggctgcctcttaaggctaagttatccacgcagcagtactttttcagtttgaagcttaaggttgaccctgaagggtttgcacgcgtggtggagaacatgccacaggtggttagtctccaccaacatgtgattatgaagccggttgagtttctccttggaaggacgataccggcacaggacgtggcaagtatggtggtcaagtgtcctcagttggtggcactgagagttgagctcatgaagaacagctattacttcttcaagagtgagatggggaggcccttgcaagagcttgtggaattccctgagtattttacttatagtttggagtccaggatcaaacccagataccagaggctgaagagtaaagggataaggtgttccttgaattggatgctgaattgtagtgaccagaggtttgaagagaggttgcagggtcattacattgaaactgagagtgtaggccccagattctgtatgggagggaaattagagctaccagggaatggcctagtgtcagatgaggaagaggagagtgatgatgaactattatacagacgaactgtttctctttag

SEQ ID NO: 6569 - DNA, 1590 bp, Glycine max
  Peptide Sequence Number=SeqID_98254
atggcttcctcaatattcagaagcctccaagttcaccccttcatgctttatccaacaacattcctcagacgaagaaatggggtttttcatttgacgaccaaagccacacaatcccaaacagacacccaacagaggcaacctcagacaaaggtttcatcaagcaacagcacacagtccaaaaagctcgacaaaattccaaaagactatgaagccatcattggcattgaaacacatgttcagctctcgactctgaccaaagccttttgtggttgcccttacagttatgggtcttcacccaacagcagcatttgccccatttgcatgggcttgcctggtgctttgcctgttctgaactcaaagataattgattttgctgtcaagttgggccttgctcttaattgcaacttggctttcaaatccaagtttgacaggaagcagtatttctaccccgatcttccaaaagggtatcagatttctcagtttgatgtgccaattgccactgctggctttcttgatgtggatattcctgttgagtttggtggggggcacaagaggtttggcattacaagggttcacatggaagaggatgcagggaagctcctacatgcagagaatggaaattactcacaggtcgatctaaatagggcaggggtgcctttgcttgagatagtttctgagcctgatatgagaaatggtattgaagcagcagaatatgcagcagaattacagaggttggtgcggtatttgggagtgagcaatggcaatatgcaagaaggttctcttcgttgtgatgtaaatgtatcaatacgacctattgggcaatcaaagtttgggacaaagagaacaattacaatgaggaaaaaggaagggcttgctgattatcgatattttccagaaccagaccttccagcagtaatcctttctcaagaatatgttgatggtataaaaaattctttaccagagcttccagaaattaagcggagaagatatgagcagatgggcttaagcatgcaagatgttcttttcctggctaatgataaaaatcaaattgtcagtctaaaatacaaactcataaaagctgactatgaactaactacatgtttgcaaattacagggtgcaaccagattgcagaattttttgatgcaactcttgcaaaaggtgctgactcaaagctggttgccaactggataatgagtgatattgctgccttcatgaaaaatgaaaagttgaccataaatgagataaagcttacacctgaagagttgtctgagttgatagcttccattaaaggtggaaccattagtggcaagattgggaaggagatactatttgagctattagccaagggtggaactgtgaaggaactcatacaaaaaaaggacttggttcagatagcagatcctgttgagattgaaaaaatggtggacaaagttattgtggagaatccaaaacaggtagagcaatatcgaggaggcaaaactaaactacaaggttttttcgctggccaggtaatgaaattatctaaaggcaaggcaaatccaggtctccttaacaagatcctcttggagaaattgaattcaaagagctga

SEQ ID NO: 6570 - DNA, 1368 bp, Glycine max
  Peptide Sequence Number=SeqID_98255
atggaagattttcaaagatcatttttgagccggctattgactatgcatcctaacggtgaaaattttatcagattcattgagaacttcgggacacacatccttgtggggcttggcattggtggcaaagatttagtgttggtcaagcaagacgtgtcttccaacttggatccatcagagctcaagaagcacttggatgagcttggaaatcaaatattcaatgggacatgcaattttcttccaaaatccaaagaacaaaaatataaggcgccacaagcttttgatgtctttggtccacaaattgttgccttcgatagctctacatccgtttgtgcaaaagatggaattacggtgatatgtgcaaaaaggggaggggatacccaagtgagagaccatagtgaatggcttctgacagttccaaagaagccagatgctgttgattttagcttcattcccatcacttctcttcttaaaggtactccaggcaaaggcttcctatcccatgccatcaacctctaccttcgatataagcctccaatgtcagatttgccttactttcttgactaccaatctcacaagctttgggctcccattcacaatgatcttccactcagtccagccacaaatagaactaatctttcgccttctcttagtttcgacttgatgggtcccaaactttatgtaaacacctcaaaggtaacagttggtaaaaggccaatcacagggatgcgcttgtttcttgagggcatgaaatgcaacaggttagccatacacgtgcaacatctattaaacactccaataatgcttaaaaacaaaatagaggacacgccaatatggtcagaagaaatcaatgatggccgtttctttgaagcaatcaatgggaagaaattttaccatgtatgtacagcaccagtgaaatacgaccctagatggagctctgacaaagatgtggcctttattgtcacaggagcacaacttcatgtgaagaaacatgaatcaaggagtgtccttcatttgaggctgttgttctctaaggtgtctaattgtgcagttgtaaaatcaagttggacacagggctcctctgggttatcccagaggtctggcattttctcagtcataagcacatcaatttctggtaaagaccagaaccagaaaaaaccggttgtggttttggattcaagtgtatttccaacaggacctccagtgcctgtgcaaacacaaaagctgttgaaatttatagacacatcacagttgtgtaaaggtccacaagatagtcctggccattggttgatcacgggggcaaggttggtcttggacaagagaaagatatgcttatgggctaagttctcattgttaaatactggttcatga

SEQ ID NO: 6571 - DNA, 3471 bp, Glycine max
  Peptide Sequence Number=SeqID_98256
atggaattacggggccttttccagtatcttgtgaatcagttaaaaaaggggcagggaattgagcttgttctactgcaggagcttattcaacaaatggctaatgtccagtacacggagaacttgactgaggaacagttggatgcaatggcagggagtgagactctcagatatcaagcaacatcttttggtgtaactcggaataataaggcattgataaagtcaactagcagacttcgtgatgcattacttccaaaagatgaaccaaagttggcgatccccctgttactgcttattgctcaacatcgttctttggttgttatcaatgcagatgcaccctacattaagatggttagtgagcagtttgatagatgtcacggaactctccttcaatatgtggaatttctttgcagtgcagtcactccagcatcaaattatggcattcttattccctccctcaatgacctggtccacctttaccacctggaccctgaggttgctttcttgatatatcgccctgtaatgaggcttttcaagtctcccgggaatcctgatgtttgctggcccttggatgataaaaatgctgcaagtgatgcatctatgaactttgagtctgatcctttggatcattctgctagtatggttctaaatcttggctctgctcaaaatcctataagttggtcgtatcttcttgatactgttaaaaccatgttgccttcgaaagcatggaatagcttatctcctgatctttatgctacgttttggggtcttacattatatgatctgtatgttccaaaaaatcgttatgagtcagaaatagccaaattgcatgctaatcttaaatctttggaggagctttctgacaattcaagctcagcaatcacgaagaggaagaaagaaaaagaaagaattcaagaatctcttgatcgtctgatcagtgaactgcataaacatgaagagaatgttgcatctgttcgtagacggctttctcatgaaaaagacaaatggttaagttcctgtcctgacaccttaaagatcaacatggagtttcttcagcgctgtatatttccacgctgtactttcagtatgcccgatgcagtttattgtgctatgttcgtacacacgcttcattcccttggaacccccttttttaacacagtcaaccacatagatgttctgatttgtaagaccctacaaccaatgatatgctgctgcactgaatacgaggcaggcaggcttggcaggtttctgtatgagactttgaagattgcttactattggaagagtgatgaatctatttatgaacgtgagtgtggaaacatgcctggcttcgctgtttattatagatatccaaatagtcagcgagttacatatgggcagttcattaagtgtctagaatctactgagtacatggaaattagaaatgctcttataatgttgacaaaaatttctagtgttttccctgttactcggaagagtgggatcaaccttgaaaagcgggtagctaagattaaaagtgatgaaagagaggatcttaaggtgttggcgactggtgttgcagcagcattggctgctaggaagccttcttgggttactgatgaagaatttggtatgggttatcttgagttgaaacctgcaccatctgtgactaaatcttcagctggaaactcagcaactgtacaaagtgggataaatctcaatgtttcacaaactgaatctgccagtggaaaacatgtggactctggaaacatagtcaaagatcaggcaatgagaacaaaaactgcagatggcaggtctgagagaactgaaagcattacagtgacaaaatctgatactggccacataaaactcaagagtagttcaatggtgaatggattggatgctcaatcatccttggccccgtcttctgtacaatctgggacgtcaaaatctatggaaaacccaaagcaagtggaagaatccataaatagagcatcagatgaacatgggacaagaactactgagttaagaacttcggctaaacgttcggtgcctgctggttcactatcaaagccctcaaaacaagatcctgtaaaagaggatggtagatctggaaaacctgttgctagaacttctggttcctcgagcagtgacaaggaactacaaacccatgcattggagggaagatacactggaactaccaatgtaccttcttcaaatggtaacaccatctcaggttctacaaaaggttcaaatccaccagtcaagatttcattggatggccctggtaatgaatccaaggcagaggttggagttgccaagtcttctgatattagagcttctatggtgaaggatgatggaaatgatattactgacaacccaagaggagcctcttctcgcgtagttcattcccctaggtatgaaaacacaggagtcacttcaaagtctaatgataaagttcagaagagagctagttctgctgaagaaccagacagactaggtaaacgacggaaaggggatgtggagctaagagattttgaaactgaagttagattctctgaaagagagaagatgatggatcctagatttgctgatgacaaatcgggaccagaggaacatggtctgtacagggcaggtgataagccattggaaagggcaaaagacaaaggcaacgaaagatatgaaagggatcacagggaaagaatggaccgtctggataagtctcgtggtgatgactttgttgcagaaaaacctagggataggtcaattgaaagatatggaagagaacgatctgttgagagaatgcaagagaggggtagtgataggagttttaatagactccctgagaaagctaaggatgaaagaaacaaggatgatagaaataaattacgatacaatgatgcatcagtagaaaaatctcatggtgatgatcgcttccatggtcaaagcttgcctccaccaccccctttacctcctaatgtggttcctcaatctgtaggagctggtaggcgtgatgaagatgttgatagaaggtatggagctacaaggcactctcagagactttctccaaggcatgaagaaaaagaacggagacggtctgaagagactgtggtttctcaggatgatgccaaacgccgaaaagaagacgattttcgagatcgaaaacgtgaggaaattaaggtggaagagagggagcgggaaagagagaaagcaaacattctgaaggaagagttggatttaaatgccgcatccaagagacgtaaacccaagagggagcatttaccaactggtgaacctggtgagtactcacctgtggcccatccaccttcttccgctggtattggcatgtcactagcatatgatggaagggatagaggagacagaaagggacccatcatgcagcatccaagttacgtagatgaatcaagtctcaggatccacggtaaagaggtggccagcaagttgaatcgccgtgattcagatccgtatccttaa

SEQ ID NO: 6572 - DNA, 2916 bp, Glycine max
  Peptide Sequence Number=SeqID_98257
atgttgaagattgaacctgtgtgttttgatatatgtgttgaacagagagtttggacgagagagagtttgcatgaagatgaggagtttgatcaacatcaaaggcaacttgctgcacttcttgtatcaaaggtcttttattacttgggtgaacttaatgattcgttatcttatgcccttggagctggtcctctgtttgatgtctcagaggattctgactatgtgcacactcttcttgctaaagccatagatgaatatgctagccttaagtctaaggcagcagagtcaagtgatgaatctatcaaaatggacccaaggttggaagcaattgtggagaggctgttggataagtgtatcgtggatgggaaataccaacaagctatgggaactgctattgaatgcaggagattagacaaactagaggaggcaattacaaggagtgacaatgttcaaggaactctatcatattgcatttatgtatctcattcctttgtgaaccttagagagtacagacaggaggttctccgtctccttgttaaagtatttcaaaagcttccttcaccagattatctgagcatttgccaatgtcttatgttcttggatgagtcagagggtgttgcaagcaaactagagaagcttttacgttctgaaaacaaagatgatgcacttttggcatttcaaatagcttttgatctggtagagaatgaacaccaagcttttcttctgaatgttagagatcgccttgcaccacctaagtctcagccttcagaatcttcacagccaaaacccagtgagacagcctctactcaaaatgctagtgcgagcgggcaggatgatgttcaaatggctgatgatgattctgctcctatggtcaatgtgccagaggatccgattgaaaccatgtatgctgagagatctgacctcctaattctaaagacaataaagcagtctgtggagatgaggaatagtgtctgtcatagtgctacaatatatgccaatgcaataatgcatgctggaacaactgtggatactttcctcagggaaaatttggattggttgagcagagctactaattgggccaaatttagtgcaacggctggtcttggtgttatccatagaggccatttgcagcaggggaggtcactgatggcgccctacttacctcagggtgggactggagctggtggtagtccatactcagaaggtggtgctctctatgcccttggtcttattcatgctaaccatggagagggcatcaaacaatttcttcgtgatagcctgcgcagtactactgttgaggttatacaacatggtgcatgtttaggtcttggtttggcatcgttaggaactgctgatgaggatatttatgaagaaataaaaaatgttctctacaccgatagtgctgttgctggcgaggctgctggtattagtatgggcttactcatggttggaactggcagcgagaaagcaaatgagatgctcacttatgcccatgagactcaacatgaaaagattattagggggttagcattgggaatcgctcttacagtttatggaagagaagaagaagctgacactttgattgagcagatgactcgggatcaagatccaatattgcgttatggtggcatgtatgctttggccttggcgtataggggaacagcaaacaataaggccattcgccagttactgcactttgctgtgtctgatgtgagtgatgatgtcaggaggactgcagttctagcattagggtttgtgttgtactctgatccagagcagactccacgaattgtttccctcctatcagaatcttacaatccacatgttcgatatggagcagctcttgctgtgggtatttcctgtgcgggtacaggtctcagcgaggctatctctttattggagcctttgacatcggatgttgttgattttgttcgtcaaggtgcccttatagcaatggctatggtcatggttcagatcagtgaagctagtgactcacgcgttggaacatttaggcgacaattggagaaaattattctggacaagcatgaggataccatgagcaagatgggagcaattttggcatcaggaatccttgatgctggtggcagaaatgtgaccataaggttactttctaagacaaaacatgataaaattactgcagtggttggtcttgcagttttcagccagttttggtattggtaccctcttatctattttataagcctgtccttttcgcctacggcttttattgggttgaactatgatctgaaatctccaaagtttgagttcttgtcacatgcaaagccttcactttttgaataccccaagcctactactgttcccaccactacttcaaccgtgaaacttcccactgctgttctgtcaacctcagctaaggctaaagctagggctaagaaagctgaagaacagaaggctaatgctgaaatttcatctgctcccgactctgcatcagctgtcccaagtggtggaaaaggaaagtcgtctggtgagaaggatggagactcaatgcagggaatagggattgtggattgcaattctgttactgaagtaatttcttcgttgtgttacaaagttgatagcccaacaacggagaagaaatcagagcctgagccatcgtttgagattctgactaatcctgcaagggtggttcctgcacaggagaagtttattaaatttttgcaggacagcagatatgttccagttaagttggcaccatcaggatttgtgcttctcaaagacttgcgtcctactgagccagaagtgcttgctctcactgacacaccttcatctaccacttcggctgctggtgggtcagcaacaggattgcagagttcttcatcagccatggctgtggatgaggaacctcagcctcctcaaccatttgaatacacctcatga

SEQ ID NO: 6573 - DNA, 1236 bp, Glycine max
  Peptide Sequence Number=SeqID_98258
atgcctgtcacaaacacaacaacaccaactgtggcagaacacatcaaatggagaagacccagaaaccaattcaaccaccatcagcaccccatttcagaaaccgatccaaaccctcaaatcccttccattatccaatccactaggtgcaagtctaccatttcctccttgctcctctccactttctccaacaacacctcctccaacaatgacactcccaccaccttcaatgccactgcccatagcaagaaaaaaagcaacttttctgcatcaaccttcagagggttggggtgcaccgccggagcgtcgcagcaggtgtcggtgccggcggtgattcgctcctccgccgattggcaaggaaagaaaacaagaaaaaagaagcacaagagaagcagcagcagcagcaagaacaagactttccatggtggggttctagaagggtccaatccagagtgcgtggattttcaagatgtttggtgtggccctggaattgggttctcaacagatgctgctgctgctgcctctgttgattgtgttgtggccaggaagaatgtctcttctgcaagagggaaaattgatgtggataagatcactcacagggagatgcaaagaagtgttgttgattattgtggagccttctttggaattgaagtggttacgttagtgggagacatggatccgttttttatgggtttagatagacaccgatcatcgtatgtgggaaggcgcactgaaaccttcacttttctggacagtactgatcctgacattttcacaccacgctctgcctctgactcttatggaactgcaacatactatcgtcatgttagagatccttcctctgatggttttgctgagataatgatgcttcaagggagtctactaatgggtggacaactaaattcacatgatcatttcaaagactggagacttgatgttgataacatgtcctatgagcaattgctagagcttggtgagagaattggtcatgtgaacactgggcttaaggaagatgagatgggacggaacataaggaagactaggcttcaattttgggatgatacatcaaagcaccaagtagataaagagtgcagcatttgtcaggaggagtatgaagcaggaaatgagttggggaggctaaattgtgaacacatctatcactttcagtgtataaaacaatgggctgcacaaaaaaatttctgcccagtatgtaagcaacaagttgcggctcgacactga

SEQ ID NO: 6574 - DNA, 153 bp, Glycine max
  Peptide Sequence Number=SeqID_98259
atggtgtcgatcaatgtagtgtggacggaggtgtcgttggtctgccaacaccctcaccatcgctttagtcatcactttggtcatgctttggtgattgatgtgatcaaagaactgttgatcatcatcttcactaaaatcatgttttcgttatga

SEQ ID NO: 6575 - DNA, 573 bp, Glycine max
  Peptide Sequence Number=SeqID_98260
atgttaaccgcattggcgccaaaggttcccgcaagcacaagcacaaccgggaaaaaaatgagacatcgcagtcgccttggaaacaaggttcctgatagacaacctcacggggttaccacacaccagacacttgttcctcgggaaactatcgagtgtggagttaaaagcaacgaagatggcatcagcgaggaacgaaagaagagagttggcgaagccagggacagagttgggttcgtggatgacaacgttggtgccgcctctgagcttggcagcgatgcaggcggggaaagagacgtagccgccggtgccgacaaccacgtgcggttggaagtctcggaggtggcagagacattggatgagagacttcaagagacagacagaggcgaagtcgtagcctgcggaggagattgcggcgctttccacgctgttgggggtgcccaagaagaggaactggcacgtggggttggcggttttgagctcctccgcgatggccaacgcaggatacacgttgctgccggtgccgtcgccggagaacgccacgcggatagggtcattgttggagttggagggtga

SEQ ID NO: 6576 - DNA, 300 bp, Glycine max
  Peptide Sequence Number=SeqID_98261
atggagattctgaatgaatggcttggtgctgttggtgaaagaaaaaaactgaaactttttgttcaagggtatccggtctctaatccagcgtcatctcaaactttgacggtgtttggatgcacatcatcatcccctaaacgtgtgtcagttatggtcaaacgtgggaaaaatcaaaactatgaatctgtgctggcttttaaagcaaaaatgtcaagcggtgaaatggtgctggttttcttaaagatggtagctgcagctgttggcttggggagagaaatcttgactggttatagattctag

SEQ ID NO: 6577 - DNA, 1500 bp, Glycine max
  Peptide Sequence Number=SeqID_98262
atggatagagaagatcaaaaggcatctctactgtctcaattgatacatatcacagtggaagatagactcaaagttgataacatacagcgcaacaaggataagcagcaggcaatagagagagctgaactgtatgaagaagtgaggaagcagttatggctagcagggcctttaatatctgtttctatgttaaattattcccaacaaattatatctgttatgtttgtggggcatctcggccaattgcctctctctggtgcttcaatggctacttcttttgcctctgtcactggttttagcttattgtattatgccaaacaacttccaaatactaatgtggtgggaatggctagtgctttggatactttgtgtgggcaatcatatggagcaaagcagcaccatatgttaggcatacacatgcagagggctatgcttgttcttatgattgtcagcataaaccttgcatttatttgggcaaatacaagatccattctggttgcccttggtcaagaccctgaaatatctgcagaagctggacaatatgctcagctaatgattccaagcctctttgcctatggcattcttcagtgccttaacagatttttgcaaacccaaaatattgtatttccaatggtgttcagctctggagtcactactttactgcatattcttatatgttggactatggtattcaaatctggacttggaaacaaaggagctgccatagcaaatgctatatcttactggataaatgttttaatcctcatactctatgtcaagttttctccctcgtgctcaaaaacttggactggattttctaaagaggcattgcatggcatcccttcttttcttaaacttgcaattccttctgctcttatgctgctacacatgcttgacaatttctgtttaaccagtctgaatacttcgacaagtgtttggatgatcccctttggactcagtggagctgtaagcactcgtgtctcaaacgaactaggagctggtcatccacgggctgcgcgtttagcagtgtattttgtctttataatggccattattgagggaacttttgttggagcagtgatgataataatacgcaacatttggggctatgcatatagtaatgaagcggaagtagtccaatatgtagctatcatgttgccaattcttgcaacatccattttccttgatgcactccagtgtgttctttcaggaacagctagaggatgtggttggcaaaaaaagggtgctttcattaatctaggatcatactatttagttgggattccatcagctatcttgtttgctttcgtcctgcacattggtgggaaggggctttggctggggatcatatgtgctctagttgttcaagtgtcatgtcttctgatcattacaatacgtactgattgggaacaagaggcaaagaaggtgaaagacagagtctacgattctatgagagctgagcttttaaacagcgatatagcattaagtctcttcaatctgtaa

SEQ ID NO: 6578 - DNA, 243 bp, Glycine max
  Peptide Sequence Number=SeqID_98263
atgacttatgaggtagcattggtgaaaggtaaaatttgcagtttgaagaggcagcagcagcatgcaagtacaggaattggactacgttttggtgccactgggtctgttggtgttgggaatgtatcacatttggcttctctgcactataatgcgctacccatctcgcactgtcattggcttgaatgctcagtctcgttaccaatgggttttttccatcatggctatgttcaatcctcgtcataa

SEQ ID NO: 6579 - DNA, 339 bp, Glycine max
  Peptide Sequence Number=SeqID_98264
atggaggttggagggcatcatataatgaatttcaccttggtgatttcagatccaaagcaggaggttgaggctgagccaaaggctgttgaggctgagccaaaagtgaaagataaggagattccttctgttcaagatgaagaagatgtgcctgagatgacaaaaagacacttgaatgttgtgtttattggtcatgttgatgctggtaagtctacaactggaggccagatacttttccttagtggtcaagttgatgaacggactatccaaaaatacgagaaagaggctaaggacaaaagtcgagaaagctggttagctcatttacttttgttttttgattga

SEQ ID NO: 6580 - DNA, 945 bp, Glycine max
  Peptide Sequence Number=SeqID_98265
atgttgtctttaattggttgcatcttcgttattgtcctgcggcataggaggaaggttttcgtcactgttggtgttttaggaagtgggtatcttttgtataagctctacggtgctcagagacatggggttcaggaacttgaaagagaactcgcagttcagagggaaactgaggaccttatgaaggctcagatgcaagctcactttgagaatattcagaagatgtctgatgtaacattgccgcatgctatgcacgagttaagttgtcggatcacagaagagttggatctttctcaccttcttgaaaggctaattcaaggaaagggtcagccaaacaccttgactcaatcagagaaactagatctatggagtagactcaaaattctgagtatgaatctggaaagtggagatgtggttgatagggaagaccaaaagaaatttctagataatattgattttctctctcagcatggtatgcctgccttgatttctgatatggaggcagcaacaaaagaagttctcaaaggcacaacacttcatgaaactatcatgcagatactcaactccttcatgagcatggggactccaaattcctggataaagtatatgatacctgaagatgttagaccatattccacaacctatggtagtgatgacccagtgccatttgacatgactgaatttgaacaacttatgatggaagcatgggcagtattatcaagtgctgaatttggaagcattgtagagatatctctgaaagcagtggtggatacactggtggagctcatggggactaaatttagtggaggaagtgtagccgggggcctgcctctggccagagtgttgcctcaagttgcacagattgctgtacacggaaatgactttttcatctcatctatttactttattcgtgcagtgcttgtcagattggcttttcaaatgttctaa

SEQ ID NO: 6581 - DNA, 522 bp, Glycine max
  Peptide Sequence Number=SeqID_98266
atgctctctgatctgcctgaaacggcgtcgttgaaggccgtcgatggctgtgttgcgatgtcgcccgataagtctccctctgtgcccgttgaaggtgaggccttggtgtcccctcagtgtcaaggtgagaccgcggagaaatcgaagggggtgctgatggcggcggcgacgacgacgggtggtcgatcgaagaaacaacgcccttcgaaattgagccccaagttgttgggtgtttaccttgcttgcttgggttgggttttggtgtggcggaggggggatcgggagggggaggaggaggagggggagaggaggaggcgtcgtccatgggggaatgagaatgagagcgagaaagagggttcggtggtggaagtggtgtttggtaacatagtgggtggggtggtggtgtgcggctggctggttttgagatgtggacaggataggacgagggagggcaccaccaatttggtgggggaagtggctaacgtgcgccgcgttcacacctggacgctgctcattggctga

SEQ ID NO: 6582 - DNA, 1908 bp, Glycine max
  Peptide Sequence Number=SeqID_98267
atgagtcacgagctgttagagacctacgcctgcatgcccacgacggagcgcggccgcgggattctgatctccggcgatgccaagtccaactcagtcgtctacaccaacggcagatcggtggtcatgatgaacctccagaaccccctccacgtgtccgtttacggggaccacgcctaccccgccaccgtggcccgcttttcccccaacggcgagtgggtggcctccgccgacgcctccggcaccgtcaggatctggggcacgcgaaacgacttcgttttgaagaaggagttcagagtcctctccgctcgcatcgacgaccttcagtggtctcccgatggtctcagaatcgttgcctgcggcgaaggcaaagggaagtccttcgtccgcgcttttatgtgggattcggggactaatgttggtgaattcgatggtcactctcgccgggttttgagttgcgcctataaacccacgaggccttttcgcgttgtcacttgtggagaggattttctggttaacttttatgagggacctccctttagatttaagctatctcacagtgtaagttctgacaagaagggtgtcatattcgatggaaagagtgcagaaaagattggtgagctgtcttctgaaggtgggcatactggtagtatttatgctgttagctggagtcctgatggaaagcaggtgctgactgtatctgccgacaagtctgcaaaagtatgggacattactgagggcaataacggaaaggtgaagaaaacattgacttgtgctggctctggtggagttgaagacatgctagtggggtgcctatggttgaatgattatcttgtcactgtttctcttggtgggacaatatctatatttttagcaactgatcttgataaagccccgacaacattttctggacatatgaaaaatgtttcctccttaactattcttagaagtaaccctagggtgctattgtctagcagttatgatggcttaatagttaagtggattcaagggattggatatagtggaaaactacacaggaaggaaaattctcaaatcaaatgcttagcagctgtagaagaagagattgttacatctggatttgataataagtgtggagatactgaagccattgatataggaagtcaaccaaaggacttgagtgttgcacttctttctcctgaacttgctctagtttcaattgattcaggagttgtcatgttgcgtggtaccaaaattgtgtcaaccataaatcttgggtttattgtgacagcatctgctgtctcacctgatggaagtgaagccattatcggtggacaggatggtaaattgcacatatattctgtttctggtgatactcttgtagaagaggtagtccttgagaaacataggggtgctattagtgtcatacgttattccccagacgtttcgatgtttgcatcaggggatgtcaatcgagaagctgtagtgtgggaccgtgcctcccgagaggtgaagctgaagaacatgttgtaccatactgctaggataaactgcctagcgtggtcccctgatagccataggattgctacaggatcactcgacacatgtgtcatcatatatgaagttgatcagcctgcatctagtagaattaccataaagggtgctcatttaggtggggtttatgggttagcatttactgatgaatatagtttggttagctcagggcttatagaagtcaagactgatgatgatgtgcttatcaccataagttggtcatacacaatcctattgcaaatttcaagcctcgtttggtggtcactcttgacattggtggggatcaatatggatattgagagtttttgtgttaaaagtgttgatagattagagaacacagacaatgagttctccccacccaaagccccacctctttag

SEQ ID NO: 6583 - DNA, 732 bp, Glycine max
  Peptide Sequence Number=SeqID_98268
atggctagagatactagtaaaaacatcaaatttgcatcttctcccataaataattatttgcggtattacgtaaaaacgttgcgcgggaagtttaacctgagacggttacatagcagcaactttcaagttcaacgaccaaccaattatccaaaaccccatttcaaaggcccacacattgtgaaacgcaccaaagctatctctacccacatgcgcaatggccactgcgacttggctctccgtgtcttcgaagccatcccgcttcgaaactctgtctcttacaacgccatgatatctgggaacggcagattccgtgatgcccgcgtgttgtttgattcaatgcctgaaaatgatgctgtttcctggaatgccatgttgtctgggtatgtctggagtgggcatgttgacgaggcaagggatgtttttgataggatgcctcacaagtcacaagaattccggccatctcctggaatgggttacttgcagcatatgttcagagtgggagactcaaggaggctcgtcgcttatttgagtccaaatcagactgggaattgtttgatgggtgggtatgtgaagacaaacatgttaggtgatgccaagcagctttttgaccagatgcctgtcagggatgtaatctcctggaacaccatgatttcaggttatgaacaggatcgagatttgtcacaggctaggaggtggtttgaggaatctccagtgagggatgttttcacgtga

SEQ ID NO: 6584 - DNA, 858 bp, Glycine max
  Peptide Sequence Number=SeqID_98269
atggttaagcaagtatcagaactcagacagcaaatcagttcgaaagagttgtttcacgaagaactcagaaggcgaatgaagaatcctcgtcaaactggagcttcacaaaatcaactagtttcaaaaagcgttgagttggaacgggaaatccacgaggcagagcactctttaattaataataaagttgcacagttgcaggaaaaggcaaggaagctagaagctgatattgaaatgacaaggaaggagatagaagagccaacagaagtggaagttgagctcaagcgaaggcttcaacaaatgactgaccatttaatacagaaacaagcaaaggtgcgtgtttcatacatccatttggttgtaattgtgtgtgaatgctcatggatcactgttttaaattcagactggacctgtctgtctgatcagtcagtccaacaggttgagtcactctcttctgagaaggcaagtcttgtattcagaattgaggctgtctcaaggttgctggatgagaacatgtcagcatcaggtgcagcaaacatgaatcctgcctcttcatcaagtgacttagaatcaggattgtgggagctctccaattcaaagttgaagcctatgctaaaagccagaattcattctggcaagatacagcttggatcattgcttcaacaacttgattatatttttgtgactggagcactttttctgaaaaggaactcaacggcaaaattgtgggctttgatatatcttgtttgccttcatttctgggtgttttatattcttttatcacattctagcccatcaaatgagggtagatctggtgcccagatctcactggagaacattaataacactggtggagtatga

SEQ ID NO: 6585 - DNA, 234 bp, Glycine max
  Peptide Sequence Number=SeqID_98270
atggtgatactgacagggccatggaaattgcgagcagcgcaattcaatggccgtactggacgcattagccaacaagggcagcgaagtagaaggaggggattaaacctaaaagactatagagaacgaatcaacaacactattaatcaccgtgaatatacggctccaaataatggaaagaacttgctgaaagagaactgtgatcgttttcaaaagttgggcatagagataaaataa

SEQ ID NO: 6586 - DNA, 174 bp, Glycine max
  Peptide Sequence Number=SeqID_98271
atggaggttgagaaaggaaaaagtcgaagcaagatggagatggaggaagtactgttgtcgctcatagtggagcatttcttaaactcttccaagatcaaagagacgtgtgatctcgttgagatggacttatcaagcatcccttacgaaatcctaagcaaagtcaatattggataa

SEQ ID NO: 6587 - DNA, 1854 bp, Glycine max
  Peptide Sequence Number=SeqID_98272
atggacgaagatcagtggatgtatgaaagcataatgtctgaagaagtggatatgaattatcaaaatgaagaagaatgtgatgtgaatgaatcacatgttgattgttcggatgcgttcaatacttctcaaaggatgttttacggtgggcttgatcccttgctcatgaaaatgaatttgtggcggaatgacgaatataggtgtaggaagaaagaatttgttagaagagatattgagactaggaaatgtgggtgtcgcttcaagcttcgtggcaaactagtggttggaggacaaggttggatggtgaagttgatgtgtgagattcataatcatgaattggtcaagtcattagttggacatccatatgttgggcgattggctaaagctgaaatgacacttattgctgatatgacgaagtcaatggatgaagatgtggttcgtgatatcttttggtgtcaccctgatgcagtgaagttagtcaactatgtcatggatgtctggggaactcttgttgattgtccttcaaagcaacagtttgatgagtggctgaagaagtttgaaatggtttgttcatcttggtcaataacggaacaacagaagctcgcggaagaacggaagaacaagaggcactcacaggaaggacgaagaggcacctcacggaagaagaacaacgacctcgcggatgaagcagggagggagcctcacggaagaagaagaagcagctcgcagatgaacgtgatggatttggaaccctgggaagcacttgacgtggatgacaccaatctctccgccttcctccgcccttgcaactctaattccgattcctcttccctcattcccggtcctgccggcgccgtccaggccgtgatgaggaaccggcgccaccatgaccccctctccactcaagaatttctaaagcgagttgagcgccaaagtgaccgcgatttcaacaccaatccctggctctgtgccctccaattcgtgcacttgcagggtggtgatgatgacgtggcacacggcactccgttgagctcaatccagaacaacgccgagactgagagagtaccgttgatcgtggcccttgtcaaatcctccactcccaatggtttcggagacatcacggttaacctcaaggatcctacagccactcttactgccactgtccatcgcaaagttttttcacatccagatcttaggaaggaaattttaactgttggttcagttttaattctccaaaaggttgctgtgttctctcccaatcgcaatacccgttatctcaacataacattgcacaacattgtcaaggtatttcccaaggacagtggacctccatcacaacaactaacatatcctgcatgcccagtgatacgcactacacctagtatgggcagtacattctctctgccactggaaagaaccgaaggaatcatgtctaatctcaggtttgattcaagctttagacaagtagcagatagtgacaggcagaggagtgaagttttggcttcaacgagctttcgcagtgataatggaaacgatcaaaaccgagaaactgtttcagaaggagagaacttatcattgagtctggataatgctggacctgtgaaagtaaactgtggtggtgagcttgaaagtgaggtggaagatcaacccaacccccctaaattggatgaaggaggagacattctagcacggattgctcaaggcaatagttctgcaacaaactcaattcctacatctcatggtgaaaaaactgggatggagaatcactttgaaagacagacgcagatggtaaataaaaaatgttcgttcccacattggacagaggaacagctggatgagcttttagcatttgattga

SEQ ID NO: 6588 - DNA, 2487 bp, Glycine max
  Peptide Sequence Number=SeqID_98273
gatgctctgcggcatgtgtttgctagcaggattacggaggtgaagaattctccgcagtggaaccgcttgtcctttgtgtcatgtgcgtgtaatggcttggttctcatggacgagtctctacagcttcttcctgcggttgaaacgcttgaccttagcaggaacaagtttgcaaaggtggataatctacataagtgtaccaaattgaagcatttggaccttggtttcaatcacttgagaacatttgcacccttcacccaggaaatcctttgtgttgtgctcgatggtatagagcacaagtattcagcttcttctcctacccagaaaggtatgcataagcaacctgccagttttgggatttatgtgcctgcaaaggatgaagctgtcattgaaggtggcaatatcagaaggaaaaaggtctctcgtcttgtcagtataaaaaatgaagagaccactagcatatgttctgacgaggactctgcctcttgtgcaaatgatattcaaaatagacaggatcctgatttatctgacaatgaagctgaaattgtagatttgataaatagagttgaacatatgaagaaagagcgttctattcattggttgagggaatttaaagactggatggatactgcttctgacaaatcagtagaaactagaaaggaaggcggtgcttccctgcatcatcagaaggaaaattacatcaggaagaagacaaatcaggagcagtctggtgacatctcaagatatgcttcagactcagttctagcctcgggagatgacagtagcatgaatattttagaatctgatagttcttttgtagatatgtcagctagttatcatagacagcagcactttgactatagaggtttgcttggtaatgttagtggggcttcacattttgactcaagaggagtggacatggagcgccttaaatcctcacttgagggaattagtagttctctctcacaacctagaagttctcattctgacactgttaccacccaaggagcacaaagaatgactgaaaatgtcaacatctcaccattgataaccattcatgatatatctgggtctcagtcatcatctgcttgccccacttctcctccacattttcaagaagaccttcttcatcgccggcaacacttggtggaggaaattttgcagctttcagcagattccttttcagtggcatcttctgatagtaacacaagctgtagtgaagttgattgcagtgaatttgagtcatcagtgcctaaagttgataatttcccgtgcaaatattatatgaatggaagtgttgatggtcatttatctcaaaatctgctcaaggaaaagttttacaacccaagacaaggaattcttcatgcaagagaaaatggaaattctttatctagtcctacctgtgacccaacttctaagcagcattcaattgactttgctgctggtgctgacaatgctgagagtgcattttgtgctagccaagacactggtttgttggagaaaagaaaaattagaaaaaaagccaagaagagaattatttcaatattagaagagaatttagatggtgatgcatctgatcatacacaagaacagataagtcaaggacagatttctccaaatttaaaacaagaattggacattgatgattctactgaattttctgggcgcaattactctacccaagagaatgatgatttgattgtgacatatttcaatacaagtattgctgattctgaagctagtgagcttttgaaaccctctttaatatgccatccaggaacacttttgagtgtattgagttgccacaaaattgaagaagtttgtgaggtgctagtaggaatgggacttcaggtgttaagggtaaattttgagaatggggaaacgtatctttttgtaacaagaagcattgagaaatcaagagaattactatgtaccatacacgtgcttgattcatgtggtggaaatggtagatgctcaataagaagtttggagcagatccaggttgagttgtttgacaatcaaatatgtggtggttcaaatgtgagcatatatcagtatgcaatggtgctcgtcttttctaaatatggcagtgaggaatcatggctatcgagatcactctttgtgattggagggaatgtgcttatatgcattgaagatcttaagcagctgtactcattatcatcaaatgcgtctgcctctccatacttcagaattgattcatgttgctccattgctgacattgctgagatggttattgaggttggtggcagctgctgtgtgactttaggtctgacttgtccacgggcagaactccatccatctacccaaatgaaccttcaaaccgtcaatcatgaaaatactgctcccgggtctcttaaattgaagcttcagtggttctctaaagatcaccttgtgaagtttgtgtcattgttgaagacaatccatgaaaaagaaacggggtcacctttggtagtaagatgtatatcgtaa

SEQ ID NO: 6589 - DNA, 459 bp, Glycine max
  Peptide Sequence Number=SeqID_98274
atgggtcatttaccatctatgtcctccacattgcctcccaagcaaaacttaggggaaaaggttgttaaaggggttcaacacatcgagctaagatctaacatagcaagagtttttgaagagaaacatgtccttgattgtggttgcacacacaatcatggttcagatggagttgtcaatgggaacgtctttaaaggcgaagacgaccttggatgggtcatcgggagaagattaaagggagaagtagtttttgttgttcttgaagtgatattgacggggaagaaaaaaaaaggagtgataaatggaaacaaatatggggttaaaagcgatggtaaggtcgataaagtggaagaggagggagggacaagagaggttgggagaggtgggagtagaggaaggagatcaagaataggaagagcacaatgcatgggtagaacaaagcacttaactcatagaatgtga

SEQ ID NO: 6590 - DNA, 321 bp, Glycine max
  Peptide Sequence Number=SeqID_98275
atggctggcgatgttcacattcttcgagacattgcattctcaacaaaggcgttgagtggcaagaggagcagacacgtgacgtgctggagccaggagggatcggaggttgttgacggcgaggatgaagtcctggcagtgagccttgcacacctcttcgatctccaactccttcaactgtgcgaaatggcagaggtggtggtggagcgtctccagcttgctggaggtgaaggccttgcagatgaagggttggaaggggaagagataaggaagggatgggtattgggtactttgttgggtaggggtaatttggaatttcaataa

SEQ ID NO: 6591 - DNA, 1158 bp, Glycine max
  Peptide Sequence Number=SeqID_98276
gatgtgaatggaacaggacgacccaagaggctttttgtttttgttaatccattcggggggacgaaatctgctgtcattgtttttcgtgatcaagtcaagcctctgcttgaagacgcacaagtgcagcttacagtccaagaaactaagcatcagctccacgcaaagcaagttgttcagtcattagatttttcaaagtacgatgggattgtttgtgttagtggagatgggatcttggtcgagttcgtaccaagtaccattgtgattgtggttgtaaatggactgcttcagaggcaggactgggacactgcaattaagatgccccttggagtagttcctgcaggtacgggaaatggcatggcaaagtctcttcttgattcagttggtgatccttgtacagtacccaatgctgttcttgccatcatacgaggccgtaagcgaaaacttgatgtggccaccatcacacaaggggagaccagatttttcagtgtgttgatgcttgcatggggtctggttgctgatattgatatcgagtctgaaaagtataggtggatgggaagtgctcgtattgatttttatgctctcactcgaatcttgcatttgaggcattacattggatgtctttattttgtgcctgcacctggatttgaagcttacggggaccccactagttaccctggaagttctaataacaaaggcagcaatagtgaactaattgatgaggaacctttgaagttacaaaggctaggctatcaaggacctgaaattgacctggagaatcagagttggagagttttaaatggaccatttatttctgtctggcttcacaatgtggcttggggtgctgaaaacaccaaggcagcaccagatgcaaagttctcagatggttatctggacttgatcattacgaagaattgcccaaagttaccattgctgtcgttgatgtcagatttgaataatggaggtcatgtgaaagttttggtcttggaacctggtccacgcttgggggaccaagagaaggaagggatcatagatgcagatggtgaggttctggcaagggggaaagggtcgtaccaatgtgagcagaaggctttgatggcctatgataaacttcaaataacagtagatcaaggtttagctactattttttctccaatataa

SEQ ID NO: 6592 - DNA, 276 bp, Glycine max
  Peptide Sequence Number=SeqID_98277
atggatgaacagacctttagcatcatacaagtcaaatgctctaggcttggaacagttattatattgagtttgaggtctcctaagggactactcaagaacaagggggttacccaaggtggagattgggtattttgtcactcaggtgtggcaggttatgagtgggatattggacattttcatggggctcaacgacctagtgtggactgctttaggaacacttcatttggtctgtctcaggaagaggttgggccattatctgatgtgtcagggacctaa

SEQ ID NO: 6593 - DNA, 678 bp, Glycine max
  Peptide Sequence Number=SeqID_98278
atggaagtggaggcagtgcaacaacagcgcaaaggagcgcacctgaagaagagggctctgaagaacaaagctttgggcatcactttcaacgagaaagatctcactgactacgtcaccggctttcacaagcgcaagaagaagagaagaaaggaagcccagaagcaacagaacgaggctctgcgccgcaaacgcaccgaggaacgcaaaaggaggaagttggaaagagaacatgttcttaatggaggcgtgccaccacctgatgaaattgatggggaccaagaagaaaccgaggagcaagttgaatctattgctgaaacaaagacatacgagaatgatgatctgaaagtcactgttgtaacaagtgagatcaaccctgaggacggtagttatcctagtgagaggaaggaggcagcagtgatccctccttctgttgtgtctgataaaaggcaaggggtacctataagtaataagaaatctttcaagaaggttgcaaaacagaggtctcggccaaggccatcaagatttggacgtgtttcatctagttggttacctaactggttcctaatgtccatgacaggagtttcttcttcagggctattcctgactttccattttggggattcaagagttatggaagaaacacctaatttttctccttttcttttggttaatcggtaa

SEQ ID NO: 6594 - DNA, 942 bp, Glycine max
  Peptide Sequence Number=SeqID_98279
atggatgaaactaaaattctcttagagttgaagtccgtttcgtccttatgtgttcatagcttcatcaaccttctatgcgaagaaactatttcttttctctcagtgttctcttcagatcctctgtttcattgcatcgtggcgttttgcaccttggttttcctctatttgccacaccttttcttgaaaataattctatctccagtgcccattctcactgcgattctccttctctctattctccgtctcggtgcaattcaaaggttacaacatgaaagaagggagaatcatgtgaaacacgaagaacaacccatcgtttacgaagaaaacaagggaagtaaatacaagggagagaaacagagtccatgtaccattgaacctgacgaaacaaagtccgtagaacaagtgcaccaatgggtccattcagaaacagaggtcatttccgacatgggttttgaatcaagttctcgttttgttgaatggaacgtgaaagcaccgttggaagtgatatatgaagagtatggtgaaggtgaagaagcaggggatgatgcaaacgagaacgtgggtattatgaggtacccttcgttgtcgcgtttttacccggaatcggattccgatagcgaatcggagagtgagtttccggcgatcggagattgggactcgccggaggaccttgagtttcgctggggtgaagaagaagaagaagatgatggtgatgatgatgatgaagaagaagaagacagagaagggttgattgagatagctctcgatggatgcaagaggaagaggaacttggaatttaactttgatgaagagaatttgattgagatcgatatttctccgtcgaggtacagagaactttccggcgacgacgaggtgttttccgtgatggtggcgatgaagattcatggaggaggtagtggcagagaggaagaagaaggatag

SEQ ID NO: 6595 - DNA, 426 bp, Glycine max
  Peptide Sequence Number=SeqID_98280
atgggagatttggagaagaagcaagagagggtgatggaggaagaagataaagagaggttggtggagggtgtggcggttttggactttgatatgctttgctccactgtggctttgcgagctgcacatggcaaatgggggaagctgggagttgaagatagaggaagaagaagaagaggagggtgttgtccttgctaccgatttgggaaaaacatgaagagagctgatttcggttcttgctacattcagggagcaatttattttcttcttgctattggtgcctttcttaacttcattgcctttgctgtcacgagacgtcactgttatctatacctgattgttgcctttggagcatatttaggattcttccggacacgtataagaaagaaattcaacatcatagtgggtgttttctgtaattgtttatga

SEQ ID NO: 6596 - DNA, 225 bp, Glycine max
  Peptide Sequence Number=SeqID_98281
atggcggcctcaagacgatccacacaggcggtggaaagttcagtgtccgtcattgaagagtggcagcttttatacacaattgcatgtctgcattcccactacaataaccgctacaataaccgctataataaccactacaataaccacacccccactacaataaccgctactagaatgataactacccctatgacaggttttcatggcagagcatcttcttcctaa

SEQ ID NO: 6597 - DNA, 717 bp, Glycine max
  Peptide Sequence Number=SeqID_98282
atgtttctttggcctcaaccatttccattatttcttatgccaatacaaaggaggcaggctttgtttgaatggtttctcactgtgtcgaacgagctgtcaatgtcatcatgtcttgtctggtggtgttactattctacgtacggacatgttgagaagttagctgaagagattaaaaagggagctggttccgttgaaggtgtggaagcaaagctatggcaggtacctgaaacactttctgaagaggtccttgggaagatgggtgcacctccaaagagtgatgtaccgattattacacccaacgagctacctgaggctgatggcttattgcttggtttccccacaagatttggactgatggctgctcaattcaaagctttcatggatgcaactggaggcctgtggcgcacacaggcactagctggaaagcctgcaggaatcttttacagcactggttctcaaggaggtggacaagagactactccgttgacatctattactcagcttgttcaccatgggatgatttttgtgcccattggttacacatttggtgctgggatgtttgagatggagaatgtgaagggtggatccccttatggtgcaggtacctatgccggggatggttccagacaaccaactgagttagaattggctcaagcttttcatcaagggaagtactttgctggcattgctaagaagcttaagggatcatctcagtga

SEQ ID NO: 6598 - DNA, 1413 bp, Glycine max
  Peptide Sequence Number=SeqID_98283
atgtcgaagaagaaagttagcggcaacaccatgacgctgaaggacttccatggcggttcaattccctctgatctccctctaccttctgctcccggcgtgactgtgaggacttcagatcgtgctggttttgatcggccgtcggcgtgggggacaccgatgggccggtcggatcattggtctcggccgcacacgtcgccggcaactaggcattatgatgacaaaaccccgtttttgtcacacactgccccaattggcaggaattttgatgaggatgagaggaagccccttgatggtggttcgatgccacgtaggacaatcagtgatgagagcatccgtggtggtccgcctcctcgtgttgaggtaaggccacctgagtttggactgggaggaagttcattgggcaggcaagtggctccagtgtctcaaactcctgttggggcaggtaattcatactcggggaggctcaccgatgcggtgcatgtggggatgaatcctccgagtttaggaggtagtaaggagcagggaactgcagcaggtggtggtggttatccgaacgcgtggtcaatgcggaaagaagtggcaagtgctgtcgagccagagcaaccagcttggtctagtgctggtgctgcttccaagttggctcacgccagtgcccttgagaaggtgtcttctggtagatggcagtctaaggctgtaaattatcagactgatgctgaggtggttagatctcctgaagtggagaatagaccacatgttaatgttaatggcgttggtgcctataataggacggaggcagtgggtgaaaaggagtattatgatgcaatgctagctagacacgctgaaaggggcttaggcattgataatccgatgcaaggtggtaggaatgagttaccaaattatgaaaggtctggggtttcccgatattcagatgtacggccaacaagtgcacctcatcactctggtggggttcagctggctcgaaatgatggaaaaattgttgggtctgatttgcagcaccctatgccttctgaactaactgagcgacctaaactgaagttgctaccaagggcaaagccagtggaaagttcagaacctgctgtcatggattatgcacagggtaatcgtcaggttaatgattctggccatgttgaaaccgtttatcaagcacatggccatgctaattttgtgaagcctgtatcagctggaaatgacaatgggaaagacgcaggacagcgtccgaagctgaatttgaagcctcggtctcagcccactgaaaagctggatggaaacagtgaaagagacagaattatggaaaatcttaaaagtttcactctggctttgttactttccaaaggccataatttggaggaacagttgtgctccctaaagtctaaaagtgatggagagaagtag

SEQ ID NO: 6599 - DNA, 837 bp, Glycine max
  Peptide Sequence Number=SeqID_98284
atggcactttcccatcaaccagcagccaacggggaggcagaagatagctataacaagatggactgggataagcttggatttcaagtgattccaactgattttatgtacataatgaaatctaatgaagaagggaccttctcaaatggagatctcgtaccatttggaaccgttcaaatcgaaccacattctactgttttaaattacggacagggattatttgagggcatgaaggcctacagaagagcagatggtgaggtgcagatatttcgaccagaacaaaatgctatgcgcatgcagatgggagcagagaggttgctaatggtggcaccttctgttgagcagtacgttgatgctgtcaaacaagttgttcatgcaaataagcgttgggtgcctcctcatggaaaaggagcgttgtacattaggcctttattatttggaagtggatctgttatgggtattgcacctgcaccacattgcaccttcctaatatacactaatccaatttccaacgcttacaaaggacgacatactaattcaaccttgagcttgttgattgaagatacacttcctcgtgcatttcccggtgggactggaggagtgaaaaatataggcaattatgcaccagttttccaagtgacgaaagaagcaaaagccaaaggattttttgacgtcctcttcctagatgcagaggaacataaatatattgaagaggtatcttcgtgcaatgttttcatggtcaagggtgacgtgatttcaacttcacctacactcggaactattcttcctggaataacaaggaatagcatcattcaacttgctcgtgatttgggttaccag

SEQ ID NO: 6600 - DNA, 2445 bp, Glycine max
  Peptide Sequence Number=SeqID_98285
atggcttctcgcaaccacagcaccagcaaaaaggtgggccccgaagaagcttctctcgacaagcgtcgcaggatcctcggagctgacaagatggaccgacagcagggcggtagtagggtcagaacgccgttttccgtcgtcaccaacaccgcagcaacgagtgacactgccaatgcggccgaaggcgccgctgtcgtcgttgatttcacgaaggacgaggtggaggcgttgctcaatgagaagaagaaggggaacacctatgataataagaaaaagattgagcagatgatggatcttattaagcgccttaagctctgcgttcggtggtttaagagaattgaagaagggtatatgcaagaaaaggaaaagcttcaatctgagctagagactgctgagaagaagtgcactgatactgatttgagaaggagatgctatttgtgtattgttgtattatatgctgcgtggctagcagggactgagatgaagagtaagattgaggagttggaagagactgtatctgatttgaggaagacaatttcttctctagaagagagaattgtaaaggaagaatcggataaattggaagcaattaattcttatggtaaagaaaaggaagccagaactgaagctgagaaagttcgggatgagaaatcagctgagcttgagaaagttcgggatgagaaatcagttgctgtgaagaaggccatttcaaatgaggacttgtacaagcgatcacaagagtataatatgagcctgcagcagtacaatagtcgtcttcagtcagatcttgaaactgttaatgaagcccataaacgacttgaaacagagaaagcaacaattgttgagagccttagcaatgtaagaggccacaataaggcattgcaggatcaattggtgtctcttaaagtttcacaagacgaggctataaagcagaaagaaattttagcaaatgagctcaaatgccttcgtgaagagttaaaacaaattagagatgatcgtgattgccaattgggtcaagtacatgctttaactggagaaatagcaaagtacaaagaatatacagggaaaacatgtacacaattggatacgttgatgattaaaacaaatgctcttgaggagacttgttcatctcaaaaagagcaaatacatatactgcagcagcagttgtttgctgaaaaggaaaagtttaagaatgctgacttatcttctttagaaacaagaacaatgtttgaagagcagaagagaattatccgtgaactacaggatcgattggcagatatagaatttcaagttatggaaggagagatgctaaggaaaaaactgcacaacactatcctggagctaaaaggaaatattcgtgtgttctgccgtgtgcggccgctcctaccagaggacagtacaggaacagacatggctgtttctttccctacgtcaacagaagtgcttgatcggggcattgatttggtacaaagcgggcagaagtacaatttcacatttgacaaggtgtttaatcatgaggcttctcagcaggaggttttcatagagatatcacagctggtacaaagtgcacttgatggcttcaagtgcatgtgggataaggtgtgcatctttgcatatggacagacaggttcaggaaaaacctatactatgatgggtaagcctgatgcgccagatctgaaaggattgataccacgttctttagaacagatattccagattagccagtctctaaaagaccaagggtggaagtacacaatgcatgtatcactatatgaaatatataatgagaccatcagggatttgttatcattaaatcggtcaagtgggaatgatcatacacgaatggaaaatagtgctcccactcccagcaagcagcacactattaaacatgaatctgacctcgccacactggaagtttgtagcgtggatgagatttcctccctcctacaacaggctgcacaaagcaggtcagtgggaagaacacagatgaatgaacagtcatccagaagccactttgtctttaaattgcgtataagtgggagaaatgagagaactgaaaaacaagtgcaaggtgtgttaaacctgattgatctggctggaagtgaaagactgtcaaggagtggggcaactggggaccggttaaaggaaactcaggctatcaacaaaagtctctcgtctttgagcgatgtcatatttgctttggcaaagaaagaggagcatgttccttttaggaattcaaagctgacacactttctccagccatatcttggtggggattccaaaacgttgatgtttgtcaacgtatcacctgatcaatcttcagctggcgaatcactctgctctctccgctttgcagccagagtcaatgcctgtgaaattgggattccacggcgtcagactcagacatcaacacgctcctcagagtcccggttgagctatggttaa

SEQ ID NO: 6601 - DNA, 1551 bp, Glycine max
  Peptide Sequence Number=SeqID_98286
atggattatccgtacattctaggagggatcatggcttgtagttttgcattttttaatgagtgtgcaaagacatcatcagaaggtggaatatgttcttcagatgaggatgcaggaagtgctgacatcatcattgtgggtgctggggttgctggtgcagctcttgcttacactcttggaaaggatggacggcgagtgcatgtaattgaaagggatttgagtgaacctgacaggatcgtgggtgaattgctacaacctgggggctatctgaggttaattgagttgggccttcaggtatgtatcttagttaacaactcccctgactctgctgattgtgtggatgaaattgattcacagcaagtctttggctatgctctgtatatggatggcaaaaataccaagctgtcttatcctttggaaaaattcagctctgatatttctgggagaagctttcacaatggccgtttcatacagagaatgcgagaaaaggcttcgtctcttccaaatgtaaaattagaacaaggaactgtcacatctctacttgaagagaaaggaaccatcactggggtgcactacaaaatcaaaagtggacaagagttcacagcaaaggctcccctcaccatagtatgtgatggttgtttttccaacttgaggcgttctctttgcaatcctaaggttgacgttccctctcattttgttggtctggtcttggagaattgtaatcttccatatgcaaatcatggtcacgtcatcttaggtgatccttcacccgttttgttttatcccatcagtagcactgagattcgctgtttggttgatgtgcccggccaaaaattaccttccctaggtggtggtgaaatggcctgttatttgaaaactgtggtggctcctcaggttcctccagagctgtatgattcttttatagcagctattgacaaaggaaacataagaaccatgccaaatagaagcatgcctgcctcaccttatcccacaccaggtgcacttctaatgggagacgccttcaatatgcgtcaccctttaactggaggaggaatgactgtggctttatctgacattgttgtgctaagggatttacttaaacctcttcatgatctgcatgatgcttctgctctttgcagataccttgaatcattctacaccctacgcaagccagtggcatctacaataaacacactagctggggcattgtacaaggtcttttgtgcatctcctgatccagctagaaaggaaatgcgccaagcatgtttcgattacttgagccttggaggtgttttctcagatggaccaatagctctactctctggtctaaatcctcgtccattgagtttggttctccatttcttcgcagtcgctatatacggtgttggccgcctgctcataccatttccttctccaaaacggatgtggattggagctagattgatttcaggtgcatcaggcatcattttccccattattaaggctgaaggagtgagacaaatgttcttcccagcaactgtgccagcatattacagaacccctcctgtccattga

SEQ ID NO: 6602 - DNA, 1026 bp, Glycine max
  Peptide Sequence Number=SeqID_98287
atgtctctcccttctgttttggggaattctgaagacaattcaaaaagtgttgctgttgaaaactgtgctggcataaactgggatgagcttggatttaacccagttcccacagatttcatgtatgtcatgaaatgtgcaaaaggagaaaagttttctgaaggatccctcattccctatggtaacatagagatcagcccttttgctgtgatactaaactatggacagggaatctttgagggactaaaggcatatagaactgaagatgggtgcatccttctgtttagaccagaagagaatgctcaacgaatgaagataggagcagacagattgtgcatgccatccccatccattgaccagtttgttgctgctgtgaagcagacagttcttgccaacaaacgttggaactgcacccgtcagttagcagttgtcgctatccatcacgcagtggaggtgctcgtcagagtggaggtgcctccaccagggaaagggtcactatatattaggccattgctcatgggaaccggagcttctttgaacttgtctccagcacctgagtacacattacttatttattgttctcctgtcactaattaccacaagggttcactgaacttaaaagtggagagtaagttctaccgagcaatatctggcactggtggaaccggagggatcaagagtgttaccaactatgcccctgtttatgctgcaagcattgaagcaaaggccagtggattctctgatgttttgttcttggactcagcaactggaaaaaatatagaggaggtttctgcatgcaatgtgtttgttgtgaagggtaatgctatctgcaccccggcaacaaatggagccatcctccctgggatcacacgaaaatccatcattgagattgccttagatatgggttatcaggtcacggaacgtgccatatcagtggaggaaatgctagatgctgatgaagtgttctgcacaggaactgcagttgttgtcaactctgtttcatctgtaacctacaaagaaacaaggtaa

SEQ ID NO: 6603 - DNA, 1194 bp, Glycine max
  Peptide Sequence Number=SeqID_98288
atggcggtggagtacacatgctgctcaacggccttcttcgttcacatactggtcatcgtgctgctcgtgcttttcgcgggcctcatgtcgggcctcaccttgggcctcatgtcgctcagcctcgttgatcttgaagttcttgctaagtctggtactcctcaggatcgtaaacacgctgagaagatattaccagttgtcaaaaaccaacatttattgctatgtactctgctaatttgcaatgctgcagccatggagattataccccaatcagtttgttctcggtatggtttggctattggtgcatcagtggctccctttgtccgtgtgcttgtatgcatatgttttccagttgcctatccaattagtaagttattagattttttgctgggccatcgacatgaagccctattccgtagagctgagttgaaaacactcgtaaatttgcatggtaatgaggctggaaaagggggggaactgacacatgatgaaacaacgatcattgccggggcacttgaactcagtgagaagacggcgagtgatgccatgactcctatatctgaaacatttactgttgatattaattcaaagcttgatagggaactgatgaatgagatattggagaaagggcacagcagagtcccagtctattatgagcagcctacaaacattattggacttgtactggtcaagaatttattgacagttcatccagaagatgaagcacccatgaagagtgtaaccatacgcaggattccaagggttccagaaagtatgccactttatgacattttgaatgagtttcagaagggccatagccacatggcagttgttgtcagacggtgtgacaagactaaccaacaatcttcccaaaataatgcaaatgactcggtgagagatgttaaggtggatattgatggtgaaaagcctcccaaagagaaagctttgaaacccaagatgccactccacaagtggaaaagctttccaaatacaaacaagtcatcaaataggggttctcggagcagaaaatggtcaaaaaatatgtactcggatattttggagatagatggaagtccccttccaaagctccctgaagaagaagaagccgttggaattattaccatggaagatgtcattgaagagcttttacaggaggagatctttgatgagacagatcatcattttgaagactcataa

SEQ ID NO: 6604 - DNA, 1692 bp, Glycine max
  Peptide Sequence Number=SeqID_98289
atggcacaacaacaagaacatgaaggaaaaccagagtcttcttcctctcaacctgagtcttctttggaaccagacatgggcaccaagtccacaatgattccgtcaacttcatggtttacaccaaagaggttactggctatattttgtgtgatcaacttgttaaactatttggaccgaggagcgattgcaagcaatggggttaatggaagtcaacgaacttgtgaaggcggtacctgcaaatctggaacaggaatacagggggattttaacttgaacaattttgaggatggagttctatcatctgcttttatggttggacttcttgtggcttctccaatatttgcttctctagcaaagagcgtaaacccatttagactaattggagtgggattatcagtttggacccttgcaaccttatgttgtggtttctctttcaatttctggtccattgcagtctgtcgcatgctagttggtgttggtgaggcttcatttatgagtcttgcagcacctttcattgatgacaatgccccagtttcacagaaaacggcatggcttgctatattttacatgtgtataccagcaggatatgcaattggctacatctatggtggtttggttggaaaccattttggttggcgttatgcgttttgggtggaagctatattgatgtttccatttgctattttgggattttttatgaagcctttgcagttaaaaggtgcacattcttctcctgcattgatttcttgcagctccataacttcgtttcccatcactaaactacttgtgcatccaggttttgcccctactgattcagaaaaggcactgatactggagacagtggtatcagaagttccagatgtcggggtttcaaatggaaaagatgaagcgttgtccttgaaggaagagttcagagacaaaagctcacatgaaccttccaggtcaaaatgtgcaatattagatcagttctcaagatttctgaaagacatgaaagaacttttgcttgataaggtttttgttgtcaatgttctaggttacatagcatacaactttgtaataggtgcttactcatattggggccccaaagctggttatagtatatataacatgactaatgcagatatgatgtttggaggaattactgttgtatgtgggatattgggcaccttagcaggaggtcttgttcttgatttcatgactaacacaatatcaaatgcatttaagcttctctcattaacaacatttattggtggtgcatgctgttttggtgctttcttatttaaaagcgagtatggcttccttgccctttttgcttttggtgaactacttgtatttgccactcagggtcctgtgaattatgtatgtctccattgtgttaaaccaagtttgaggccgctgtctatggctatgtctactgttgctattcatatctttggagatgtgccttcctcacctctcgttggacttatccaggacaaaattaataactggagaacgactgcattgattctaacaactatattctttccagcagctgcaatatggtttataggaatatttttgcccagtgtggatagatttaatgaagatagtgagcatgaagtatcaagcgtggaaaggacaagcacagcaccattgcttgaagagggcactgctgaaacatcagcatctggtcaatcccaagaatgctga

SEQ ID NO: 6605 - DNA, 633 bp, Glycine max
  Peptide Sequence Number=SeqID_98290
atgccccttccaccgcaacgcatggaactgcctccggaacgagcgccagaacatgaccctcatcaactcgtggaggtgggtcccacaaagctgccacttgccccggatcgacccggttcggtttctggtgtcgctgataagggtgcgaagaagtggaaaaagaagggtgcttggaggggtgcctatttccccaaattcaatgtcaccgtcgcttatcaccgtgccgttttgctctctagataccagtggcagccaaaacaacctgaagctggggtgaaagatggatcagaaggcttttatcgagttgatgttgatgttcctgcagatgattgggctaaaattgctggtttctatgatgttttggtgtttaatactggccactggtggaatagggataaattcccgaaagagaaacctcttgtcttttataaagcaggacaaccaatagttccgccacttgggatgttggatggacttaaagttgttcttactaacatggtcacatacattcaaaaagaatttcctggaaacacacttaaattctggcgattacaatccccgaggcacttttatggtggtgactggaatcaaaatgggagctgcttgttcaacaagccccttgaggaggatgag

SEQ ID NO: 6606 - DNA, 147 bp, Glycine max
  Peptide Sequence Number=SeqID_98291
atggatttcagatccatagactgtgctgatgttgatgcagcacatgatgagactaggaaaaataaggtgaagcctgagcaacatggaagcattgatcttgggagtaaacacgccactgttggagttgactttaaggacataagttga

SEQ ID NO: 6607 - DNA, 63 bp, Glycine max
  Peptide Sequence Number=SeqID_98292
atgttgggagggtctcaagacggttcagtatgctcagctttcagagtgtgcggggccaactga

SEQ ID NO: 6608 - DNA, 730 bp, Glycine max
  Peptide Sequence Number=SeqID_98293
atgcagaccactccctcccttctcttgcatcagaggctgcccatggatttccctcccgccttcaatctcctcaccgaattcggttgcggcttcgtccttctccgctccctctcgcgcattttcaatcttctaggcctctttctcatgctcaccttctgcttcaagcttctgcgcttcggctggaacaccaagggctccattcgcttcctctgcgactccggcggcatccccaaactccgcttctgcctcgataacgtcgctcgggaaaaagtctccaaagcaaagaccaaacctttgaaaaaaccgcgccacccaacttcgagctcttccttccggaggcggcccaatgagtccggggagagaggcaacgcggtttcggatgatgggtcggagggaaaggtagagaacgagagagagggttgcaatgaggacgaggtgttcgacgtaatgacgctgagaagaatcgtgaggatggagcggcagaaggccaatgcggcgtgcgcagacctcgagaaggagaggacggcggcttcctcatctgcggaggaggcgatggcgatgatcctgcggctgcagagcgagaagagcgcggcagagattcaggcaacgcagttccggcggatggcggagcagaagctggattacgaccaggaggtgattgagtcgttgcagtggacgatcacgcagcacgagtttcagaagtgtgaggtggaggatcggatagggatgt

SEQ ID NO: 6609 - DNA, 378 bp, Glycine max
  Peptide Sequence Number=SeqID_98294
atgacctctcccagtcaacagcccctcgggaaaacgattctcatggccctcttagggttccctcctggagtccccccccttcctcacatctccaagatcaatgtggatgggagttttcttcctcttcagggggtgtcatcagagatagttctggacgatccttgccctcctcatcatcccaatgggggtcttcttcttagcctcttggagtttttccataggaattggaatgtgtccatccaatttattggtagagaagccaattcagtggtccattctttggcggcattagggctgcaccaggggtctcccctttgtattctgacctcccctcccccctctcttgctatccttccgaagaaggatagccccgtgtag

SEQ ID NO: 6610 - DNA, 1137 bp, Glycine max
  Peptide Sequence Number=SeqID_98295
atggaaacgaggatgttgcggctttcgattcaacgagtgaggaagttgaactttctgaggcctcagatctctgctttgggaaggtcccatttgtcaactgctgctgaaccatcttccagtaagagcaatccacctgcaacccaagaagttgtttcacaagttcctttgtcgacgcatgaagagtttaaggcagctgtatctgcagcaaaggaagcatttccatcatggcgtaacactccaattacaacacgccaacgtgttatgttgaagcttcaagagcttatacgcagagatatggataaacttgctttgaatgtgaccactgaacaaggaaagacattgaaagatgcacaaggagatgtatttcgtggtttagaggtggtggaacatgcttgtggaatggctactctacaaatgggggagtatgtttccaatgtatcacatggaattgatacttacagcattagagaaccacttggtgtttgcgctggtatttgtcctttcaactttcctgcaatgattcccttgtggatgttccctatggctgttacctgcggtaatacctttgttctaaaaccatcagagaaagacccaggtgcttctgtaatgcttgcagaattggcattggaggctggtttgcctgagggtgtcttaaatatagttcatggaacccatgatattgtgaatgctatttgtgatgatgaaaacatcaaagccatatcttttgttggttcaaatgttgctggaatgcacatatattcaagagcagcagctaaagggaaacgtgttcagtctaacatgggagccaaaaatcatgcgattgtcatgccagatgcaaatgttgatgctactcttaatgctttagttgcttctggttttggtgctgctggacaaaggtgtatggctctcagcacagttgtttttgttggtggctcaaaaccatgggaggataaacttttagagcgtgccaaagctctaaaagtaaatgctggaactgaacctgatacagaccttggtccggtgatcagcaagcaggcaaaggagagaatacacagattagttcaatctggggttgaaagtggtgccagactactgcttgatggaagaaatatagtggtagctgttatatcctcttaa

SEQ ID NO: 6611 - DNA, 162 bp, Glycine max
  Peptide Sequence Number=SeqID_98296
atgaccaaggaaattgcttcctggtctgaaggtgaccaaggaaacaagtctgaaggtgcaggaagcaattgtcccaaatacaagatcgctgattgtttggctaaaatgttggaagtgattatccctccttgtctacaaggaattagggatgagagtaagtaa

SEQ ID NO: 6612 - DNA, 1179 bp, Glycine max
  Peptide Sequence Number=SeqID_98297
atggccggaaaacaggtcggcgagggtttaccggcgaacctcgctggaatgtcaaagaatcagctctacgatatcatgtctcagatgaagaatctgatcgaacagaaccagcaacaggccaggcagatcctcatccaaaatcctatgttaaccaaagcgcttttccaggcacaaattatgcttggaatggtgcaagcacctcaagtggttccaaaagttcagccaatggtttcacagaacaatcagcagccagtacaaccaacacaacagccaaatattcagcctgctccattattgcctgggcatggtggtgcacaggatcaagcaggtgtatctcaaacccaaattcctctgaggaaacaccagaaccaaccttcagtgccagtttcatctgctgttcctgcagcgaggcatcaatctcagcccatggctgcacattccttgccaatgccacaacatcctaaaggacatccaactccccaaatggctctagtgtctcttccacaatcatcacaacttccaaacatacctccaccttctcttcaatcatcatcacagcctcttcatccaactcaaatggcaactgcttccagtcagttacagcaaccaatgcagacatcggggtttccacctctgcaaccaccgctgccaccgcagatcagaccaactgcattgccaaccttccatccccagtatcccccacaaatgggtgcaaacatgggtttccaacatgctggtgcttctcacaatcttccgcaatcgatgtttcatcctggtacaaaaccttctgctagtgttgggtccacattcccacaggggcagacaccacttccaggtcaaccatcatctcagccaccttatcaggttgggaatatgcctttagggcctgattttggcaaccaagctggaaatgctatgcaagtagacagagggtcttcttggatgcttggtccctcagaaaacctagcacatctatctggtcctcctggaccaccatctgtagtttctggtcagatgggtgctgctgctaagcagcctcttcggcctcctgggttgacaccggagatggagaaggcactgcttcagcaggtcatgagcctcacaccagagcagataaatctcctgcctccagaacaaagaaatcaagtgctgcagctacaacagatgttgcgtcaatga

SEQ ID NO: 6613 - DNA, 1215 bp, Glycine max
  Peptide Sequence Number=SeqID_98298
atggactacatcaacacttcccacccaaattttattggtggaagtaaggcaatagaagctgcagtgcaacaaaccaggtcttctagagttggtttaccagtttctagggtgaaggatgcactggaatctgataagggaccagctactgagagaagtgggaagtctcgatctattcttgcaagacatgcaaatggagtagtggctgatcagggtgttcgtgctacatcagatgttgaaaaagtagtgacctctggaaacacaggtggatcaagttgggggatctcatccattttcggtggaggtgataaccgtgtgtctgtgaaggaaatgacagctagtaaaccacatactactgaaccaatgcataatgtgcagtcattctctacaattcatttgagagagcccccttctgtcttgagaccattggagagcaattcagagaccgaagctgttgaaatcacagtaacaaagttgcttttgaaatcatactatgacattgtcaggaaaaatgttgaggatcttgtccccaaagcaattatgcacttcttggacttgaacgaactgcctcttgaagctgaaacagttgaaaggggatacagtttgcctgaaattactaccggcttacctaaaattcgtggattgccaacttcatctatgtattctactagcagttcgggagactattatgaagcttctcccaagaacacaaagtctaaaaataaaaagtcttcacattctggggaactccaatctccatttcaggattcaaacggaaatggagggccatacacgtcaggttatccaatggctggaagatctgcccgtcctgctcctcgggcagctcctcgtcctgctccagttcaccatgctcctcctccagcccctgctcagagtggtggtggatctatgcttggtggcattggttcaaccatagctcaaggtatggcttttggcaccggaagtgcagtggcacacagggctgtggatgcagtcatgggtcctcgtaccattcaacatgaaacagttgttacagaggctgctgctgctgcccctgcacccactgcaaatacttttggtggcgatgcatgcagcattcatacaaaggcattccaggattgcctgaacggctatgggaatgacattagcaagtgccagttttacatggatatgcttgcagaatgcagaaagaactctggagccacgttgagcatgtaa

SEQ ID NO: 6614 - DNA, 1839 bp, Glycine max
  Peptide Sequence Number=SeqID_98299
atgtctcagttaagccgtgccgtgtatttggagaattatgaagatgctgccaggcttaaggttgcatttgcagctacagctaacaacgacagtgttggaagagtgatgtcttatctcaatagagccataaaagaggagcggtatggtgatgcagctttcttaagagataaagctggcgctggacttgtgggttggtggtctggtatttcagaaggtgtaaatgatccacatggtctaattattcgcataactcctgagcatggaagatatgtggcgaggagttatagtccaagattgtcattagacaaagctgtctattctcattctctgtataggtttaagggtacaagtattttcagtgccatctgttttcttcgcatgcaacttgcaacttctgctgctggcattcctctttttgaattttttcttacaatggataaaaaaggtgaattcaagtcacaggctgtgtacttaaagcaaagaggggccttccatggacccccaacaacctcctctaaaacattggatgctgctgggagactgagttcagtggagtctactgaagacaaaagtgagctgtttgttgtgagtactgaagatccagaaaatggtaatgataggaatgatggctctgatcctgctgagggaatgcctggatttcagaatgtcttgaaagatatgattcctggggtaaaggtgaaggtattcaaggtgataactccagagaaagtagacaaggatctatctaatgtgattgagaagataattgaggacgaagacggagacgaagacgaagatgaagagatggaaaatgatgcagaaagtctagaactggaagagattaagtctgagactgaccaggagggagatgatgagattgaaataaatgctggtctgggaacttttgaacgtgaagaccagaatgagtttgctgtcaaaattgccattggtggtcttgttcagaaactttctggtaatctatcctctagagatttgcttcgagtccctgctatgctggagatgaaggggcgtggttcattttcctttactgttgaaaaagaagtcaatcagcaggttggtcttgacaaaggaaaatcttcatctgataaatcaactaagtttcaaggtcgacgcagagttgatcatgttatttttgaccttgcaaaattcattggcaggggaaagataccctcaaaggtgctgaaagaagtgggagaattgataaatctcactctaagtcaggctcagagccatcaccaattatctggctcaacaattttcaatcgcatcgaaataccagcttcgtttgatcctttaaatgtgcagtgtaaaccaagtaacatattttcattttcatcaggtctatacattggtgcacatgggctttactcctctgaagttattcatctaagacgtagatttggtcagtggcaagaggacaatggggctaaggagccttcaaatattgagttttatgagtatgtagaagctttgaagctaactggggatccttatgtaccagctggccagcttgaaacaacccttggacagaatatacaagatgaaaatggaactcctgtggcatttcgtgcaaaaattggaaagaggtatcaattgcctcataaagggataatacctgaagagtttggcgtgattgctcgctataaaggtgaagggaggctggctgagccagggtttcagaatgcccgatgggttgatggtgagcttgtgattcttgatgggaagcacctaaaagcagggccggttgttggatttgtgtattgggcccctgggtatcattttttggtcttcttcaatcggcttaggcttcaacagtag

SEQ ID NO: 6615 - DNA, 1881 bp, Glycine max
  Peptide Sequence Number=SeqID_98300
atggccgatccaaactccaatcctaaccactctaacgctcacgtgaaccgttccagacactacaccactcacgtgaccttccgtctcctctgtcacgcgtcgcgcgtgggcgccatcatcggcaagtccggcgtgctcatcaagtcgctccaggaggccaccggcgccaagatacggatcgtggacgcgccgccggactcccctgaccgagtcatcctcgttagcgccccctccgtcaccgaagacggtgagctctccacggcgcaggaggcgctgctcaaggtcttcgaccgggttctcgacgtcgccgccggcaccgaagtcggcgacctcgtggtctcttgccggcttctggccgaaacttcgcaggtcggcgccgtcatcggcaaggccgggaaggtcgtggagaagatcaggatggacaccggatgtaagattagggttttgaatgaaggtttgccggccggcactgctccctccgatgaaatcgttgagagggcgagccctggtgcagcggtaaagttgtgccttggtgacttgttggtcatgggttcgaatccggaaacagcctctttgcatatgcaaggaaaggattgtttggagttgtatcagatagaaggccagctgacatctgtaaagaaggcactcattgctgtctctcatcggcttcaagattgtcctcctcctgatagaacaaagatgacaggaagcagacattatgaagtggttcagtctgagacattttcagttccacttgagtctttaactaatctgcatatagatcatcatctgcaaaggagctctacattatccactttatccaataggtctaatggcaatgcctctggagctcataaattatcagctgaagttaatagagtctcagccctggatccaaaagcatatcagcaggaagttacctttagaattatttgttccaatgatagggttggtgccgtaattggaaaaggtggcagtattgtaagagctcttcagaacgaatcaggggctattataagtgttggtccttcattagttgagtgcgaggatcgactagttactattactgcttcagagaatcctgaatcaacatattcccctgcacagaaggctgttgtgcttgttttctccaagtctgttgaggctggtgttgagaaggggctagagttgggatcaaaaaaggagccatatgttactgcacgacttgtagtcccatcaaaccaagtgggttgtttgttagggaaaggaggggcaatagtctcagaaatgcggaaagccacaggggctaacataagagtaattgggaatgatcaggttccaatgtgtgtatcagataatgaccaattggtacagatatcaggagtgttttcaaatgttcaagctgcaatacataatgcaactggtagactgcgagatcatctttttgtcagtacgcaaaacagtggtggagcaaggagcctttcctctgttctagctggaggccaaccaactcttgctatttctcatagtctcaatagacattctttgccaggattacaggcaccacagacagtggctgggataaattccagaggcaccaatggtgttagtcggggattgatttctcgaaaaggtggcttagaacttatcagtgggagtaaaactgccattgttactaatacaactgtgcaaattgtggttcctgatgatgttattggctctgtatatggggaaaatggtagcaatctggctcgcctgagacaaatatcaggggctaaggttattgtccacgaacctcgtcctggaacaagtgataggactattatcatatccggtacacccgatgaaactcgagcagcacagagccttctccaagcatttattcttgctggatcatcgtga

SEQ ID NO: 6616 - DNA, 315 bp, Glycine max
  Peptide Sequence Number=SeqID_98301
atggcggcgagagaggtgaggaagctgaagcatctgcacgctaccaggaacgggtctgctctgtttcttatagtggtcgacgacgtggtggtggtggtggccgcgttctgttccactacgtcgtcgtttcgagacattttgtggatgaacgctggttattactatcggaggtacatgaaaaagtgcaaaggaagattgaaaagaaaacaagcatgtgtaacagaagaaattgaacaagacagatgtgaaaaaagatcacttattgaaagcaacaataacaacagggaactgaatgaaaatggagagtggagatga

SEQ ID NO: 6617 - DNA, 1245 bp, Glycine max
  Peptide Sequence Number=SeqID_98302
atggatgaagagtacgatgtaattgtgttgggcacaggtctcaaggaatgcatcctcagtggccttctctcagttgatggcctcaaggtgttgcacatggatagaaatgactactatggaggggcttctacatctctcaatcttacacagctatggaagcgatttaggggagatgacacaccggcagagaacttgggatccagcagagaatacaatgttgatatgatacctaagtttatgatggccaatggagctttggtccgtgttctgattcacacaaatgttacaaagtatttgaactttaaagctgtagatggaagctttgtgtataacaagggaaagatttacaaagttccagcaacagatgttgaagcactgaagtcaccattaatgggactgtttgagaagcgccgtgctcgaaagttcttcatttatgtccaagattatgaaacaaatgatcccaaatctcacgaaggactagatttaaaccaagttacagcaaggcagctgatttcgaaatatggattggaagatgatacagttgactttattggtcatgccttggcacttcatcgtgatgataattacttggatgagccagccaaggattttgtagacagagttaagatttatgcggagtccctagcacgctttcaaggaggttcaccttacatatatccactctatggactgggagagttgcctcaggcatttgcacgtctgagtgctgtgtatggtggaacttacatgctgaacaaaccagaatgcaaggtggaatttgacgaaaatgggaaagccattggtgtgacttcagaaggagaaacagccaaatgcaagaaaattgtgtgtgatccatcgtatctgtctgataaggttcagaaggttggaaaggttgctcgtgcaatatgtattatgagtcatcctattccagacaccaaagactctcactcagcgcaagtcattctgccacagaagcagcttggtcgcaagtcagatatgtatctcttctgctgctcttatgctcacaatgtagcagccaaaggaaaatatattgcttttgttacaacagaagcagagactgacaaccctgaggtggaattgaagcctggtattgaccttcttggacctgtagatgagatattctatgacacttatgacaggtttgaaccctgcaatgatcatgaagctgatggttgcttcatctctacatctatcactaatgaacaggggcaggatatgaggtaa

SEQ ID NO: 6618 - DNA, 264 bp, Glycine max
  Peptide Sequence Number=SeqID_98303
atggccataagaaccgacttaaaattcaatttttttagtagtataggcaaaggtggagttggtggcaatggtggagttggtggcaaaggtggcagtgtaattgggattgggactgttggcacaggtggcaatggtggcaataatggtggggttgctggcaaaggtggcagtggtgggaaaggtgagagatggcgtgttgctaatgccatgtccatgcttgagaaggaaatagcaatgaacaaagccaaaatgatgcaactatga

SEQ ID NO: 6619 - DNA, 285 bp, Glycine max
  Peptide Sequence Number=SeqID_98304
atgcagaagtgcaacgaaaatacgcggaagattgaaaagaaaagaacagcatatgttgtaatcctaggcaaaggtggagttggtggcaatggtggagttggtggcaaaggtggcagtgtaattgggattgggactgttggcacaggtggcaatggtggcaataatggtggggttgctggcaaaggtggcagtggtgggaaaggtgagagatggcgtgttgctaatgccatgtccatgcttgagaaggaaatagcaatgaacaaagccaaaatgatgcaactatga

SEQ ID NO: 6620 - DNA, 75 bp, Glycine max
  Peptide Sequence Number=SeqID_98305
atgggtcacgtatatggctcggaatttaacagcaaattgaactatcaagacagtggcaatggctctattaattag

SEQ ID NO: 6621 - DNA, 996 bp, Glycine max
  Peptide Sequence Number=SeqID_98306
atggctgccacgtgctgtagcttcactcaatcgtcttctggtttcaggaaactccatgagaacattcagctgcagagctacttcacaaggcaacaaagatcaacttgcagtgttgaaaatatcttccatagggactatggaggaaggtttttacaagttgaaggatggcatcaacatcagtatttgttatgtgcaagaggagttgagttgtccccttctgccaatgaagaagttggagaggagactgaggaggatatctcaaaggaaacgttgatttggagagccatcaagttgccaatttactctgttgcatttgttcctctcactgtaggcagtgcagcagtttattttcagacagggatcttctcagctagatgttattttgttctcctggcttcttcagttcttgctattacctggctcaatttaagcaatgatgtttatgattttgacactggagttgacaagaacaaaaaggaatcagttgtaaacctggcaggtaggtacaagttttttgctggcatcataatcatgttggaaagttattcaggagtcattaacttgcaattttctgtgcttggccaattgctgttgcagtgtccaccatttcggttaagctaccaggggctgggagagcccttgtgctttgcagcatttgggccttttgccacttgtgccttttatttattacatggcagttcaagtcatttccatcaggtggaaggagacaaggaggttgggaaaatgtcacctttggttagacttggcactaaaaaaggtgcagaggtagtgaaaggggcagtctttatgctctatgctcttttggttgcttttggtctaatcaaggcacttcctctcacttgtataaacaaaaataagattttcatggctaagtacttctgtgtgaggcttcatgcattgtttggagttgcactggctttaggactagtgctggctagaaatacaaaatttacatcatggccaatattgagttga

SEQ ID NO: 6622 - DNA, 288 bp, Glycine max
  Peptide Sequence Number=SeqID_98307
atgagcttgattttgtgtttgtgtgaaaatgaaacggagggcagatggttttatagggaacatggacgtgccaggggccccaccactagtggaagtgcctgccaggctaccactagtggtcgcgcctggcaggtaggcacgactggtagcgcctggcaggtaggcacgactggtagcgcctggcaggcaggcacgaccacccctgtcacatcgccatgtccagacaagccacgtgtcgcgttctggtggaacgcgctcctcagatcctctgccgccttggcagcatga

SEQ ID NO: 6623 - DNA, 1102 bp, Glycine max
  Peptide Sequence Number=SeqID_98308
accgcggcgtcatccggttcaaagttcaaacgttgacaggctggcacgagaaggcccaatgaaaaagctccacgtggaggctcaagatgttgacacatccttggccacagctgtcccccctgaccaggagcagccactagtcctcaagtaccacaacggccagctcctgaagggccgcatcaccgtcaatctcatctggtacggcaccttcaccccgatccaacggtccataatcgtggacttcataaactcgttaagcagcgcgccaaacgcgcctctcccctcgaccgccacgtggtggaaaaccacggagaagtacaaggtgggaggaggatcccctgcgctcgtcgtagggatgcagttcctacacccggcttacacgctagggaaaaatctcaaaggaagagatctcctcgcactcgcgtcaaagttcaacgagattaactcgataacggtggttttaacggcgaaggacgttgccgttgagggcttctgcatgagccgctgtggcacccacggctctacccggaacgttaaaagtaatgcccgaaccgcatatatctgggttggaaactccgaaacacagtgccccgggcaatgcgcgtggccattccaccaaccgatttacgggccccagacgccgccgttagtttctcctaacggcgacgccggggttgacggaatggttattaacttggccacgcttctcgctggcacagttaccaaccctttcaacaacggttacttccagggtcccccaacggcgccgttagaggccgtttcggcttgcactggtgttttcggaagtgggtcgtacccgggttatccgggtcgggttctcgtggataaggcaaccggggcgagttacaatgcgcatgacttcgacatgcaagaccctcgtctgaagactgccacgtggcgaggttgtgtaatggttgtagatattggtcgatgggaacggaagcagggaatggataatagaggtggtgatggatttgggctaggagaccattatggcgaggtatctatcggtaatgatgattttggctggggtggtgaaataagctttgtgattgtgaatgtgaagattggggtgagtgag

SEQ ID NO: 6624 - DNA, 429 bp, Glycine max
  Peptide Sequence Number=SeqID_98309
atgttttttgattcaaatggctttccctgtccacctctccataacccttctgatcatttcttgcggatcataaacaaagatttcaaactggatgatgaaaaatgcttccacaaaacagtacccaaagaagtagttgatatccttgtagagttctataaatcttctgaaattagtaatcaagttcagaaagaagtagcaataataggtgaaagtgaaattggtttcatggagaggaacagaacacggactgcatttcttactcagtgtcacattcttatgagaagatcttctttgcatctgtttcgtgatgtaagcaattattggttacgtctagctatgtttgttctagcagctattagtcttggcactatattctttgacgttggttcaggtgatgcatctatcgaggtaaagcagaatagcacataa

SEQ ID NO: 6625 - DNA, 1149 bp, Glycine max
  Peptide Sequence Number=SeqID_98310
atggcaagtagacaagtaagatgtaaccagtgtggatcagtattaatggttccggcggcagcggtccgtgttgttgagtgcagagtgtgccatggcatgaaccagattcgaccctccacaggtccatggagtcaagtatacaactcctttcatcagtttggaggtcgtctcagaagctttgtgaataccataatgcctggttcagttaacagaaatccgggttattattatgggacgacacctcaattagggtattatcctcagccactaaggccatcatacaatgtatttggcccaaagagggctgtcctatgcggaattcgctatcatgggcaggatagccagcagctaaacggcaccgtgaatgatgttaaaaacatgaatatgtttctggttaagtattgtgggtttcctagggaatccattctcattctcacagatgatatggaggagagagacccgctaaaattcccgacaaaatataacattcaaatggccatgaggtggctgattgagggtagccagtcaggggattcattggtgttccacttcgcagggcatggcgctcaggaaccggatatgtctggagatgaacttgataggtctgacgaagtaatatgtcctgttgattccagagagcagggaaatatacttgatgatgagattaatgctacaattgttaggccactaccacgcggtgctaaacttcatgccgttattgattcatgccatagtgggactgttcttgatttagcttatgtttggagcctgagggaaggctattggacatgggattatcaatactatcgagttcgtagacctaataaagacacaagtggaggggtagcaatttgcatttcaggttgccacgatgatcaatcgtccaaagaaacccctgccttaagtggtggctatgcgtttactggcgcctttacttatagtttcatctataccatgctaaatgaacctggactaagttatggtcgcttgctcagtgccatgcgttctatcatccgtgggataccaaatgacccatatgcttcgctctttaatacagattttatctttgcctcaagacaggatttgcaggagccacagctatcctcttccatggagtttgatgtgtatgcaacccgggttgtactatga

SEQ ID NO: 6626 - DNA, 519 bp, Glycine max
  Peptide Sequence Number=SeqID_98311
atgatctatgatttcattcatttgcctagtcagactcagagcttcaacctggagagcaaaattgttggcaaaaaaaagaggagatatacgattacgagggccatccttaacgaattcgacttccacgtccaaaagactactaggacaaaaagttgttttacaagaccaggacgttttaagaacgagactatacatctaccagtcttcaactgggctctcaaccgccaagtcaccctccaccaccgcctctccctttccccctccgccgtccccgctcctgctcaactgcccccagaccctcccctctctacaacgccctccgaaggagatgattgtgaatcttataacttcttccacaagtctctcaaccacaacaaacaaactcttgcatggcacctacgccctcgtccgccgcaagggcctctgtccggacaaaaccacctacgcgctcctcatcaatgcgtggtgctccaacgggaaacttcgcgaggccaagctattcctcagggaaatgagtga

SEQ ID NO: 6627 - DNA, 1389 bp, Glycine max
  Peptide Sequence Number=SeqID_98312
atgtgtttgattgctgatcattctgctcctgaaagtgcagactcaacaagagacaacttcctccaaatttttgaaaggaagatggaggaaagacatagacaattaagagaaagtggtcgtgagctagctgtttcttgggctctatgcgctgtctgccttgttggccatttctctcatttctttgcagcaaaggcaccatggatccatgtatttcattccattgggtttcatctttcgttgtctttgtttacgttgcttggtcctggccgccaacttatccttgatggcttaaaaagccttcttaaaaggacgccaaacatgaacaccttagttggtctcggggctttatcatcatttacagtcagttcatttgctgccttgctgccaaaattgctattgtttgcaagattgctattccctagtagttcaccgattactataatatgtaaattcccttttgatacatgtctatacacatgttggtccccagctttcacgcatgcattgctcatgctcaagcaagttgatagaggttggaaggccttctttgaggaaccaattatgctaattgcatttgtcttgttaggaaggaatctcgaacagagagctaagattaaagcagccagtgatatgacaggacttcttagtttattgccaccaaaagctcgccttcttttgaacaatggggaaacagaggttggctcggttgttgaagttccttctgacagtctttctgttggagaccaaattattgtattacctggagatcgtattccagctgatggagttgtgagatctggtagaagcactgtagacgaatcaagttttactggtgaaccactgcctgtaacaaaagtacctgggagtgaggtagcagctgggagtataaatcttaatggaactcttacaatggaagtgcagagaccaggtagtgagactgctatggcaaacattgttcgtctagttgaagaggcacaaagtagggaagctcctgtgcagcggttggctgacaaggtggctggacacttcacttatggagtgatggcaacctctgctgccacattcacattctggagtctgtatggcacacacattttacctcctgctttatatcaaggacgtgcagtttcactggctttgcagcttgcttgcagtgttctggttgttgcttgtccatgtgcacttgggttagccacacctactgcagtgctggttggaacatctttgggagctaagagaggattacttcttcgtggtggaaacattctagagaagtttgccatggtagacactgttgtgtttgacaaaacagggaccctcacggttggtagacctgttgtgacaaacattgtcattcctatttgcataaaaaatgcaatttcaaggtag

SEQ ID NO: 6628 - DNA, 2298 bp, Glycine max
  Peptide Sequence Number=SeqID_98313
atgggcaaagagatgttggagaacgtgaaggatgatggggggctcgaggagctcgagatgttgctgaatgagatccctcaggcaacatcactcaatctttaccatgggaaatcgcatcatcatcatgatgttgttgttgttcatcgtggtgatgatgatcatgatcgccatcatgattcttttgttgtgtctcatggaatgtgtgatgatttcactcagattcagtatccatctgtttcatcccctgtgagtggcttttctctgcaatccgatggctcttcctcaagcttgttctcttcttctggccatgccttgtctgatactggatcaccaacccctcctccattggaggatcttaaatccaccaccatgccttcttcttctcaccctaataaccgtttcatcacacctgattcaactactcttatgaggaatgccaatggaggttttgttgatgaacttggaggcctgtgtgccaatttgagtcaaatgtacatcagcaatcagcaggagagcccttgtgatttcaaggatgcttcaatggccatgcataggcctaggcctcctccatttcctgaatgtgtttccttcactggaaatggtccaagcaataatgttcaatatcatggggattcttacagtttcaggagaggttcttttgattgtgttggtggtgttcagtcccctctttcttggactcctgtaaatcacgatgccgagataaattcggcgttaatggctaaattttttggatcaagacagtgtgccaaaatgtcttatgagacaatgctttctcaattacatgactttagtagttcaatggatcatcatcgtcattcaaggccgctgctggtggataactactatcgtggaggaagtggaaatcagccaccggagtgtactgcttctctgagcagaaacccaatggttgatgctttacttaatgcacagaggaatggaatgaatgtaactgaagaaacaggcatgtcgagatcgcctagctcttcttcccggggtattaatttaagaccttatttgggtgttcaagatttactgcagtatagccattccctgcctaattatagtgcaagagctgtgcctctttcaaatgctagaatcctacaaggaaatatagatgctattgcaagagaggagagcttcatcatacaaggtgaaggtgtaaattatgctgctagcataggtttggatcgttctatgtatcgtagtaaggctgtggtgcgagacactggcttcgccaggcatttgaagagatcagagttagacgtgccataccaggttgtaggaacttatgacaatgataggggtgctaggataggttgctcctttcctttgttacccaagtatagttccctagctgaagctcaaggttatatatatttaatgtccaaagatcagcatggctgtaggttcttgcagaaaatgtttgatgagggtacaccagaagatgttcaagtgatatttaatgagataattgatcatgtagtggaacctatggtgaatccttttggaaattaccttatgcagaagttattggatgtatgcaatgaagaacagaggatgcaaatcctactaataattactgaagaacccgggcagcttgtcagaatctctttaaacactcatggcactcgtgtggtacagaagctaatcgagactctcaaaaccaggcagcaaatttcattagctgtttcagctcttgaaccaggattcttggctctcatcaaagatctaaatggaaaccatgtgtttatatttgttgctgctgcaaagtattgtgttgacatcgcaactcaccaacatggatgttgtgttctgcaaagatgcattggccattcaaatggggagtatcaagaaaaactgattgcagaaatatgtgctaatgcacttctcctagctcaagatcaattcggaaattatgttgttcaatttatcttggacttaaagattccatctgccacagcatgcataaggttgcaatttgaaggcaactatgcgcacctatcaagacagaagtttggtagtcatgtggttgaaaaatgtcttgctgtattcaatgatgagaatcgatcaagagtcattcttgaactgctctccatgcctcactttgaacacttgcttcaagatccacatgctaactatgttgttcaatcagctcttcgacattctgagggccgtctgcacaatttactagttgaagcaattgagtcccacaaagccatttctcgaaacagcccgtattccaagaagattttctcgcagaagcttttgaagaaatga

SEQ ID NO: 6629 - DNA, 396 bp, Glycine max
  Peptide Sequence Number=SeqID_98314
atggcaagaatagcaaaatctttaagcctcagttgttgcggtaggatatctgtaacttttattgacaaggatggtgaggagaagcatatcaaagtccctgttggaatgtctatgttagaagcagctcatgaaaacgacattgaactagaaggcaagagctttgattttagaattctattacttcgcctcaagattttggacttggaacaatacaataaattggaagatccaactgatgaggaaaatgacatgttggatctagcttttgggcttactgaaacatcacgtctgggttgccaagtgattgcaaaacctgaacttgatggaattcgtttagctattcctgctgccactcggaacttcgctgttgatggttatgtgccgaaaccacattga

SEQ ID NO: 6630 - DNA, 783 bp, Glycine max
  Peptide Sequence Number=SeqID_98315
atgcagtcagatgaacactgttgtaattcttgcgaagaagtgcgtgaagcatataggaaaaaaggctgggcaatgacaaatatggatttgattgatcagtgtcaaagagagggttatgtgcaaagggtaaaggatgaagaaggtgaaggatgcaatcttcaaggatctcttgaagttaataaagtagcaggaaattttcattttgcaactgggaaaagctttcttcagtctgctatatttctggctgatgtgcttgctttacaggataatcattataatattagccatcggatcaacaaattaagttttggtcaccatttccctggattgatgcctttattttctggtgacaaggatggcatgccacatagatgttttcatatactgggatttttaaatttgaatctaattccattgattgaaattctaaaggtaaggtgggtgcaaggacctactcatggcatgtaccagtatttcataaaggtggtccctacaatatacacagacattagaggtcgtgttatccattcaaatcagtattctgtgacggagcatttcaagagttcagagctgggtgttgcagttcctggagttttcttcttttatgacatatctccaatcaaggtcaactttaaagaggaacatactccatttttacatttcctgaccaatatttgtgcaattattggaggtgtatttactgttgcgggaataatagattcatcgatatattatggtcagagaacaatcaagaggaagatggagcttggaaaatttacatga

SEQ ID NO: 6631 - DNA, 1011 bp, Glycine max
  Peptide Sequence Number=SeqID_98316
atggagaagggtagaaccgtggtggtgtccgctctgcagtttgcttgcaccgatgatatctcaacaaacgtcgccaccgccgagagttttcaaaatgtaactaaacaaggttgttcagacaaactggtggagggcggtgcaaggtacaaagcagagtgtggaattgaggaagagaaaacaatttttaaaaccaaaaggctagttagagctgcacataaacagggtgcgaacatcattctcattcaggaactctttgaaggttattacttctgtcaggcacaaagagaggatttcattcaaagagctaagccacataaggaccatcccacaatcctcaggatgcagaaacttgcaaaagagttaggtgtagtcattccagttagcttctttgaggaggcaaacaatgcacattataactcaatagccataattgatgctgatggaactgatcttgggatttatagaaagtcccatattccagatggaccaggttatgaggaaaagttctattttaatccaggtgacactggattcaaggttttccagactaaattagcaaaaattggagttgctatttgctgggaccagtggtttcctgaggcagcccgagcaatggtgcttcaaggtgctgagattttattttatcccactgctattgggtctgaacctcaagatggaagcattgactctcgtgaccactggaaacgagtaatgcaaggacatgctggggctaatttggtacctcttgtggcatcaaataggataggaaaggagataattgagactgagcatggaaaaagtgagataacattctatggaaactccttcatagcaggacctactggagaaatcatttcaactgctgacgataaagacgaagctgttcttattgcacaatttgatttggacaagatcaaatccatgagacattgttggggggtattccgtgataggcgtccagatctatataaggtgcttttaacattagatggcatcaatcccgtccagtga

SEQ ID NO: 6632 - DNA, 1587 bp, Glycine max
  Peptide Sequence Number=SeqID_98317
atgggaggtttaacctctcattgtcatgaaagacttacaaatacaaaaaggggcaaaggaagtggaagaaaatggaggaagatggagaagaatggaggtggaatgctccaaatgaatggctctctctccactgtggttttaatggggaatatactgaatctaaacaattcaaagactagacggaatgattcccatggggtcttgcaaggtgaatcctgcaagagacagaggttgtcaccaaactcttgtgaggacaacccaagactgattccgtcccttcctgatgagatatcaatacagattctagctagagttcctcggatttattatttgaatctgaagttagtttgtcgtgcttggaaggaaacctttgttagttctgaactattttgtgtgagaaaagagcttggaagcatggaggaatggctctacattttgacaaaggtcaacgatgataagcttttatggtatgccttggaccctctttccagaagatggcaaaagttgccgccaatgccaaaagttgggtttgaagatgaaacaaagaaaggtttgatttcctttccccttcggatgtggagcatgatgggttcaagtattcgaattgttgatgtcataatgagctggcttgggaggagagatgccctggactggatgcctttttgtggttgctccataggagctgttgatggttgcatctatgcattaggaggattttcaagagcttcagcaatgaaatatgtttggcagtatgatcccattaaaaactcttgggctgaggctagtccaatgtcagttggcagagcctattgcaagacaggtatattaaataataagctttatgttgttggaggggttactaggggtcgtggtggactaagccctctgcaatctgcagaagtatatgaccctcatacaggcatgtggtccctgttacctagcatgccttttgcaagagctcaagtgttgccaactgcttttttggctgacttactcaagcctattgccacaggaatggcttcatacaaaggaaggttatttgttcctcagagtttgtattgctggccattttttgttgatgttgggggtgaagtttatgatccaaatttaaattcatggcttgaaatgccaattggtatgggtgaaggctggcctgcaaggcaagctggaacgaaattgagtgttacggtcgatgatgatctatatgcacttgatccttcaaattctcttgacagtgcaaagatcaaggtatatgattatgaaggtgatacttggaaagttgcagcaggagatgttcctattcatgatttcaccgaatcggaatctccttatctcttggctggtttacttggaaaacttcatgtaataactaaagatgctaatcacaacattacagtgttgcaggctgacatgcaaaatgaacatgctgagtcagctttctctcaatcaatattgtcatcaccagataactcgatcagtgaagatgctgaatcttctgcagaaacacagggagaattttggaaggttcttgcaactaggagtggtagatctgctgaactagttaactgtcaatcccttaaaatatga

SEQ ID NO: 6633 - DNA, 1479 bp, Glycine max
  Peptide Sequence Number=SeqID_98318
atggaaaaagaggaggaggagcagcgcgagtggaggctatacgaaggctacaatgagctccacgcgctggcccaggacttgcacacgcccttcgacgcccccgccgtcttggtcgtcggccaccagaccgacggcaagagcgccctagtcgaggccctgatgggcttccagttcaaccacgtcggcggcggcaccaaaacccgccgccccatcaccctccacatgaaatacgaccctcaatgcgagtccccttcctgccacctcgtctccgactccgacccttctctttcccaccataaatccctcccccaaatccaggcatatattgaagcggaaaatgcgaggttggagcaggacacgagccaattctctgccaaagaaatcatcatcaaagttgaatacaagtactgccccaacctcaccatcatcgacactcccggcctcatcgcgccggctccgggccggaagaaccgtgctctgcaggcgcaggcgcgtgccgtggagtcgctggtgcgggaaaagatgcagcacaaggagttcatcatcctctgccttgaagattgcagcgactggagcaacgccaccacgaggcgcgtcgtcatgcaggtcgatcccgaattggccaggacagtcatcgtgtccaccaagctggacaccaggattcctcagtttgcacgtccttctgatgttgaggtcttcctctcgccgccgccgtcgacgctcgacggctgcattcttggtgattctccgttcttcacgtccgtgccttctggaagagttgggtgtggaagtggttatctccatagctccaatgatgagttcaaacaggttgaatcgcctgggtactgcttgagttcagtccttgacagaaacaattcttattcagattttacttctctcccagtcgaatttcggattagtcagggtctcttttgtccgataaatcagagggttaagacaaaagaaaaagcggtttgcttcagagagatagaagatgttgcatctttggaggagaagttgggcagggcattgtcaaagcaggaaaggagtaggataggcgtgagcaaacttaggctgtttctggaagaattgctacaaaagaggtatataaataatgtaccattgatcattccacttctcgagaaggagtaccggagtgtgacaaggaaattaagtgacattaatcaagaattgagcacacttgatgaagccaaactgaaggagaaaggaagagccttccatgatatgttcttgaccaagttgtcattgttgcttaaagggacagttgttgcacctcctgataagtttggtgaaacactgcaagacgaacgaattaatggaggtgcatttattggtgctgatggtgttcagttccctcacaagctaatacctgcccaaagtccaccactaaggtgcatgttgggagagttaaaaggagcaatgcaccttggagagagaatggctcaactaactggctag

SEQ ID NO: 6634 - DNA, 450 bp, Glycine max
  Peptide Sequence Number=SeqID_98319
atgcctatgtttaatgcgcaacagtgtcttgaacaagaatgtagagctttggcagagggaaagcaatggtactactacagcagaaggacacaaaatagggtcactagcaatggctattggatgccaatgggaatggaagagccagtgatttcaaactctagcaacaagagagttggcatgaagaaatattatgtgttccatttgggagaagcccctgatggcaacacaaccaattggataatgcaagagtatcgtctattagattctgcttcctctagcatatcatccagaagaagatcacaacctaaaccggaccatagtaaatgggtgatatgtcgagtttatgaacgggataacgatgaagatgatggtgatggaacagagctctcttgtttggatgaagttttcttgtcattggatgatcttgacgaaataagtttgccaaattag

SEQ ID NO: 6635 - DNA, 204 bp, Glycine max
  Peptide Sequence Number=SeqID_98320
atggttttcgttgggggccatggaggagatgcctccaacgaacgtggggctacccacgtgattcttctgcattctcgaatctttctaaagggtccactcactcatatcttcaattatccaatcacaattgctcacggaatgtctttagttgaagcttgtagagctatatatgcaccaaggcttgagcaacttgtgttaacctaa

SEQ ID NO: 6636 - DNA, 819 bp, Glycine max
  Peptide Sequence Number=SeqID_98321
atgttggttgacatctgtgtgtgtagaaactttttttatggatatgggtttagattcgagaagttaaatttgcaagcagcagaaggaagggcaaaggtcataggcaccataattggaattagtggagcaatgctgatgacctttttcaaaggcgtagaaattaatatttggtcgtctaataaaatcaaccttctgcatccacatctgaaccaaaatgggcatgtggcatctcaccacactgagtttcgaaataaactgttgggtattccatgtgccatagctaaaatgaatgcagaatatccaagccctcactcaagcgcagctttaatgagcataatgggagcgatacaggccaatatttttactctttgtgtcgaaagggattggagccaatggaagctgggtttcaatatcaggcttctaacggtggcttattcgggaatggtggcctctggagtagtggtcgtgatcattgcctggtgcataaagaagagaggccctctatttgtttctgttttcaatccactacagcttttgttggtagatatcgctgcttatttaatgttggaagagaaattgtatttaggaagtgtgcttggagcagtgataattgtgtgcggtctatacacggtgctttggggtacagcccaagaattgaaaaagaagtctcagttagtgccattaggaaacaccagaggagagtctgaaaatgatcgggtgggggaaagatatacatccttgctaacattgtggatagcaatagcaagttcttttactcttgcccccgccttcagatattgcttgtgtctaagtttctga

SEQ ID NO: 6637 - DNA, 1212 bp, Glycine max
  Peptide Sequence Number=SeqID_98322
atggaggagggacaatcctctgctgttatcttgaagtttgaactcatgcatgctcctataattgaaactgggcctgagttactaggttcactggatgcatatgctgcttcagttcatgaatataaaatcccccctaaagctctccagggattacattcatattgtcctgttcattttgatgctttccatgctgtccttgttgaaacaagcattcacatcagtctactaaaagctagttatcacacatctcgacagaaggtatccagtgattccagaggttcagaaggtgcttatgttgaagattatgttgggtcaaacaaggttatgctcatcaaagcattgatggctgcatatgatatcctgcttgaagatttgagaagaataagcacaggcattggcaaagctattgatttgactgaaatgacttctgaatcagatgctacagaattgtttgcttctactcctccagcatgcgtgaaaagtattgatgttcaatcatctcttcaactgtctgacaggccacaagtcagtgctgagaaagctgctcatcatgtcaataatcttttcgagaagtcgcctcaacctttttcttgggatgaccatctgttaatctctttccagtctttaggaaatcagctcttatgtctctggaatatatttctaaaattccacagggaaaacaaaacaaaaatactggaatttctacgtaaatcctgggagattgataggagaactgaatggtcaatatggatggtgtactcaaaggttgcaatgcctcgtcaaaatatgagcaatggagttgaggggacatcattgtcccatggcatgcatagaagttcaataattacaaggaggtttactgatgatcctattcaaactgcagcaatgcgtgcagaacttcacaggcgaggaatagctcaaatgaggatcaacaatcggtcacttcaagatatgtatatatttggagatcctctgctggttcctattattattgtagaacgcttgacaaacgtgtaccattctgccattgtgaactcaaacttcattcctttggagggtgaagggaggcatatcctagaaaatggatccagagccacaaagaagttgtgtggtagtagtccacagaaaaatgaacttgttttgagaatagttgtttttgttcatggatttcaggcatgtttcatattcttgcagttgcttttatctccttga

SEQ ID NO: 6638 - DNA, 78 bp, Glycine max
  Peptide Sequence Number=SeqID_98323
atgggggctgatcgcacttgcaaactctttgcctctcacatccgaggttggatgacttatttgattgaggccagatgg

SEQ ID NO: 6639 - DNA, 315 bp, Glycine max
  Peptide Sequence Number=SeqID_98324
atgtcgctaaggccagatgccagaattgagattcacctcaacttttataaggttgtcgtggttgccagggtggttgattttccattcatgttcctttcacctcgtcgcgttttgtctcggcctcagagccaaagcatcgaggaccagcatggcatgcatgtcgaggaccaggccctactttgcgatggcctatcattgatggagtcgccattccccgcatcaccaccgttctgcaaaactgtattagttgtggtgtttgtatgggtaagtacttctttgggacatagttttaggaaaatgatgagatttttataa

SEQ ID NO: 6640 - DNA, 777 bp, Glycine max
  Peptide Sequence Number=SeqID_98325
atggggtcgaaccaagcatatgcttttgagaaaagtttttcatcaagtcaagaacacgctttacggtgcccttaccgaacacatgccaaagctagagtaatgagtgaagtagaggaggtgcaagagcagatgaagaccgacatagatgccatgaaagaacagatgaccacaatgatggaggccatgatgagtatgagaaggatgatggaggtcaatacaactactgttgttgtcgaaagtaccgccacaaaagtggacccgactcacccacctggcttcaatcaagtaaatcgtccagcttcggatatggtaggtcagggaggtgaagcgttgggaagtacaggcggcccctatttggtgcaagttcaaaacaagcattccttcccaccatatgtcttgcctcccaactatacaccacccaatgttgcacacactcccgatgagaatgtcaaaaactccgctcccataccaattgagagccaacaaccccaatttggtcatgcacaggtccctctacccatggggggacacatgaagtatcccgagaccacactttatccgactttgagccttacctcggatatgccactaagggatagacattttgtggtgtacccctgccaaacactttggggggcctcagtatcgcccacaaccacaacctttacattttgcagtgggaagagtacctcctgctatggtggaaagggaaaaattcgatcatatagaagaaaggccgagggctatttaaggaggtggagattatgcttttgctga

SEQ ID NO: 6641 - DNA, 447 bp, Glycine max
  Peptide Sequence Number=SeqID_98326
atggccttgaaacgaatcaatatggaattgaaggacctgcagaaagacccccctgcgtcctgtagtgctggtccagtggctaatgatatgttccattggcaagctacaattatgggccctatagatagcccatttgctggaggtgtgtttcttgtgtcaattcacttccctcctgattatcctttcaaaccacccaaggtttcatttcgtacaaaggttttccaccctaacatcaacagtaatggaagtatctgccttgacatcctcaaagagcaatggagcgctgttctaacaatatctaaggttcttctatctatatgctctttgctgacagaccccaacccagatgatcctctagtgcctgagattgctcaaatgtacaagactaacagagccaagtatcaggccactgctcgatcatggactgagaaatatgccatgggctaa

SEQ ID NO: 6642 - DNA, 111 bp, Glycine max
  Peptide Sequence Number=SeqID_98327
atgttcactgtctttggggtccctaagcatgtggcacgggccatgaggcctaagtggtgtgtgtgggttgcacttgccactgtgatggcagcaacaatggctgcaatgtag

SEQ ID NO: 6643 - DNA, 279 bp, Glycine max
  Peptide Sequence Number=SeqID_98328
atgccgaaaaatcaaaaaaatattgatgcacaatccaaaacaagtatcgttacggaattcgtaagtttccgtgactttacggaaaaagaatcaccaaaaaaagcagaggggggtgtacttagtaaaaatgggggtgcaaatagcacccaggcccacttggccctccagaagattcctccagaaggctgttgcttctggaggaagcaacctggctcgcctgggcgagctgagctcgcctgggcgagctgggcggcaaccacctcccctattttgctataa

SEQ ID NO: 6644 - DNA, 330 bp, Glycine max
  Peptide Sequence Number=SeqID_98329
atgcaaaaacattaccttcacaacattgtgcaatgtaatagtcaaataacatttggagtgagtaggaaagggataaaacacaacctaattggtgatgtcagaggaagaggcctaatgctaggagttgaacttgtcactgatcgtgaacttaaaactccagcaaaaaatgaaacattgcatgtaatggaccaaatgaaagaactaggagtacttattggtaagggtggttactatggaaatgtcttcagaattacacctcccttgtgtttcaccaaagaagatgcagactttgtagcagacgcaatggacttgaccttgtctagaatgtga

SEQ ID NO: 6645 - DNA, 150 bp, Glycine max
  Peptide Sequence Number=SeqID_98330
atggcgaagatatatgaagataagtggatgtatgatagtgtaatgtctgaagaagttgatatgaatgaccaaaatgaagacgaagctggtgtgaatgaagaacatgttaattgttctgatgcgttcaatacttctcaagtattaatatga

SEQ ID NO: 6646 - DNA, 321 bp, Glycine max
  Peptide Sequence Number=SeqID_98331
atgacgaggtcgaagactaagaggatgaaacaagcattacaaggcttgattataattctaaatatcaaagagaaagaagaccaatctttaaacttgagattggatattttacaatctccattcagatctagaagtcatagaaaatcaacttcagaagaagaagaagaagaggaggaggaagagtatttagatgcaagaagtcatggaagaaggcgaagaggcaaaccaaaaagagacaatcatttggggagcattaagatgacaatccctacatatcaaggtaaaaatgatcttgagttgtatttggagtggaagagatag

SEQ ID NO: 6647 - DNA, 470 bp, Glycine max
  Peptide Sequence Number=SeqID_98332
atgactagaggcaatccatctaacttacaaccctttgatcctgagatagataggacatttcataaattagttaggcatcatcttgtaccttttgagcattctgttattggtgattttgagcattataattttgaacagtctgattttgaacattctgagaacatggcacaacctccaccccgtgagaggactctaagggaaatggctgcacctgattttacctacaaaagcttgtgcatccaataccctgatgaggatgtcccatatgttcttaaagcaggactgatacatttgcttccaaagtttcatggccttgcaggtgaagacccgcacaaacatctgaaagaattccatattgtctactccaccatgaaatccccagatgtccaggaggatcacatatttctgaaggcttttcctcattctttagagggagtgacaaaggactggctatattaccttactccaag

SEQ ID NO: 6648 - DNA, 309 bp, Glycine max
  Peptide Sequence Number=SeqID_98333
atggttacgtcgcttacctcaatggtggacggtgacgacgctccctcgacggtggacggtggtgttgctcttcacggaaacctcctcaatgcacctcacaacctcttcacggcaaggtcctcttcacggcaacaatggtttgtggctgaagaagaagaacaacctttcccgacaatggtgacaaatggagacaccggtgagggatggtggtgggtggtgggtggtggatctgcaccagagatgggtggtggtggttttgggatagtgttcaattgcgtcgatgactggaagttgaatgcagcaaggtga

SEQ ID NO: 6649 - DNA, 507 bp, Glycine max
  Peptide Sequence Number=SeqID_98334
atggcattcttgggagagacaagcagtcagacagttgtgaactccacattaggttttatttttccaactgaatccattgtttacaatgacagtggtgtttcctttcaagcttccaccccagttcccattcgagtacctaacgggtgtgattttcaaacgttaaaaaccataatacacaatacccttaagctaaccgacaaacaatttttggatgaaatttactaccggcaacctttcacgtatgcagctactatgacccctacttatgatgccctgctatattacaatgggaggtggaacatgtcacgcaaaaatgagtttgttggttactcgttcataggaaaaaatcccaaaaagtttgacattcccattggatgtaccatggatgaactgaaggatttgatcaagcaagttgtgcctcctgggatttccctttatggtattgatgaaacacaaatggtaaggcgattgttttttcggaaaccaagtctccataagtattcataa

SEQ ID NO: 6650 - DNA, 954 bp, Glycine max
  Peptide Sequence Number=SeqID_98335
atgcccttgcggggtaggattgcatcaccaacctcctatgacactaggcagcagacctgggaggtcacatcgtccaggctaagcttcatctacgcgcgctcatcttcatcctttgcttctttcattcatttcgcagttttttgtgttgaaagtttaatggcaaatggattgtttcgaaggttgatatcgatagctgaaataaatgacaaaaaggaaacttggaagattgttgttcaagtgattaacatgtggaccataccaagatcgcctaagtgtattgttgagctaattttagttgacaagaagggtgataaaattctagcacaaatgaggaatgttgatgctcaactcaacaattatgggctcgaaatctaccctaaggctcatgagaaccctagggcctttccttgcatctctagcccaatctacttggagtcttctagccaatgcccttgcgggaactcaaggtcaccttccccatggaaagctcagtcgagatcgaggtctaggtctaggttaagatttggatcgaggtctaggcctagacaaaggccaagatcgtgttctagaagtcgtggcaggtctttacttcttcaggtcaaggtcaccaattcatggaaggaaaacatctccatcgagaaagaaaccccagttttctacccatcggactacttgcacaaaggctaccctcatctcaggagcaatatttacaagaattcttcaacattttggtgcattagcagtatattgacaacacaacaaaggagagacacctccatgaaggaggtgcagtcccagacgccactggatgcaggcctggtgacgctaggccgtcacactcataggatcgcggtgatggtggcgacagcacggcagcgcgacgtagcctcgccgaagttggccaaaagaaaaaaacataatgaaaatgaggaagatgacgacgaaaacatttga

SEQ ID NO: 6651 - DNA, 261 bp, Glycine max
  Peptide Sequence Number=SeqID_98336
atggatacgacagcttctcccgaaaacctccgcacttgttcagctgccggcggtgacggtgaggtttgtggtgagagggacgccggtgaggtctatggaagtgagttcaagagcagggttgggttcgggagagagtttttgaagcttaggagttgcagagtgggaaccgaagaagaagatgcagaacacaccaagaggaagaagaggagcaaaagagagcttctgtatagagctttcattttctccagatatcgaaggtga

SEQ ID NO: 6652 - DNA, 459 bp, Glycine max
  Peptide Sequence Number=SeqID_98337
atggaagaattcactagcaccatctctttgaaccagacgatgaagttgagggaggctcaagctgtggaccaagtgctcttggacaaaattatgggtgttacccctgtcactaagtatcaccacctgttggtctgtgatatggcccaaaaggtgggtgatatctggaaaaccctcatcgtcatccgcgatcaagagaaataccttggaggcacatttgtggaagatggtttgagtggtgtgggtaacaatggaggaggggtcggagaaatggaagaggggccaaatgagatggttggtgaaggcaaaggaaaggaaaataggctaagaactgaattggccattgctcctcatccattggagccaggcaagagctctgtcttccatgaaggtgaagacgaagatggattggcggaagaggatgagggggaatggtggtacacatctgggctaggcatttga

SEQ ID NO: 6653 - DNA, 77 bp, Glycine max
  Peptide Sequence Number=SeqID_98338
atgggtgcagagaaacgcgaggaactggaaccagagaggcagcaggcaaaccgaggcaggatttcaggatctaaaag

SEQ ID NO: 6654 - DNA, 750 bp, Glycine max
  Peptide Sequence Number=SeqID_98339
atggcactgaatgtatccaaaatgtgcatggagacatgcctcttcttgcatcgtgtagctgtagtgatagctattgatccatctgattatcctccattggtgctccatgatcttcccctgaaattggtggttgcaaggaagcttttccctcattctcaagttgcttttcttatccccttctcattcaccattgaagcctccattaaagctccaaactttgctcaccatttctactccaaatcgcaaaaggaagccattttcggagtcgtgaagcacacctctacgttgtgggacttcaaatttcagttatttgtgaaggaatttgttgaaagcatgctaaacttgtcatgcttgataaaactggtagagatgatggggagagttaacctagggttgaatgtgagaatggtagtgatgatccaatttgagcaaaatcggatgagggcaagtgggatttcgaaatctgcccaatttgtgcagcaaaaagctgtcaaattttgtgcagcagaatttggctcttgtgcagaaaatgcttatgcattgttgcttggaggggttgatggggacccgatgctgagaggaacgaggataagggctacgtgggggtacgtgagctcagttgaaggtgggcaactggggatgagtggtacctggagatatgtcgcgggggtcaggagaccttggggacgtcaggtggggtgctattgcccaaaaccaagcttgaccaatcccgacccaacccaggcatag

SEQ ID NO: 6655 - DNA, 486 bp, Glycine max
  Peptide Sequence Number=SeqID_98340
atgacatcttcgtcgttatgcttatcaagtatacaaactaggtctggtccaattgatggtgacgtgttgtggatgcaacccaagcatgtttcagaacatgtttggaatggggaaccagacagaaaactacacatcaaacgagcagtcccgacgtatcaaggattcagaccacaggaaggcgaaattgaaggcagtgtcgtcaaattaagttggttggctcaccatttttctcacataaatattgatgagggtaacattgagcaattacaaaggtttacctgtgcgtggatccttcgattcataggaggtgtcctctttgttaacaaaagtagtagcagagtttccttaaggtacctacaattttacgtgactttgaacagtgcagtacgtatgcgaggggacctgccgtgcttgcgtatttatatagagagatgtgaagctccaccgattacaaagttaaatcaatcggaggtatgtgcatcttaa

SEQ ID NO: 6656 - DNA, 519 bp, Glycine max
  Peptide Sequence Number=SeqID_98341
tgctggatttacgagcactttcccttagttgcgaattccactgctgataaggaatacgacgaggattccctacgtgcgtgtagatggattgtgaagaagaagacaatgaagagcatacgtacaccggcttacagggagtgcctggaccgactccagattccggatgtttgttggatctcgtatggggagcaccgatcggtccgagacttccatgtcatatcatgctattccagtctcttgcactgggggcctgtggctgtttattaccgtccagagagggtcgtgcgacagtttggatacacacaaaccattcctgctcctcctatcgattcatgggtgtcgtatgatgatatacacgataggtggatgcactactcagatcatatcgttccagcaggtgaggtgtgcgctatgccaggtcagtgtgtcagtgactacatggactggttcttccgcatctcgcatcctttcatgccactaggccacgcatcagatcctctgcctaatggtcatgcctag

SEQ ID NO: 6657 - DNA, 756 bp, Glycine max
  Peptide Sequence Number=SeqID_98342
gcttatgggagggatgcgtttccattcatgtgggttgtgctgggttgtccacccttcttctatgtctattgttgcatgttcgaggttctaaacttgatccttccactgaactcctttcaatgtgccttgctaaggcgtctgaacgtggcaccttctcagcttcatcctaatagttgggaaatggtcagggcctttaaggtgtcgctcaatagcatgtccaagaagatgttcgagtttgactcaaacgtgtttctcaaatttaaggatcattttttcaaggtcaaggttggtcttgttggaaattatgtgtctcatctttccccctcattcttgaacctgctgctagggaaggaggtcaacctgaggctagagtcgaccctccttaagctttcgaagctggctaccgagtttatgtccgatttgggttgcctttcctctaccagcccttcgtgttcgccttcagatcctccaattgttcaagttgttgctgcaactgttgctgactctccagctcttccatctcctcatattcaagtggttcctgctcctccttctactgtgttgactgtgtcaacccccttagcaattcttgtttcaatttcacctacttctattgcaatattattgctaagtgctggtgtaacaacaaatgtcctaggacacttgtctcatccttctttagctttcccatctccagctctgactgtcttgcctttgacaatgccttcctcctctttgcatccaaatgtctcataa

SEQ ID NO: 6658 - DNA, 2532 bp, Glycine max
  Peptide Sequence Number=SeqID_98343
atgttggtggctagattgaccaaggaaatagttgaaacataccaaatatgcaatccacagtttaaatattctgaagatctaaatccaaaaagatttttgaccagcccgtctgttggagtgcttaatgatggctatgataatgtaaactcggatctgattttgacagtgaattttgtcttgatccatttagagaaaaataaaagatatattgtcaaagatctccttggccacgggacatttggacaagtggctaaatgctgggattcagataccaacagttttgttgctgtgaagatcattaaaaatcaacctgcatactatcaacaggcgctggttgaagtaactattttaacaacgttaaataagaagtatgatcctgaggataagcatcacattgttcgtatatatgattattttgtatatcaacgacatttgtgcatttgctttgaattgctggacacaaacttgtatgagcttatcaagatgaatcattttaggggattatcacttggtattgttcagctattctctaagcagattttatatggactggctctactaaaagaggctggcattattcattgtgatctgaagccagaaaacattcttttatgtacgagcactgtgaagccagcagaaataaaaatcattgactttggatcagcatgcatggaaaaccgcaccgtttactcttatattcagagagaggatgagagaaagagggatcatcatggagggagagcagatggcaaagtcaacgcccgtagctggagtgtacaacggagaagaaatagtgagaatgcggatggtaataacaccatagaggacgatggccaaccacatactcgtgacaacctgcaggaaggacaatggattcaagtgaagagtagaagaaaggcaccttcgaagatctttctagttatccgaagggctatagatgagctgaaagccccttaccaggccaccgcgagagtccgtgaaaaagacccatggaagattttccaggaatggggaaaagtgtgggaggtcttcataccacagaagaggaacaaacaaggccacaaatatggctttgtgcgtttcaaaggggtagaggatggagataggttggagagaatactcgataacaacatatacatacaggggattaagatgtttgttaacaagcctaaataccagaggggaggtaacagggtacataagtcaatcgcaggccttcataatagaacagatactagaccgccggagtctgacgcgcttgaactgaagagcaaccaagttcctatggccacgaagctgaaatcatacgtggatgtggtcaaaaatcgaaagaaggaaggggaggagaggcaaggacccacgtctgcaaatgggttaacagaggtgaatacagagcccataaatatccagacgaccaaggaaaaaacaaaatggctcgataaggcttgggtggggcatttaaaaaacaagggtattttcgacagggtggaggaggagcttcagggggtgttcggggtggaggtgaagaccgcgtattggggtcatgacatggtcattctctatgacctggaagaagaagcagttaatacgctcaatcacaaagaacaagtgcatggagggtctccattcttctccttacagagatggacgccggagatgatgccttcataccggctaacatggcttcgtatttggggggtgcccttgactgcttgggacgcagagaacctagcaagtatcgttttggtctgtggagaactcatcgagctcgatgcggcgacggaggacaggttgcgggttgacattgcgcgggtcctagttcggacgaacgacaaactgccaatagctcgtacggtggtggttaaggtggacggaatacaatactccctgtatgtgcgagaggagttggagtctaggtggggaagaggacaacgggtggaggaggaggaggaggaggatcggtttccgccgtcacctttttctacggccatagtagactccgacagtgagccaaacacccatggtccacaacgattttctcccggaagcatctctgtcagctctgtcggcgggtcgtccaccaggtcgcagtcgtgcatggtggagcgtcgccggagatggaggaactcaggaaactcccccaaccgtcatgggtatgagaccccgccaataaaccacttggcccaagaaaactgtaacccaggttgttataaggctgacattgtttcgtggactaaggacactgtgattaatcaaaaagaatatggggaggagatgttctttcagtccccagaattagttgggaggacccctaaacaagactgtccctcacaaagccctgccactaataacagcttcaataatagtgattttgagaatgaggaggatctccataggaagattgttagagagttgggtgtgtcctatgctgataaaaacacctgtaaggacaagatgaagcatgatgttattaacagtagcattttccctcaatcagcagtagtgatgggaatggagcagaatgacccatga

SEQ ID NO: 6659 - DNA, 567 bp, Glycine max
  Peptide Sequence Number=SeqID_98344
atggccgaaggtggacaaccacctgattatgtactaagggatgccaaaaacacaagtaagttcttcaagtgtattgggagtctccagaacattgagagcagtgagagttctaaaaatggaagaagtgtttatcaaacattgacagtggaagaatatgaagctagagaattgaagaagccatcaattggaaaagagtattttaatcagttgaaccttgaagcaattgttacaaattatccctacagaaaaaacctacctaaagaagatattctcaaagaaagtcaaatacgactggctcttatagattttctgaaagggcttgttgaatttgatcctgcaaaacgctggtcaccctttcaggcttcaaaacacccttttgtaactggggaaccttttacacacccttacaagcctcctcctgagactcctcatatgggggagctaggaggccacaaggatagagtgatgttcaagaagagcttgttgcatcagactgatcagagcatgtttctgctttggtctctgattctgcaattttcattccactatccctctatcacccactag

SEQ ID NO: 6660 - DNA, 783 bp, Glycine max
  Peptide Sequence Number=SeqID_98345
atgcagcggtgttttgagttggacagtgttgcggtcttcggcgctagcagtaggtattgtttacccgtgaaagaagcaaaaggatccattgaggatgccgtgaagcagagggagagaagatcagtaggacgctggtcaaagatgtgtcaggtgacatgtgcccgaacttcacgtgccaggaccctgcatggggccgtgttttgcgctggttgcgcaaatggacaatgtcacggtctgcgccgatggcgacaacggtgttttgagttggctgcacacatggacagtgtgacggtcttcagcgataggcaacaacgatcgaaggtgagagctccaaagaaaaggtgttgggaagtctgccaaaagagggcaaacgagtcccaaaatggcccgaaactgactgggctttgtgcacctcagtcactaaacgaaaagctcgtcagagctccggctgcagcttctggaagaggagaaaaatcgccagaaggacagcgacataaaagttcactagaacgcggaaacaggtcaccggaagatgggaagacgagcagaaaggtccaccggaatgtgaaaatagataagaatgttgtaaataaggctacaagtagtgctacttcttttgcaacattgcactctaggcttggtcaccctagtgttcctgctatgaaaattgtatttcgactttgtaatattccaaatattaataaagaaccaacagatttttgtaataactgttgtattggaaagtcatatagacttccttcttctctttctcatactgtctag

SEQ ID NO: 6661 - DNA, 222 bp, Glycine max
  Peptide Sequence Number=SeqID_98346
atggatggggtcgcacgtgcggtggagcaggctcagtcatcatcgggcttggcctcggggtggcgtccccgcggctccgtgttctctccttgtaagcctaagggcgaagaagaagcttctgctgctgctgggaagaagccgcagcaaccgttgcacgtggttgtgaggaaaccttgttgttggattctcgtcgtcttcgttcttcaccatggcaacagctaa

SEQ ID NO: 6662 - DNA, 273 bp, Glycine max
  Peptide Sequence Number=SeqID_98347
atggcaagagttggtgatggtggtggtgattatcatcagctggacggatctcagcgtttgttattgaatgtaatgacaacacaaatgcaacaattgctaaaccaggggcaggacagaattgagggagtaaaactcaatgtaccccctttcaaaggcaggagtgacccagacgcctaccttgattgggagataaagattcagcatgcattctcctgcaatgattatcctgaagaacagaaggtgaagttagtagcagctacattctcagactaa

SEQ ID NO: 6663 - DNA, 252 bp, Glycine max
  Peptide Sequence Number=SeqID_98348
atggggaaaggaggctcacggcggagccttccggaagaacattttccggaaagtttccggaagaagtgttcttccggaagtcaacgtcttccggaagaacacttcttccggaagactcccagaaaacctcttctgggaactttccggaagaagtggttcatccggaagaattccggaagacgcgctcttccgaaagaactttcaaatttccggaagacctttccggaagaagttccggaagtgattttatga

SEQ ID NO: 6664 - DNA, 174 bp, Glycine max
  Peptide Sequence Number=SeqID_98349
atgtggaccactacgggggaggtggttgccgcccagctcgcccaggcgagccaggttgcttcctccagaagcaaccgccttctggaggaatattctggagggcccaagtgggcctgggtgctatttgcacccccatttttactaagtacacccccttctgctgttttttggtga

SEQ ID NO: 6665 - DNA, 153 bp, Glycine max
  Peptide Sequence Number=SeqID_98350
atgagtctcaaagctttattcaagacaaaggtattaaagatattcaagatggatgatcaagacagtcttgagagtctcaatagagaggaacttgtaaaaggaatttacaagatagtgaaactctcaagcgggttgcttggggactggacgtag

SEQ ID NO: 6666 - DNA, 336 bp, Glycine max
  Peptide Sequence Number=SeqID_98351
atgtaccctcccttgttctctttgaacctagtggatgtaccctccactagaactgatccacaagagatgtaccctctcttgttctcagtcaaacccaaggagaagggagacacaaaagaattcaggctgttagtcctttgttcttttggaaaagagagaagagagacacaaaaagaattcaagcggttagtccttggcgaattctctttggcaaagggagaagggaatgaagaactttggaaaaaccagaaaactttggaaagcttttggcaaaaggaagaagaagaagaagttcaaagagacttagaaatcaatgtggaaaacttgcttgtgtaa

SEQ ID NO: 6667 - DNA, 474 bp, Glycine max
  Peptide Sequence Number=SeqID_98352
atgggtgaagtagacgaggtgcaagagcagatgaaggccgacatggaggccatgaaagagcaaatggccacaatgatggaggccatgatgagcatgaagaagataatggaggtcaatgcggctgcagttgccgctactaggggcaaagaattgggaagtacgggtggcccccactttgtccaagttcagaacaagcatgccttcccaccatatggcttgcctcctaactatacaccacccaatgtggcgcacactcccgatgtgaataactccactcccatagtcattgggagccaacaacctcaatctgatcatgcacatgtctctcaactcatgggggagacacatgaaataccccaccacaatctctccgacttcgagccttgcattggatatgccactgaggggcaagcagttagtgatgtacccttgccaaacactttggagagccctcagattcgctcacaaccataa

SEQ ID NO: 6668 - DNA, 132 bp, Glycine max
  Peptide Sequence Number=SeqID_98353
atggctaccattgcattattgagtagatacgagaatgtgcaacaggcgagccttgtggctgatttaggggtggcttttgtggttgattgggcgttcttggttgatagggtggtgggtaatgagaagggctga

SEQ ID NO: 6669 - DNA, 186 bp, Glycine max
  Peptide Sequence Number=SeqID_98354
atgacagaggactttgagtcctatgaaagacaaaagcgaggacttcgagtcctgtcaaagataaagatgaggactttgagtcctatgaaagataaagaatcccaacttaaaagtgaaattagtcattccttgatccgcatcggctttattgggcttgtaacgtggtcagggggaagagggctatga

SEQ ID NO: 6670 - DNA, 237 bp, Glycine max
  Peptide Sequence Number=SeqID_98355
atgagtttcgggctaaagggcttactgaagaagactatggggtgtccctactgtgaaaggacgacacccatgccaatacctgatgcattcgtctcaacggtgaatgggagcttgaagtctgggctctatggtggtagccttgaccatgggtgtggcaatggtggcataaccacagataaagcggcgatagaacccagcgaggcccagaaaacttcgaagggctttaatggaacatga

SEQ ID NO: 6671 - DNA, 300 bp, Glycine max
  Peptide Sequence Number=SeqID_98356
atggccattgttcaggacctggtgattgccaataggaagaagaggctcattatttgtagaatcaagccagacctcaaaagagctttcaaggaaactatcaaggctacaaaggaggctcaggataatggtgagaaaaagaataaagaaggagttgaaaaagaaaaagagaaaaatgatgaagtggtaactagtgaaaaagttaaagagaaagtgggacaaacctatctttcaggaggaggaagagcagagaaggatgaagacatgagaaatcctgttgattatgtcattggaggagactga

SEQ ID NO: 6672 - DNA, 156 bp, Glycine max
  Peptide Sequence Number=SeqID_98357
atgaatgacgaaggatgtgatccatggtctgcagcacctggctccactttctcactcttgcttctctactgcgagattcatctaaaaaaagggaagaagttgccagaccaactcgcccaggcaagctgcactcaccctgacgagttgcttgcttaa

SEQ ID NO: 6673 - DNA, 702 bp, Glycine max
  Peptide Sequence Number=SeqID_98358
atggagaatcaaggttgtcatcatcaaaaagggggatattgtaggagcaagcttcatgatgatgaatcaagattgattcaaggtacatcctttgtggtacaagtagagggtacatctacttgggttgttgtaactgagaacaagagaggatacatctcttgtggatcagttcaagtggagggtacatccacttggttgttacaaagagaacaagggagagtacatcccttgtggatctttgcttgtaaaggattttacaaggttgaaaagaaatctcaaggaccgcaggtcgcttggggactggatcgacaaaggtatactgaaggaggattttcaggcttccttcagggtccttataatcaacaaggacaatggaggtcacaccctggaaatcagttcaacaaagaccagggtggaccttcgaacaggccaatccaacaagggcctaacatctttcagaggactactaagctggaggagactttgactcagtttatgcaggtaacaatgtcaaatcataaaagcactgagtcagcactaaagaaccttgaggtccaggtgggacaactggccaagcagatagctgacaagtcatccaacagttttgtggcaaatacagaaaagaatcccaaggaggaatgcaaagctgtgatgacaaggagtaagaggtttaggaggctgaggatgaggagagtgttgtga

SEQ ID NO: 6674 - DNA, 1530 bp, Glycine max
  Peptide Sequence Number=SeqID_98359
atggcgaacgctttcgatcctcctgctcctttgtctccacccactcaaatggtttatgcaccttcttcctctacaccagccacatcttcattccctctgccatgcttgctcctacattttccattgcaccgccactacgataggtgtcttaacgagcatgcctcctcctccctccatttttccaccttcagctcctactatcccatcttcggccacgccttcttcctcttcacttccaaacatttaattggactaggtatatccttctcgagaggcaaattcattaaggagtataggtggaagctgccaagtggagggccactaccaggacagtgtggcgagtggagcgccctaaggttcaaccatcagttgcctttgctgaagtgccctaagtgtggcgagtgggctaccgttgcctttgctgaagccatcgggttcaaccatcagttgttgtctagggtcgacaatgtttttgccaagtcagtgagcacaaaactggacaacgacgaggtattcagacgttataaagatgtattaaaagaaaagaatgacttggcagctaaggtggagtgctctgctgaggagaaagaagcacttaatacgatggtggcagaatctgctaagttgattgtggatcttcaagcccagctgagggattcggagctcactgcgtccaacctccaagctaagccgaaggagttcgagctcaaagtagtgaatgagaagaaaggaaataaggagcttgaggatgagctcctcacgtttaagaaagaggctatgaagcaacacaagaaaaaagacaggaaattgcttgacgaggatgagatagccaccatggaggtgtctgatggagaggagggtaaatgggttgatacttggcctcatcgtggaacactgggggtggttctttgtgttaagtattgcactgccatgcttgatggtcatctcgggtttgattttaacctggttgaaggtcttgccatggtagactctcatgatattgcacttatctcaggaacaataatcatgagtgcccactggtgcattgggtataacacgttacattggccaagtgttagattaatctggaccttgactaggaacatcatggttttaagtgaagaagtttaccaaaagatggaccttggctttgtcgagcctttggagattcgacagggacacatttgtcctgggtttggtgacactcaccaaagacgaaccttgggtttgacgagcctttggagatttgaccaggaacatatttgtcctgggtttggtgagactcaccaaggacagacctttggtttgaagagcctttggagattcgaccaagaacatgtttgtcttgggtttggtgagactcaccaaggacagatcttgagtttaacgagcctttggagatttgaccagggacatgtttgtcctgggtttggtgagactcaccaaggacgaaccttgggtttggtgagccttcagagatttgacctggagcacgtttgtcctgggtttagtgagacttaccaaggatga

SEQ ID NO: 6675 - DNA, 525 bp, Glycine max
  Peptide Sequence Number=SeqID_98360
atggcaaagagatttgagattttcttgtccaatttgaattatatcattgagtttaatgctaaaagaagctccccttctggctaccttcttggtctaaacaattttgctgattggagccctagtgagttccaagaaatctacttacatagccttgatatgcctacagatagtgctcctaagctgaatggccctcttttatcatgtattgctcctgcatcgttagattggaggaataaagtagctgttactgcaattaagaatcaagggagttgtgctgctggagccatagaaggaatacatgctataactacaggggagcttatcagcctttctgaacaagagcttgtgaactgtgaccgtgtaagcaaaggttgtaatggaggatgggtgaataaagcatttgattgggttataagcaatggagggattactttggaagcagaatatccttataccggaaaagatggtggaaactgcaattctgacaaggttttgcttctatcaactccttgttcctttccataa

SEQ ID NO: 6676 - DNA, 465 bp, Glycine max
  Peptide Sequence Number=SeqID_98361
atggaaaccatattagggcgatttgaagaccttgatgtttttggcaaagttactctaaagagtaaactctgggaaattgcctaccctaatctaaactctatgtgtcctcctccagaaaaggtaaacaccaaaggtgctcagaagaaaccaatgaccatacatcaaagatcaacaaagcgtgattcgtcttattgggagtatgttgatgctttacattacatgcaaaatagtaattcttcagtcaaacgtagtgtgccatcgtctgaccaagcaattccaagaagaactatgccgatgttggatcaatttcattcgttcattcatgattccattaaaaaatttatcgatgtcaaagctgacggtaactgtggatatcgtgcaattgttgccttattaggtgatgtagctccattggagcttgtaggccttggatcttctttatcaatggattcctttgcttcttga

SEQ ID NO: 6677 - DNA, 587 bp, Glycine max
  Peptide Sequence Number=SeqID_98362
atggacgaaaatcaatggatgtataacaatataatgtctgaagaagttgatatgaatgaacaaaaagaaatcgaagctggtgtgaataaagaacatgttgattgttctgatgcgcttaatacttctcaggtgtttgctacccgagatgatattctacattgggctcgatgtgttgcttatgaaattgaatttgtggcagtgattatgaggagtactgacaatagaaaatgtgggtgtccatttaagcttcgtgagaaaccagtggttggaggacaaagatggatggtgaatgatactaaatggcaacaactaatgaagcttcttgaacaggatcagtatattcattggcataaattaaaggatgaagaatttgtacgtgatatcttcaagtgtcatcttgatgcagtgagacaagatgctctccctggagttattattatcgacagagacctaacattgatgaatgcagtgaaaactatattccctaagtgtaccaacttgttgtgtagtttggttgattgtcctttcgaggatcggttcgatgattaccttaagaagtttgaaattgcttattcaccatggccaat

SEQ ID NO: 6678 - DNA, 690 bp, Glycine max
  Peptide Sequence Number=SeqID_98363
atggcagcggaatggaaaaggaagagagagaggagatgccacttcaaggagaagatgagtctagaagaagctcaccaccataggaggtcatggataagagcttggaggaagaaggagatgaatgaagggagaggaagagaagagcacggaattttgtgctctaaaagagttctgaaatctgaaaatcctaggaccttcttcagcaactctatcccaatcctcttggagcctcttgctcatggctctagtgactgtgctttggatgatctgaataaggattccttggacgcacttttgaacaatgacttcgatgaggattacttggacaatggttccaacaagttcttcaagggacatgaaattggtcttagagcttcgattgaagcacaattctgcatctgtttcgtggtagatcaagtcatcaatgatcaaccattctgctttttatctgtttgtgttgcatcttcaagattctatgaagatgatggtcaacaaataaaaattgagaaattcacaaggaataatagctttagcctttggcgcatcaagatgcaagcattgttgaaagaatatggcatatgggcttctctctctggtacgccattgaaggaacatattaatgagctaaactctactctaatggagctatgcgacattgatgtcaagatggaagatgaagattggaattga

SEQ ID NO: 6679 - DNA, 894 bp, Glycine max
  Peptide Sequence Number=SeqID_98364
atggaaattgtgggtgagaatattagctctccaaaaggccagtccaagacgttattctacttgttccctaagcaactgcaagttgagtatgccctcgaagccgtccgcaagggcaatgccgccgtcggtgtccgcagcaccaacaatgttgtcctcggcatcgagaagaaatccaccgccaaactccaagactctaggaagatagtgaatctagacaaccacattatgctggcatgcgcggagctgaaggccgacacacgtgtgctcataaacaaggcacgtgtggagtgccagagtcacaggctcactgtgtggagtacgaggctgattgctatggatccattaacatctggagactatccaaaaaacgatatgctgaatgctcctagaactaaaattgggctgaagagaatgggagaacttgatcataaggtttttgtgaataactgcaagaaaagatttcctcttgaagaagctgggaccaaaggtgtcgagctttgttctttgtggcaggaaaatgtgaagaattcagcttggcatccatttaaagtggtcacaattgatgataaagcagagcccaggattgatgataaacacccaagatggttacatctgcggatccgaccatcttctttacctgttctggatcctgccaagttcaaccaccccaggaaattaaagacaaaagcttttgtcgatggaagatggacattggcgttcagggatgaggagtcttgtaagtctgctttatccatgattcttgaagagattaattttctgagtgacgaggttcatagaagactaaagcctttgctcaaccttgaaaccgcgttggatttatcaggcccagaggaggattcctctacactttcaacatctcccaattcggtgtaa

SEQ ID NO: 6680 - DNA, 128 bp, Glycine max
  Peptide Sequence Number=SeqID_98365
ctagcacaaggagaaaagagtggtccaggtcttgaagcttcaaaggatgagaaggctcaagaaaatggaggagaaactccacggtccagcagcaccaagaaagaaagaagaccaaaaagaaaaggaag

SEQ ID NO: 6681 - DNA, 432 bp, Glycine max
  Peptide Sequence Number=SeqID_98366
atgtctttatccactataaaggccgagtacatggctccagcaaaaagaagcaaaggaaagaatttggttgaaggaaatggggtagggattattgtggacaaggagtggaagaaggatgtcgtagatgtaagaagagtaggagatcgtatcatagccttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaagaggggatctcaatggacatgtaggtagcgtggatagagttttgagggggtgcatgggtttttgcctaggggagatgaatggggaggtaatccatcttggagttttcgaggctttgatctttctatag

SEQ ID NO: 6682 - DNA, 237 bp, Glycine max
  Peptide Sequence Number=SeqID_98367
atggtcgggagagtactaggtcgtggtcgcgagggtactaggccgtggtcaagtcaaatacctaaggtttcttcttgcctaagagggttgaagaccaaggttgggaaagtattaggttgtggtagagccaaatacctaagtgatgacagtggtgacgacggtggtcatgacagtgatcacaatagtggcagtggcgacaatggtggtaattatgatagcaatcttgatgtaaattaa

SEQ ID NO: 6683 - DNA, 513 bp, Glycine max
  Peptide Sequence Number=SeqID_98368
atgcagattttgttgctgggagtgaagattctaatgcctattcagcaaattctctctttctcatatgaaatccttcaagtacgctggtgtggttctattcctcttaggcctgttccttactgtttgtaccccctgtctgttagtctttgtgttgcatccctgattgctatcactccatgtcgcttgcggaaacaccttgtcctcaaggtggtagttagcacggagttggtcccaatcctcccaagaagtatcgtcagggcacagaccatcccattggaccaagacctcccattttggtgtagaagagtccgacaagcatttggaatccacaatggccagaggagtaataagaggttgattatctatggcggtggccgacagagagacaccgatgttggggttgtcgcgaggcctggaagcaatggggtcgcaattgccgacaagggccgcgggggcggcacgacaagggctggaaggcttggacctcctagcggatctccagagtcaacctag

SEQ ID NO: 6684 - DNA, 492 bp, Glycine max
  Peptide Sequence Number=SeqID_98369
atgtcggtggtgattgttgcggtgattgattcgattgttaacggagatacgtctgaggggttgtttgtttgtgatgttgaaacttttgaatatcttgttaatatggacgaaaatcaatggatgtatgacaatataatgtctgaagaaattgatatgaatgaaaaaaatgaaaacgaagctggtgtgaatgaagaacctgttgattgttctgatgcgtttaatacttcccgggtgtttgctacccaagatgatgttttgcagtgggctcgatcagttgcttatgaaattgaatttgaagcggtgacggtgattatgaggtcatacccaaacactggtatgagaggaaggactttattcttgttaattggttgtgaaaggagtgatcagtataggtgtaggaagaaagaatttatcagaagaaatactggcagttggaaatgtaggtgttcctttaagcttcgtgagaaacaagtggttgtaggccaaggatga

SEQ ID NO: 6685 - DNA, 708 bp, Glycine max
  Peptide Sequence Number=SeqID_98370
atggaaagtagtatagttgatgctacagttgcttcaagaaaatgtagaagagatgaagaggaggaagaagaacttgaacaagcatttttcattattgttagttttgccactatgcttgtgggtgcaatgacttggtatcacgacaagtactttgttaaggaaactgcccgaaaattggaattagaaaggcatagtttcctaatcgtctattcaggggaacaaaaactggtttatatgtgttgcctgggtgggaaaggtcagcaagagattctcgagtattgcaagatgctttgcatcgtcaaaactgtctccatattccaaatgagaaatggaatcaagcaatgtgaagaacatgtcaagtggaaaaaagaaagatgtctaggagaggacacaagaagttacttcgcatggaatttggaaatggagagtgtgctgactaatgtgcttagagatcaaagcaatttgggcaataaaggtggatttggctgggatagcacaaagtacatgattattgttgaaaatgaaattgcatggaatacatatgttaaggccaaacgatttcgattcaaagtcattcctaattgggatgatgttgtagacctatgtgcaaaggatagatctactggactcggagcaaaaaatgcattatatacagatgatatcatgagcaaagaagcaaatgaagaggaagcaattcacaatgaatga

SEQ ID NO: 6686 - DNA, 480 bp, Glycine max
  Peptide Sequence Number=SeqID_98371
atggcggcgcagctaatccgtgatcgagtagagatggagtgcctagagggagcttgggagaccctcgaaggcaacacgaggtgccgatttcggggcactattcgattcacggctacttctttggtgcatccagatgaacctgcacggacgcttcagcgcactgtggagtggatactacccacgcctacaccatatcgtctagtggagcccgtccaagtgatcgaggtaacgtcatccgaggaagaccccgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagacggcgatcagcggaggctcttcatcctatgaggattttccttctaaacctagttatggtgaaaagagaaagaaatga

SEQ ID NO: 6687 - DNA, 519 bp, Glycine max
  Peptide Sequence Number=SeqID_98372
atggtcaagtttggctacaattccatcaagaaggctcaagccaagaaggctgcaaaagcaaagactatgaaggttcaggccgacaaggccaaggttcctcctccccctcccatcagcctaggtgttgttgagagggccaatccgggtcctcaagatgaagggccttcaaaaaggctaagagtggagctggggaaagatttcaatcctagtgccctcatccagtcttccataacttgggggattgctgatttatgggctaaagagtttgagaaagttaatgttgagtccgaaaaggctcaagttgagtgtgccaaggccaaattcggagacaaagttaaaggaggtcgagaccaaagaggaggcattaaagaccaagtgggtgttgagaatgttgaggaaaagttaaagagtgatctcggtgaggttgagtccaagatcctaaggactcacaaattcaattttaagaaggcgctatgtcaggcctgggacctggcctatcgaatagggtcctctgattaa

SEQ ID NO: 6688 - DNA, 321 bp, Glycine max
  Peptide Sequence Number=SeqID_98373
atgaacaatgttttgaagatcttacctaagcatttgaagtatgtgttcttagaagataatgaggcaagtccagtggtcattagtaactccttgactaatgaggaggagtctcggctagtagaagttttgaagaagcataatgatgtagctctatgtggagcttgtaggccttggatcttcttcatcaatggagtcttttgctccttaaagatcatggcatcggaatggagatggaagaaagatgattggagatgccacttcaaggagaagatgagtcaagaagaagctcaccaccatagtaagccatggataagagcttga

SEQ ID NO: 6689 - DNA, 117 bp, Glycine max
  Peptide Sequence Number=SeqID_98374
atgactacctccacttactgtctagtggggggattctttagaggatcaggcaacgtagggaagctttgttccccatggtcgtcaggatatcctaaacataactattggcaaacctaa

SEQ ID NO: 6690 - DNA, 219 bp, Glycine max
  Peptide Sequence Number=SeqID_98375
atggcagtggtgcgacacaccttcgccaacccaaacccggtgaagatgagaaggctagcacgagcaccttcgagagctgattcaggatcagaacctaggctagggcaagtgattgagaagacgtgttttgaaaagatgaagttcccaactgaggatttagccttccattgtgaggaagctcctttttacaagttcaaagaagagaagaagagaaattga

SEQ ID NO: 6691 - DNA, 207 bp, Glycine max
  Peptide Sequence Number=SeqID_98376
atggcttccaaatcggcatttagtattagctcacaagtgcttaacaaatatcgaattaggcttcttggtgataatgtgcaagccttgatatgtactaaaaattggttactaagatatgatgagcaaggaaaagaatatgaagatgtggagatggagaaagctcaagctaattcaaatatggaatcatttattgttggagatgtttaa

SEQ ID NO: 6692 - DNA, 1422 bp, Glycine max
  Peptide Sequence Number=SeqID_98377
atggggatgttcagtggtgccgagtatgtgcctattggtaatgatgagttaccttctccaagagaaaatcacatgaggagagtttctgttcttcctctggtatttctcatcttctatgaggtttctgggggaccctttggtgttgaggacacagtgcatgcagcaggtcctctattagcccttatggggttcttggttttcccattcatatggagtgttcctgaggctctgatcactgcagagatgagcaccatgttccctgagaacagtggctatgtggtttgggtctcttctgctttgggtccctattgggggtttcagcaaggttggatgaaatggctaagtggggtgattgacaatgctttgtatccagttctgtttcttgactatttgaaatcaggtatccctgcattgggtggtggggttcccagaactgtttcaacttgggccttaactgtggctctcacttgcttgaactataggggtttaaccattgtgggaatggttgcagttctgttaggtgttttctcactccttccttttgttgtcatgggactcttgtcaattccagacctgaaaccttcaagatggtgtgtgatgaatctggatgatgttgattggaatctgtatttgaatactttgttttggaacctcaattattgggactctattagtactcttgctggggaagtggataatccaaggagaactcttcccaaggctctattttatgctttgatccttgtggttttgggctattttttccctcttttgattggcactggtgctgttcctctcaatagggacttgtggactgatgggtacttctcaattattgctgagattgttggaggagtgtggttgaggtggtggcttcaagctgctgctgcaatgtctaacatgggaatgtttgttgctgaaatgagcagtgactcattccagcttctagggatggcagagaggggcatgctacccgagttcttcagcaagaggtcccgtttcggaacccctcttgtaggaatactcttttcggcctctggtgtgatcttactgtcatggctgagttttcaggagattgtggctgctgaaaacttcttgtactgctttggcatgattttggagtttgttgcattcatattgttgaggatcagacaccccaatgcgtctaggccttacaaggttccagggggaacagctggagcaattactatctgcattcctcccacagttttgatttttgtggtgctcgctttctcctccaacaaagtgctggttataagcctcatcgctatggcgattggccttgtaatgcaaccatgtcttaaaattatggaggaaaggagatggatgaagttctctgttagatctgagctccaggatcttgacaataatgaggagagcattcactcttttgtgggttaa

SEQ ID NO: 6693 - DNA, 2250 bp, Glycine max
  Peptide Sequence Number=SeqID_98378
atggctttgattaactggttgtctatggaaaaggctttatcgaaagagacaaaatctacttcgtccggtaagaacgagcgtgtgacgattcgcgagttctgcgcgaatggaagttgcatggaagcgaaggaacttgaggccaagcttgatgaaggaaatattcaagaagcagaatcggcattgcgtgaagggttgtcactaaattttgaggaagcaagggctcttcttggaaagttagagtatcagagaggtaatgttgaaggtgcacttcgtgtgtttgatgggattgatcttgaagcagccatacagcgattgcaaagttccctttctgaaaaaacacctgttaagaaaggccccactcgcagtgaatcaccttcctccgtctctcagcatgctgcaactttggtgcttgaagccatctacttgaaagccaagtctctacaaaaactggacaaatttactgaagctgctaaagaatgcaagcgtgttcttgatgccgttgagaagatatttggtcagggtatacctgatacacaagtggacaacaaattgcaggagatagtcagccatgcagtagagctccttccagagctttggaaacagactggttgctataatgaggcattgtctgcttataggaatgcccttcttagtcaatggaaccttgataatgattgctgtgcaagaattcagatggcatttgctgtgtttatgctgtacagtggggtggaggcaagtccacctagtttagccgttcagattgatgggtcctatgtacccaaaaataatctggaagaggcaattctgcttctaatgattcttttgagaaagtttagccttggtaagataaattgggatccttctattatggaacacctgacttttgcactttcagcatgtggtcaaacttctattttggcaaagcaatttgaagagttggcacctggtgtatatcaccgtattgaccgatggaattttttagctctatgtaatagtggagctggagaaaatgaaagtgctttgaatctgctaaggatgtcattgcataaacatgaaagaccagatgaccttatatcattattattggctgcgaagatttgcagtgaggatcctcatcatgctgctgagggagcaggatatgcacagagagcaatcaatattgctcagggcttagatgggcatttgaaaggtgtgggtcttcggatgttggggctttgcctgggaaaacaagctaaggtttcttcttccgactttgagaggtctatgcttcaatccaaagctctgcaatcattggaggaggcagttagactggagcaaaacaattatgatctaatttttgagctggctattcaatatgctgagcaccgaaatttaactgctgctttatcctgtgccaagcagttctttgacaaaactggtggctctaaattaaaaggttggagattgcttgctctggttttgtctgcacaaaaaagattttcagaggctgaagtggtgactgatgctgctttagatgagactgcaaaatgggagcaggggccactactcaggctgaaagccaagctgaagatctcccaattacgacccatggatgctattgaaatttaccgttaccttcttgcattggttcaagcccagaggaaatcgtctgggcctctcaaacttagttcacaggatcatggattcaatcccttgcctgcaaaactcttacctaaggggatttggagtgcacttatggatgtgatcattggtgaaagggatgttagcttgtttggatttgcgattgtttcccaagtccttgcatcaaactcccatgtccaagcaagtggtggaagagcacaagctggaatgaggcaaaaattaagaattatctgctttcatggctgtacctcatcattgacattttatattttgcaatatgttgtaccaggtattatgttcgatggtcgtggagaatatcaagaagctcttattggtactttcaatgcggtcctatttgaaccaaactatgtgccaagcaagatcttgatggcttctttgatactgaaaatgggttttaaagcttcacctgttgctagaagcttactttctgatgcacttagaatagaacccactaaccgtatggcttggtattacttgggattaactcacaaggctgacggccgattagtggatgctgcagattgcttccaggcagcttccatgcttgaagaatccgatcccattgaaaatttcagctgtatgctttga

SEQ ID NO: 6694 - DNA, 390 bp, Glycine max
  Peptide Sequence Number=SeqID_98379
atggcggaaaggcgtggcggttttttgaaaaaacgccaccgaatagcggtggcgtggcgggtttcgaatggcggccgccatagccatgacggtcatggcgtaggtgttgggctgacagtgatgaccccacggcggcaacaagcaccggcacgaagggcggcgatgagcaccggcacgaagggtggcgacgagcaccggcatgaagggcggcgacaagcaccggcacgaacggcggtgacaacgcgcacgaagcagtttcgcacttccgggaccgattggccttgtgcgaggtcaccctttctaaggtgcaaattctctcgaatcagatcttcctttcgaagatcttgggcggaaggcgccgacgatgagtcagccgaaggttcggaatga

SEQ ID NO: 6695 - DNA, 501 bp, Glycine max
  Peptide Sequence Number=SeqID_98380
atgcaccttgaagcagagaatgaatttgatgaatcaatcacaaaatcacatgctaagcaaatggtgaatgaagctaacttgaagaaaaatgcttatgactggctacaaaatctcacacaaggtagcaagagtcttgaagagtaccataaagaggggataatgactatgaggagagccaatgcacaagagcctaaaacttccatggcaaggacaagtccaagaaggagggatcttcccccacctaagcaacaaggttcaaagtctccaagtggtaaacatgttcctaaccctagcgcttcttctacttctcggagtagttcaattaaatgctttaaatgcttgggtcaaggtcatattgcattacactgtccaaacaagaaaaccaaagttttgagggacaatgagattgtcactagtaagttttcttttattagttcatctaatatctctagtgataatgatagtggatgtggtaccagatctctagatgatggatattga

SEQ ID NO: 6696 - DNA, 1797 bp, Glycine max
  Peptide Sequence Number=SeqID_98381
atgaacaataaagatggaaaaccagtcacccagccagacaaaagcaggattgtctctatggcaatcatatttgtggtgctgtgtggattttctttctatatgggtataatcttttgttccgagaaggacagatttgtgacaatgtacaaccagaactccattgaatcccccaaggagtcatcaataagttctctgcaaattaaatacaccagttttcctgaatgcagcgctgactatcaagattacactccatgcacagatccaaggagatggaggaagtatggctcgtatcggcttaagttgttggaacgtcattgccctccaaaatttgagaggaaagaatgcttagttcctccccctgatgggtataagcctccaattagatggccaaagagcagagatgaatgttggtataggaatgttccgtacgactggattaacaagcagaagtctaatcagcattggttgaaaaaggaaggggagaaattcatctttccgggtgggggtactatgttccccaatggtgttggtaaatatgttaatttaatggaagatctgatcccagaaatgaaagatgggtccattcgaactgccattgatactggttgtggagttgctagctggggtggtgacttgctagatcgtgggattctaactctttctcttgcaccaagagataaccatgaagctcaggttcaatttgctctggagcgtggtatccctgcaattctcggtgtcatttctacacagagacttccattcccatcaagctcctttgatatggctcattgctccagatgccttatcccatggacagaatatggtggagtttatctccttgaaattcaccggattcttcgccccggaggattttgggtcttgtctggtccaccgatcaattatgagcgcaggtggcgtggatggaacacaactattgaagcacaaaaatcagattatgagaagttgaaggaattgctgacttcattgtgctttaaaatgtacaagaaaaagggtgacattgctgtatggaggaagtctccagataacaattgttataataagctggctagagattcctatccacctaaatgcgatgacagccttgaaccagattcagcatggtatactccacttcgtgcctgtattgtagttccagatactaagtttaagaaatcaggtctgctgtccatttctaagtggcctgagcgattgcacgttacaccagatcggatttcaatggttcctcgtggaagtgatagtactttcaaacatgatgacagtaagtggaaaaagcaggctgcgcactacaagaagttgatccctgagcttgggactgacaaaataagaaatgtcatggacatgaatacaatatatggaggttttgctgcagccttgattaatgatcctgtatgggtcatgaatgtagtttcatcttatgctaccaatacactccctgtggtttttgaccgtggccttattggaaccttccatgactggtgtgaagctttttcaacatatcctcgaacatatgacctgcttcatcttgatggactcttcactgcagaaaaccacaggtgtgaaatgaagaatgtattgctggaaatggatcgaatcttacggccttgggggtatgcaatcattcgtgaatccagttattttacagatgctatcactaccattggtaagggtatgcgttgggaatgtcgtaaagaagatactgacaatggcagtgacatgcagaagatattaatatgccagaaaaagctatggtactcatccaaccagggttcaagatga

SEQ ID NO: 6697 - DNA, 183 bp, Glycine max
  Peptide Sequence Number=SeqID_98382
atgatgtgtcacacagctcctttctataagtactttcagacagagcatacggtgcatgtttcaatgcacatccaacgggccaacacaattttgaggcttgcgaacgcttactcaaacatatctacagagtatctttctccaaatgattatccaacgtgcatagatttcaccagtgataattaa

SEQ ID NO: 6698 - DNA, 459 bp, Glycine max
  Peptide Sequence Number=SeqID_98383
atgagtgactggaggagtggtagtcaatctcaagactggtgtggcagggtcctctggcatctcaagcactggggtagaaggcctcctgtctcatctatgtcctgcctgcctcctcagcctcataaaccattggctctaggactatggcctcagaggatgcatcctccacctgtggaggtacctaagctgtggggtctccctcacaagagaaggtgctggtactgggtagcagatgtggatggagctagtggagtagaagaagaaggaacatcaacttgtcttgcccttgccttccttgatcctctgaaattaactgctcaagctctcataggtcaaactatcagaagtaactcctctagctctgcaaagagcagtaatcaaggcttgaaatccaagcctataggagctacggagatttggatgacgccacttccagtgaaggaagataagtcagggtag

SEQ ID NO: 6699 - DNA, 688 bp, Glycine max
  Peptide Sequence Number=SeqID_98384
gtgcaacagctggtgtctcgctaagcgaggtccttgagcttagtgagtctcatccgctaagcgagacatcagcccgcttagcgtgtaagaggaatttggaagggaatctaccatgcaagctcatgctcagtgtgtcatctgctcgctcaacgagtcatctatctcttttggagctgagcgtgcctagcttgctaagccaaagttcacttactcgtgctaagcgtgaaaatggcgctaagcgagccttcgaggacagaaagccctttttaaagcctgaagtgagagcactacatagatcttctgtaggtgatttggacttggagattgaagctatttgcagaagaaacaatgcagagaggaagagaaaatttttgctagtgttttgtatgcgtcttagatcttctgtaggtgatttggacttggagattgaagctacttatagaagaaacaacacagagaggaggagaaaaattttgcaggaaagggaagtaacaattctagaggaaccttgttcattagaatcatcttctatttttccaccaccaagggaatctcacacaggtgcatctgaagctcacaaaatggctgaagatcaacctcgcagagtgactcttgaggattattccagctctactgtgcttgttcaacggccaacaagtgtaccagatcgctcaagtagtatagaacg

SEQ ID NO: 6700 - DNA, 105 bp, Glycine max
  Peptide Sequence Number=SeqID_98385
atggagatctgcaatggtggtttgggcattatgttgagggatgctcaaacaaggacaaagcaaacacatagcaaggctctcgtggagctaaagggaaaaagatag

SEQ ID NO: 6701 - DNA, 921 bp, Glycine max
  Peptide Sequence Number=SeqID_98386
atggtatcagagcatatcctagatccattagtgggccccttgtatttatcatgctctaggcagttatggtggctagctgtgggcaaagaggggtgtgttgaagtcccagaattgtggcatgtagctgtgggcaaaaggagtgaagcagatgagatctacaaaatatgcagtgtgataggtagtccaaccactgaatcttgggcagatggactcaaacttgccagggatatcaactatcagtttccacagcttgctagtgtacatctctctacactgatcccatccagaagtgatgatgcaatcagccttgtgacatcactttgttcatgggatccctgcaagagaccaacagcagcagaggctcttcaacatcctttctttcagagttgcttttacatccctccatcccttcgcaccagagctgtaaccagaactccaccatctgctgggaccaggggatcactggatcggcagggcctcaagagatactctggtgctttgcctaatacaaaaatcaccaacaattttagttccccgaaattacaagcttctatagcttcagaacatgatactcattcatttataaacattacaggtgtgcaaaggaagctggatatggcaaatgaggatggaattaagagcaagaaatcattgaagactactcaacaatcaaaatatcgattaccaggaaaaggcagcccaacttctataaacaaggggaggactgctcgtggggtttcagaaacagctgagaagttggctaatatgtcgattggtactcgaagacaatccttaggacaaacccgtccgcctcccatgaaggctggagtcaattggatttctgaatctggaaatttcatgctcaggtccggacaacaaattccatctgaaagaagtttgacaagaaaagttgccgggtga

SEQ ID NO: 6702 - DNA, 787 bp, Glycine max
  Peptide Sequence Number=SeqID_98387
atgaaagccatagggttaaaaaacatagaggctgaatttgatatccctaaagcatctgatttgaggacaaaaaagaagatacttcagactgtgggggagcggtggagaaagtttaagtttgatttgacatcgaaatgggcacttgcagacgacaaggacagtgtcaatgacactgtatgcgaaaaatacgacattagcaaggagaagaagggcccaattttgtctgagccacagagaccctttgtgggagaaaacaagttaatggaggagaagaaaaagaaacatctggaggaagctgttatatctggaagcactgacactgtcattgatcctccatctcccatcaaacgacaagtgaagtggaagatggcccgcaccaacaaaattgggcaaatgacttctggggcagctaaggaaattgatgacaagatcgattctttggaggagcaggcctcacagggttcctttgtcgcccatggatgtaaggatgtactgactattgccattggacgaccagaataccctggtcgtgtgcgtgctgctggagtcggtgtcacgatcaaacaatactttggaccggctctaaggacctctcgcacgtctttgtccatggctcccaaagacctggagcaacttacacaaaaaataaggccccagctggaggagtctatcacagaaaaaatgcaatcacatggactcacactgcctcctgagcttgaggttggtccttcagctgctcatgtcagtacaaaggagagttgtgttgatcattcagggaacgatccag

SEQ ID NO: 6703 - DNA, 462 bp, Glycine max
  Peptide Sequence Number=SeqID_98388
atggatgtaattgcagatgacgaccttgttgattcttgcaagcctggagatcgagtggcaattgtggggatatataaggctcttgcaaggaaaaggcagactgttctcatagccaacaatgtttctcttctcaacaaagaggctaatgcaccaatatacagtgctgaggatgtcaaaaacattaaagagataactgcaagagatgatgcatttgatctgctaactaattcacttgcaccttctatatatgggaattcttggataaagatagcagtggttttgttgatgcttaatggggtggagaagaatttaaagaatggcattcacttgcgagggttagagttttctcttgatctcctttctgtgaggcagcacttgatgggagctcaagatatggaagagaaaatgaagctgatatggactcatgtgtctttgtcaaatataacagaatgttacaattaa

SEQ ID NO: 6704 - DNA, 243 bp, Glycine max
  Peptide Sequence Number=SeqID_98389
gacttgacgatacttaacaaagtaaatccaagcctcttgctaggtggattgttgttaaaacaaaaaggaagcactaagtgtgggtattacgtcatgcactggatgtcaactataatcttaggaaatttccagaataattgggaaatgtatttcactgatcctagaccattggaaccagaaagattgaaggcgctttgcaaccagtgggcaaagtactatttgaaagttaaaaatgaaacttag

SEQ ID NO: 6705 - DNA, 456 bp, Glycine max
  Peptide Sequence Number=SeqID_98390
atgaggtctttcaacaaactcatttatgaaaggatactggaagaatttgaggctagactatctcaagctaggtttgatgttgcatcaagtgttggtgaatcccaactcactcccttagaccccgctgaagaacaaaaacttaggagtcagtgttgggttgtagctgcaggaccaaagtgtaagggacacctttatggtactagagacctttctcatacttacaaatgcggaagtgacaacttcatgcagcatacgcaaggatcttccaatcgcactgaagatgctgcagagattaaccgcctgagggaggagctgcgtcaatcaaaagaggagatgcacatttttcaatcagtagtccttcagttcctacctctagaggcacgtaacattattcatcagcaacaacgacctcaccagcaacatcgagatcaacagcaggaccaagcagatgactaa

SEQ ID NO: 6706 - DNA, 318 bp, Glycine max
  Peptide Sequence Number=SeqID_98391
atgcaacatttgaaagttaaattcaacttccaacagctacaacaatggcatgttccaagctcactctataaattgagaaaattcgagtggagcaacttgcaaggaaaggttgccaaagaaaatggtaaagagatttccaagaatgacaattcctcagatgacaccactacaaaattcgaggacgtgacatgttggcgacaaagacggagaaagatgacatcaaagacgaagaatgagaagaagaggaagatgaagcggaagagaaagagaaagagaagggtaagggtaagaagagtaagagtgagaggtcggggctga

SEQ ID NO: 6707 - DNA, 372 bp, Glycine max
  Peptide Sequence Number=SeqID_98392
atgacaaatttaatgattcagccaaaaatagttttcagatttatgcaaagcaaagcaaaggaaaggaaaaggaaaaactgcacaaaggattgttatattagttcactccaaccttggggttttctccttacaaaggggattccactcaagaactcaatctcacacttatatataagatttgaagactctggacttgataacagtcgtgatctattcgccaaggccatggtaatctgcacaaccatgaggattatggtcaaccaagaaggtcgtgatcaatccacgatggcccaaggcatcaatgtcaattccaatcacggtcgtggtggatttaccatggctgtagtgcgccttttcatgaaatatctttag

SEQ ID NO: 6708 - DNA, 267 bp, Glycine max
  Peptide Sequence Number=SeqID_98393
atggcaactcttcaagagtccttaaatacacctccacaagccgcaaccccaggagatccacaggttgcaccatttgtgttcactttaacccactcaaagaaaggaggatacaaaataacaagaatgactttaggagctggtctaggtctcccgataatgtggaaggatttaagaatttggaacacaaacatggaagaatacatacgaattatagataaataccaacaagtacaagaatcacctgacatgtatttaaaatcacactaa

SEQ ID NO: 6709 - DNA, 2269 bp, Glycine max
  Peptide Sequence Number=SeqID_98394
cgtacgtgttcagcaaggagcggaagccaacaaagtcatccatcgtagtcggagtgaccaacgaagatgtggagttgcggaggttgccaataccgaccttatagaggacgacggtccacgaagtagtcacgccaaccagcacgagggacaatggattcaggtgacgggcagaagaaaggcatctttgaagagcgtctcaacttctcgaaggggtaatggagtaccgaaagactcttaccagtgcattgacataggaaggctccatagagtaacgtggagggataggatggacataacctccttctatttctctcacttccccgacggcgtccatgaaaaggacctctggaagaaattccaggaatggggaagggtgagggaggtattcataccgcaaaagaacaaaactggccatagatatgacttcgtgcgtttcaaaggggtagaagatgtagctttattagagagaaagctcgataacaatatctatatacaggggatgaagttgtttgtcaaccagcctaaatttcacaggggaggtggcagggcagctaagccatctacggaccttcttaacagaccaaaaatcagcctcagggtgccagctggatcagaacagaagtcacaccaagtcccaacgtctacaagactgaaatcatttgtggaggtcgtgaaacagagtaacgatgaaacgaatggcagctttcactcaattcccgggaaggggttaagagtagacaacgacgaacccataagcattcagacgtcgccggagaaactcaaatggcttgacaatgtgtgggtcgggggtttaaagaataagggtatgtttgatagggtagacatggaggttcagggggcgtttggattggagttgaaaactgcgtattggggagacgacaagattataatctacgacatggatggtgatacaactaatcagctcatccatgacgaacaacaacacggagggacccctttttattctcttcagaggtggacgccgatgatggagccttcccaccgtctgacgtgggtatgcatttggggagtgccattaacggcatgggacgcggagaattttgcacgctttgtatcggcttatggtgacttggttgaactcgacgccatgacggaggaaaggtcacgggtggacatagcgagggtcctaatccgcacagagcacaaaccggtcatagacggcaccgtagcgatcgtcgtagatggaacccacttcctcttgaagctaagagaggagtttgggtgtcaaagggggaatcgttcgtggatggagaggttggaacggctaccgccctcaccattctctacggaagtggcggggtcagacgacaaaggtcacatgcacggagtgcgaaacttcacctccggtagccctctcagtctcccgagcacctggacatcgccgtgcacggaagagcgccgggggagatggcggtcaccggaatcgcccctacggggcgattggaatgtcaatctcaagggtgcacacgtgtcacatcaagcctgtcaagggtcgctgccagcccttgagggactgacacctggaatcgggggccagcacggaggtaacggctctcagcctatggccttgcatgaaaatggtaggacagaacctacctctcctcgccctagtcagcagcagcaactacttagggaagaagacgttggagataaagccaaaggtgcttcagaccacgtgtgggcgaaaggaggtgatcccctggataataacctcgaggctttacttggagtcaaacttgggtcaaatgaaggggactctgcaatgtgcatgagaattaaatcttctcatattttgggcctgggaggtactggcccaaatactaccagaagcaaaacaacctcacctctcaaggtctatgttagaaaaaaggcagttactccagcaattcacatgggccgtgcaattaatagccctgatcaacacgggattcaggctgattctcggaagctggacatagatgaaaatgggaggcacactcaatctccagcagcacagggaacgagtcttgagaagcctcgcttggctcatagccctatatccagtaatagcttcaaaaaaggcctctgtgaaaatgaggaggcacttcatagggacattattagagacctgggactctcctttgctgagataaacacctgcaaagaccacattgtggctgatggaactcacagtagcatcatctctacaccaacaggagtgatgggtaaaaaacctattgaaccatga

SEQ ID NO: 6710 - DNA, 258 bp, Glycine max
  Peptide Sequence Number=SeqID_98395
atggggagtgcttcgggcgaggatgccacctgggaactagaaggtcaaatgcatgatgcatatcctaccttattcgataccaagcggcttttacaaaaacacattatatttctttctttttctctgacacacaagaaccctaacagagcagccggaggaggagctctagagagcaccagaaacaccaccattgctaacggggaacgcttgagcgactacatcgaggtaagggatgagttactcacgtttgaggattag

SEQ ID NO: 6711 - DNA, 513 bp, Glycine max
  Peptide Sequence Number=SeqID_98396
atggcggcagaaaaaggtgttgagatggtggcattggagtgtttgggaaaaaggttcaatttggccagcaattttcggttgaggttcgcaaagggaattcagaaagagaggttggtggtgcttgatgaacagaacaagagggatattttgattcctggaactagaggagttaccattaaaggggtttctaagaatattcattgtgataaaggggattacgatgtcgtttccctctgtttccacattgacgaccaccaccctgtccaagccaaaatcgggcgtaaaaggagggtcaggaaagtaggctctggttcaacaatgtctatattgagaaaagagttacgagaaggagccttgcagtcccttcttggaagttcttcatacttagcttcctccaattctgagcctgatcctttgttatcatcttttatgtttaacccagctgtaactgatgattcttttgttgaagatactctagtaaaagaaagcctatttagggttagggatttgtaa

SEQ ID NO: 6712 - DNA, 669 bp, Glycine max
  Peptide Sequence Number=SeqID_98397
atgatcgcatcgctgattaagttaatccagaatatgaaacctgggaggttcaagaccaaacgtttcttgtttggctacaatctaccctttcgaagctatattgatgaattagctagcgtgggcattccgattcgtcacgaggagtatgttgatgcactcctcgaagggttaccgtcagattacgtgctagtcatttctgttatcgagagtaagaagcatactccctccattgcaaaaattgaagctcttctctatggtcatgagactcgtcttacacgctacaatcgagatactccaacgaccagttttgcatcactacactacactcaaggctactcgcatcccaacacgtacaaaattggtggttttcgagactcgcatggccgcgacggtgatcgtggtaccttttccgacatactagacataggggtggtggctctggcagaggccacagtggtggtcgttttgctaacttccaatgccaaatttgtctcaaataaggacacactacaaatgtttgccatttcaggactaatcccattccttattcaactagtccacctagaacctccaacacttgggttaatcccaattctaagtcaacaggctcaggtcataatcagcccaatgccatgctcacaaactcaacctctcatgggactgctctag

SEQ ID NO: 6713 - DNA, 503 bp, Glycine max
  Peptide Sequence Number=SeqID_98398
atggctaagttcgatcctgaaatagccatggagttttatgctaatgcctggcctacagaagaaggggactttgcctggaccgcagtggagagaagggtgtggatcatgcgcactagcattaccactctcacacagatctggatgacgttggattgcgcctacgagacacccggtggacccagagaagtccaacagggccttgtgatttcctgctttgattacaggcctctgccaattctatggagtgccggtgcaaggccaggcaccacaatagccagaggagggccagtagtaggcagctacagacgcaccaccgccacctccagagtccacctctgctcacctacagagttcgaagctgcagtggcatggcctggagattggcccgattttcagacaggggcagggcccgcagggacctctggagatggagacggggctctagaagatgatgacatggctgatgtgattaatttcttccttggaggatgcaaagtcgtacg

SEQ ID NO: 6714 - DNA, 231 bp, Glycine max
  Peptide Sequence Number=SeqID_98399
atggctaagcccagcaccagcgtgcatgaacggctaagcccagcaccaacacgcatagcgagtaaaggggagtctgagaacggttcactactcagagtcctaaagagtgtgaatttcagagagcatagaacagagcaaggggccaagttttcatcttttagggagattagtaagtttttgactaattgtgagattcctagaggtggaggagacatccccactcctttgtaa

SEQ ID NO: 6715 - DNA, 1296 bp, Glycine max
  Peptide Sequence Number=SeqID_98400
atggggtcgaaccaagcaccctcttttaaaaaacggttctatcatgtcaaagtcaagagcctagaactagccagcttgcaaaagctaaggcagcggatggaccaagttcaacatcaagctttccgcaaagcatatgggaaaatatgggatttggccttgatagaagtatctgttgaagccatcgcatcccttgcacagtactatgaccagtcactcagatgcttcaaatttggggactttcagttggtaccaaccatagaagagtttgaagggatcttgggatgcccactaggaagaaggaagccgtatctgttttctggattctacccctccatggcaagagtagaaaaagtggtcaagatctcgccactagagttagaccgactgaagcaaaatagaaatggagtggtgggcataccaaggcagcacttggtggagaaggcaaaagctttggcagatcaaggagagcggactttgttcattgatgttttagcactgttggtgtttgggatcgtcctctttccaaatgtagacgggctagtggatctagcggcaatcgatgcttttcttgcttatcaccacaagaaggaaagcccgaccattgttgttttggccgatgcctatgacacattcgacctgagatgcgagaagagcagcacgagaattgtctgttgcacacccgctctttatgaagatccttttacactgaagaagaggaatcaagagaaattgtttgcttacaaaggagtgaggatgtctcctccacctctaggaatctcacaatcactcaaaaactcactaatctccctaaaagatgaaaacttggccccttgctctgctctacgctctcttaaattctcactcttccagcctctgagtagtgaactgttctcttggctcccctcacaattttgtgcaaatcaggctttaaaagggcttcctgatcttgacgtcgcgtttagcatgaatcctgtcaatgatcccgtgcatgctcattcaagtccagtgctggtgcatatgatggatcctgagaaagaggcaggtccaacactggtgcagatggctcaggctcaagctcaggctgaggagatggctctggctctggtggagtgggctctgaggcctctagaatgttgtcctcctggtcctgctaaggctcctgggatgcagaggcctcaccccttccaaaaggagaagggacttggaagaattggagtttctagtggtgaaggaagagcagaagtagatggagccggtgtagagggagctggggcatccacgttccctgaaaagtga

SEQ ID NO: 6716 - DNA, 255 bp, Glycine max
  Peptide Sequence Number=SeqID_98401
ctcgctcaggctagttggttacttcaccatgaagctatttggtggcccatgcgagccaaaggctatgatgaggacaaggcaaggaataagggcaaggaacctttagaaggacttggaggacctatggcaagggctagaacaaagaaggccaaggaagctcttcaacaagtgttaaccatgctatttgaatttaggcccaagttacaagttgagaagcttcagattgttaattgcaccatgttccaagaagagtag

SEQ ID NO: 6717 - DNA, 474 bp, Glycine max
  Peptide Sequence Number=SeqID_98402
atgattgagatgaattttatacaagaaaataaaaggaaaccgattgaaagggaaatcataacaattgcacaaaagattaataggcctaactatcaaaaaacagtccccagtggagtcgccaactgtcgcaacctaccttttgacgagagggcgacgcgagggctcacgggtgcatcttccaagggagaaaggcacgcggagtctccaccaacgtttattcgaggaaaacatcgaaaaaaccaaaaaggtgtgcgagcattcgctaagcgcgacattcagtggctaagcgcaaggaagaatccagaagaagatgagctgtcaagttcactaagcgcaccactccaggtcatcgagcgcaccacttcagctcatccgctaagcgaaacaagcgtgctaagccaaaatccacttatgcgcgctaagcgatctagatctgcgctaagcgcacgagcacgaacaaggccacctatttaa

SEQ ID NO: 6718 - DNA, 150 bp, Glycine max
  Peptide Sequence Number=SeqID_98403
atggggttgaaacaagcacatgcttttaagaaaaggttttcatcaagtcaagaggaggcgcaagagcagatgaaggctgacatggaggccatgaaagagcaaatgaccacaatgatggaagccaagatgagtatgagaaaaatgagatag

SEQ ID NO: 6719 - DNA, 555 bp, Glycine max
  Peptide Sequence Number=SeqID_98404
atgagtcttcattcttcatctagtgttaatggtgagggttctactcctaatgaccccatgtataagatattagatgagttgagatcccttaagttgtggaaacaaaaacaagagagaaaagaaaaggaaaaaaaaagagtggaagaaataagtcaagatgaaagagagaaaacaagagaggaagaaagaagaaaaataatgaaagaaatgaaaagagaaaaacatgcctcgtatagtagtcataactcttgcaagagcctaagtgaagaactttgtgactattatgaaggaaggcatatgtcacatcttagacctcactcccataggagagaaaatgaaagaaagcctcaagaggctaacattaacctcccatgcttccatgggaaggacaatgtagaggcttacttagattgcgaaataagggtagagcaaaaacttaaaagaaagtctactttaaaatcttatgactcttattctgatccaaataaagaccaaggtctaggcatcttaggggcagcaccttctaagcccgaagattataaggggaagaaatag

SEQ ID NO: 6720 - DNA, 861 bp, Glycine max
  Peptide Sequence Number=SeqID_98405
atgatcactctagacgacgtttcgtcactcctgcacattctgattactggcgcgctgcattcatttgagccactggttacatctggcgcagtgaccctgttgacggagctacttgaggtcaccccagacgaggctacagctgagacacgtcaggcaggtgggcctcatgttcagttgtcctggcttcgggacatgtaccagagtaggtgccgggccaggcagtgggttgctgcagctcggatgtacctccttcatttggttggttgcactcttttcgctaacaagagtgcaatccatgtccacgttgtgcacctgcaggcattcagggacctgggccaggtaggggcattctcttggggggaggtcgctttggtccacttgtacgatcagcttaacgaggcgtcgcaagcccctacacggaagattgccagttacatttcactacttcagatgggtcagatcattgtctacattcgaccagagagggtggttcaacagtttgggtacattcagaccgttcctccgccaccggttcgtgattcgttgacaggtactgatatagacgaccggtggatttcacacccttttgtgacgccgacgaaggagactgttgagctgagacctgcgcctccccctccccctcatgatgatgacttcgtcgagccacctgtccccgaggttccagtcgcgtcggatctccctacgcattctgtggttgattgcacaggatgtgtaaggattgctgagcatttggagcgggtcatcaacctcaggatggtgactgaagggattgacttatatgatatcatggatctttgtctgaggatagctagaggtgacgacccagatgacaagtcttag

SEQ ID NO: 6721 - DNA, 661 bp, Glycine max
  Peptide Sequence Number=SeqID_98406
cctcaagaggctaacattaaccttttatacttccatgggaaggacaatgtagtggctaacttagattgggaaataagggtagagcaaaaacttaaaaagaagtctacttcaaaatcttatggctctcactcttatccaaagaaagaccaacgtcaaggcatcttaggggtgacaccttctaagcccaaagatgataaggggaagacaatagaaaagcaagcccctaaggctagtatgcaagagaaaactagctctataaagtgctttaagtgtcttggaagaggacacattacttctcaatgccccaccacaaaaaccatgattatgagaggccaagacatttatagtagccaagatgaggctactacttcaccttcctctagtgaaagtgaaaaagcaaaagggaagaatctagcacttgctagcattgccacacctcttgggcttgagtttattcctcaagtaaagaagttgttggatgagggtttggtttgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggtgtatgtacatagggacccattag

SEQ ID NO: 6722 - DNA, 675 bp, Glycine max
  Peptide Sequence Number=SeqID_98407
atgttgctaagtagcactgtcatccatatctgtgtaagagtggtcatgttggtgcgcatgatccgcactcatctctttgcagcgacacgggtgaaatcttgccccgataagcatagtagttgcacgatagcctccctctctagttgtgctcgcacagttggtcgccctccaatatcagggggtggcccaggaactgataaaagcaaactactagcccctcacccgggagcatgttgccccagtatgcatagtagctgcacgatagcctccctctctggttgtgctcgcacagttggtcgccctccaatatcaaggggtggcccaggaactgataaaagaaaacaattggcccctcacatgtgttttgatgataacaaagatgatgacaaaaagcctaagagaatgatttcaagattgagtcaagaccaattcaagaatcaagagaaagattcaagagaaagtttcatcaagaagattcaagattcaagaataatcaagatcaaaattcaagactcaaagattcaagaatcaagagaagacttaatcaagataagtattaaaaagtttttcaaaacattgagtaacataagaaggtttcacaaaatcattaccaaagagttttactctctggtaattgattaccagattatagtaatcaattaccagtggttttaa

SEQ ID NO: 6723 - DNA, 390 bp, Glycine max
  Peptide Sequence Number=SeqID_98408
atgacagacctctattcccaagtggaagtcactcttaagaaatctcttcaagttcaattgtgggaggcagcttatgcatatgaatctatgttgagacaaaaggctagaattaagtggctaaaagaacgggacagcaactctacttattttcacagattgatcaatcatagaagaagaaaaaatgctattccagcaagttggtgcagggaagctgcccaattccttaattgcagtactttggaatttccttttacttatcttggaattccagttggggtgtcctctaagagttggatcgtgtggcagcctattgtaaggaagtttgaagtcaaacttgcaaaatggaagcaaagaactctatcaatgggggggcagaatcactcttattaa

SEQ ID NO: 6724 - DNA, 540 bp, Glycine max
  Peptide Sequence Number=SeqID_98409
atgaggggagcaccggcggaagagagcatctctcatttccttgtgagagatttcggcgcgcaaagtttcaagattatacaaagagtccacaaggcatgggaaagaccgttaaggaaagataaagaacttaggggcattcgtaatggcatcatcggtggttatcatgaatggctgaaagttcgtacacgagggttagattggctctccaagttgaaaattatcaacgaggagaacttcgaagctccggaagaggatgaagaaaaaatacagctaccgcaagagcccttgaacgagaaaccaagagggctcgcaaggaagagcatggctgagacaaattccgagttagctgattgctcaaggtccaagagaagcttgtctcagtgtttatgcgagatagagaccaacatgtcagccatcgtcagaaagtaccaagaagaattaaatctagccacgggccacgaacacaaagtggcggacgagtatgcccgagtgtatgtggaaaaggaggctagaggaagggtgatcgactcgttacattga

SEQ ID NO: 6725 - DNA, 723 bp, Glycine max
  Peptide Sequence Number=SeqID_98410
atgggtgaagcagaggaggtgcaagagaagatgaaggccgaaatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacacccatactcattaagagccaacaacctcaatctgatcatgcacatgtctctcgacccatggaggagacacatggaatgccccaccacaatctagccgacttcgagccttgcctcggatatgccactgaagggcaagcaattggtggtatacccctgcaaaacactttggagggccctcagtgtcacccacaaccacaaccctcacattccacagcggttaaaaaccctcatgttatggcagaaatgggaaagaggaaaggctcagggccattgaaggaggtgctggactttgacaagtacaaggggactacttgccccaagaaccatccaaagatgtattgtcgaagatgcgggcatacgcaaagatga

SEQ ID NO: 6726 - DNA, 335 bp, Glycine max
  Peptide Sequence Number=SeqID_98411
gtggagttggcattgaggaagaggaaccaatcgatttgaggtcaaatcctcttcaagggggaggggatgatgcaatcctccctaggaagggaccagtcaccagagccatgagcaagaggctccaagaggattgggctagagctactgaagaaggccatagggttctcatgaaccttaggatgaatggcagtggaatggagaaggaagagagagagaggagacaccacttcaaggagaagatgagtctagaagaagctcaccaccataggaggccaaggataagagcttggagaaagaaggagatgaatgaagggagaggaagagggatcctctag

SEQ ID NO: 6727 - DNA, 566 bp, Glycine max
  Peptide Sequence Number=SeqID_98412
tgttggaggaaggccaggagtgcgagttcagtcagaggaggaatagggccaacgggttcgacgaggaggccattgcccagctattgtgcacactagggcaggatttcgctcgaactgctgccgggagacgggtgcggatcatgcgctccaacatgacctccttgacccagatgtggatgacgttgctgctcagcaatgtcttgcctagtgatcataactccgatctccctctgccgaagtgtcagctggtgtatgccatcctgacatggatgagcgttcacgtggctcagctaattgctggcgccatctatttgtttgcaggtatgccacccaccaggcaccctctagacccggataagtctaacagggccctggggtttccagcattgatcacgggcctctgccagtcgttcggggttcccgtcacccctagtaaggtgatccgaccgccgatcactcgggctttcattgagaagtattgcacgcctagacaggcgcaggggatgcatctcaggacgcagacgcaccatcgccacctcatcaggccgatcccgctgggtcactag

SEQ ID NO: 6728 - DNA, 382 bp, Glycine max
  Peptide Sequence Number=SeqID_98413
atgactagaggcaatccatctgacttacaaccctttgatcctgagatagataggacatttcacagattagttaggcatcattttataccttttgatcattctgagcattccattactggtgaatctgtgcattctgttattggtgattttgaacatcctgatcttgagcattataattttgagcattctgattctgagcattctgattttgcacattctgagaacatggcacaacctccaccccatgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 6729 - DNA, 198 bp, Glycine max
  Peptide Sequence Number=SeqID_98414
atgttttcttatagtcctttcgctaagcgcaagcctcgcgctaagcgcatatttggtcatgcgctaagccgagagtctaaagcgcttagcacccaacccttacatctgaggctgatttggtccgctaagctggccaaggctgagctaagccaatttcaattcgatctgaattcggctaagcgacggcctaaccgctaa

SEQ ID NO: 6730 - DNA, 363 bp, Glycine max
  Peptide Sequence Number=SeqID_98415
atgtacaaagataagcgggctcgtactaagcccatgggcccgaaatctaccctaaggctcatgagaaccctagggccttctcttgcatcgctgacccaatcttcttggagtcttctatccaatgccattatcttctcaaagaagcctcttgagaaagcttctcaaagaagccacgaggaagcttctagagtgtcgcaaggtgcccttcacgggcgagcgagggcgaggctcacgggtgcgttttccaaaggaggaaagatgcgcggagtcgccaccaacgtttatttgtggaaaacgtcgaaaaaaccgatggaaaccggtcaaaatgaaaattctaagttcgggagttgtatttacgcttga

SEQ ID NO: 6731 - DNA, 216 bp, Glycine max
  Peptide Sequence Number=SeqID_98416
atgtcgactttgaaagagcaaatggcttccatgatgggtgccatgctaggaatgagacaacttatggagaataacgtggccaccgctgccgctgttagttcagctgccgaagcagacccaactctcccagctaccgcccatcctctcccaaatgtggtaggacgagaaagaagcacactggggcacatcagcaacccccatctgggatacaactga

SEQ ID NO: 6732 - DNA, 393 bp, Glycine max
  Peptide Sequence Number=SeqID_98417
atgggtgatcaagaggagacacaggaacagatgaaagccgacatgtcggctctgaaagaacaaatggcctccatgatggaggccatgctaggcatgagacagctcatggagaaaaacgcggccaccgctgccgccgacggggaagggacacacacggggcacgatggcaacccccacctgggagacaaccgagcggctgacccacatggattgccgcccaactactcaccatccgtcttgcaagacgatgcgggtcatatagctcctcccatggttgagagagagatgatcaccatgatggtagacactctgctagtgttctactatgagaagctagtaggctatatgtcgtccagcttcgcggacctagtgttcgccgaggaaagaatcgag

SEQ ID NO: 6733 - DNA, 557 bp, Glycine max
  Peptide Sequence Number=SeqID_98418
atcctggtcaccgtgggcgcgcagcaggcgttatacctgatggcagacgcgctgctggccccctcgcaacgcgtgggcttcgaggagcccggccacccgcatgcgcgcaacaccttttcgctgcgccgcccgcattgggtgcccgtggccgtggatggggaaggtgtggtggtcgatggcctgccgccgctggactatatgttcgtcacgccctcgcaccagagtcccaccaccgtgacgatgagcctgcagcggcgcgagcagctgctgcgccgcgccgagcagggcgatttcgtgatcatcgaggacgactacgaggccgagaacctttaccagggcacgcccatgcccgcgctcaagagcctggacaagagcgggcgcgtgatctatgtgggttcgctgtccaagagcctgtcgcccgcgctgcggctgggatacatcgttgcgccgcgcgcgctgatcgacgagttgcgcgtgctgcgccatgccatggtgcgccaccccagcgcctttctgcagcacgcctatgcgctgttcctgtcgctgggccaccatga

SEQ ID NO: 6734 - DNA, 555 bp, Glycine max
  Peptide Sequence Number=SeqID_98419
atgaaagtcgacatgccggctttgaaagagcaaatggcttccatgatggatgccatgttaggaatgagacaacttatggagaataacgtggccatcgctgccgctgttagttcggctgctgaagcagacccaactctcccagctaccacgcaccatcctctcccaaacatggtaggacgagaaagaagcacactggggcacatcagcaaccccatttgggatacaaccgagcagcttacccttacggattaccacctaattacacgccaccagtcatgcgtgatgatgcgggtcatgtcccttcccccatccttgaaggggagcctcctcgacagtcggacgaggttcacgaggatcgtagagagtatgcccaatgagacatcgatttctaccccctggtccccattgaggggccgacacccaacacaatgcctcagcccaacctcactagagaaccttgaaacctcccagcacaaccaatattcttctccacagaaggactgcccctggcagcggaagaaaaaaggaaactcgatctcatcaaagagagattga

SEQ ID NO: 6735 - DNA, 408 bp, Glycine max
  Peptide Sequence Number=SeqID_98420
atgccacctcccaggcaccctttagacccagataagtctaacaaggccctggggtttccagcattgatcacgggtctctgccagtcattcggggttcccgtcacacctagtaaggtgattcgaccaccgatcacccgggccttcattgagaaatattgcacgcctagacaggcgcagggtgatgcaccgcaggccgcagacgcaccaccaccacctcatcaggctgatctagttgggtcatttggcatggagcggtatttacagcactcggtttgccagcaggcggccaaccacagggggcagatcagttcagggctgaggttgcatggcccggagattggcctgaggcccaggcaagggaggcgcccgcagggctcccggcgatgcagaggaggcccgcatggatga

SEQ ID NO: 6736 - DNA, 204 bp, Glycine max
  Peptide Sequence Number=SeqID_98421
atgtgggccatcatcgatgagtgcaaagagaagctaaatctagcggcgactcacgagcaaaggctagaggatgagtacgccaagatatcagcagaaagggaagcaagggaaaggtattggcaatcaaaattgccattccctgcattggatatggggttgaaccaagctcccgcttttacgaaaaggttcatcgagtcaagttga

SEQ ID NO: 6737 - DNA, 277 bp, Glycine max
  Peptide Sequence Number=SeqID_98422
ctatgaccatgattacgaattcgagctcggtaccgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggaccgtaggtcgcttggggactggatgaaggcacggtttgttgtcgaaccagtataa

SEQ ID NO: 6738 - DNA, 699 bp, Glycine max
  Peptide Sequence Number=SeqID_98423
atggggggggtgctgcccgagctgcagccgctgtttagccgctgcggcgaattggcccgcgcgcacaacattcgcctgtcgttccatcccggccagtatacggtgctggcttcggataatgatgacgtggtggatcgggcgctggaggatgtcgagtaccatacgctgtgcgcggtgctgatgggctacggcaggcagtttcaggatttcaaaatcaacatccacatgaacggcaaacgcggtattgagggctttcgcgcggcgtttatgcgcctcagtccggaagcccgcaatatgctgacggtggaaaatgacgaaatttcctgctcgctggatgacgtcttgcaggcgcgtgcgctgtgtccggtggtactggatattcaccatcactgggtgaaagagaatcagtttattcaggccagcgatgcgcgcgtggcactgattctggagtcgtggcgcggcgtgcggccggtgctgcactattcgatcgcccaggaagggttgatcccggagagcggctttcccgatcaggagcaactcaccgcctcaaagccgaagctgcgcgcccattctgactactatttcaaccagacgctgaatgactgggcactgtcgtttgatcgcttcgacatcatgtgcgaagtcaaaatgaagaacctcgcgcgcgatcgcctgtatgactatgcgcagacgcgctga

SEQ ID NO: 6739 - DNA, 600 bp, Glycine max
  Peptide Sequence Number=SeqID_98424
atggcgagtcaagaagagtgggtcccgtttagggatatactagctttgctgatctttggggttgtcctttttccaaacgtggacggtttggtggacctagccgcaattgatgctttccttgcttatcaccatagcaaggagatcccggtgagaagaatcgattgggaccaacacttggctgggataggaggcaacacaatcaactggtttcctcgatggaaggaaggaaaggagggagttcttttctcatgtggggactaccctaacgttccattgatagggacgaggggttgtattaactataatcccgcacttgccataagacagctagggtaccccatgaggggagcacctacggaagagagcctctcgcctttccttgtgagagatttcggcgcgcaaagtctcaaggttgtacaaagagtccacaaggcgtggaaaagtccgttgaggaaagataaagaacttaggggcatccgtaatggcatcatcggtggttatcatgaatggctaagagttcatacgcgagggttagtatggctctccaagttgaaagttatcaacgaggagaactttgaagctccggaagaggatgaaaaa

SEQ ID NO: 6740 - DNA, 276 bp, Glycine max
  Peptide Sequence Number=SeqID_98425
atgttaaggcaacccaagtggggacatctcaaggagttgcatgcagtggtcaagtcttattctaccactttattggaaggaaagcagaacaagttctctttaggccaactactggaggataattctgaattgcaacaacagttctcctcatggataaagactattgtggccgtacctgtcaaagcatggggagtggtacagtgtgaatctagaaagaagcatataaatgttcctcttgacaggagttctcaagtagtggtcaaagccactaagtag

SEQ ID NO: 6741 - DNA, 435 bp, Glycine max
  Peptide Sequence Number=SeqID_98426
atgagggtgaacacagagtttgagcgcgttcttaagtatttcaatgaagatggggatggtaagatttccccatctgagcttaggaaccggctaggcatgatgggtggtgagttattgttcaaagacgctgaaaagttgattgaggaattggattctgacggtgatgggcttttgagtttggaaaattttgtgaagataatggaggatgctggggaagagaagttgaaggatttggcagaggcttttgagatgtaccgtaacactgaaatgtatgggtttataacaaccaaaagcttgcaaaggatgctgcgtaggttaggagaatcaaaatccatggagcaatgcacaactatgattgaccactttgatttgaatggagatggcctgcttgtaaaacaattaaggttttctagattattaattataggaaattaa

SEQ ID NO: 6742 - DNA, 132 bp, Glycine max
  Peptide Sequence Number=SeqID_98427
atgcagatattgattaagaaatatagaaatggcaataactcaagctacatggctccaaatgaggttattccaaaacgaggtgaaaggtcttgttttgaaattcaatttaggctcaagaatcacttaatttga

SEQ ID NO: 6743 - DNA, 228 bp, Glycine max
  Peptide Sequence Number=SeqID_98428
atggccccgaggaagcttgccacaaagagatctaggaaggataaagcagctgaaggaaccagttccgctcccgaatatgacaaccaccgttttaggagtgctgagcaccagcaacgcttcgaggccatcaagggatggtcatttctctgggagcgacgtgtccagctcagggacgacgagtatactgacttccaggaggagatagttcgccggcattgggcatcactg

SEQ ID NO: 6744 - DNA, 366 bp, Glycine max
  Peptide Sequence Number=SeqID_98429
atgggtgaagtagaggaggtgcaagagcagatgaaggccgacatggaggccatgaaagagcaaatggccacaatgatggaggccatgatgagcatgaaaaagataatggaagccaatgcagttgcagttgccactaccagcgctattgctaaggtgaacccgatgcccccatctgatctcaaccaaatgaatcatccaacctcagatatggtaggcaaagatttgggaagtacggatggccccatgatgtgcaaattcaaaacaagcacgccttcttgccatatggcttgcctcctaactatacaccacccaatgtggcgtacactcctaaagaggatgtcgataactctgctccatactcattga

SEQ ID NO: 6745 - DNA, 342 bp, Glycine max
  Peptide Sequence Number=SeqID_98430
gttagtgtggacaagtggatggatataacggagatgggatatgtgattgcatcatggtataacgtaatccttgtatcgttgtcccgacaacaaagcatgaagttttttcctcttagaagtcaaccaccacctgattcttctgggcatcgcatgatatgtgtcagtcacgtatttggaaatcattttgttcaggagaaactagcagtcagacgattgtcaactcaaggttgggtttcatttttccaaatggatcgattattcacaatgatactggggtttacttccaaacttcgactccggtgcccattcgagtaccaaacaactgtgattttgcaagcctaa

SEQ ID NO: 6746 - DNA, 528 bp, Glycine max
  Peptide Sequence Number=SeqID_98431
atgcgtttacaaggcaatgcccaatcaattgatgatcaagaaactactaaatttgcaaaatggattttagatattggagatggagttattgggaatcaaaatgatggatatgctacagttgaaattcctcagtacctattgattactgaatataatgaccccattgatgctatagtcagatcaacatttccagatttatatcaacaccacagtaatcctgaattcttcaaatgtagagcaatattagcttccaccaatgaaacaattgaagaggtcaatgattatatactttgcttgattccaggtgaacacatggaatacttaagctctgattatatagagaaatcagaaaccattgacagttggcatttccaatcaattaccacagaatttctcaattcactaaacatatctggtctgccaaatcattgtatcaaactaaaaatcggtagtcctataatgttgctaagaaacttagaccaaactgagggcaaaaaatcaaatgcctgtgtaatggtactagattag

SEQ ID NO: 6747 - DNA, 496 bp, Glycine max
  Peptide Sequence Number=SeqID_98432
agactaaagtccttttctgcgccttttgttatccagaggcggcggacccaatgacatgcgggaaccatttggtccaacacctttttgctatctataagactcaaagcatgatagcgagcagagacaaacgtcgtcttctacgccttttgtcatccagaggcggcgggcccaatgacatgcgggaaccatttggtggcgggcccgatgacatgcagttatccgcacgctcgatgagtgataaacgcgcagagacagattctgcgccctttatcattcaggagcagcgagtcgactggaacagcaagttgggtggtaaacacgcagagacggattctgcgccctttatcattcaagagcagcaaactgagtggataaacgcgcatagacgaattctgcgccctttatcattcaggaacatcaagaacaacaagttgggtggtaaacgcgcagagacgaattctgtgccctttatcattcaggaacagcaagttgggtg

SEQ ID NO: 6748 - DNA, 120 bp, Glycine max
  Peptide Sequence Number=SeqID_98433
atggtgccttgggctaagcgcagcttcaacgcgacagaagaatctggcagggcatcaatatcaaggccctgcgttaagcacaagatcagtgcgctaagcgcaacagttgtcttctactag

SEQ ID NO: 6749 - DNA, 441 bp, Glycine max
  Peptide Sequence Number=SeqID_98434
atgaggcaccgaatccctatgataggtggtatgatgaatgtgttgagtggtgcaaccctcttttgtaaaatcacccatgcatcaaacatcttcatgattcacatacatagggactcattaggtagttatcaaggggttcccacaaaccctaagagaataaagatcattcttgagtggcccactccaccaagtataaggaaaatttgtggcttccatgacttaacaaacttttacaaaagaccttaccttactccaacataccaaacaccacatgatgtagctccttgtggagcttgtaggccttggatcttctccatcaatggagtcctttgcttcttgaagtttaatggcagtagaatggagaaggggaaagatgattggagatgccacttaaaggagaagatgagtcaagaagaagttcaccaccataggaagccatga

SEQ ID NO: 6750 - DNA, 634 bp, Glycine max
  Peptide Sequence Number=SeqID_98435
atgggatcaagtcaaaagcatccgcttaaaaagaggtatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccggtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtagtgaaaatttcagcacaagagttggaccgtgtaaagcaaaacagaaatggagtagtcgaagtaccaaggaagtgtgtcctctttccaaatatggaagggttagtggacctagcagtgattgacgcttttctcgcctttcatcatggcaaggaaagcccggtcgtcgccattttggccatgcatgacacgttcgatcagagatgtgaaaagagcggcgcaagaattgtttgttgtacaccagctctttatgtgtggctggtttcgcacctttttctccaagaag

SEQ ID NO: 6751 - DNA, 432 bp, Glycine max
  Peptide Sequence Number=SeqID_98436
atgaccgggaggctgatttctggttcattggctcttgaaagccgcatccttcactatcttattgttcgtatcttactcccaagatcttcaaaccttgcacaggtttctgaagaagatcttatagtcatgtggtcctttcataccggccgacaaattgattgggcacagctagtccgatctttcttgattggtgctgctgtggttgcgtcctttggttaccgcaaagagcgtgatggctcttgggtaaaaaagggtttgatggactttaaacctatgttggtgaaaggtttgatgctttggaacgacaagtggacacgtgattcgatgaaatggactcaaggatcacaaaggttgaagaagatgtcaccatcattcgcaactgccttgatttacctccaccaccaccatcaatttagacattaccattattaa

SEQ ID NO: 6752 - DNA, 318 bp, Glycine max
  Peptide Sequence Number=SeqID_98437
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtcacgccaggttttcccagtcacgacgttgtaaacgacggccagtgccaagcttgcatgcctgcaggtcgactctag

SEQ ID NO: 6753 - DNA, 435 bp, Glycine max
  Peptide Sequence Number=SeqID_98438
atggctccattgtcgtcactccaaaatggtcaaatgactaaatcaaacagaacaacactcagagggagttcccagagagatttgcaaaaagataggatgagtccgcatttaccaaatttcacgacaaaggttgcatgcatctgcatccctaaaaatcatgttaactgcatagatttcctacatctaatgtccaaatcttgtggatttgggatgaccggccctctcgatgagtcgatctcttgctttctcataagggtggacccttgggtacttgtacctatcacctttagaggactacacgtcctcgccttgagaggacttcatgtcctcacctttagagggctacacgccctcggctccgaggactatacgtcctcatcttcagaggactacatgtcctcaccttcagagggctacgcgccctcgccttcgtag

SEQ ID NO: 6754 - DNA, 147 bp, Glycine max
  Peptide Sequence Number=SeqID_98439
tatggtacgcttgatggagtattaagtgacatggttctccaagtgtttaggtgcttatcttacatgcatgatattaagtccatgaaagaaaattacttgccagagttgaatgaaatgtaccaaaaatctgctagtaaacttcagcgg

SEQ ID NO: 6755 - DNA, 159 bp, Glycine max
  Peptide Sequence Number=SeqID_98440
atgactctaagacaacatggattaaaaccaaaccacaagacaatggaggatatacatggagaacaagatgaagaacaaggaattaaagaatcaccgaacaaaaagatagaggaagcaaaagaacatcacctagatgaagatgctcttgataccacatga

SEQ ID NO: 6756 - DNA, 318 bp, Glycine max
  Peptide Sequence Number=SeqID_98441
atgtctctgctgtaccaagtgagatttttacgtcattacattgttgggagtgttagtcctggaagtgaaataccaaggtggttcaataatgagcatgagggaattagtgtaagcttagacgcatctctttacacaggcctagtatgctatcagatttgccaaatgaatcatccgagaagactaagatattttttgttgaatgtagaccccattccctatcaattcaaacacacggaaataaatattacccggtataaggagcctaagatgctttgtccaagatttagtgtgttgggctgttattttgtctatatttaa

SEQ ID NO: 6757 - DNA, 498 bp, Glycine max
  Peptide Sequence Number=SeqID_98442
atggttgatcgaggaggagaagaaaacagaccaccaaggaggactcttagtgactatgcttatcaacaaggaccaaagcattacaacaacatagtcattcctcctttcatcaacaagcttgtggagttaaagctagcactactctgtgtgattggcttgcattcttttgatggaatggatcatgaagatccatacacacttttgtctaccttcatggaactttgtagtaccatgggagcttctgacgaagatgctgaagctgtctaccttagagctttcccattctccttgacaaagatggttcttgatgcctcaactagaggtactatgatgtctaagagcctagaggaagcaattgtaatcattgactccattgcagcccatgattatcagagtcaccatggtaggactccaattcaaagaaaaggaaatatggtgtgctctggaattctgtgcaaatcatctgcctaccctaattctgcacaaaacaggctttaa

SEQ ID NO: 6758 - DNA, 459 bp, Glycine max
  Peptide Sequence Number=SeqID_98443
atgggtgaccaagaggagatgcaggaacagatgaaagccgacatgtcggctttgaaagagcaaatggcttccatgatggatgccatgctaggaatcagacaactaatggagaataacatggtcaccgctgccgttgttagttcggctgccgaagcagacctaactctcccagctaccgcgtaccatcctctcccgaacgtggtaggacgagaaaaaagcacactggggcacgtcagtaacccccatctaggatacaaccgagtggcttacccttatggattaccacctaattacacgccaccagtcatgcgtgatgactcggacgaggttcacgaggattgtagagagtatgcccaaggagacatcgatttctacgccccggtccccgtcgaggggccggcacccaacacactacctcagcccaacctcacgggagaacctcgaaacctcccagcatag

SEQ ID NO: 6759 - DNA, 840 bp, Glycine max
  Peptide Sequence Number=SeqID_98444
atgagtggaatggatgaatgcatgaagaaatgcacatggcacagattttatgaatacgggaacccgggaaattgtccccttctcagatacaacatttgggcagcatggcgcccgactgcagggataattcccaaggtggtcatatctctcttgatggtctctagaggtatcatccccttcgaagaacatattgcggcagtagggactattagcaacaatatgttatcaaagagaaaaactctagatgaggtggagtcaccaattgtcgcaacctacctttcggcgggagggcgacacggggctcacgggtgcgtcttccaagaaaggaaaatgcgcgcagtcgccaccaatgtttattcgaggaaaacgtcgaaaaaactggaaaggtgtggtctacgaactttaggtgtgaaaggttcaggagttgtatttacgcacggagaaggggaaaagagggaggtggttgccgcccagctcgcccaggcgaggtggttgccgcccagctcgcccaggcgagctgggttgcttccaccagaaggcaccgccttctgttggaacatcctagaaggcccaaactttacggattacgcaaccttcccctctttgacttctggaatgttacggaactttacggattgcgcaataatgcttccttttgactcccgacatgtcgtggaacttcacggattgcctaatgatgggtgtcaagtacctcgaagcggtcaagcgaagattcaacatggtcgtggtaagcagtacgaccatggtaatatgatgactccccttttgaacagtgttagccttcagacgatggccttggtgaattcactatggccatag

SEQ ID NO: 6760 - DNA, 342 bp, Glycine max
  Peptide Sequence Number=SeqID_98445
atgaagtaccaagatgcgaacaattatcaattacaaatctttgctgtctctagaatatgtccattggatttaatgatgaaatatgtgcaatttcagttgagcttagctaatcagtgggctaagcgcgcatccaccactaagcgcagcttcagtgtgcttagcgcgacagaagaatctggcagggcatcaatatcaaggtcgtgcgctaagcgtgagatcagtatgctaagcgcaacaggtgtctttagccaggctcagcaattagggtacagaactttgagaaggtcagggcacagaatcccacagcacaccatagtgcctatttcgggcaaagaactctag

SEQ ID NO: 6761 - DNA, 405 bp, Glycine max
  Peptide Sequence Number=SeqID_98446
atggaggccatgaaagagcaaatgaccacaatgatggaagccatgatgagtatgaggaaaatgatggaggttaacacaactatagtcattgccgcaagtaccgccactgaggtggacccgacttacccatttggtctcaatcaagtaaatcgtctagtctcggatatggtaggtagggaggtgaagcattgggaagtacgggcggcccccaatttgtgcaggtccaaagcaagcattcctttccaccatatggcttgccacccaactatacaccacctaatgttgcacatgctcccgatgagaacgtcgataactctgctcccatacccattgagagccaagaaccccaatctggtcatgcacaggtccctaaacccatgggagaggcacatgaagtacctctag

SEQ ID NO: 6762 - DNA, 468 bp, Glycine max
  Peptide Sequence Number=SeqID_98447
atgtttattgacccaaacaatgcaaacacggctacattgggtgaagttgtcgagacattgcagtatatggtgtcaccacaagggcgaaacacatggacagttgatgatctcgtgccatatgtggaaaagttagcgattttatcccaagagcaagagaggatcactgagcctgtggcacatggtccagcatcagagcgtcgatttcccccacaacagtttcacatgcttcagtcaagtgttgaaactcgaggttttgacagacgaagggagattgttcaagcggaagatttttcccaacatatggagcagcgtggccatggaatgtattacacgccaccaacatttgctcagtatccttcgcagatgtatcagtatcctttcgaaggccatgacactgatatgtctgcaagcgaacattcgttggtggtgttgcggaaacacaacctaatttttcatggccgaccatga

SEQ ID NO: 6763 - DNA, 429 bp, Glycine max
  Peptide Sequence Number=SeqID_98448
atggataatgaagagggcgtgcaagagcagatgaaggccgatctatcggccttaaaagatcaaatggcttctatcacggaggccatgctaaaactccagaaaactctagaggataatgccacgacaaccgcctccaatgcagttagggaagcggaaccagtgctgcagcccacaataaacttgggccgagatagaaacccgacggtgtttggtctgaggtacagtccgcaagcttacccttatagcttgcctctggacttcactccctgtgtcgctccggaagatgtgagccaagcccctaccttcgaggggcaacttcctccttatgttgattaccccctgcaagaagacaacgaaggagatacccatctaggccctctacttcccctcaaggatccatcccccatgaattacctcaaccaaacatag

SEQ ID NO: 6764 - DNA, 240 bp, Glycine max
  Peptide Sequence Number=SeqID_98449
atgaagaaaacgcatggagtcgccaccaacgtttattcgagaaaaacattagaaaaaccaaaaagaggtttttggattttgaaaataagggttcgggagttgtttacacatagggaagggtcgataaggggtgttgcccttgctcctacgtatcctcagataactagcggcactaatgaacggttaaaacttactttacaagaagaaaatgagattactgatgatagaagaaggagatga

SEQ ID NO: 6765 - DNA, 246 bp, Glycine max
  Peptide Sequence Number=SeqID_98450
atgcttgccgcccagctcgcccaggcgagcagggttgcttcctccagaagcaacagccttctggaggaatattctggagggcccaagtgggcctgggtgctatttgcacccccatttttactaagtgttgaggaaagaatccctgagtttcaagaacctatggatttgaggtcaaatccttttcaagggggagggaatgatgcaatccctttccttgttttgaagctcactacaagacttaagtga

SEQ ID NO: 6766 - DNA, 298 bp, Glycine max
  Peptide Sequence Number=SeqID_98451
caaaggaaatgcatgtgatgtaggtagcaaatacaccttggaagtacatataagtgatctaggtaacgaaggtgccttgattgtgcatgggaaatggccccgaggaaacttgcctcaaagagatccaggaaggataaggcggccgaaggaactagttccgctcccgagtatgacagtcaccgctttaggagcgctgtacatcagcagcgctttgaggccatcaagggatggtcatttctccgggagcgacgcgtccagctcagggacaatgagtataccgatttccaggaagaaatag

SEQ ID NO: 6767 - DNA, 103 bp, Glycine max
  Peptide Sequence Number=SeqID_98452
atgccccagcctggccagcctgatgaggtggtggtggcgcgcttgcggcctgtggagcatcaccctgagcctgtctctggtgatgggcggccgaattaccttg

SEQ ID NO: 6768 - DNA, 330 bp, Glycine max
  Peptide Sequence Number=SeqID_98453
gcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatcgttgtgagccagaaagggatagagatagtgatgcaatcctacccccgcaagggcattggatagaaaactccaagtag

SEQ ID NO: 6769 - DNA, 357 bp, Glycine max
  Peptide Sequence Number=SeqID_98454
atgaggattcttttttataggccaaggttcaaaaagtctaaggttgtgttgcaatggggtcttttatcgtgggaacccaatcttgatatctggggcgagacaaatttgggtgtcaaggtgtcggtctcgggccgagcttccatattgttccacaaggcacgcgtgacaatgatgattcgaaaacaacgtgcaaaattagtcatggctacagccaggtgggcactcaagcatcctgtttatggcattgtgatactatggttgggaatttacacagacagccccaacgtttccaagttatgttctttcatcagttcaatgaattcatccatccttatctcggttcattccggaaaataa

SEQ ID NO: 6770 - DNA, 273 bp, Glycine max
  Peptide Sequence Number=SeqID_98455
atgaactcgctaagcgcgtctgatgcactaagtgagttcatcaaaactgttgaatttatgaatgtccagacgaactcgcaaagtgacatctgcatggcatccaggaagaggaagagtatggcttctagacccgcagctcagtatgataccaggcattcccaatctttggaagcttggaacagatatacggacaacattctcggccagaacatcattccggagagaaatgttacgatttatcatactgagtttgacgagttaaagtggagttga

SEQ ID NO: 6771 - DNA, 411 bp, Glycine max
  Peptide Sequence Number=SeqID_98456
atggaaatctctgaagatactgacatcccggtaatattgggaaggccattcatgttgaccgcaagcttcatagttgatatgggaaagaaaaagctggagctaggttttgaagatcagaaaattgattttgatttgtttgttgaagacaagcctgctccagaacacaatgtttgcttacaagtaatggaaggaggtcaagaggttttgaaaggtttcaatttcttggaaaaaggactgaaaaataacttacaaaacttttttctgaaaaatagtcctttcgctaagcgcaagcctcgcgctaagcgcatctctgttcatgcgcttagccacgagtctcgagcgcttaatgcccaacccttgcatctaaggccgatttggtccgctaagctggccaaggttgagctaagctaa

SEQ ID NO: 6772 - DNA, 186 bp, Glycine max
  Peptide Sequence Number=SeqID_98457
atgaagaagatcctaggcctacaagctccaatggagcttgcatcaaaatgggattgtcatcatcaaaaagggggagattgtggaagcaatgccttccaagattattttaatgatgccaaagaatcaagagtcaagcaagtttcaagaatcaagatcaagattcaagattcaagaatcaagatttaa

SEQ ID NO: 6773 - DNA, 264 bp, Glycine max
  Peptide Sequence Number=SeqID_98458
atggggtcaaaccaagaacatgcttttaagaaaaggtttcatcaagtcaaggtcaagtatggaagtaaccagcttgcaagagttagggaagaagatggatcgagtttacatagcttatttgaccactgccaacacatgattgagctaaataatttacaaaattggggactgttgatgtccacgaaagaacatgctttacggtgcccttaccgaatgcgtgccaaagctagagtgatgagtgaaatagaggaggtacaggaatag

SEQ ID NO: 6774 - DNA, 279 bp, Glycine max
  Peptide Sequence Number=SeqID_98459
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggcgcgtttgtctcattccacgcctga

SEQ ID NO: 6775 - DNA, 409 bp, Glycine max
  Peptide Sequence Number=SeqID_98460
acgcacagctaaggagaatccgatgcgaaaaatattattgctggccgccgttttgctggcatccgcaccgatcgtcacccaggccgaggagattacgcttttaccggctattaaactgcagataggcgaccgggattcctacggtcattactgggatggcggccgttggcgtgacaaagactactggcatcgtcattatgaatatcgtgacaagcactggcgaaagctagagaaaaaacagcgtaaagcctacgagaagggctatcacgacggtcgtaaagacgcgaagaagcggatccactgcggtgaagattcgtgcggtagctatggccatatcacagctggaacccttttacgcacagtgattaaggatattcagacttgttattcaagcagggataacccttaa

SEQ ID NO: 6776 - DNA, 230 bp, Glycine max
  Peptide Sequence Number=SeqID_98461
atggcatgcaaccttcgcttgaccgctttgaggaacttgacacccatcgttaagcaatccgtgaagttccgcgacatgtcgggagtcgaaaggaaacatcattgcgcaatccgtaaatcgaagtgcttccgtaacgcttccgtaagcgatcctgtggagattcttcatcgttcttcgtcgttcttcactgttcttcacccgttcttcgttcgttcttcgttcttcaacgg

SEQ ID NO: 6777 - DNA, 576 bp, Glycine max
  Peptide Sequence Number=SeqID_98462
ggagtgcaagaacagatgaaggtcgacctatcggccttaaaagatcaaatggcttctatcacggaggccatgctaaagcttcaaaaaactatagaagataatgctacggcggccgcttccaatacaactagggaagcggaactggtgctacagcccgcaataaacttgggccgagacagaaacgcgacgggttttaatcggaggtatagtcctcaagcctacccttatggtttgcctccagacttcactccccgtaccgctcccgacgatttgagccaagcccctaccttcgcggggcagctccctcctcatgatccaaccccccatgagttgccccaaccaaacatagtccaccacgtcccgtctccatccgcacccgttaaggaactcgttccctttgcaaaagacaagggaaagattgatttacttgaagagaggttgagagcggtagaaggcctcggcaactatccgttctcggatttagcggatctgtgtctggatgggggcatattctacggacgaaaaactgttaatgcacttctttcaagacagcttagccggagcagcagtggcgtg

SEQ ID NO: 6778 - DNA, 183 bp, Glycine max
  Peptide Sequence Number=SeqID_98463
ggacaccaggaattaactattctgcgaagtgatcttccgtcacagtggcttctgtttctatcagctgtccctcctgttcaggtactgacggggtggtgcgtaacggcaaaagcaccgccggacatcagcgctggcaagtgtagcggtcacgctgcgcgtaaccaccacacccgccgcgcttaa

SEQ ID NO: 6779 - DNA, 243 bp, Glycine max
  Peptide Sequence Number=SeqID_98464
atggggttctcagttgaaggaaatgaacacatggtgtgcatactaaagaaatcaatatacagtcttaaagcaagcttctcgccaatggtcagtgggactaacgatcttggtcttcttcatgagactaagaaatttctctctataaactttgaagtgaaagatatgggtgagctgatatttgtcagtatgttttggctaatgtcacatggccaagtggacgagaactttattaatgctctgtga

SEQ ID NO: 6780 - DNA, 318 bp, Glycine max
  Peptide Sequence Number=SeqID_98465
atgtttaagcagggaatgacaaccaaagaaaatgacaagaaaaagaaaggaattgcacttaaagcctcattttgtattcaagaagaaagtggcagagaaaacttgaatgaaatagaagaagatgatgattttagtttcttcataaagagattcaacaagtttctaaggaacaaaggaaatcaaagaagaacaaatttcaatccaaagagaaaaggagaagactctccttttgttccaaagtgctatgaatgtaatcaacctagacatctacgagttgattgtcccagtttcaagaaaagaatggagaagtctgattag

SEQ ID NO: 6781 - DNA, 54 bp, Glycine max
  Peptide Sequence Number=SeqID_98466
atgtcgcggaacttcacggattgcctaacgatgggtatcaagtacctcgaagtg

SEQ ID NO: 6782 - DNA, 219 bp, Glycine max
  Peptide Sequence Number=SeqID_98467
atgggggtgcaaatagaaaccaggcccacttgggccttccagaaaattcctccagaaggcggttgcttctggaggaagcaacctagctcgcctgggcgagctggaaaatccaagccgaggcacttccataacgtttccgtaacgtttctgggtgatttcgcgaagattttcaaccgttcttcattcgttcttcgtcgttcttcggtcttcaaccggtaa

SEQ ID NO: 6783 - DNA, 681 bp, Glycine max
  Peptide Sequence Number=SeqID_98468
aggactacacgccttcaccttcacaggactacacgtcctccccatcagagggctacacgccctcacccttagaggactacacgtcctcgccatcagaggacttcacgtcctcgccttcggaggactacacgtcctcaccttcagaggaattcacgtcctcaccttcagaggactacacgtccacgccttcaaagggctgtacgacctcgccatcagagggcaagaggccctaacctttagaggactacacgtcctcaccatcagaggactactagtcctcaccttcagaggactacacgcccttgccatcagagggctacacgccttcaccattagaggactacacgtcctcgccatcacaagactacatgtcctcaccatcagagggcaacacgccctaacctttagaagactacacgccctctccttcagaggacttcacgtcctcaccttcagagggctacaagccttcacctttagaggactacacgtccttgcatttagggggctgcacgccctcaccttcagaggacttcatgtcctcgccatcagagggcactacacgtcctcaccttcagaggactacacgcctctcaccttcagaggactacacgtcctcgccatcagagggcaacacgtcctcaccttcagaggatttcacgtcctcaccttcatagggct

SEQ ID NO: 6784 - DNA, 411 bp, Glycine max
  Peptide Sequence Number=SeqID_98469
atgaactcgctaagcgcacttatcgcgctaagcgaccgagctttcctgggccaagcgcaatttgttgcggcatcctctgagctaaatgtcttccagaaaaagaaaaaagcattggtgcaaggcccacaactctatgacacaagaagatttcactccttcgaggcctggaccagatacatagataatgtgctaggaagacatatactagctaagaggaaggtagaaatataccatacggaattggatgagttcaaggctgaattggagaggcgtaacttccataagcgcctcaccaatttagctgacagcaacttcgacctagccttttgtgaaggagtttcatgccaacctttacaatcccgaggggccttcaccaaaacaagtccagaggggttgcttctaacagcctag

SEQ ID NO: 6785 - DNA, 540 bp, Glycine max
  Peptide Sequence Number=SeqID_98470
atgtgccacgactgcggctggctggcggagtgccagcgttgcgacagttattacacgctgcatcagcagcatcgtcagctgcgctgccaccactgcgacagccagcgtccgctgccgcatcagtgtccgggctgcggttctacccatctgctgccggtcggcgtgggcacggaacagctggagcagcagctcagtacgctgtttcctggcgtaccggtgtcgcgcatcgatcgcgacaccaccagccgcaaaggcgcgctggaacagcatctggccgatgtgcatcgcggcggggcacgcattctggtcggcacgcagatgctggccaaaggccatcacttcccggacgtgacgctggtatcgctgctggatgttgatggcgcgctgttttccgccgatttccgtgccgccgagcgctttgcccagctttacacgcaggtcgccggccgcgccggccgcgccgacgctgctggagcgccagtcagtgcagctgccgccgtggaccagccacgcactgtttcgtgcggaagatctggataa

SEQ ID NO: 6786 - DNA, 999 bp, Glycine max
  Peptide Sequence Number=SeqID_98471
atgtactttgtcgcctttatcgacagggttaacgtcggctttgccaaggacgcgatggccatcgatatcgcgctgtcgcaatccgcctttgccctgggcgccgggatattttttgccgcctatgcgctgttcggcatcccggccaacctgctgatgaaccgctggggcgccaaacgctggctcagcgccaccaccgcgctgtggggggcgctgtcggcctgtaccgggctggtgacgaacgaacagcagtttatcgtcttacgctttctgctggggatcgccgaagccggcttttaccccggcatcctgctgctcgcgtcgatctattttcccaataaggtgcgcgcctcggtgatcggcattttcgtgcttggcgtgccggcggccctgacgctcggctcgccgctgtcgggagccttgctggagatgcacggcgtgctgggcaaacccggctggttctggatgttcgtgctggaggggctgccggccgtcgccctcggcgtcttcgcctttttctatctcgacgatagcccgcagcaggcccgctttctgaccgaggaagagcgtgcggcgctggtggcacagttggccgccgaacagcagcagaccgaaaccagcagcgtcaaagcggcgatgagaagcggcaaagtttggcatctggcgttgatctacggcgccctgcaaatcggcgtgtacggcctgatgtttttcctgccgtcgcaggtcgcctcgctgatgggcacccatctcggcttcaaggcctcgctggtggccgccattccctgggcgttctccgcgctgggcgtctatttcctgccgcgctttgccgacagaaacaccgccagaagattaccgatcgccgtcggctgcatgatcgcggcggcgctggggttggtggtctcttcctatgccggccctttgctcgctatcgtcgccctgagctgttgcgcagtcagtttcctggcggtacagccgattttctggacgtttcccgctcag

SEQ ID NO: 6787 - DNA, 276 bp, Glycine max
  Peptide Sequence Number=SeqID_98472
atgcaaactatccgcaagaatcattgcattcagtctcaaacgggaatctacggttcactcagcatgaacaacaattatttatatagcaaattacattcaacacgtataacaacattcatgacatacaagaacattcatgacgtacaagaacatacaaggacatcaacagttgtgtgtggtagcaaaggatcattaaattgtaaacatcatcagctacatgataagggaagcagtatcaaatcaatgctttacaagctttttggtagggagcaataa

SEQ ID NO: 6788 - DNA, 168 bp, Glycine max
  Peptide Sequence Number=SeqID_98473
atggcagcgcaattaatccatgaccgagtggagatggagtgcctagagggagtttgggagaccctcgaaggcaatgcaagaggaaccagcacgcacgcttcagcgcactgtggagtggatattacctacacctactccatagcgactagtggaggttcttcatcatag

SEQ ID NO: 6789 - DNA, 243 bp, Glycine max
  Peptide Sequence Number=SeqID_98474
atgattcctccacccagaattgtacctgttgctggagagcataagcttcaggctattcaattgcttcagactgttgcacagaagggcaaagattttttatttgtggccagttgggttaccaggttaaccaaggcatctagtttaccttcaagcttcttagtctcggctgatgaagatgaatttgtggctacttcatgcactcctctaatgacaatagcatcacttctggcactaaattgctag

SEQ ID NO: 6790 - DNA, 203 bp, Glycine max
  Peptide Sequence Number=SeqID_98475
gtgtagctgattcagatgatgaggggtctacagatttgaggacaaatcctcttcaagggggaggggatgatgcaatcctccaaaggaggggacccattaccagagccatggctaggagacttcaagaagattgggccagagatgcaggagaaggccctagggttctcatgagccttagggtagattttgggtccatgggctaa

SEQ ID NO: 6791 - DNA, 1035 bp, Glycine max
  Peptide Sequence Number=SeqID_98476
atggcagatcatgccgctgccgccgccgaccgcgccttcctgcggcaagccgccccgggccgcctgctgcgcctggcgcacgtgctcggccttgacgtgaaagccgttgatgtcgttgagcaggccgtcgaaggtttccatcaccaccggcatattccaatacaccgcgttatcgcccgcgggcagcgtttcacgctccagcgcgatcagcgcatcgcgcaccacgcccacgctgtgggtgttggtgaaggcgatcgggctggtcagcaggcccgcttcgcgcacccattccagaccggtggcgtcgccgttgccgttcaacacgtgcaccccggcgaagcagggcgcgtggcgcgcggagccggggcgcggttcgatcaccgtcacgccggtgcgcacgctgcgcccgtccgccaaatcggcatggatgctggtatggccgacgcgcacgccgggcacgtcggtgatggcgttcagcgggccgggcgtgccctgtccgatgataatgcccagatcctgagcgcgctgcgtcatggttattctccttctattgagggggcggcgaggggcgccggttggcggccgcgcagatggttcagcgccagcccgaagccgatgatgccggcaatgataataaagtctttcaggctgctggcgatcaaaatcgtccacagcacgtacaggcagcacagcagcgccaccaccaccggcagcggccatagcggcatcaggtacgggtggtggaagtggcggcgacggcggctgatcagcgccgccaccgccatgatgatgtacaccagctgcagcaggatcacggtgaacgaggtcagcgattctagatcggagcaaaacgccagcagcgccgacggcactccgaacagcagggtggcgatccagggggtgccgaagcgcgggtggatgattttcagcgcccggttaaacgtcagcagccagaagccgtcgcgcccgctggcgaacatcatgcggctgaactgcgccacgatggcgatgatggcgttgaatcccgacagataa

SEQ ID NO: 6792 - DNA, 141 bp, Glycine max
  Peptide Sequence Number=SeqID_98477
aaatgggtttatgatcccaacatggaaaacgcaaggatgagcaaacatgaaaacaaatggtatgcaattttgcagatcaaaagtttgttgaatgcatatgatgatgccatgactcatgcaaaatgtgaggctggaatatga

SEQ ID NO: 6793 - DNA, 444 bp, Glycine max
  Peptide Sequence Number=SeqID_98478
atgtcttccaaagttattttgattatgccaaagaatcaagaattaagcaaagattcaagaatcaagttccaagattcaaaattcaagaataatcaagatcaagattcaagactcaagattcaagaatcaagagaagactcaatcaagataaatattaaaaagtttttcaaaacattgagtagcacaagaagttttcacaaaatcattaccaaagagttttactctctggtaatcgactaccagaagaggatacatctacttggggattgttatactgagaacaagagagggtacatctcttgtggatcagttcaagtggagggtacatccacttgggttttcaaagagaacaagggaggggacatcgcatgtggatctttggcttgtaaaggattttacaaggttgaaagaaatctcaagaatcgcaggttgcttggggactag

SEQ ID NO: 6794 - DNA, 459 bp, Glycine max
  Peptide Sequence Number=SeqID_98479
atgggtgccaagcacctcaaaatgaccaaatacaagttgcatgccaccaagccaaggtccccggacgaaattagggaacgtcttgagttgaagttatcctcccatggaaggaaggtagagaattttggctggtcggcttcagagattgaagacttagtggctgccacaggattaagtcctctggtcgcatgttccttggacactggtgatcggggacttagatctatttttgcggagaggtggcataagaaaactagtagtttccattttcctgtaggagaggtgactatctccctggatgatgtgacatccttgctacatctgtccattacaggcgccctccatagcttcaaggctcttcatgtggacgaagttgtttttcttttagttgaattgattgaagttagtttagaaaaagcaagagctgagacaatacaatgctatggggttggtaattaa

SEQ ID NO: 6795 - DNA, 310 bp, Glycine max
  Peptide Sequence Number=SeqID_98480
atgtcggaaactttgttgaaggatgtcgagggaacatcgatcatggagtctcctcatcattctgtgcattttgagcattctgagtattctgttgctggtgattctgaacattctgattttgagtattcgactactaattttcatactgagaacatggctcaacctccacctcatgagaggactcttagggagatggctgcacctggtttcacttatgaaagtttgtgcattcaatatcctgatgagggtgttccatatgttctcatgactggactaatacatttgttgcccaagtttcatggtcttgcag

SEQ ID NO: 6796 - DNA, 258 bp, Glycine max
  Peptide Sequence Number=SeqID_98481
atggctactcagttgaatcaagctcagtcccaagattctaacaaattaccttcacaaactatgcaaaatccaaaaaatgtgagggcgatcaccttgaggtctggcaagcaaattgaagtgcctccaccagtagcagcacctacacctaaaaaaatggatgagatagttgcacaaaagagaaatcttcctgatcatgagcgagctaacaaaaattatcatgtaggtggaccttcttctagtagttctgacttgcagtag

SEQ ID NO: 6797 - DNA, 195 bp, Glycine max
  Peptide Sequence Number=SeqID_98482
atgcaacagggacaggcagatatcctcatagctaggttccctgaccctaactatgatgttaaaacggtttttcaaaggaagcttaagacatacaatggcggttccaaagtcagaaaagatgcaagacagataaaactaacaagaaacaagcgtagaaccatggttacctcgaaagaaaacgaaaggtcagactag

SEQ ID NO: 6798 - DNA, 138 bp, Glycine max
  Peptide Sequence Number=SeqID_98483
atggccggcaaagggcaacagacgcaccgccgccacctccagagcccctcagctcatctacaaaggctggagcgttgcctacgacccgtagtcgaccagcaggcgaccaagtccaaagccaaagtaggacacacctag

SEQ ID NO: 6799 - DNA, 621 bp, Glycine max
  Peptide Sequence Number=SeqID_98484
atgtctaaagttctgatctttaccaataataagaagaactccgatttgttatttacaaagattgaggaacttttccccggacaatttgatgttattcactccaataaatctcagaattacaggttgaaagcgatgaaacgctttgaaaatgaagaaatcagaggccttatcactacagacgttatggcaaggggacttgatatctcagatattacccatgtcatcaactttgagactcctgaagttcctgaacagtatatccatagaattggtagaacaggtagagcagataaaaacggtaaagctgttacttttgttacaaaaaaagaagaaccgttggtactggatatcgagcttttgatggataaagagctgaaatttatagatttccctgaagaagtaaaaatcaaccctaagaagattgcatcagaagaagaccagattataatgaagaatccggcacaggtgaagctttacgaaggaggtggagctttccatgagaaaaaagataagaataaaaaggaaaactggggtggaccttctaaaagaaaagcaccaaagaaatttggggctaacagggcacagcagaaagcaatttcgaaatcaaaaagaaagaaataa

SEQ ID NO: 6800 - DNA, 339 bp, Glycine max
  Peptide Sequence Number=SeqID_98485
atgatccaagagtccgcaggcacggccaccccttcaaaagaagtggactcccctggataccctgatggtgcacgggtcggttatgagcccggaatgggtctgggcaaggatagccacgggaatgccgatgtggttgacgttaggggtaacccacacaaatatgggttggggtctgagcccgggaaacctggaagaaggaatgcaccatcaagactccgggcagatagggcatggcccggtcatgttagccagtgtttcgcaagtgccgcgataatgttcgaagaagaggtggcggcaataggagaagaggctccacaagatccgctgagtttcgtgtga

SEQ ID NO: 6801 - DNA, 437 bp, Glycine max
  Peptide Sequence Number=SeqID_98486
atggtgggatacgaaccttcaagcttcacggatttggtcttcgctggtgaaaggatcgaaacgagtctgaaaagtggcaaatttgatcatcttgctttaatgaatgagaaaactggggcaaatgaagaggatgagaatgaggaaggaacccatgttgtggctgccattcctacatggccaaacttcccaccagctcaacaacatcattactcagccaatatcaactcttctcattacccaccacccagtcatccacaaaggtcatccctaaatcaaccacaaagcccacctagcacacaaccaatgctaaacaccacctgtagcacaaaccaaaacaccaaccaaggaaggaattttgcagcaaaaaagcctgtagaattcaccccaattccggtgtcctatgctaacttgctcccatctctactcgataatcaatg

SEQ ID NO: 6802 - DNA, 399 bp, Glycine max
  Peptide Sequence Number=SeqID_98487
atgactagaggaaatctatctgacttacaaccctttgatcctgagatagataggacatttcatagactagttagacatcatttagtaccttttgagcatcctgagcattctgatattggtgattttgagcatcatagttttgagcattctgattttgaatattctgagaacatggcacaccctccaccccgtgagaggactctaagggaattggctgcacctgatttcacctacgaaagcttgtgcatccaataccctaatgagtatgtcccatatgttcttaaaactggattgatccatttgcttccaaagattcatggccttgcaagtgaagacccacacaagcatctgaaagaattccatattgtctgctccaccatgaaaccaccagatgtctag

SEQ ID NO: 6803 - DNA, 417 bp, Glycine max
  Peptide Sequence Number=SeqID_98488
atgcccaaggctactttggacaagctaccttttaatgcatcacacctaagaccgaggtccatggtagtacgggctttcgacggtagtcgtcgggatggacagctgattatagtttcgggagaagaagacatacttgtaagttgtccatcctctatgccttatgtggaggttgtagaggagtcattggaaacatccttccaggcattggaagttgtcagtagtgcttacatggagtctcccccagttcagccacgctcatctggtgccgctttggtggtggctcgagtgatgttaggacacggatatgagcctggaatgggtttgggccgaaacaggaatggcatagcaagtttggtggagttcacaaagaatcatggatgttcgggttgggatacgagcctatgtgcgccaacatga

SEQ ID NO: 6804 - DNA, 381 bp, Glycine max
  Peptide Sequence Number=SeqID_98489
gttccacacgagctcccgttctgcggcgtggtggcaggaccgataggagattggctccgggtagtatgggccctctgacttccagctatgtgttgtgcggctcccgcgaagcgaatgaagggaagctcgaagagcttacgcttactctcagcctctttgattggtcgggggaagctaccgcttatacgacagctctgcttcctcgtcttgcttctggcaaagcttcgactttgcttgcttctctcgcgcttgcttgcgcgaaggcttataaagtccttttcgctaggtccaaaagcttccgtcaaagcgaaagatctgatccaactgaaatcccgcatatccgctgcgctcaatatgcggctacggctaggcgatcatatc

SEQ ID NO: 6805 - DNA, 447 bp, Glycine max
  Peptide Sequence Number=SeqID_98490
atgagtcatcattcatctagtgttaatggtgaggaaaaaatagaaagaaaagaaaaaggaaaagagagggtagaaataaatcaagatgagaggcaacaaataagggaagaagaaagaaggaaaatactaaaagagttaagaaaagaaaaacatgcctcctatagtagtcatgactcttgcaagatcctaagtgaagaacttcatgattattatgaaggaaggcataggtcacatcttatacctcactaccataggagagaaaaggaaagaaatcctcaagaggctaacattaatctcccatacatccatgggaaggacaatgtagaggcttacttagattgggaaataagggtagagcaacaacttaaaaggaattcttcttcaaaatcttatggctctcactcttatccaaagaaagaccaaggtcaagtctactttccctcttag

SEQ ID NO: 6806 - DNA, 339 bp, Glycine max
  Peptide Sequence Number=SeqID_98491
atgtggaaaagacagcatttattatttttacacagttcaagaaaaacgcacacacaaagtttcataattccacactttcctaaaaataggcctaactcacaaaacagtccccagtggagtcgccaactgtcgcaacctacccttttgcgggcgagcgaggcgaggctcacgggtgcgtcttccataggaggaaaatgtgcggagtcaccaccaatgttcattgaaaggaaaacgttagaaaaatcaaaggaaaccggtcatgaagaatattccagattcgggaggatggtattagcacctctcacgtttgtcccaaaggacaacagccttagattataa

SEQ ID NO: 6807 - DNA, 102 bp, Glycine max
  Peptide Sequence Number=SeqID_98492
atgaaatccaaggtccgattcctggtgaaattcttgctccttgtatatcccatggactcacaacacttgcagatcagagttcacaactttcaggcaatctga

SEQ ID NO: 6808 - DNA, 47 bp, Glycine max
  Peptide Sequence Number=SeqID_98493
atgcagtatctaggaagtgatcctaggtcgtctcccaatgagcaatg

SEQ ID NO: 6809 - DNA, 330 bp, Glycine max
  Peptide Sequence Number=SeqID_98494
atgcacgatgtcatgcttaaagtttggagcactgaccattatgcacgcctcatgctgggagggttatgcatgagtaagcatggctcatgcttaagtatgcaaggggtcatgcttaaagtttggagcactgaccattatgcacgcctcatgctgggagggttatgcatgagtaagcatggctcatgcttaagtatgcaaggggtcatgcttaaagtttgcagcgttaaccaatatgcatgcctcatgcttggaaggttgttcatgagtaaatatgacccatgcttagctaagcacagggttttgcttctgttaaacaagtggcctcaataa

SEQ ID NO: 6810 - DNA, 870 bp, Glycine max
  Peptide Sequence Number=SeqID_98495
gaatttaaagagaggcttttagatttaggtgttgaggtgagtcgagttttgctacctggcgatcaagcaacctcacaagtttcagggggaagtcagctatcatcaaaggattcgtttctttcaaaggctgaagccaaaactattttagaaatcgatgccatttctgaggacgttgtttgtgttacggtggggactattagcaaaatagtcatggataaccattcatggtcttatccagcctgtgctcaatgtcataggaaaactgacatccaaacaggaccattcacatgtggatgtggcaaggataatgatcagcctgttctgaggtataaagttgaagtcatggttacccaaaacaatgagagcagcacatttttgctctgggaccatgaatgtgctgaattgattggtgaaacagctgatgatgtgaatagggtcaagattgaactggtgaatttctgctgtttctggcaggatggtgatcttgatttggatgcttcccctcaagcacttgacaaattgttgggtcatatgcttgcttttaaggtcaggattcaatcaaaattcaaaaatgcagttgtacttagatactcaaaagacctagatttgatcaatgttgttctcgagatgctgcctgatagtgaggcatgttccaaaatagatccttccaatgctgattgcaatgatgctacgcatgctgaatgtcaatctctgtctgtcacagctgaccatgatctggttgcgggattgcctttaacacccaaaaagcggattccatctaatgaagccgatgatgagttagggagctctcaaatttcgccagcccaactatcgtctaacaaattaacaagacattctcataaaagctaa

SEQ ID NO: 6811 - DNA, 573 bp, Glycine max
  Peptide Sequence Number=SeqID_98496
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagggttattgagaatatggtgtttccgtctcagcccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 6812 - DNA, 257 bp, Glycine max
  Peptide Sequence Number=SeqID_98497
gttgaagagatctctaacagaccttggaggaccgaacccacgtatgtggcaaaatacggggatgacttgtggctaggggtgaaaggccaaccaagatcggatatagctgatccaaagtcaagagggaaacagcccagatcgtacgctaaggtccctaagcaatcacttactggaaaaggaagtgatcgaacgatgacaaccaggagggctcaagtgattcacagaagcgacgagaccttgaaagttgcttttcaagt

SEQ ID NO: 6813 - DNA, 705 bp, Glycine max
  Peptide Sequence Number=SeqID_98498
atggcggaaccatcaaagaagcgcaaaggttattcgagtagaagccaatggcactccgaggctcaggatactccaattctttccttcatttcctcctcctcatttttctcatcggaagaacaacgtacacgtgacggagtaccatttgaaggtgcactagatgatgattggaaattcaatttttctgtgcatgatgcccgacggttggtttgcaccaaccaagcggatatgactggaaggctgcttgccagttcattggctcttgaaagccgcatcctccattatctaattgctcgtatcttactccgcagatcttcaaaccttgcacaagtttctgaagaagatctaatagtcatgtgggcctttcataccagtcgacaaattgattgggcacatctagtccggtatcgcatgcataaggcattgcgattaaatgctcctttgccttatcctcacttaattactttgttccttcaacattttaacatccctcttgattttgaaccttatgttccaatcaagagatctttcttgatcgatgctgctgtggttgcctcctttggttaccgcaaaaagcgtgatggctcttgggagactcttctctccttcagagtattttggacaggtttgatggacttcaaacctatgttggtgagaggtttgactccttggaacgtcaagtggacacacgattcaaggagatga

SEQ ID NO: 6814 - DNA, 655 bp, Glycine max
  Peptide Sequence Number=SeqID_98499
atggcgcacgccgttgcacgcgccatcgataaggctcagccgctggtggtcgaagccggtaccggcacgggtaaaacctatgcttaccttgcgccggcgctgcgggcgaaaaagaaggtgattatttccaccggttcgaaggcactgcaggatcagctctacagccgtgatttgcccaccgtggcaaaagcgctgaaatataaaggccgtctggccctgctgaaggggcgctccaactatctctgtctggaacgccttgagcagcaggcgctggcgggcggcgacctgccggtgcaaaccctgagcgacgtcattatccttcgcgcctgggcgaaccagaccgaagagggcgatatcagcacctgcgcgagcgtgccggaagactctcccgcctggccgctggtgaccagcaccaacgacaactgcctcggcagcgactgcccgctgtataaagactgcttcgtggtgaaagcgcgcaaaacggcgatggatgcggatgtggtggtggtgaaccaccatctgttccttgcggatatggtggttaaggacagcggctttggtgagctgatcccggaagcggacgtgatgatcttcgacgaagcccaccagttgccggacatcgccagccagtactttggtcagtcgctctccagcc

SEQ ID NO: 6815 - DNA, 672 bp, Glycine max
  Peptide Sequence Number=SeqID_98500
atgtcttgcctagtgatcataactccgaccttcctctgccgaagtgtcagctggtgtatgccacccactaggcaccctctagacccggataagtctaacagggccctggggtttccagcattgatcacgggcctttgccagtcattcggggttcccgtcacacctagtaaggtgatccgaccaccgatcacccgggccttcattgagaagtattgcacgcctaggcaggcacagggcgatgcaccacaggccgcagatgcaccaccaccacctcatcaggctgatcttgttgggtcattaggcatggagcggtatctacagcacttggttcgccaacaggcggccaaccaccgggggcaggtgcagatacatgagtgtctctaccagctcagccttagtcagcagggccagggtttcgttccttttgtgtgccctactcctgatcagtttagggctgaggtcgcatggcctggagattggctcgaggcccaggctggggaggcgcctgcagaggctcccggcgatgcagaggagacctgcatggatgaggagatgacagatttgctcgatttcttgggagggagcaggagccacatgaccatgggatccccagattcatattcttttttatgtttcatcctttatcatttacatgttattttatttctatga

SEQ ID NO: 6816 - DNA, 360 bp, Glycine max
  Peptide Sequence Number=SeqID_98501
atggaggagtttgaggctcaagtggcctggccaggagaccagccctcttcttttgggggggggggggggtgggcctctgcagtccaggagcctgatattgaggagccaccagcaccagcaccaatagaggataaggatgagctcactcctcctgaaccctcttattttgatgcaggtacacacacggttcaggaggaggagactgctccaaatcagattccacaaccatctccagcccctgcatatatacctgaggatgctgcaccagttgtggagcctgagcagcttatacaggattcatcagcagctctaacactggatttgaatgaagaccagccacaagaggagcaagatgtttaa

SEQ ID NO: 6817 - DNA, 747 bp, Glycine max
  Peptide Sequence Number=SeqID_98502
atgatattactggataatggagaaatagagagtgagagatcaagtgatgatgaaatgccaccattggaggattgcagtgatgttgatgttgttgaacctgtatatggagatgttcttgttactaggcgttctcttaacaagcagtctaaggcagtgcaacctacccattcttcaattatgcacattaggggatgcaacatctgtggtggggcccatgagtcaggcatgtgcatggtccaagaggatgtatccaaagaagtcaactatatgaccaatccacaccgtcaagggttccatcaaggaggacctccaagatacaatcaggggggaatttctatcaaggccaaggtttctctgtcaaatcacaagagcattaagtctgccatcataaatctagaggtacaagtggaccaattagctaagcaattggttgaaacatccacagacaattttggggccaacatggagaagaatcccaaggaggagtgcaaggaaggagaggataataagagagaagagggtgatgaagagaaagaagagagcaaggagaagggtgaaaaggtcttacccactaagaccaagagtcagttagcaagggaggctagaaaagagataccctcagtccgagtgaaggacatcccatatcccttagtgccaccaaagaaagacaaggagcaatattttgctcgatttcttgacatctttaataagttggagatcatcattccctttagagaggccttatag

SEQ ID NO: 6818 - DNA, 192 bp, Glycine max
  Peptide Sequence Number=SeqID_98503
atgaggagtattcagatgcaagaagtcatggaagaaagcgaagaggcgaaccaagaagagataatcatttgggacaatccctatgtttcaaggtgcaggaatggtgaaaggcctattagcatatgggaggagatgaagattgccatgagaatcaaatttgtacctagccactatcatagggatttgcactga

SEQ ID NO: 6819 - DNA, 327 bp, Glycine max
  Peptide Sequence Number=SeqID_98504
gaatttaaaaatgtctttcctaaggagattcctcatggaatgccaccttcaagaggcatagaacatcaaactcaacgtaaggatgcacatgccaaagttgagtatgtgaaaagattgtatgaccaagtgaatgtgcaaattgcaaagaagaatgaaagctataccaagcaagccaacaagaaaaggaaggaagtggtacttgaacccggtgatgatcttggacatttgagagcaaatgttttccaagaaggagggaatgatgagagtcctgaaactggccaaatacaggctaaaggcccaagtggagaaggacgaaggcccaagtga

SEQ ID NO: 6820 - DNA, 573 bp, Glycine max
  Peptide Sequence Number=SeqID_98505
atggctgcgatttcttttccgctgatgcttgcactgctttccgcgcaggccccgatggccgcaaacgcggaacgtgattacaccggaccgacagaggcatcctcgatcgggcctggcatctgcgaccccggcatggacatgctgccgaacggcggaggcgtggtgatccggcgctgcggcaagaacggtacggtcgcgggcgttggcagcaatatcgatgctgcgacggccaacaccaatggcttccttgccgtcgccgaggaaggcccggtatgcagtgttttcgcgcgcgacccttatgtcagcctcccggcaccgggtgtcggcatcaaggcgcagtgcagttccacgccgctttccgcctatggcatgacgaccaccactgcgggacagaacgtgcttgagctggccatcaacctggcggcgacccaggcctggtgcaatgtcgactactacaatggttcggcgcatggctataagtatccctacacctgcaaccgcccgggccagtcctggagcgttgccggtcttggctccagcgtcgacgatgcaaacgcgatggcaatgcggctt

SEQ ID NO: 6821 - DNA, 105 bp, Glycine max
  Peptide Sequence Number=SeqID_98506
atggaagagatacatggaaaagaggatgaagaacaaggaattaaactccatatagagcttgtaggccttggatcttcttcgtcaatggagtcctttgcttcttga

SEQ ID NO: 6822 - DNA, 348 bp, Glycine max
  Peptide Sequence Number=SeqID_98507
atggagcatgaaacattccttgcaacttggttggcagagattgatttctctctcaatggcttggagagattctcaaatttgcaaccacagcctagctaccatgaaaaacctatgaaaaacctatggatggtggaagcagtctatccaatgatgctggtgtttccacctgaattttctcctttgaaaactattttatttggaaatccttcccaagacaccgttgaaaaactgatggaggctttggaggaagattataaagatggaaatgagataaatgaatcaaggcagtttattggaggagtattggatcttgaaaagagaatcaatagactagatacattgacttag

SEQ ID NO: 6823 - DNA, 327 bp, Glycine max
  Peptide Sequence Number=SeqID_98508
atgccaaaagaggcgaacttcataattgaggagatccacgagggttcattcgggacacatgccaatgggcattatggcaaggaatggggatccttagaggccgattggcatgaatgttgcctttcgccctgcacggatatagaacctcggtacgaacttctactagggcaacgccgtattccttggtttccatgggatggaagcagtaccccatttgaggtagaggttccttctcagaggataataatggaattaggcttcttatataagagtcagaataggggctcaagcgacgcatacgaccaactcccttatagaagatcataa

SEQ ID NO: 6824 - DNA, 597 bp, Glycine max
  Peptide Sequence Number=SeqID_98509
atggagagaagtatgatagatgctgccagtggtggagcccttggagacatgacccctactgaagccagaaatttaattgagaagatggcttccaactcccagcaattcagtgccagaaatgatgctattgtcattagaggagtgcatgaagtagccacgaattcatcttcatcaggtgagactaagaagtttgaaggtaaactagatgccttggttaacctggtaacccaactggccatgaatcaaaaatctgcacctgtcgccagactctatggtttatgctcctctgccgacccccacacagacctttgcccttctgggcaacaatctgaagcaattgaacagcctgaagcttatgttgcaaacatctacaacagacctcctcaacctcagcagcaaaatcagccacaacagaataactatgacctctccagcaacaggtacaatcccggatggaggaatcatcccaaccttagatggtcgaatcattcacaacagcagcaacaacaacagctttattttcaaaatgttgctggcccaagcagaccatacgttcctccaccaatccagcaacaacagcaacagccccagaaatag

SEQ ID NO: 6825 - DNA, 818 bp, Glycine max
  Peptide Sequence Number=SeqID_98510
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccaccgtcatacgaggaatcaccttattaaacttatgagcatcaattcctttagaacgcaaatgaaccgtataatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 6826 - DNA, 300 bp, Glycine max
  Peptide Sequence Number=SeqID_98511
atgaagaacgaacgaagaacggatgaaaagcgacggaaaaccttcacagatttgctcacggaaacgtctcggaagcattacggaagcacctcggcttggattttcttcacggaaacaattttttcacccaaaaaagccgaaatgcatagccaaggggatcgggctgcacaatgcacaaggcaagataaaatgtcaaatgaagaattgaagctgcaggatccacgatgtcggatacaatgtccaggacatcctgcccgaaaatactggacacataaatctgttatacctttaacagattaa

SEQ ID NO: 6827 - DNA, 391 bp, Glycine max
  Peptide Sequence Number=SeqID_98512
gtctgagttcctcattgaggatacgcaggagcaagagcctcgcttttgtcggccgcctcacaatctctatcatactggccctgaggtcataggcggcgagcctgatgacatgcggagacaaattatggtcattccgtaccttttgtcattcagggacaatcgtgttcgatggcatgcagagacaaattatggtcattctccacctttcgtcaatcgagaggaacgaatttggcagtatcaggatgatgttggtcgttcggtgctgatcattttcaagatttttgcagttcgtgaagttccgcggcatgtcgggagtttgaaaggacgtgttaaggcgcaatccgtaaagttctgtaacattctggaagccaaagaagggatgattgcgtaa

SEQ ID NO: 6828 - DNA, 171 bp, Glycine max
  Peptide Sequence Number=SeqID_98513
atgaatgaatttgacatccttgtctctctcatcctttctgtcgcaacgtgcccttcgcgggcgagcgagggcgaggctcacgggtgcgctttccaaaggaggaaaggtcgacaaaagcggggcttttgctcctacgtaccctcctttggagaggaaatcagacctacgtag

SEQ ID NO: 6829 - DNA, 867 bp, Glycine max
  Peptide Sequence Number=SeqID_98514
atggcaagaatagccaaggtagtcaaaatcttggcacaagaattggaccgagtaaagcaaaatagaaatggggtggtcaaaataccgaggaagcacttggaggagaaagcgaaggctttggcggatcaaggtgaatgggttttgttcattgacgtcttggcactattggtatttggagtcatcctttttccaaatgtggacagattagtagatctagcggcaatcgatgccttccttgcttaccaccatagtaaagaaagcccggtcgttgctgttttggccgatgcctatgacacatttgacctaagatgcgagaagagcggcgcaaggattgtctgttgcacacccgctctttatgtgtggttggtctcgcacctctttcatcatgaaagtagacctgggcatctgtcagttggttcccctgatggaaggaaggaagagccagagtcttgtccttgtgcgagggggtcgccatcggaagaaagtaccacgcccttcatcacacggggtttcagtgaccccaatgcaaggatatttcaaagggtccgaaaggcatggagtgcggtgcaaagaaaggataaggaatttaggggaagcagcaatgggatagttggcggatatcacaagtggctgaaggctcgaacacaagagttagattggctcccgaagctgaaggtctcaagtgaggaagaggctgaaacccccgacgagagtgaggaggtgcaagccttaaaggtggaacttgaaagggcgcaagcggtcaaggaaaaattcaagacgacagccatgatggtccgaaaggagtgtgacgaactaggagacatcaatgtggccacagccgaagcattggaatgggaaataaagagg

SEQ ID NO: 6830 - DNA, 154 bp, Glycine max
  Peptide Sequence Number=SeqID_98515
atggcagaatcgtcaaagaggcgcaagggctcatcatcctccaccaccactgccggccaccaccgccacggtccttccgatgaccctctgacaccacccaatccatctctttcctcatcgcgctctcttactttgttttccattgatgtccaac

SEQ ID NO: 6831 - DNA, 309 bp, Glycine max
  Peptide Sequence Number=SeqID_98516
atggtccaacaatttttcgtccgcggaatacgcccccatctttcggcaatacatccgaagatgccccttcggacatgtcgtccctttgtacttatcaaagtccggccctggactgctcttaacctctcttcaagcgcctcaatctttcccttatcttccgcgaagggaacagattcttttatgggtgtgggtgaggtcgggatatggcggactatgttcggctggggtagttcatgtggggacagatctttgaggtggagcagggggccaagatgggtatctccttcctcatcgtcttgcccgggatag

SEQ ID NO: 6832 - DNA, 168 bp, Glycine max
  Peptide Sequence Number=SeqID_98517
atgtgcacatgtgcaatttttggtgccccaaaatgcttgagtatgcatgtatgtgagtttagccaaggagatgtgtgtgatgtaagtaacaaatacaccttggaggaatggccccgaggaagcttgcctcaaagaggtcaggaaggacaaggtggccgaaggaactag

SEQ ID NO: 6833 - DNA, 84 bp, Glycine max
  Peptide Sequence Number=SeqID_98518
atggctttctatggtggaagcaaaggactccatttgatgaagaagatccaaggcctacaagctccacatggagccacatcatga

SEQ ID NO: 6834 - DNA, 81 bp, Glycine max
  Peptide Sequence Number=SeqID_98519
atgaagaagaattgccccaggttccataaatggcttgagaagaaagggtatgcaaaacctaaggaaaccagtgggaagtga

SEQ ID NO: 6835 - DNA, 213 bp, Glycine max
  Peptide Sequence Number=SeqID_98520
atgaagaagatcctaggcctacaagctccaatggagcttgcatcactaatgttagctttcaatgggggtttaccggaaagtgcaccggattgtcaacctaaattactaaacgttcgatccctcgtcaggctgaatatccaagcttcgtccgcagatccctcatttaagactacacccgatttagacagccctcttacgtttagactaacttaa

SEQ ID NO: 6836 - DNA, 372 bp, Glycine max
  Peptide Sequence Number=SeqID_98521
atgcggggttaccttatggttaccgcacctttcgtcaaccaggggcaaacgacgttgaccactgatgtggagactaacatcgtcttctgcaccttttgtcgtcctgacccaggaagtcaggtgacaggctggggttacttatggttacccgcacctttcgtcaaccaggggcaaatgagcccattgaacgcccagagactaaaatcatttctgcacgttttatcgtccctacccgtgaagtcaggtgacatgcggggttaccttatggttatccacacctttggtcaaccaggggcaaacgagcctgttgacgcgcggggactaacatcgtcttctgcaccttttgtcgtcctgcaccgtgaagtcaaatga

SEQ ID NO: 6837 - DNA, 815 bp, Glycine max
  Peptide Sequence Number=SeqID_98522
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccagcactttttatcccactgccttttgccctccgttgatcctgatgagaagtcagctgttaatcatattgttgctcccctggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 6838 - DNA, 471 bp, Glycine max
  Peptide Sequence Number=SeqID_98523
atgaagcacttcactgacaccctcatcagtgccaacatactgacttctcatcaggatcaacggagggcaaaaggcagtgggataaaaagtgctggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 6839 - DNA, 309 bp, Glycine max
  Peptide Sequence Number=SeqID_98524
atggcgggaaggcgtgctcattttgaatttgcacatcatgggggctgcccatacttcccaaatctttgcctaccatatctgaggttggatggttcattgatgccggatggggacgtcgggttcaccttagcaacaacgctggtagcggcaattgcaaccgcattggcttccattatcttcttcacgctcatcatgacctccatcattgtggtcattttctctttcatggctaccatgtgggccttcaccttctcttgcacctcctctgttttacccattactctagctctagcacaggaaagaatgtaa

SEQ ID NO: 6840 - DNA, 240 bp, Glycine max
  Peptide Sequence Number=SeqID_98525
atggaggcccgaaacccacacgtttcacctgagatgcggagaggctaccattactctccaagatgtgtcagttttaccagtgcagcacgtatgcgtggagacctgccgtgcttgcgtatttatatagagagatgtgcagcgccaccgattacaaagttaaatcaattggagggtttaggtgggttggggttggagcttagtgtgttgggcttagggttaggtttgaggattagggtttag

SEQ ID NO: 6841 - DNA, 852 bp, Glycine max
  Peptide Sequence Number=SeqID_98526
accattacacagataacatcctcgcccggaacattcttctagagaggaatgtgaagctatacattactgagtttgatgacttcagaagagaagttgagaggaggaactggcacagggagctcactaatttttttgaaggaagcatagatgtggtagttgttaaagaattctacgcaaacctatatgtccccgaggacaaagcaccaaagcaagttagggttcaagggcacctgattatgttcgatgcggactccctcaacaccttcttgaagactcaagtggtcttggagcaaggggagagcttaccttcttactctaggttctgcaggttgaggccagaccctcaagagctagtagtctggatgtgtatccctggaaggggatttgttcttaacgccgagggcttgccgtggaagctcttgaggaaggatcttacaactctagtgcagacctggataatgaagatgaacatgaacataggagcacttatatctggacagatctcgtttattgctcagtccagctcctcgaggcttggatttccagccctcatcactgccttgtgcaaggctcgaggagtcacctcagattctctcacttatgagtcactcagcccagccattaatttggcttatattaagaatagttggaacctggatgacccttcggtcacttttccagggaccaaaaaatccagggctaaaagatctgaggccctgtctccttcagctgcccctgctccctctacttctgctctcccttcagcaccagcagccccagttcttccagagcctgcaccagggacagctcctaattatgtagagcttgcaggatgtggtccaacaacaacca

SEQ ID NO: 6842 - DNA, 249 bp, Glycine max
  Peptide Sequence Number=SeqID_98527
atgcatactggggcaagatttcgtccttaccgtcgtagggagatgagtgcggatcatgcgcaccaccacaactccgacctccccttgccaaagtgtcagttgggattgcgcccggatcgcaccggcaagatacccagtggacccggagaagtccaacagggtcctggggtttccagctctgattacgagcctctatcagttctacggagtacctgtcccccccagcaaggtcatcaagcctcctactaa

SEQ ID NO: 6843 - DNA, 240 bp, Glycine max
  Peptide Sequence Number=SeqID_98528
atggcatcagatccaggtcagattcgagatcttgtgtggcggcagattcagccctttcacgaacacaaccatggtgtctccgctgagggaagcctcattcgtcataacggtttgtggacaggactggttgaacctgaacttggaaaatcggttcaggtgaactggaagaggaagcgctggggtggagcatgtagaagacacactctagttcgtggtgcttttgttgttgagagttggtga

SEQ ID NO: 6844 - DNA, 171 bp, Glycine max
  Peptide Sequence Number=SeqID_98529
atggaaccttgggggttgatggcaaatgggtgtggtagcggaggttgcttaagcgaagaggttgagtgtggaaggaggagtggcgggggtgtagatatgaatgatgatgggtggaagaagaagaacaagaaggaagaggagtggatagaagagaaggagagggaggtctaa

SEQ ID NO: 6845 - DNA, 1717 bp, Glycine max
  Peptide Sequence Number=SeqID_98530
atggcaggagggtctttcacaacaggcactgtgagcaaggagagggcagagcagtacaaggggagagtcactgcttatgtcatcatctcttgcattgttgctgccacaggaggggctctctttggctatgatattggaatttcaggtggggttacatccatggatgactttcttatagagttcttcccctcagtatacagacagaaaaagcatgcccatgaaaacaactactgcaagtatgacaatcagggcctagcagcatttacctcttctctgtacattgctggtttagttgcatccctgatggcatcccctgtgacaagaaagtatggacgtcgagtaagtatcataggtggtggtatcagctttcttattggatcagctctgaatgcttcagctgttaacctgataatgttgatcttaggccgggttatgcttggtgttggcattggatttggaaatcaggctattccgctttatttgtcagagatggcaccaacacaccttcgaggaggcctgaacatgatgtttcaagttgcaaccacttttgggattttcacagctaacatgatcaattttggaacacaaaagatcaagccttggggttggaggctgtccctaggcttggctgcagtaccagctcttttgatgactgtgggagggatatttcttcctgacactccaaatagcttaattgaacgaggattggcggaaaaaggaaggaagctgctggagaaaatccgaggaaccaaggaagttgatgcagagttccaagatatggttgatgcaagcgagttggcaaagtccataaagcacccatttcgtaacatccttgaaagaaggtacaggccagagttggtgatggcaatcttcatgcctacctttcagatcctgactggcataaattccattctcttctatgctccagtgctgtttcaaagcatgggatttggaggagatgcatcactcatctcttcagctttaaccggtggagttcttgctagttcaacattcatttccatagcaacagtagataggttgggcaggagagttcttcttgtcagtggtggactacaaatgatcacatgccaaatcatagtggccattattctaggggtcaagtttggagcagaccaagaattgtcaaaagggttttcaattttggtggttgtggtgatttgcctatttgttgttgcttttgggtggtcatggggtccacttgggtggacagtccctagtgagatatttccattggaaatccggtcagcagggcagggcatcacagttgctgtaaaccttctcttcactttcataattgctcaggcctttcttgctcttctctgctcattcaaggaccggaacggaactcggatcgggacccaaccggttcgtggatcccaaaaccaaatcgaaaccttcgtcgtcgccgccgcgggtctcggcgctgagcgtctcgcctctcttgaggatcttgacatggcccatgacgaggttcgcgctggggcctttcaccaccatgccggagcggtcgccgtcgtggagcctccgccggcgagtctgatggagttggggacaaggcatcgtggtggccttgaagacaatcgtgggagcggagaagagaggttcccattagaaggaaaccaaggagtgatgcattacggtgggaacgtcggtcaccacgtcgaaccctcgactcttataccaattgttgaggggg

SEQ ID NO: 6846 - DNA, 369 bp, Glycine max
  Peptide Sequence Number=SeqID_98531
atggctaacctccaaccccagagtttcaggaagcagatgttggactggttagctcgtcttcgtattgtcgaagatgctgcaaaaggtcttgaatacctacacacaggatgcaatcctagtatcattcaccatgacataaagataggaaatattctcccaggcatcaatatgagagcaaaagtttcagactttggactctccagttttacaaaaacatttatgttccttttttctttgactcccaagaaccctaacagagcaactggaggaggagctctagagaacaccagaaatgccattattgataacagagaatgcttgagcgactacatcgaggtaagggatgagttacttacacgtggagattag

SEQ ID NO: 6847 - DNA, 195 bp, Glycine max
  Peptide Sequence Number=SeqID_98532
atggcaagatccttaactcgtaaaggagatgaaatgaacatcatggacccttctctaaaagggaattccaaaatcgagtccatttggagggtggttgaaattgccatgcaatgtgtagaacaacatggtgcatccaagccaaggatgcaagaaatcattttggctatacaagatgctatcaagattgaaaaatga

SEQ ID NO: 6848 - DNA, 930 bp, Glycine max
  Peptide Sequence Number=SeqID_98533
atggcgtacaccccgctgccaggctggaactggactatcgtgggtgaagtggataaatcggtgctgctcgcaagcgtcaacgccatgcgcgaccgtttcctgctggctggcgtggtcttatccattctctttgcagccctgttcgtggtgcttattcgccggatgctgacccggccgctgcgcaacgtgatccatcttgcccggcaatatgccgcgggcgatctccgctccagcctgcccgtgacgcgccaggacgaggtcgggcagttgatcgatgccatcaacggcatcggcggcggcctgcaaaaaattgtgctgcaggttcgcgaagctgcaggtgagatccatttgggcaccaacgcgctggcctccgataccggggagatttcagagcagatcaacaagcaggcgagcagcgtggaagagacctccgccagcatggagcaactggccgcgaccgtacagcaaaatgccgccaacatggagcaaacgcagcaactggtgggtgaaacctcgctcgcggtccatcaggggggtgaaaccgtcgcccacgccgtgtcgaccatggatgacattcgcgaagcgtcaaaacgcattgaagacatcacccgcgtgatcgagtccatcgcttttcagaccaatattctggcgctgaatgcggcagtggaagcggcccgcgctggcgagcacggtaaagggtttgcggtcgtcgcgcaggaagttcgtgccctggcgggacgtagtgcgaatgcagtgaaggagattgaacagctgattggcgataccctcaggaaagtgagcgagggtcatgcgctgtctgaacagacgcgcctggcgatggatgccatcatcgttcatatcgataacatcagccaactggtcaccgagattaaccatgcctcacgcgagcaatccgcggggatcggtcag

SEQ ID NO: 6849 - DNA, 114 bp, Glycine max
  Peptide Sequence Number=SeqID_98534
atgaatcgaggtgctcggggacgggtacgaatggacgctaggctcgtggtcaacatatcgatgtcccgcgtccggctccggacgatcgagaagtgctactgggaggcagcctag

SEQ ID NO: 6850 - DNA, 231 bp, Glycine max
  Peptide Sequence Number=SeqID_98535
atggggctgagcagcgtaacccgcagcagtcacgtgttcgcaccccctgacctgccaacacagcctacaaatgctaaagggaaggcgaagatagcggaagaacaaaatgacaaagcaatccccgctccggacgaggatattccaatgaaaagtccttctgagaaaaaggatggctgtggcaagaaagaagtgtcgctagaggaggcaggcgagttcctccacattatttag

SEQ ID NO: 6851 - DNA, 192 bp, Glycine max
  Peptide Sequence Number=SeqID_98536
ccccgagtcgtccctcgggccctagagacagatatacctcacgtgtcggagccaggagcaccgtcgacatatgcgaggcccgctgtggtggagcctagacatgcagtggaagtttgccatgtgattgctaagaggttggagcaccatctgagcctaagggggtcacgtcaggctcatcgacacatgaggtga

SEQ ID NO: 6852 - DNA, 327 bp, Glycine max
  Peptide Sequence Number=SeqID_98537
atgatgctattgtcattagaggagtgcatgaagtatccacgaattcatcttcatcaactgagactaagaagcttgaagcagcaacaacaacaacaaccttattttcagaatgttgttggcccaagcagaccatacgttcctccaccaatccaacagcaacaacaacaacagcaacagccccagaaacatcaaacagttgaggctcctccgcaaccttcccttgaagaacttgtgaggcaaatgactatgcaaaacatgcagtttcaacaagagaccatagcctccattcagagcttaactaatcagatgggacaattggctacatag

SEQ ID NO: 6853 - DNA, 558 bp, Glycine max
  Peptide Sequence Number=SeqID_98538
atggctcccgaagacctagagcagctgactcaacaaatcagggaccagctggaggagtcaatcatagaaaaaggacttgcactgcctcttgagcctgaggttggtccttcagctgctcgtgtcaacacaaaggagagttgtgctgatctctcagggaacgatccaaacatgggtgactcagacaaatgcgggttgtacatcaaagaaaatcgtccccgcctagttacccaaggaagagtttatgagggatccacaatcgttcacaacatccctttgttgcatgatcaagtgaaggttagcgttgaggaggttagagatgcagatgctcccattcctgtacccactgaagagggagttgtgggaccagcaaaacctgcagataggccggattatgaggttgatgatcccctatatctgatgacattgaccatcccacaactttttctgaagccattgcaagttatgtgggatgctattgtgttcggggtgtttaatgaagacttccccttgtacataaagcatgaagatttgtctgaaatagcacattgtggtcaatga

SEQ ID NO: 6854 - DNA, 254 bp, Glycine max
  Peptide Sequence Number=SeqID_98539
gttacattaagcaaaaaggcaacagaaatgaagagaaagaaggagttctgaagcaggcccagcccaacactcgcgctaagcgagcaaagaagacaggcgctaagcgaggcgttgagctcgaagatgtagaatccgttacgtgcgctaagccccagctacgcgctaagcacgcgatccaacagaagcacaggctaagcctgcagggcgcgctaagcgcgcgatccgaacgcgctaagcgcgaggtgtcgcgctaa

SEQ ID NO: 6855 - DNA, 327 bp, Glycine max
  Peptide Sequence Number=SeqID_98540
atgccccgtggtggaggagctacttcaatggctcatggactgggggcagctcgaagtgtccgagagaggtatacccctcccgttattggaaaaggggctgcaaccgaggttgactccttgtcagccaaggtgaccaacattaccggccttagtggcgtaacccgcagtggtcaggtgtttgctccccttcacccaacggaactgccctccaaggggaaagcacccatgacccaagagtccgtaggtgcggccaccccctcaaaagaagtggatcccccggtagtaaagggggctgaaagaagaaagatctccaaggaagggcagtga

SEQ ID NO: 6856 - DNA, 392 bp, Glycine max
  Peptide Sequence Number=SeqID_98541
atgactaggggcaatccaggtaatttacaaccctttgatcttgaaatagatagaacctttcatagattagttaggcatagtgtgcatcctgataattctgtgcattttgagcattgtgagcattttgagcattcagagtattttgttgctggtgattctgaatattatgattttgagcattcgactactaattttcatactgagaacgtggctcaacctccacctcgtgagaggaatcttagggagatggttgcacctgatttcacttatgaaagcttgtgcattcaatatcctgatgagggtgttccatatgttctcaagactggactaatacatttgctgcccaagtttcatggtcttgccggtgaagatcctcataagcatcttaagga

SEQ ID NO: 6857 - DNA, 279 bp, Glycine max
  Peptide Sequence Number=SeqID_98542
atgtcctcttgggggaagaaaaccgtatcttttctccgggtttcttccctccttgagcaagattgcagttgtggtcagggattcggcaagagagttagatcgtgtaaagcaaacttgaaacggcgtagtgggcctaccacggaagtacttggaaagcaaggcaagggatatggcgaatcaagaggagtgggtcccgtttgtggacgtattagcattgctaatctttggggttgtcctcttttcaaacgtgaacggtttggtggacctagccgcgattga

SEQ ID NO: 6858 - DNA, 215 bp, Glycine max
  Peptide Sequence Number=SeqID_98543
gtgccctgtttcagattcccttgtctctggaaagctagaagacgactcagatgattggggttcctcaagaattggtggtgttgtcctgtcttacagtatttttctttttctctctgcattgttcctcctacaagtggcttcaatttccaaatccaatggaactaaatcacctgtagaagatttacctcgcatacaaagcactagcatgagcagcg

SEQ ID NO: 6859 - DNA, 225 bp, Glycine max
  Peptide Sequence Number=SeqID_98544
atgatgacaacaaaagttgatgacaaaagtgatgaacaaaaagctcaagtgaatcaaagaacatctcaagagaatcaagaacaagtcaagagttcaagaatcaagaataattcaagactcaagaagaaagcctacaaacaagaatcaagattcaagattcaagatctcaagaatcaagatcaagattcaagaataaagaaaggactcaatcaagataagtattaa

SEQ ID NO: 6860 - DNA, 192 bp, Glycine max
  Peptide Sequence Number=SeqID_98545
atgggaggaaaatgcgcggagtcgccaccaatgtttattcgaggaaaacgtcggaaaaaccggaaaagacgtggtctacgaactttaagtgtgaaaggttcgggagttttatttactcacggggaaggctttttaaatccacgtctaaccaataaaatcgaaaaagaccatttcaaggcgttggacctttaa

SEQ ID NO: 6861 - DNA, 231 bp, Glycine max
  Peptide Sequence Number=SeqID_98546
atgcatacatgtggatgggctaataccgagaatgtccgccagggtccagcctatagccttcttatgcttcttgagaacagacaacaacttctccaattgctcatcagcaagggaggcagatataatcacaggaaaacttttgctatcatccaatggcagaaggagatggtttctcagcctgtacctcataaagaaagtcataggtatgtgtacttcctgaaacatggttag

SEQ ID NO: 6862 - DNA, 132 bp, Glycine max
  Peptide Sequence Number=SeqID_98547
atgagtgaactaccatcaaagagagaaacacgagctgatgacaatggtggtgtaatatcatcaactggacggatctcagcgcttattactggacgcgatgactacacaaatgcaaagttagtagaaccgtaa

SEQ ID NO: 6863 - DNA, 966 bp, Glycine max
  Peptide Sequence Number=SeqID_98548
ctagacgcgctcgccttcagaggagtacacatcctccccttcagagggctacacgccctcgccttcgtagggttacacacccttaccttcaaaggagtacacatactcaacttcagaggactatacatcgtcgccatcagagggctacacgtcctccccttcaggggacaacatgacctcccctttagaggactgcacgccctcgccttaacaggactgcatgttctcaccttcagaggactacacaacctcgccttccgagggctagacgccctcgccttcagaggagtacacatcctccccttgagagggctacacgccctcgccttcgtagggttacacacccttaccttcaaaggagtgcacatactcaacttcagaggactatacatcgtcgcaatcagagggctacacgtcctcgcctttagagggctacacgtcctccccttcagaggacaacatgacctcccctttagaggactgcacgccctcgccttaacaggactgcatgttctcatatttagaggactacacaacctcgccttccgagggctagacgccctcgcctttagaggagtacacatcctccccttgagagggctacacgccctcgccttcgtacggttacacacccttaccttcaaaggagtacacgtactcaacaccagaggactatacatcgtcgccatcagagggctacacgtcctcgccttcagagggttacacgtcctccacttcagaggactacatgcccataccttcaaaggataccttcataggactacacgcccttggcttcaggactacacatcctcgttttctgagcgatacatgccctcgccttcagaggactacatgcctaacctttcaggggtctgcacgtccttgccttcagtgggctacacgtccttgcctttagaggactacacgtccaacccttcagaggtctacacgtcattgccttaa

SEQ ID NO: 6864 - DNA, 516 bp, Glycine max
  Peptide Sequence Number=SeqID_98549
atggagacgtgtttgggagtagaggaattgttacagcggatgatagatcaaggtcgactggaagtcggcagtgaaggaaaagaagagcagcatatatgcatgcagtctatggagggaagcagtgttgcgaagcccaaacccttggtgatatacttcactaaaagcgcagcttcgcaaaagcccggacaccccttaatagccaaacctgttcctttcccataccaaaatagccacgcggtcccgtggagatatacacctccgagggagaaggaagaagaagccactgacgtcagctcgctgtcagctaaagtaacaaatatcacgggactgagtggtgtgacccgtagtggtcgtgtgttcgcacctccggacctaccagtccaacccgcggacatcaaaggaaaaggaaaagtggtggaggaacaagatggcgaagccccccacgcttcgaataaagatattccggcaaagggccccccggagaaaaaggatggtaaaaagaatggtcgcccatga

SEQ ID NO: 6865 - DNA, 165 bp, Glycine max
  Peptide Sequence Number=SeqID_98550
gatccacatggacctggggtctctctgcccccaactggtctagtcaccaatgatcttaggcatgtggcttttcttgtccgcttcaaggtagaaggggaatgtgatgctgcatcagtaggaagaggaggaggaggagagctgggtggtgtagtcattttcctgtaa

SEQ ID NO: 6866 - DNA, 315 bp, Glycine max
  Peptide Sequence Number=SeqID_98551
atggcaggaaggcgtgctcgttttgaatttgcacatcatgggggccgcccgtacttcccaaatcgttgcctaccatatctgaggttggatgattcattgatgccgaatggggacgtcgggttcaccttagcaacaatgctggtagcggcaattgcaaccgcattggcttccattatcttcttcacgctcatcatggcctccatcattgcggccatttgctctttcatggcctccatgtcgacctccatctactcttatacctcctccgctttacccattactctagctctagcacgggttcggacatggggttga

SEQ ID NO: 6867 - DNA, 432 bp, Glycine max
  Peptide Sequence Number=SeqID_98552
atggcagcgcagttgatccatgatcgcatcgtgatggagtgcctagagggtgtttgggagaccctcgaaggcaatgagaggtgccgattccgtggcacagttcgactcactgctacttcgctagtacatctggagcaacccgcacgcacacttcagcagcctgtggagtggatactacctacgcctactccatatcgactagttgagcctgttcaattgatagaggtgtcatcctctgaagaggatcttgaagaggacccagaggagttatctcctaaacctgctatggatgcccctgacttaccagaggatgatgaggacccgctctctgatgttgattctccagaggatattatgccagcatctgaggcagactctacagaggagagtggccttggagggacatcgaatagtgacgactcttcatcatag

SEQ ID NO: 6868 - DNA, 393 bp, Glycine max
  Peptide Sequence Number=SeqID_98553
atgaagggaagtagggcaggaatcatccttgaaggccccaacaatgtcaccctagagcaagccctcaaacccaacttcaaagcctcaaacaatcaggccaagtatgaggcactcattgcaggtctaaaactagaaagagaagacgaggccaagaagctacgatgctatgtggctcgcagcttgtccagggacaggttgccaacagatactagaccaaggagacaatactgcccaagtactaccacattgccaaaactctcatggacaattttgaatgctttgaaatgtaatgtagttccatgtagagcttgtaggccttggatcttcttcatcaatggaatcctttacttcttgaagatcaaaggcagcgggatgaagaaggagaaaaggtga

SEQ ID NO: 6869 - DNA, 1154 bp, Glycine max
  Peptide Sequence Number=SeqID_98554
atgaaccaaccaatatctcctacattgtgtttggcatcatcggttctgccaagtcttggcaggacaaccaacactacattgaagtgtggtggtagccgaatgtcaccaaaggctttatgtggctggaaaaggaactttcagtttcattcaaagagatgtggccggagtccttaccatataaagtctccggagactttccaactagggctagaaaacatgaggtggctcgtgatgggagacgatgacactgtgtttttcacggagaacctagttaccatgcttgcaaaatacgatcacaatgaaatttattatattggagacaactcggagagcatggaacaaaatgcggcactcacctatgacatggcttttggtggtggtgggttttccatcacagggcagtctagtcaatcccacaaacaccatcttcacaccattcgagacatcgacatcaactttttcggtgcaccatcacaacgaagtctccctcctatcactttcacggatagggacttcaagggtatcaacccatcaaccaggacgaccccatggatgtccatcatcatcgcaaacttcatggtgtccaaggtactcatcgaccagggaaactccactgaaattctatattggaaaactttccaaaggctcaaagtctcgcctaacactgttcacccttactccagtccactccttggcttcacacttaacgagcttggaaccatagtctccacactacatctgaaaatgaaattctccaccctgaccaaggagattgtgaacgacaaggtgataccctatcctcctactagggagcttgccaagcctcatcctacagcagccgaaggtacccaagtcatgagtgtggatgaagggccttcaatccgagcccttaccatctaccgagaaagcccgaacgatgaatttgatatagatccacacaacgacacttctgaaagaggcctaaaggccatcgaagagctcgccaggctccatctgacatgctgggaatccatccctgcattatctgtaataacctcgccatctgtccttagcccaacccggtatcatagaagaaaaggaagatgggagaagaacgacacaaagctattagagaagaagcgaacaaactcctcaatgtcaacttcatcagaaaa

SEQ ID NO: 6870 - DNA, 246 bp, Glycine max
  Peptide Sequence Number=SeqID_98555
atggcttcctatggtgtaaaagactccattgatgaagaagatccaaggcctacaagctccacatggagctacatcaagaaggatcttctaatggatcaacctatgagaagaaaagaagaatccatgaaatttgatgaaccaagacaacggatgcatggttatatggatctggtagacaagtcagacgatttagagcaagctttacaaaaaaatgaggtttcatgggttgaagatgaatccaactaa

SEQ ID NO: 6871 - DNA, 220 bp, Glycine max
  Peptide Sequence Number=SeqID_98556
atggaaattttgttacaattggttgggtattcaatcagtaatggcaaattccttggagtcattatacttgcagcttggtttttctgtctatggcaaggagggatcaaaagcctagcagcgagggcgaggctcacgggtgcgctttccaaaggaggaaagatgcccggagtagccaccaacgcttatttgtgggaaacgtcggaaaaactgaaggaaaccg

SEQ ID NO: 6872 - DNA, 111 bp, Glycine max
  Peptide Sequence Number=SeqID_98557
atgggtggaatttcatgtcagacatgcaaaaggtatgacatgggacttattccagctttacaggaagtcatgcctggtgcacctcatagattctgtgccttgcatctttga

SEQ ID NO: 6873 - DNA, 648 bp, Glycine max
  Peptide Sequence Number=SeqID_98558
atgcccttgtggggtaggattgcatcagtctacaccacagaatttgatgaattcttagatgagctggatagaagacactggagggaggagttgactgactttcaggacggcaacatcgatgttgccattgtaaaagaattctatgcaaacctctatgaccccaaggacaaatcacctaagcaggtgagggtgagaggtcatctgattaagtttgatgaggatactcttaacacatttttgaagatcgttgttgttgtggaagagggggaaacactttgtgcttactctagattcatactcctgaggcttgatcctcaggagttagctgctaagctttgtatcccaatgaggggattcgagcttaatgttgatagttatccggtgaatattttgaggaagaacatgaccactcttgctcaaacttggagcgttctttccttttcaaaccttattcccacttcccacacttttgatgtcactcttgacagagccagactcatttatggcatcatcatgaagatggacatgaatgtggggtacttcatctcccaccagatctccctcatagcacagcatgacacatccagactaggattccctaccttgatcacagctttatgtaaggctaaggagttcagtcagatttga

SEQ ID NO: 6874 - DNA, 339 bp, Glycine max
  Peptide Sequence Number=SeqID_98559
atggcattaaatcaaagtatgcaaaaaggtgtggcacaaatgaaaaatggaaaatggcctaagtcagatgagagatctacttacaaagctagattgaaatacgatgaatacactcccttgagcgcatctcgaggaagaatactaaatgaaattattaatgtggtgttgaaggatgctgatcatggagttcataagttgctaagaatcatagatatgtgcaaggccggggagaaaactttagacctcgatatcattggccacctagtgatgagcaatgagaaaggtcaagaagtcctagttggtaccaaagaaaaggacattccatatagcgatctttga

SEQ ID NO: 6875 - DNA, 126 bp, Glycine max
  Peptide Sequence Number=SeqID_98560
atggaggagatacatggagaagatgatgaagaacaaggaattaaacttcatgtagagcttgtaggccttggatcttcttcatcaatggagtccattgcttcttcaagatcaatggaagtagaatga

SEQ ID NO: 6876 - DNA, 196 bp, Glycine max
  Peptide Sequence Number=SeqID_98561
atggagaatgcactaagcaatcactacgcatggctccaaactcgtgggtggaggatgcatgaacgaaaacgcaattcatggggttccgaaaagggtagagaatggagaattgcactaagcaatcactacggatggctctcactcgtgggtgggaggatgcatgaacgaaaaagcaattcatggggctctccaaaag

SEQ ID NO: 6877 - DNA, 387 bp, Glycine max
  Peptide Sequence Number=SeqID_98562
atgcttagcaaccatgtcatcttcagtgcgactcctttacatgcattttcaggagggacttcccctagtaactcgtggcataaatcatctcaatgccttcatcattcaaccaatgcagtgatcaatgcaggatcaattttacactgtttgattaaggcaatatgttggaacccggtacacgataataatggtataatttgtggttctggttcaggtctcaagattccaaagcacattaacaacaattgtagtactgtcacgcatcgagattctaatgcacgtgaaccaatgacattttcatgcacattattcacccgcatgcgtatgttaactgcattagcttcgttctcaacattttgcattccctcaacattacacttaatgtaa

SEQ ID NO: 6878 - DNA, 285 bp, Glycine max
  Peptide Sequence Number=SeqID_98563
atgtggagtcgccaactgtcgcaacctacccttaggcgggagggcgacgcggggctcacgggtgcgtcttccaagaaaggaaaatgcgcggagtcgccaccaacgtttattcgaggaaaacgtcggaaaaatcggaaaaggcgtggtctacgaactttaagtgtgaaaggtttgggagttgtatttacgcacagggaaggtattaacaccccacgcgtccgtcacaagggacgacagcctttaatcatgtgtgcaaatatgacttcaatttgggggatcctctag

SEQ ID NO: 6879 - DNA, 285 bp, Glycine max
  Peptide Sequence Number=SeqID_98564
atgcttccatttgatttccggtgtgtcacggaaacttacggattgtgcatcaatatttttttggttttccagcatgtcttggaatttcacaaattgcctaatgatgggtaccaagcacctcacaaggaccaaagaaaggtcgcatttgagatcaaaagcgactccataaacaagagcttcaaggtcaacagacatcgacttaagccattcctcacgaacccttctttagtggacgtagtggtggaagagacttccttactccaccctactcttcctccaccatga

SEQ ID NO: 6880 - DNA, 473 bp, Glycine max
  Peptide Sequence Number=SeqID_98565
gaagtgaagtgaaaaagggttcagcccctcaggcagttctctctctttcgaatttgcttggaaaaattgtttccgtgacgaaaatccaagctgaggggcttccgaaacgtttccgtaacgtttccgtgaggaatttcgcaaaggtttcgaccgttcttcgacattcttcattcgttcttcatcgttcttcgatcttcaacgggctgccatcccttgtgacggacgtgtggggtgctaataccttccccgtgcgtaaatacaactcccgagcctttcacttaaaagttcgtagattgcgtcttttccggtttttccgacgttttcctcaaataaacgttggtggcgactccgcgcgtattcctttcgtggaacacgcatcccgcgagtcacgcgtcgccctcccgctgaagggtaggttgcgacatctggtaatcgattaccagaaggaagtaatcgattaccaatgtttttaa

SEQ ID NO: 6881 - DNA, 276 bp, Glycine max
  Peptide Sequence Number=SeqID_98566
atggcttgcttggaccagcagcattctggaagggtgggacaggctgttgttgttgtggaggacttgtccatctcagatttggatgattcctccaacctggattgtatctgttgcttgaaaggtcataattattctactattgttggttttgctgttaaggagattgctgcaaagaaggacagagatctgtatggtgatctgcagaagaacatagaccacagactcttgcaacagctgcagatttctgattcatggcaagctgagttactaggttaa

SEQ ID NO: 6882 - DNA, 471 bp, Glycine max
  Peptide Sequence Number=SeqID_98567
ggctcaaccctggacaagcagtggaaactaccaagctggagtacggtaggggcagagggaatttccggtggaacggtgaaatgcgtagagatcggaaagaacaccaacggcgaaagcactctgctgggccgacaagtccaattttacctcggtgttttcgatcatgatcttgttatgttggaagagaagtttgttactattattgatgctagtagcaatgaagagaaaactcattataaagtttgggaaagatctaacagactcagcctaatgttgatgagaatgattgttgcagacagtattaagacaactctccctaaaattgaaagcgctaaaaggtttatggggtcagtgggagagccctctcaaacagctaataagtttgttgttgggacattaatgagtacattgaccactatgaagtttaatagttcaaatgatgcaatcctaccccgcaagggcattggatag

SEQ ID NO: 6883 - DNA, 588 bp, Glycine max
  Peptide Sequence Number=SeqID_98568
atgtccagctatgctacaagccttgagccaaagtcccaactcaccataatccttgccctcggaagaaaacaaaacaaagaaaaagaaaagaagagaaaaggagaaaaggagaaaattcccgatcaaaagaatcagaagaaaggagaaaagggaaaattcccaatcaaggaaaatgggggaattcaaaaaagaaagataattctcgatcaaagatcggaagagaaaagcagaaatatgcagaaaggtcttaggaccagacaatatctaaacaatacagatttgtcaccaagtaaacaggaaaagaaaggaaaccacgacctaaagtggtcctttccctttgattgccaaccaaaatcctgtgtgtcagtgactttttcgccccgcactaaacaaaaacagaaaaggaaaaggccaaaaacattcaaagtcgaaattcccacaaaaaaacaccattcccaagaaaaagtccaactgattcatgatcacgcatcatgttcgcatttcagtaaagaaaacactgagactatttttagtctcacaagttatccagaactacgtaggtctgagttcctcattgaggatacgtag

SEQ ID NO: 6884 - DNA, 318 bp, Glycine max
  Peptide Sequence Number=SeqID_98569
gttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccaggccatgtcagagtttactcttgatggacccaaaggccgagtccgtgccatgactgttggcaacaatacactctttgctgttgcagaggatggttataaaaaaggatctcgaacttaa

SEQ ID NO: 6885 - DNA, 294 bp, Glycine max
  Peptide Sequence Number=SeqID_98570
atgaggagaaacaaaagaagaaagagataccaaattgcctgccagaccctaactaaagggggattagcctttcattgtcatgagagacttttacactttagggggttgatgtggatagaagaagatggatggatagaggaggaaaagaggataatggacatagaaagagggtttcccaagttggagatactcaggcttacgatgtattcattagagaactctaagtcttcgggcgtggtgttatctcggtgtatgggttatggccttcccttctacttcctaatcttttcatag

SEQ ID NO: 6886 - DNA, 464 bp, Glycine max
  Peptide Sequence Number=SeqID_98571
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgtatggccgcgttgtctcattccacgcctgacactcagttccgg

SEQ ID NO: 6887 - DNA, 249 bp, Glycine max
  Peptide Sequence Number=SeqID_98572
atgtctctgatacttgtagggtactccgtttttgaggagcgcaaaggcaaagcgagtaagagaaagaggaaaaaggaaaaaggaaacggaaagtttccgtctctccgaatccagcagtgggcagttcctccaactccctccgtcgccgccgcctccctcctcctctcctctgtgtcttctcttccctccatcgccgactccttctatttcctcctctccgcgccgtcgtcgccgtcttctcttccataa

SEQ ID NO: 6888 - DNA, 645 bp, Glycine max
  Peptide Sequence Number=SeqID_98573
atggagggggattcaatcatacacatagtggcatatgcagatgatgttgtcagggtaagtgtagaaacagttattgatcctgaggctgaggtcccctatgccacctcagaaatacaatatgagaagcaggccgtctatacatttgtagcttggcccacacaccttgtgaaagctgtattagatgagcatccacaaagtattccacacaacgaggatgcacatgtgccgaagccggctaatgtggacgcagatgatccgttgcgtggattgatgaagtacagtttcgatatttacgacaagccacttgaaatcagctttgatgggagctttcttggaattgtagatgcatctacatcgatattcatcacatattcagatgttactgaaataatagcaggagacaaaagtatatgcatgagtggagtcagatattcagtcaaggtttcatgtatgctccttgagccacagtcgttggtttgttcaaaggatagacacagcgaatgcgaacaatatcttgaaagatggcttaaggaatctgaccgagaggtgtacactggaccttacttccatcatgtaatgacaaaattgaagaagaccttgtctcctgaaactaaggcagttgcacctaagtggattgaagtaaag

SEQ ID NO: 6889 - DNA, 930 bp, Glycine max
  Peptide Sequence Number=SeqID_98574
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaat

SEQ ID NO: 6890 - DNA, 207 bp, Glycine max
  Peptide Sequence Number=SeqID_98575
atgacggggaaagtagaaaagtgtgagattttgagggttagagaagccaaatttggggttagtggaaattggagtccaaagacttgtagtaaggcttgggcagagcaaatgagaaaaatgagtgacaaaggtgaaagcaagagccatttccagggtaaattgggtgttgaggggtcaaatcttgaatcggaggagtttttgccttaa

SEQ ID NO: 6891 - DNA, 984 bp, Glycine max
  Peptide Sequence Number=SeqID_98576
atggttctgaaagaggagttgatggctggttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaagcagctcatagagaagaacgcggccaccgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgctgcccaactattcaccacccgttttgcaagaagatgcgggccacattgcttctcccgtccatgaaagagagcctcctcaacagcccgacgaagtccacaaagaccctcaagattatgctcgaagggatgtcgagttctatcccccgatccccgaagggccggcaccaggcacgttgcctcaacccaacatcgcagcaccaccaatagttttgtccacggaagggccgcccccagcaactgaagaaaggaggaagctcgatctccttgaggaaagattgagggcc

SEQ ID NO: 6892 - DNA, 600 bp, Glycine max
  Peptide Sequence Number=SeqID_98577
atgtgcaaaggaaatcaattagatggtgaagagtctacacttgggaataacttgggtatggaaacgcattcatcacagtctgaatactcgttggagagccatggccagggggtggaaaaggtggaagaaactcatatggtggtttgttgtgctaaactatacactgatggagaagaaagtggtttttgcccactaaacaataaatatgaagacatggcagataatgaaaagatggaagggcagacatgtgtcgagggggagttgggggaaggaaaaggtgaggggcaaatgcatagtgtgggcgttgaaaaggagtttgatggggtagtagtgaggaagcagctttttgaagtcaacactaccctagagaaaggatacccacaacagtcatttaaggttctttcgaaaatcttccggaagaagaatttgtgttctaccggaagaaccttttttcggaagctttccggaagaaccttctttcggaagaaggttcttccggatgaacaatttgttctaccggaagaacttcctcccgtaactttttcggaaaaaggttcttctgaaagaataaattattttaccggaagaaccttcttctga

SEQ ID NO: 6893 - DNA, 2250 bp, Glycine max
  Peptide Sequence Number=SeqID_98578
atggtgaagatgctcatggaacaaaaaggcatcacgtataatgacgccaagaatgcatctatggagcaaaacaatgggttggaggataaggagtccgcaatggaacctgagccttcatcaacatcagaggacgaagagaacaagcctgaggcagattcaatattgaattcatcacaccattattgggcgaaaggggtgaaaatgccaatgtttgaaggagaggatctgttaggctggattgtgcgtgcggaaaagttttttgtagtgcaacatgtccaacagagcacgaaagtgagattggcctttatcaacatggaaggaaatgccttgcactggttccagtattggaagcaaaagacgaagcggaaaagttggtttgttttcaaggcaacgctgattaagcgctatggtggtactggaaggggagatgtttacgaacatttggcaacattgcaccaaatggggattacgactaaattcattcaggaattcgaggtgctgggacttcacaaggagatctatgcaaaaattcatccccacaaaccgaaggatctgtcaagtgccatggagttggcgacagattttgaggaagctgagaaagaagggaatccagaggtcgagttgcatagtcgtgggtttcattttcaacccaagggagaaatgtggatacacaatgttgaaggatccacaacgaatacctttcacaacaaccaacgtcagaatcaaactctaacaggggaggcacgtagctctgtgaacgtaatggctgcaaatcaaagtgagtctacaagaggtccatttgttgctggtcataagtgccccggaaaaaacctcaggttgcttattttggcaaaggatgaatgtattaataatgaggtggagtttacaagaatggaggaggagcttgagaatacatttgacaatataggagaaataaaggaagagagggagaaactaatagagagtcctatgctgggggactcagcagtgttgggaacaggaggaggaggctctggtgatgcagtggcagcaccaccacctgctgcatcaggaggagcacatgatggtggtgttgacggcggtgacggtggcggtggcggatcaaattcaggggatgatagagttgaggaaggtgagaggagcttcggtgggaacaggtggccgaagcaagagactttggctttgttgaagatacggtcggatatggacgtggcttttagagatgcaagtgtaaagggtcccttgtgggaagaggtttctaggaagctggcagagcttggctacaacagaaatgccaagaaatgcaaagagaagtttgagaacgtttacaagtaccacaagagaaccaaagaaggacgaagtgggaaatcagaaggcaaaacttatcgcttctttgatcaattacaagcccttgaaaacaaccctgcaattcatggaaagcaatctccaacacctccaaagccgccaccacaaacaacagcactatcagcaacaccagtgtcaatagtggtaacaacaactacaactacaccatcatcaataataatgccacttccattgccaccagtgtctaataacaacaacaacaccactgttccatccacaacatcacttcctatgcctcaaagcattctcaacataacaccaccatcaacactgaacatcacaatcccttcttttccaccatcaaaccctacaacatacttcccaacacaaacaccaaaccctactagcaacaacaacaacaaccctccaagcaccatcaccccaccttccttccccaatttccccgccgatctcttgtcgaattcgagttcttcatcgacttcttcggaggaaacaccgacgacggaggccagagggcgcaagaggaagaggaagtggaaggacttctttgagaggctcatgaaggaggtgatagagaagcaggaggagctgcaaaggaggttcttggaggccatagagaagagagaacaagagcgtgtggtgagagaggaagcgtggagaatgcaagagatgcaaaggatcaacagggaaagggagattctagcacaagagaggtccattgccgcagcaaaagatgctgctgttatgacatttttgcaaaagatagccgaacatcagcaacaagaaactatcaatcttgaaccagcattgaataacaacagcatcactgttgttccacagcaaccagtgccacaagcaacaccaacatcaactccaacaccacaacaagcacaaacaacaaca

SEQ ID NO: 6894 - DNA, 246 bp, Glycine max
  Peptide Sequence Number=SeqID_98579
atggctcatgctcaagtggcattggatctagttataagacttggcgatttatggatcctgatgaactcttcttggttaccccaaacaagtcaaacaattaggttgataactactttcaaaggacatattcttgaactcttccttcatcaagttgtggaacatgagaggagagagtttttagagcttagagggctacaactaatgaggagaggagcaagattgttcagaagagacatgctaccttag

SEQ ID NO: 6895 - DNA, 904 bp, Glycine max
  Peptide Sequence Number=SeqID_98580
atgaactcatccgcttgtaagagatgtcagagtggcgcggtgagccgtagcgtctttcccgaggggggaagacaggcgtatttcggtcagcggtcagatccgccgggtgaacggttggattggcggggtaagcggttggcggcctggagaagagattcggccgccggcgggcgacggcctgtcttctcaggccgtctgcatggcctgcagcaggtggataaacgcggcgctgagcggcggcgtggccggctcatggcgggtaaagacgtaaaagcgcgcgctgatgtcgatctcctgcgtcgggattttctgcaggtgcagctgcggggcgtagtgtgcgaccacccgatcgctcagcagtgcgatatagccttgctgcctgaccaggcaccaggtcgccagaaaggagtcggtctcgacgatctggccgtgcggcgtgtagcgttcggcgatctcgcggatggcggcatgccccaccgagcaggagcgtggcaccacccatttggcctcggcgggcggctgcccggctgcgcgctcgcttttcagcgcctgcatggccagatcggcgccgcccgccgcgccgttcaggctgctgaccgccaaatccagctcgcagtttcgcagccgggccagcaggccctccgggccgtcttccaccaccgtcacccgggtatgcgggtagcggcggttgaagccttcgagcacctgcggcagatagcagagcagcggatcgacgctcatccctacccgcaggcgcttctcgccgtcagcgctcaggccgcgcagttcgtcaaacgcgttgagcaactgattggtggcggcgtctatccgccggtaaaacagctcgccgaccgccgtcaggcgcacgccgcggttgctgcgctccagcagccgcgcgccgatg

SEQ ID NO: 6896 - DNA, 558 bp, Glycine max
  Peptide Sequence Number=SeqID_98581
atgtttatagatgggttgagaccacaatctaagcagttgttagatgcttcagcaggagggaagataaagatgaaaacccctaaagaggcaactgaattgattgagaatatgtctactagtgatcatgttatcctgcgtgatagagtgcaccaacccaccaagaaaagcttattggggttatcatcacaggatgctttgttggttataccatttgtggtggtgctcatgaatcaggccattgcatttccattgaagagcatactcaggaagttaattacatgggaaatcagtagaggcaaggatacaaccaaggaggattttcaggtttccagcaaggtccctacaatcagcaagggcaatggagatcacaccctggcaatcaattcaacaaagaccagggtgaaccttcgaacaggccactacagtaagggccaaatctttatgagaggactacaaagctggaggagactctcactcaatttatgcaagtcacaatgtctaaccacaagagcatggagtcagccatccagaaccttgaggtccaggtgggacagttag

SEQ ID NO: 6897 - DNA, 180 bp, Glycine max
  Peptide Sequence Number=SeqID_98582
atggataaccatgagcatgcaaatcatcgtgacacagtacaagccaggataaagaataaaggtatcaggcagcacaaagttaatgatcaggctcagaatattgattttaatattcctgattcatcagaggatgagagttctgaatcaacacaccaattaaaatcgactttatcaaattaa

SEQ ID NO: 6898 - DNA, 517 bp, Glycine max
  Peptide Sequence Number=SeqID_98583
cgtgatcgacggcatcgccttccagaccaatattctggcgctgaacgccgccgtggaggccgcgcgagccggagaacaaggcagggggtttgcggtggtggccggcgaggtgcgcaatctggcgcagcgctgcgcgacctcggccaaggagatcagcagtttggtcgacggcgtaaccggcgatatcgccgtcggcgtgcgcctggtcgagcaggcgggcgagacgatgaatgccatcgttggctcggtgaatcaggtgacgtcgctgatggacaacatctcgtacgcgtcggaagagcaaagcaagggcattgagcaggtcggagtggcggtgacccagatggatcaggtgacgcagcagaacgccgcgctggtggaggaggtggcgaccaccgccgtcggcgtggaggagcaggcggccctgctggcgcaggcggtggcggtattccaactggcggagggggaaacgcgccaggacgaagcgcaggcatcggcggccgttgccggttgggcataa

SEQ ID NO: 6899 - DNA, 213 bp, Glycine max
  Peptide Sequence Number=SeqID_98584
atgccaatcttcccctgcagatgtatcggttgggatcgcgcccacaagacgcccagtgggccccctactaatcgagctttcatcaagaagtactgcgtttccaggcaggcgcagggcgaaacaccacagcagcctggggatggccggcagcgggcaacagacgcaccgccatcacctctagagttcacctccgctcatccacaaaaaggttag

SEQ ID NO: 6900 - DNA, 288 bp, Glycine max
  Peptide Sequence Number=SeqID_98585
atgagaaaactaacaaaactacccatcatatctcccaaaaccccatacccacgaaaatcaaaggagaaagaagtccacccaaacctgaaatttcgaagtcccacttgtagccacacacttcacgactccaaaaacgccctcctttcacgatttggggcagaaatgatggccaaaggttggagctttgttagggtttcaatggagaatggagaagaagagaatggcaacgtgagggagagagagggctgtctgaaattttctgttttgctgagtgaggagagagaatag

SEQ ID NO: 6901 - DNA, 510 bp, Glycine max
  Peptide Sequence Number=SeqID_98586
atggctgctagtgatcaggctattttgcatgatcggtctcatgtaccaacaaaaaaaagcctgctagagctttctttacaagatgcactattggcgcagaacaaactgctagctaaacaacttgagatattgacagagacacttattatgcaggttggaggttgtagcatatatggaggagcgcatgaatctggttactgtatacctcttgagtatgctgcaaaggaagtggattatatgggaaatcagcatagaccagggtttaatgtagatggatttttaggttatcagcaaggttccaattttaatcaaaatcaagggcagtggaggtctcatcctagaaaccagttcagcaaagaccaaggaggatcatccaaaatgcctcaaaatcaagggcctagcctttatgagaggaccaccaagctggaacagactttggctcagttcatgcaagtttcaatgtccaattacaagagcacagagtctgctataaagaacttggagattcaa

SEQ ID NO: 6902 - DNA, 1537 bp, Glycine max
  Peptide Sequence Number=SeqID_98587
gtcgactctagaggatcccccgccttgcagcgcgtccacgccggtggcggggatggcggcgtgcgccatcttgccgtgcaccgtcacttccatctgcaggcagccgttgtgcgccgtcacgacctcatagctgaagccggccgcgatcagcaggtcgggtttcgtcaggccctggcgcagcagccagccgggaccgagcaggccgccgaattcctcgtcgtaggtgaagtgcagttcaaccgcgccctggctcggacgggccacggcttccagcgcccgcagcgcgaaggtgaagctggcgaagtcgctcttgctgaccgcggcggcgcggccgtagaggcagccgtcctcgatctgggcgccgtacggatcgtgctcccagccgtcgccgggcggcaccacgtcgccgtgggcgttgagcgcgacgcggcggccgccggcgccatattcgcgccgtacgatcaggttggtgatggactccatgccgtaggcgcgcacttcatcggccggcacgggatgggactcggccgccaggccgaagccctgcagcagttcggcggtgcggacggcgtgcggggcgttgttgcccggcggcgtgtcggtcggcacgcgcaccagttcctgcaggaagcgcacttcttcgtcgaagtgggcgtccacccaggcgtcgagtcgggcgtaatcggtcatggttcagctcgttgcgtcgttggcgagatcgtcgagcagccgctgcatcgcctgtgcggccagctgcatgtcgtggttggtggtggattcgagcgggttgtggctgatgccggcgttctggccgcgcacgaacagcatggcctgcggcatgatctcgtgcagcttcatggcgtcgtggccggcgccgctgggcatgcaatgcaccggcacgcccagcgcttgcaccgcgcgttcccagcgctgctgccaggccggcgcgctgggcgcggcggcggcgcgcatggtttcctcgagcgtgtagcgcaggccgcggcgcaggcagatcgcttccagttcggccagcacgtcgctggccagcgcatcgcgctgcgggtcgctgggggcgcgcaggtcgaggctgaagcggcattcgccgggcaccacgttgatcgagccgttgggcacttccagcatgccgacggtgccgaccgagtcgccgtcgcgcgcggcgcggccttcgacgaacacgatcagttcggccgcggccacggcggcgtcgcggcgtcgatccatcggcgtggtgccggcgtggcaggcggtgccgtggatccgcacgcggtagcgcacgcagccgttgatggaggtgaccacgcccagcggcaggcccatttcgttcagcacgggaccctgttcgatgtgcacttcgacgaagcccaggtaacgggccgggtcgcgcttgagcttgggaatgtcatcgacgcacagtcccgcgcgcgccatggcctcgcgcatgctgatgccgtcggcgtcccgttgttcgagccagcgcggctggaagtcgccgatcagcgcgccggaaccgaggaag

SEQ ID NO: 6903 - DNA, 471 bp, Glycine max
  Peptide Sequence Number=SeqID_98588
atgttgcacaagatattgactaaagaagttgattcccatgcctctcaacaagacaaaaatagcatggagggaagttggtcagaatttagtgaagtaaaggctagttcttgggcaagaaaggtggaactacctagctttgatagaaacatagaagggggaactgatttgaagggtagcagaagtaaagaaggttcagtaatcaagaaccacaccctttgtggtggagaaaaaaccaaaaatgatgaagcaaagttagcaagagaaaaaaagattaaaaaggttatggaggaagaagttgatccatcgataactagggagaagcacaaggaaaacagagtgacgaatgtgggttgtgaaaacgattttcttgataacccaattatagatttgatcaagaaggaagttgaggctggtgattcaaccaagccacattgttttcaagatttagatttccataaaaagattgttatg

SEQ ID NO: 6904 - DNA, 549 bp, Glycine max
  Peptide Sequence Number=SeqID_98589
atggcgcctaccaggcaccctttggacccggataagtccaacagggccctgggatttcccgccttgatcacaggactctgccagtcgttcggcgtccccgtcacacctagcaaggtgattcggccgcccctcacccgagcttttattgagaagtactgcacgcagagacaggtccagggtgatgcaccacaggccgcggacgcgccgccacctcatcaggctggtccggccggattgtttgatacagagcagtatttgcgacatttggttcaccagcaggcggccaaccaccgggcacatgtacagactcatgattgtctgtatcagatgagtctcagcctgcagagtcagggctttacttcttttccgtgccctactctgaaccagttcagggcagaggtcacgtggcctggggattggcctgaggcccaggcaggagaggcaccagcaggggcaccagcagaggctcccgatgaggcagatgaggcccgcgaggacgaagagatgaccgatttacttgatttcttgggaggaagcggggccacatga

SEQ ID NO: 6905 - DNA, 216 bp, Glycine max
  Peptide Sequence Number=SeqID_98590
atgataaatgcaggaatgatatgtccattacgatgccatgaagagatgcatgatgcgatcaaggaacatgcccgaggactatcagcgacaatgcatcaccaaaagaggaaaactttagaagaggcttcactgttatcaagtgagtcagagacccagcatgaccacagatcgacctccactccttatagctcacatagacccgggtatagggcctaa

SEQ ID NO: 6906 - DNA, 204 bp, Glycine max
  Peptide Sequence Number=SeqID_98591
atgaccttggacctcctgttcgtcatggacaggcctgtcacatgcaacattctagatcagggtgttgagcctcaatataacctgttgcatgttgatggatgggctgttggacaggaggaagtcactactcttatactcggaccaccgggttcagagaaggaagcaatcgagaaggcaaagctggatttgcatttgaaaatctag

SEQ ID NO: 6907 - DNA, 489 bp, Glycine max
  Peptide Sequence Number=SeqID_98592
atgacattgctacttagcaatattctgcccagcgaccgcaatgccaatctccccctgcgaaagtatcagttggtctgtgtcgtcccgacatggggatcgcacccacaagacacccagtggacccggaaaagtccaacagggccctggggtttccagctctggttacgggcctttatcagtcctacagggtgcccgtacccccccggcaagggatcgcgcctgcaagacacccagtggacccgaagaagtccaacagggtcttggagttgtcaagctttaattacgggtctctgtcagttctacggagtacctgtcacctccagcaagggcatcaggccccctactaatcgagctttcatcaagaagtactgcgtctccaggcaggcgcagggcgaaacaccacagcagcctggggatggccggcaacgggcaatagacgcatcgccaccacctctagagttcacctctgctcatccacaaaaaggttag

SEQ ID NO: 6908 - DNA, 492 bp, Glycine max
  Peptide Sequence Number=SeqID_98593
gagtccgcaaggcataggatgcattgcaaaggaaggacaaagagcttaggggaagcaacaatgggatcattggcggctatcctaagggctgtgagagaggaagaggccaaagctccggaagagagtaaggaggtacaagccataaaggtggagcttgagaaaacccaagcagtcaaggagaagttcaaggcctggaaggaagaacacgaccgaaacaagttccgaggagctttatggggcagcaatagcgagcttaaactccgaagagacgaaagggatcagtcgcgagtcgaaggcctgattttgaaggacgagttaaaggcttgtattaggtccaaaagaagtttgtcccagcagttaagcgagacagaagggaacatgttggccatcattgataaatacagagaagaattgaacctagcgacagctcatgagcataggctagtggatgagtacgccaaggtatcagtggaaaaggaagcaagggggagg

SEQ ID NO: 6909 - DNA, 375 bp, Glycine max
  Peptide Sequence Number=SeqID_98594
atgaaactggccaaatacaggctaaaggcccaagtggagaaggacgaaggcccaagtggagaaggacaaagcccgcaagtggagaaggatgaaggctcaagtaatccttgtggcgtctaccctgacttatcttccttcactggaagtggcgtctacccagacttatcttccttcaccggaagtggcgtctacccagacttatcttccttcaccggaagtggcgtctatcatgacttatcttccttcattggaagtggcgtctacccagacttatcttccttcaccggaagtggcgtctaccctgacttatcttccttcaccggaagtggcgtcatccaaatatccgtagcctgtatcaagcgatccgccccgtaa

SEQ ID NO: 6910 - DNA, 312 bp, Glycine max
  Peptide Sequence Number=SeqID_98595
atgggtggtggtgcatggccgttcttagttggtggagcgatttgtctggttaattccgttaacgaacgagacctcagcctgctaaatagctatgtggaggtccgggtaatctttgaaattcatcgtgatggggatagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtga

SEQ ID NO: 6911 - DNA, 420 bp, Glycine max
  Peptide Sequence Number=SeqID_98596
atggctaaatatgacccagaaatagtcatggaattctacgttgatgcatggctcatagaagaagaagtcagggataagcactcctggttcttagggcatccgtgggtcctggaagaggggcaatgttgcgagttcagtgaaaggaggagccaggcttcgggatttgataaggaggccataggccagctgctgtgcatttcgggacaagactttgcacgaagtgtgccgggaagacgggtgcagatcatgcgcactagcatgaccaccctaacacagatctggatgacactgcttctcaacaacattctccctagctatcgcaattccaatcttcccctgccgaaatgccagttggtctacgccattttgactcaggttagtattcatgtggcccagctaatctcagatgccatttactaa

SEQ ID NO: 6912 - DNA, 419 bp, Glycine max
  Peptide Sequence Number=SeqID_98597
atgatgacaaaggtgatgacaaaaatctcaaaggtcaatcaaagaatgagtgcaagatgttcaagatagaatcaagaacactacaagattcaagaggaaagttgaagaacacttcaagattcaagaggaaagttgatttcaagaatcaagaatcaagattcaaggatcaagctttcaagaatcaagatcaagattcaagactcatgattcaagaatcaagagaaggcttaatcaagataaggtacatcctttgtggtacaagtagagggtacatctacttgggttcgactgagaacaagagagggtacatctcttgtggatcaattctagtggagggtacatccactaggttcaaagagaacaaaggaaggtacatcccttgtggatctttgcttgtaaaaggatttttacaaggctga

SEQ ID NO: 6913 - DNA, 237 bp, Glycine max
  Peptide Sequence Number=SeqID_98598
atgagggatggcaagaggtcttcgtatgtcattgggatcggggtgaattctggagttggccttgcgggaaagttcctcatcgcgttggaaccggcaccaaagtgggcgttgccggccgggcgagtcgtggttggagccagagcttggggggccttcctctggatgggcgtaggtgatctaggttgtacgggcgctgaattggaagagtccccaatgcgagttgagaagctcgggtga

SEQ ID NO: 6914 - DNA, 619 bp, Glycine max
  Peptide Sequence Number=SeqID_98599
gttaaagttgtagtgaacctcaaaggccgtgaaaatgaattcaggaatattgctattgagcttattaaacgtttccagagtgatgttggggagcttgcaacagaagagactaaaagctttcgtgacagaaacatcttcagagttatggttccaaagaaagccactctacagaaagctcaagaaccaccgaagagaaaagacaagtcagcagtagatgaagtctccgctggtcagggtggcttacattcttttcaaggaatccccagtgcatggcgccagtggagatggcgccttcaacagggaagagccacgtggcatgtcgccactgtgactggcgacaaaggactgcatatcgcaggtcctattggcgcatccagaggcgccactcgaggtggcgatttgggtgagagggaggcgccagtgatgttggcgttttcagcttcagtgggatttaaaagaaggtggttgaaagggaggctccagttcacggttgcttgtaaaatttgtgtgttgaaggtgaaaaagaaggtggttgctgttgagagagaggtagctggtggttgcttgtgtgttgagagtggtgctgatcagtttgtcttcttccattttataaaagctt

SEQ ID NO: 6915 - DNA, 3264 bp, Glycine max
  Peptide Sequence Number=SeqID_98600
atggaagccagcgctggactggtcgctgggtcacataaccgcaatgagctagttgtcattcatggccatgaagagccgaaggctttgaagaacttggatgggcaagtgtgtgagatttgtggtgatggcgtgggactcacggtggatggagacttgtttgtggcttgcaatgagtgtggttttccagtgtgcaggccttgctatgagtatgaaaggagagaaggaagccacctttgcccacagtgcaaaaccagatacaagcgtctcaaagggagcccccgagtggagggagatgatgatgaagaggatgtggatgatattgagcatgaattcaatattgatgagcaaaagaacaagcatggccaggttgcagaagccatgcttcatgggaggatgagctatggaagaggtcctgaagatgatgacaattcccagttcccaacacctgtcattgctggtggtcgttctaggcctgtaagtggggagttcccaatatcatctaatgcttatggggatcagatgttatcctcttcactgcataaaagagtgcatccatatccagtgtctgaacctggaagtgcaagatgggacgaaaaaaaagaagatggatggaaagatagaatggatgactggaaattgcagcaaggcaatttggggcctgaaccggatgaagatccagatgcagccatgttagatgaagcaaggcaaccactgtcaaggaaagtgccaatagcatccagcaaaatcaatccatatagaatggtgattgtggcacgtctggttattcttgctttcttcctcagatacagactcatgaacccagtacatgatgccctggggctatggctaacctctatcatatgtgaaatctggtttgctttttcatggattctggatcagtttcccaaatggtttcccattgatagagagacctaccttgaccgtctttccatcaggaactcagaacaacatggaaaatttatgagggacttaacaaaaattgaatacatatcagaaatctcaaacacatttaaactttttagaatttatatatacagtacagacaaggtcattttgttgaaatctcaaattgtgatcaggtatgagcgtgaaggtgaaccaaacatgcttgctcctgtagatgtttttgttagtaccgtggatcccatgaaggaacctcctctggttacagcaaacactgttctttcaatcttggccatggattacccggttgataaaatatcatgctacatttctgatgatggagcctcaatgtgtacatttgagtccttatcagaaactgcagagtttgctagaaagtgggtaccgttttgtaagaaattttccatagaacctcgggcacctgagatgtacttcagcgagaagattgactacctaaaggacaaagtgcaacccacctttgttaaggagcgtcgagctatgaagagggaatacgaagagtttaaggttaggatcaatgcacttgttgctaaggcccagaaagttcctcagggaggatggatcatgcaggatgggacaccatggccagggaataacactaaggatcatcctggtatgattcaagtgtttcttggtagcagtggaggtcttgatactgaaggaaaccaacttcctcgccttgtttatgtttccagagagaaaaggcctggttttcaacaccacaagaaagctggtgccatgaatgctctggttcgggtatctgctgttctcacaaatgctcctttcatgttgaacttggattgtgatcactatgtcaataacagcaaggctgcccgagaggccatgtgcttcttgatggacccacaaactgggaagaaggtctgctatgtccagtttcctcaaagatttgatggtattgatacacatgatcgttatgccaacaggaacacagttttctttgatattaacatgaagggtctagatggtattcaaggtcctgtatatgtggggactggatgtgttttcaggaggcaagctttgtatggctataatcctcccaagggtccaaagcgtccaaaaatggtaagctgtgattgttgcccgtgttttggaagccgcaagaagtataaggagaagaatgatgcaaatggagaggctgcaagcctaaaagggatggatgatgacaaagaggtgttgatgtcccaaatgaattttgagaagaaatttggacaatcctctatttttgtgacttctaccttgatggaagagggtggtgtgcctccttcttcaagtccagctgccctgcttaaagaagccattcatgtgattagctgtggatatgaagataaaactgaatggggacttgagcttggttggatctatggatctatcacagaagatattctaacaggttttaagatgcattgccgtgggtggaggtccatttattgtatgccaaagagagctgcattcaagggtactgctcctatcaacttgtcagatcgtctcaaccaggttcttcgttgggcacttggttccattgagattttctttagtcaccattgccctctatggtatggcttcaaggaaaagaagctaaagtggcttgagagatttgcctatgcaaacacaactgtctatccattcacctccattcctctagttgcctactgtattcttccagcagtttgtttactcactgacaaattcatcatgccaccgattagcacctttgctggtttgtactttgttgctctcttctcctcaatcattgcaactggtattcttgagttgaaatggagtggagtgagcattgaggaatggtggagaaatgagcagttttgggtcattggtggtgtatcagctcacctctttgctgttatacaaggtctgctaaaggttctggctggaattgacaccaatttcactgttacatcaaaggcaacagatgatgaagagtttggagaattgtacacctttaagtggactacactcttgattcctccaaccactattttgatcattaacattgttggtgttgttgctggaatctcagatgccataaacaatgggtaccaatcctggggaccactctttggaaagctcttcttttccttctgggtgattgtccatctctatccattccttaaaggtttgatgggtcgccaaaatcgcacacccaccattgttgtgatttggtcagtgctattggcctctattttctccttactttgggtaagaattgatccatttgtcctcaagactaagggacctgataccaagctatgtggaatcaactgctaa

SEQ ID NO: 6916 - DNA, 300 bp, Glycine max
  Peptide Sequence Number=SeqID_98601
atggaggatgagtcatccgagactaccactccagagcccttggttagaaggaagaaggcagatcaaacacaaaaagctgcagccacttctgagaaatctcttgaggccacttctgagccttcagaaccaatggcagatacagcttcaattcaacaggcagctgacccttccactcctaaggatcagactacaccagttctgtctccgaacatctctcctacagctacccctgagcttcacttaacagacgaggaggatgttcagacacaagatactcaagatcgatcacaggatttttaa

SEQ ID NO: 6917 - DNA, 562 bp, Glycine max
  Peptide Sequence Number=SeqID_98602
atgggtcaacttcaacagcaaggcggatggttgagcctccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagagatcctgggatgcccactgggaggaaggaagccatatcttttctctggttctatccctccacgacaagagttgccaaggaaagggcaaaggccttggaaaatcaaggcgaatgggctttcttttattgacatcttggcgcttttgatctttggagttgtcctcttttcgaatatggaagggttagtggacctagcagtgattgacgctttcctcgcctttcatcatggcaaggaaagcccggtcgtcgccattttggccatgtatgacacgttcgaccggggatgcccgtctatccgctacaaggtcaccgctcgtgcgtcgaaaaaggaaaggcgaattgggaccaactcttggctagcatggaggggcgtct

SEQ ID NO: 6918 - DNA, 415 bp, Glycine max
  Peptide Sequence Number=SeqID_98603
atgacgactcttgtcattggtggcactcgtggaatcggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttg

SEQ ID NO: 6919 - DNA, 243 bp, Glycine max
  Peptide Sequence Number=SeqID_98604
atgaagaacggtggaaaatcttcacgaaatcgctcacgaaaacgtctcggaagcgttacggaagcgcctcagcttggattttcttcacggaaacaatttttctcactaatttcaaggaggtggttgcctgccagctcgcccaggcgagctgggttgcccccaccagaaggcaccgccttctgttggaacaccctggaaggtccaagtgggcctggttgctattttcacaccccattttactaa

SEQ ID NO: 6920 - DNA, 99 bp, Glycine max
  Peptide Sequence Number=SeqID_98605
atggagaatgaaagagaaggagatgaacattcaagattcaagagaagagaaaatggctacggagatttggatgacgccacttccggtgaaggaagataa

SEQ ID NO: 6921 - DNA, 402 bp, Glycine max
  Peptide Sequence Number=SeqID_98606
atggtcctttttggtaacctggttcagcctcctatagtcaatgcagactctccaactgttctgcacccgagtaggaatcagctcctccttcttatttctgatcactgtgaggccagtcttcttcgggactacctggacgggactcacccattggctatcggagataggataaatgattccagcttacaaaagcttggttatctccttcttcactacatcaagaatcaccggaaaatagaagaaaatgatggcacatcacagatacctgagccatcctctacacctgctcttgaggagacccatccatctacaccagttgtggagcctgagcagcctattcaggattcatcagcaactccagcactagatttgaatgaagaccagccacaagaggagcaggac

SEQ ID NO: 6922 - DNA, 414 bp, Glycine max
  Peptide Sequence Number=SeqID_98607
atggggatcgcacccaagagacacccagtggacccggaaaagtccaacagggccctggggtttccagctttggttacgggcctctatcagtcctacagggtgctcgtacccccccgacaaggtcacatcatcatagggatcgcgcctgcaagacacccggtggacccgaagaagtccaacaaggtcttggagttgtcaagctctaattacgggtctctgtcagttctacagagtacctataacccccagcaagttcatcaggccccttttaatcaggctttcatcaagaagtactgcgtctccaggcaggcgcagggcgaaacaccacagcagcctggggatggccggcagcgggcaacagacgcaccgccatcacctctagagttcacctcagctcatccacaaaaaggttag

SEQ ID NO: 6923 - DNA, 154 bp, Glycine max
  Peptide Sequence Number=SeqID_98608
atggctcaacctccacctcgtgagactcttagggagatggatacacctaatttcacttatgaaagcttgtgcattcaatatcctgatgagggtgttccatatgttctcgagattggactaatacatttactgcccaagtttcatggtcttgcag

SEQ ID NO: 6924 - DNA, 249 bp, Glycine max
  Peptide Sequence Number=SeqID_98609
atggttaatctatgtctaatgggcaaagattatgaaagtgacgaagaggtatctttgaagaagaaatgttacataaatagcagatgttcaaagcatatgacgggagattcatcaaaattcacacatatttctcccaagaaaagtgggcatgttacttatggtgataacaacaaaggtagaattcttggagttagaaaaatagcaaagatgatgatccatggttatggcataaacgcattgctcacataa

SEQ ID NO: 6925 - DNA, 210 bp, Glycine max
  Peptide Sequence Number=SeqID_98610
atgtctacaacaaaaccttcttcaaacaacagaagagaaatgagtgcaaggatagcaaaagtggctgaaacacttggagaaataaggtggaactacaaatctcttactatggaatttgaacatgctgggaaaacagtgaagctcgtgggagaacaacaatgtcgacagcaccaaggagcatctacaactatgaattgcattttaccataa

SEQ ID NO: 6926 - DNA, 243 bp, Glycine max
  Peptide Sequence Number=SeqID_98611
atggcttacactcacattccggattcaacaagcgattctcctcaaatttcagccagcccgtatcaattagacttcacactttatgcttcggggtcatacaatgctcaatggaatgccccgaggctcctccatgataagcacacgttgcgttcgagtcgtatcctcagaaaaatggaggttgaggaaccttggttggggttatggctaccattgagtggatatgggatcaagtttagcatatga

SEQ ID NO: 6927 - DNA, 1608 bp, Glycine max
  Peptide Sequence Number=SeqID_98612
ccgaacgacgacagctcaccgcacctggcggcccgccgcctgaccggcgaaattttgcgccagagcggcgtgccggtgaccgaactgcgcgccggcatcatcgtcggccccggctcggcggcgttcgaagtgatgcgcgacatggtctataacctgccggtgctgacgccgccgcgctgggtgcgctccaagtcgtcgccggtggcgctggagaacctgctgcctgatcacctcggtgccgacgccgatcgcccgcgcgctgatccaggggctgaagcacgatctgcccgccgacggccggccgctgcaggcgctgatcccgcagcggctgcacaccttcgatcaggcggtcgccaccacgctgcagcgcgaacaggaggtggtcgattccgccgactggggctacgatccggcggcgcgggcccgctggcgccccggctacggttactatccgaaacaggccggctgttcgctggacaccgccgccacccgcgaggccctatggcaaacggtgcagcagttggggggcgaagaaggctatttctacgccaatattctgtggcggatccgcgcccgcatggacgacatgatcggcaacggcgtggtctatggccgcccggcgcgcgcgagcctggcgctgggcgacgagatcgacggctggaaagtcatcacgctgaaaccgctgcggcaactggcgctgctgttcggcatgaaggcgccggggctggggcggctgagcttcaccattaccgatcacggcgatcgccgcacgctggacgtgcgcgcctggtggcatccggccggcttcagcgggctgctgtattggttcgccatgatgcccgcgcatctgttcattttccgcggcatggcgaagcgcatcgccgaacttgccgagggtctggaccgccaacagcgctgaacgccgttcatttgtcgatcaaccgcacagtttgccgctgtgcttcggggctttccgattgcatagcgcacgaaatcacggaagaatggcatcttatttgctgggagcgccgcaagcgcccgccggtattccgattttgggtgagaatagagtccgttatgaaggtattggtcaccggtgccaccagtgggttaggccgtaacgccgtcgaatatctgcgccgtcagggcatcaaagtgcgcgccaccggccgcaaccaggcgatgggcggcctgctggaaaaaatgggcgcggagttcattcatgccgatctcaccaatctgatctcttcgcaggccaaggcgatgctgacggacgtcgacgtgctgtggcactgctccagcttcacctcgccctggggcaccgaagaggccttcgaactggccaacgtccgcgccacccgccgcctcggcgaatgggcggcggcctacggcgtggcgcagttcattcacatctcttccccggcgatctatttcgattaccaccatcaccgcaacgtggccgaagactttcgcccgcagcgctacgccaacgagttcgcgcgcagcaaggccgccggcgagcaggtgatccagcagctggcgctgtccaatccgcagacccatttcaccattctgcgcccgcagggaatggtcgggccgcacgacaag

SEQ ID NO: 6928 - DNA, 138 bp, Glycine max
  Peptide Sequence Number=SeqID_98613
atggagaattgcactaagcaatcactacgcatggctccaaactctggcggagtgagcggagcgaaaacgcatcatgtgctccaaaagggatgcctgaacgagaacgctattaatggggctccgaaaaagggtttataa

SEQ ID NO: 6929 - DNA, 264 bp, Glycine max
  Peptide Sequence Number=SeqID_98614
atgcagctgtcttctcaagaggaggctataaaacagaaggatgtcttggctacagaagtttcctctcttagaggagagttgcaacaagtaagagatgagcgagaccggcaattatctcaagaaaaatgttctttgaaagataatcagataaaggcattggaagagcaactagcaactgcagagaagaaactgcaggtgtctaatatatctgcatacgagacaaggacagagtacaaaggacaacaaaaatttgtgaatgagtaa

SEQ ID NO: 6930 - DNA, 342 bp, Glycine max
  Peptide Sequence Number=SeqID_98615
atgtcatcgctcagccaatatcggcccttctcattacccatcacccaatcatccacaaaagccatccccaaatcagcaacaaggcatgcctgcttaccacacgcccaatgcccaaacaccacctatagcgcaaaccaaaaaggaattttgcagcaaaaagcctccataacccctgccagggttcctcaacctccatttttccgaggatacgactcgaacgcaacatgtgcatatcatggaggagttcctggacattccattgagcactgtatgaccttgaagcgtaaggtgcaaaggctaattgatgcgggctggctgaaatttgaggagaactgcttgtga

SEQ ID NO: 6931 - DNA, 165 bp, Glycine max
  Peptide Sequence Number=SeqID_98616
atgacacaacgtcatccatatccattggcacgggtgaaatcttgcctcggtatgcatagtagatgcgtgatagcctccctctctggatgtgctcgcacagttggtcgccctccaatatcagggggtggcccaggaactgttaaaaggaaactactggccccttaa

SEQ ID NO: 6932 - DNA, 489 bp, Glycine max
  Peptide Sequence Number=SeqID_98617
atgcctcaccaattagtcaatgggagtatagacctggctttggtgaaagagttctatgcaaatttatacagttctgaggactgtccaccaaagcagtccagagtcagaggtcatttggtgaagattgatgctgacagtctcaacacatttttagagacacctatagtattatctgagggggagacattacccacttactccaaatactataggttgcctacagactacaaagaaatagagacttggttccctgctctgatcaccgcattttgtagggctagaggggttgtctcttacagcgttaccttcgagcacttgagtccggtcattaacttggcctacatcaggaagaactgttggaatctcgacgatcgagcagtttctatccaaggagctaggagggcgagggcaaggccagctgagcttccttctacttttgtagctcctactccagcatccacttcagcagctctttctgtccctgcttag

SEQ ID NO: 6933 - DNA, 435 bp, Glycine max
  Peptide Sequence Number=SeqID_98618
atgaaagataagagggatgaggaagaaaaattagaaaaacaaagaaaaagaaggatagtaaggccttgtcttcaaggccaaggggaaggaaaaagaggaaaggattcctccaagaagattgttaagaaggaaaatcattttgcatcaaaatgtgatatcaaaagagcactccttcttaagcaatccttctaccttctcctatcaagggaatcataccttagcactaccataccttgtgagcttgaggttattcctcaagtaaaggagtttttggatgagggtttggttcgtaagagcttaactctttgtgctttgttggtgcccaaaatagcacaactcattgagttggtgaggaaccatgttccctcatgggaagatgcacaagaaaaggggttttcagaccttatcttactccaacatgccaaacaccactaa

SEQ ID NO: 6934 - DNA, 234 bp, Glycine max
  Peptide Sequence Number=SeqID_98619
atgggggtgcaaatagcacccaggcccatttgggccctccagaagattcctccagaaggcgaaaaatctaaggccgaggcgcttccgaaacgtttccgtaacgttttccgtgaggaatttcgcaaaggatttcaaccgttcttcaacgttcttcattcgttcttcatcgttcttcgatcttcacggggtaagtacctcgaaccaagcttttcgattcattctatgtacccatag

SEQ ID NO: 6935 - DNA, 282 bp, Glycine max
  Peptide Sequence Number=SeqID_98620
atgggatggaaggaggttttggcggcatcgacaagaggccaggtgctagtggtgaaggagaggcctgaggaagaggcgaacctagaggaagaagtattgttgaacatcgtcaaaggggctggcaggagtcatctatcttttcttcctggagatgggtcctccaacttgttggataagcgagcaatggcatcctcaatgcagtccatgttggacttagagcaggtcgattctgtgatcgtcaataaaagcaccaagatgatgcgtacagggagaaaaagctag

SEQ ID NO: 6936 - DNA, 723 bp, Glycine max
  Peptide Sequence Number=SeqID_98621
atgcttttaggccataaacaattgaactgcttggaattgtcggatacagaagttggaagcaatgggctacaccatttatcaggattgtctagtctgcagaaaataaatctgtcttttaccatgattagtgatagtagtttaaggaaattgtgcggactctcatctctgaagtcacttaatttggatgcttaccaaattactgatgctgggctggcaaaccttacaagtttgactggcctcactgacctggatttgtttggtgcacgaatcacagattttgggacaaactatttgaaaaaatttaagaacctgaggtccttggaaatatgcggtggaggattgactgatactggtgtgaaaaatattaaagagctttcttctctagtgtgcttaaatttatcacaaaacagcaaccttacagacaaaaccctggagttaatttctgggcttactgggttggtttctttgaatgtttcaaattctcgtatcactaatgctggactgcagcatttgaagacactgaagaacttgagatctctgacattggagtcctgtaaggtgacagcaaatgacatcaagaaactgaaatcaatgtacctcccaaatttgtcgtatcttagagaagaatggaaagacaacctcaaattgtacataggctataataatgactttatggaaggtgtaattctgcttgtgctgcgaagttttgttgttttattgtaa

SEQ ID NO: 6937 - DNA, 639 bp, Glycine max
  Peptide Sequence Number=SeqID_98622
atggcttccatattcctctcctctcccccatctttctcatccgcacaccacaacgcctccacgcaccttatccttcacacccctaactcccttaacctgcgcaccatgtcccattctctccctattcgtgccatcaccctcacctgggactacctcaagagactcgccgcgaacaaggccgtggagttcgtcaagagaggcatggtcctcgaccccggcaccggcaccggctccaccgccaccttcgtcatcgccaagcttggcacactcctcgcctccggccaactcattgacatcgttggcgtccctacctccaagcgcacagaggataaagtcctcttcctcggcatccccctcttcgtcctcggtctcaccatcgacgacgccgacgaggtcgaccccaacctcaacctcatcaaaggctgcggtggtgcccttgtttgcaagaagatggttgaggccgcctccaacaagtttgtaacggacaaagacgacacaaagttggttgacggcctcggcggaagcggcctggccatgccggtggagcttcaagagcttttcaaggaagaaggcatggaagtgaaattaagatcagaggagagtgggaaaccctacgaatcagatgttgacacgtgttag

SEQ ID NO: 6938 - DNA, 2004 bp, Glycine max
  Peptide Sequence Number=SeqID_98623
atgcaaaatctcaagctccaaaccatgaaagaaagttacttaccagagatgaatgaaatgtatcaaaaaattgctaataaacttcatcagcatgattctcttccccaacaaccaaagttagatcagattgataagctgagggcatataaatcgatgttggagcgtatgatggcactcctacagattcccaagaacaacattttgcctaatttcaaggaaaaactgggatcatacgagaagcagattataaatcttctcataaattcaaatagacccaggaaaggcatgaattcagtacaggcaggacatcatcccccaactcacatgtcttccatgcaacagccacaatcccaagttactcaagtacattctcatgaaaatcaaatgaactctcagttgcagtcaacaaatttacagggttctgtaccaaccatgcagcagaataatattgcaagcatgcagcacaattctttgtctggtgtatcaacaggacaacagaatatgatgaattcaatgcaacctggaactaatttagattctgttcatggaaattctgtgaactcccttcaacagattccaatgaactccctccaacaaaaccctgttagtacagctcaacagactaacattaattccttaccatcgcaaggtggggcaaatgtgattcaaccaaatgcccttcagtcaggttccagcgcacttcaacaccaactgaaacatcagcaggaacagcagatgctgcagagtcaacaactcaaacaacaatatcagcgacaacaactgatgcagaggcagctcctgcagcagcagcagcaactacaccatccaggaaagccacagctatcttcgcaattgcagacacatcaaatgcctcaacttcaccaaatgaatgatataaatgatataaaaatgcgacaaggaatgggtgttaagtcaggtgtctttcagcagcatcttacatcaggtcaacactcaacatattcccatcagcagctgaaacaagggagtgcatttcctgtttcttcaccccaactccttcaggctgcctctcctcagattcagcaacactcatctccccaggttgaccaacaaaatcatctcccatctaaaacaaaagtcacaactcctctgcaatcttctaattcaccctttgtgggacctaccccttcacctcccctggctccatctcctatgccaggagagtctgagaagtctattccttgtgtttcatcaatatcaaatgctgcaaatattggacttcaacaaacagggggtgcagtagcaccagctcaatcccttgccattgggactcctgggatatcagcctctcctttattggcagaattcagttgtcctgatggtgcgcatggtaatgctttagctgccacttctgggaagtcaactgttacagagcagcctcttgaacgcctaattaatgcggtgaaatcaatttcgcgtaaagcattaagtgctgcggtcatggatattggttcagttgtcagcatgaatgatagaatagcaggatcagctccaggtaatggatccagagcagctgttggtgaggatttggtttccatgactaattgtcgtctacaggctagaaatttcattgcacaagatggttccaatggaattaagaggatgaaacgttacaccagtgctattcccttgaatgttgtgtcatctcctggtagcatgaatgatagtatcaagcagttaactgcttcagagacttctgatctggagtcaactgcaacatccagtgtcaagaaaccaaagattgaggttaatcatgcccttttggaagaaataagggagattaatcaccgacttattgacacagtagtagacataagcaatgaagatgttgatccaacagctgctgttgctgctgctgaaggggcagaagggattattgtcaaatgctctttcattgctgtggctctcagccctagcttaaaatcccaatatgcttcatcgcagatggtggattcccacttctga

SEQ ID NO: 6939 - DNA, 1227 bp, Glycine max
  Peptide Sequence Number=SeqID_98624
atggaggaatgggttcagcacccacgagataatacagctctaagcaaacttcttccttgcatggatgagaacacagcccaaaaaaccttggacataaccagaaacacctcattccaagtggtcaatttgcttaatgcatttataattaatatagccaacgccaatatgcctcctatacaggctgataaggacatatactacaatcaatctggtccatccatgcccctcttgtgcaatccgtttcttcctgacttgaccgaacgagcatgtggtccaatggaagtagacttaaagggtgcatctattcgtctaggctcttgtagcagggctgatgtagagggtggacacgtgtcttcggaggttgtccagtgtcgaagtaaattgtccagtgtcgaagtaaattgtcctgtgtcgagggaatttgtcttatgtctaggtgtcgggcgtggtagccttgacgaatgtgagagttacaggtcgatgtggcttgccaagccctcaagcctagacatatgttgttcaggctacttttgtcaagttgttcgtgatggacgtgtcaggcgtgtgcgaccttctgctgttgtcggggagccagtcctggttactgtgatcctccctccttctacttctgggggtacgaggaaagcttgcggaaacgaagatgtgaggtcacctccccgcgtacaacctatcttgtttgacctcgacgacgagtatcattgcgcttcaatgccagtgaagctgacgaaccctaagggctcctataagctggtcgttcaggctagcgagagtgatgacttcccattttttagggcagcgcctagtcatccaccccacttgaatgtggcctcttctcagcttcacccaaacagttgggtaatggtgcgagcctttgagattttgtgtcctttcttcaatgtccaaccaagtgttttggtcttcttgtttttcttccaaataaaattgtctggcaagattggatgggtctccttgaatagtgtgtccaagaagttgttcgagtttgactcgaatgtctttcaccgtttcaaggaccatttctttagggtcctagctactgatgtcgtgattgatggaatgccattgattttcaacaaagacggggagccacacttcccgttctattggcaatctgatcccaccagattcaagtcgtatgacaaggatttattgacccttgtagagagggtcgacaaagcgattttgtag

SEQ ID NO: 6940 - DNA, 765 bp, Glycine max
  Peptide Sequence Number=SeqID_98625
atgaatgatgattttggctgcaccaacgctgtatcctttgatgagatggtaaggttcaacaatgatagctcaaatgttgtggcagctattgggccaaaagtggaatacactgactcttatttgaagagcagcgaagaggaatttggaacaagttgttattggcctaaaaggggtgtagagaacaaccatgagttggaggcaaagacaataagggataacgacagaggaacaaaaagggcaagaacctctactgagacacagtatcatgtaatgtcagagagaaaaaggagacaggatatagcggagaaattcttagcactctcagctactatacctggcttgaagaagttagacaaggctactgtgcttcgggaagccctcaactacatgcaacaacttcaacaacgcatagcagtgctggaaaaagcagggggcaataagaataaaagtataaagtcattgatcatcacgaaatcacgtctttgttctgcgtcatgtgaaacaaactctattagtgaagtgctccctgaagttgaagcaagaggtttagggaaggaagtactcattagaatctattgtgagaaacgaaagggcatcatactcaagctattggccctactaaaagatcttcatctctcaatagccagtagcagcgtattgccatttggaaactctatcctcaacattatcataattgctcagatgagtgagaaatacaacatgacggtgaacgatttggctaagagcttgaagcagatcttttga

SEQ ID NO: 6941 - DNA, 585 bp, Glycine max
  Peptide Sequence Number=SeqID_98626
atgaaagatctttttaagaggtggactgaacatcttgacagcacacgatcaagggtcagccacttaccaccggaaattcatgctggtaagagctactccatggaaaattatcagtgggagcaagagttacaaccctacaatcaatatgaagaagaaagaagttctaatttggataatttgttgatgcaattcaaggaaacaattgaatctactcaaagagcatttaaaagtctagaaattcaagttggtaagctagcaaaagaagtgactaaatttgtggccacaagggaagaaaactttgtagaggttgaagcttatgaggaaagccttgtagaagagcatgattcaagagaaaaagatgaagaaaaaagtgaggagaaagcacaacaatgggatgagtgctcacaagaagaaaggcatggagaatatgagaaagccttaagtgtcattctttccttgatcgctatcacttctcttgcaatgatatggaaggtgtttttggaatatatgagtttcatggagtctctagctaagaggcaaaaatgcaaggaagatgtgttctatgtgaccttcatgccaccttga

SEQ ID NO: 6942 - DNA, 529 bp, Glycine max
  Peptide Sequence Number=SeqID_98627
attgacaaggccactatacttagtgaagcaatcactcatgtgaaaagacttaaagaacgtgtaagggagctagaagaacaacgtaagaagacaagggtagagtcagtgtcatttgttcatcagagatcccacattgcaactgtcaaaggcaccacctctggtgcaatgaactctgatgaatgctgtagaaccaacgaagcactccctacagtggaagcaagagtgtttaaaaaagatgtactcctccggattcactgcaagatacaaagtggcattttgatcaaaattttggaccatcttaatagtcttgatctctccacaatcagcaacagtgtaatgccatttggaagttcaactctagacatcagcattattgctcagatgggtgacaacttcaacgtaacaacaatgaacgatctagtgaaaaatctgagaatgactctctcgcagtcatctgaagtgtttgaagatccgaaaattctgcaagttctagctctccgtgtggatgtgatattggctttggaattag

SEQ ID NO: 6943 - DNA, 282 bp, Glycine max
  Peptide Sequence Number=SeqID_98628
atgaagattttcacgaacaggggtagtaattgctttgatgcttttgctgctatttgtcgttgcattgaagaccaggctaggatagagaaattcttggaggattacagggcaatcaagcctacgagattcacttatgcagacattaagagaatcacaaatgggtttagtgaaagtttaggagaaggagctcatggggcagtcttcaaaggaatgctctctcaagaaattcttgttgttgtgaagatactcaacgacacagagggagatgggaaggatttttaa

SEQ ID NO: 6944 - DNA, 1020 bp, Glycine max
  Peptide Sequence Number=SeqID_98629
atggcaacaaagtatgcccatggtacccaaaagcaggtgttcatagatggttggttgcagttggggaagaagatgttacttagaagctcctcggcaccgattctaacttcattgttacactattcaaaggagtcctcctccgaaccagaacacattcttaaccttcctaaaacagcatcagctttaagtctaagccaaaacttggtggagatagaccttaaaaagtcatcaagtcccaagagaaaaaatcgtgtgccacttagtagtgttcctaaaaatcaacagagtaaaaagataaaagaaagagatgaagggaaagatccacaacaaaaaacttgcatgaaagcaaaatcttcaattcaagaactgttttctagtttggatttagataagggactcctggatcatgaagagcgtggttcggggaagaaagatagttggttacagacttcagtgatgggtggtggaatggggagtgatggtggttggatttgtggtggttgcaatggaagtggaagaggctcaggtggtggacatggaaaaaggtggggtttccatgaaggaaatgatcatggtagagataggacggaagcttattaccagaacatgattgaagcaaaccccagtgatgcacttttgctaggaaattatgcaaagtttttgaaagaggtttgtgacgattatcctaaatcaaaagagtatctcgaaagggcgattttggctaatcctgatgatggtcatattctgtccctctatgcggagttaatatggcaattagagaaggatgctaatcgagctgaaggatattttgatcaagccattaaaagtgccccatatgatagctatgtcctagcttcatatgctaatttcctttgggatgccgaagaagacgaggaagataaagactgtaaaaataaatcgaatcacagccatacatatccaactgatctctttcatggagctaaccatcacattcatttaactgcagccatagaaacctcaccactgtttcttaagtga

SEQ ID NO: 6945 - DNA, 123 bp, Glycine max
  Peptide Sequence Number=SeqID_98630
atggtggttgaccttcttcaatatgtgaatgacactttgggaaggtgcaaacctaagaaagtaacttatatggatgctggtggtgaaaaaattcaagaagagattgactacttagaagaataa

SEQ ID NO: 6946 - DNA, 363 bp, Glycine max
  Peptide Sequence Number=SeqID_98631
atgtcattgccaaggcatgggagaagtaaccagagcaccaccattgcttggagcttctggcttccactgccacacttacatcacaagctagtccatgccaccactgttaagggattagaggcatctagggtaaaattggtgattaccggagcggaagagatcggcggcgatgggggtggaattggattgacccgtctttttggatgcagaagagcgtcgcatcttcaacaagaaatccagactctctctgattcggaagaagaagaatcgaaacgcgccaaattcaggaaagataaagagaaggagaaaggggttgaggttgagggtgatgacgtggatgcgctgaagttgtggtgtggggtg

SEQ ID NO: 6947 - DNA, 963 bp, Glycine max
  Peptide Sequence Number=SeqID_98632
atgaggaggaaggagaagaagaagggaatgagaaggttcttgtgttgtggtgctttgctaatgggttccaccggcggcggtaaagaaaaggggagggtcatgatggctttcggggaaaggggggtggatgttttctgtgatcaatctatgcttggcggcggagtaaggtggttgcgctcctcggagcgattcaagtttctgacaacgtcattctccaccaacgccaagaccacttattattccttttgcacttcatcagccaacaagaacaacaacaaaaacatgatcgttgatgaaaggtatcggcagctggagaatctggacatggtgactgccgctaagatccttttcagcgacccccctaagaagaggaagtttgggtatcccttttccttcccgttaactatgtttactctttcacctctcgctctctttcgcatttcgtcgagcaccttcgctgcacttaatatgtctacttcactacctctctttggatctgttttttactaccacatttggagtttcaagctacaagaagtggagcagaaaaggaagctgaaagaagaagaagaagcgaaggaaaaagaaaaagaaatggaactaaaccctccagaggaaaaggaagaaaaatctgatccccagcttgcacaggtgaaagtaagacttgagaaacttgaagaggctgtgaaggagattgtggttgaaacaaagaaacattcaggcagcaaccttggagaaaatcaggcaactgatgatgagaaaaaacgcctaaattcttctgcaccaagggacccaagtaccactgattctgcatcaaataaagctgtagatgaagaccattctggtaagcatgatattctcaagtcaaagcccaaattacgtgaagagaccaagggttcagtagcaactccaaatccttctcttcaggatcccaagggaaaccaaagtggaggggcttcataa

SEQ ID NO: 6948 - DNA, 489 bp, Glycine max
  Peptide Sequence Number=SeqID_98633
atgctctcctttaacgatttggggcagaaacggtggccaaaggttgaagctttgcttgaagcttcaatggagaatgaagaagaagaaagctactttctcgcgtttctctgcgtccgccggggccagttttcgaaagcaagcaatatatatatcaaaacgctcagaatgaaaccccgagcatggtttagaggtttcggctgttatcgtacaccgaccaaagaggattgtgcggcagtttggtgtgcagtaaactacatcgacgggctctacgtgagactgtcacagcccggggatccacttaggcatccacctgttgtgcacgatgacacatatgttgaaccagatattcctcagtacccaatggcgatgacagctatagaggaagcacctgcagatgcgccttctcatgtagagcagcctcgacatgcagtggttgacacggttgttgaacctaaggatagtaacagaaggtacaaaagcgtacaatga

SEQ ID NO: 6949 - DNA, 804 bp, Glycine max
  Peptide Sequence Number=SeqID_98634
atgatgaatgcgagtgagaggaatgcaacaacgaagcttagacgtgtggggaagaagctcctcaagaaatcttctgttcataaacttctgccactgcttcaaaaattggagtcgctactatcaagcctggaacaagaaccaaccgagccaattcaagaatcacttgtaccttcaaagaaggctctgatctccgacaaacttttgaggcacacagatgaggatgttaagctttcagttttatcttgcatcactgagattacaagaatcacagcaccagatgccccttatgatgatgaacaaatgaaggaaatcttcaagcttatagcggcatctttcgagaaattgtctcacatatctggtcatgaaaaagcacttgacatacttgataatgtcgataaggtcaaattatgcatggtcatgctggaccttgagtgtaatgacctggctattgaaatgtttaagcattttctgaggtttataaggtcaaaccatccccgtaacgcaattcattcaatggaatcaataatgaccctgattttgcaagaaagtgatgacatttccccggatcttcttagacctctgttggatagtgtatggaatgaaaataaggctctttcacctatgtcttggatattgggggagaaagtaattcgcaactgtgctgttaagctcaagccctatctcatgaaggctgtggagtcctcaggcagagctctgaatgagtatgcagacatagtaactgatatttgccagaacaaatctgaatctgtcaatgtgatttttcaaatggttctgaacttctga

SEQ ID NO: 6950 - DNA, 393 bp, Glycine max
  misc_feature (289)..(289): n is a, c, g, or t
  Peptide Sequence Number=SeqID_98635
atgaagaaaaacattcaccctatgaagcctcttatccatgagggatcaaaggctatgaagcacggacacaccgtcgaagtgtcgcgtcccgcgtcggagacgcaccggacacacaaacgggtgcgactccggtgcgacgcgatgtccattgccaccgccgtcgtcggacacggttggatgcaggaaacgcgtgatcggacgcggctcaacaagtggacacgcgcgtccaaacgcgagatgagtgcttctagtcctagtcaagctaaaaaacaagatgatgataccaaanctttatggacctatgttacaaagataaaaagtgtaggtgatggtggaacttatgagatcacatgtcatatctgtgattttaccttcaatgggtcttacactaaa

SEQ ID NO: 6951 - DNA, 927 bp, Glycine max
  Peptide Sequence Number=SeqID_98636
atgccaactgacacatcatcagtttccggcggcgaaatcgtgtgtgtgaccggtgccggcgatgatccgaagaatggtcatttgaaagagttggaaggaggcaaggagaggctaactctgcataaagttgatctcttcgatattgactccattaaagaagctcttaacggttgccacggtgtcttccacaccgcttctccagtcaccgacaaccctgaagagatggtagagccagcagtgaatggaacgaagaatgtgatcacagcagcagcagaagcaaaagtgcgacgggtggtgttcacttcgtcaattggcacagtctacatggaccccaatacgagtagggatgcgttggtcgatgaatcattctggagtgatttggagtactgcaagaacaccaagaattggtattgctatggaaagacggtggcagaacaaacagcatgggatgtagcaaaagagagaggggtggacttggttgtggtgaacccagttttggttattggaccgttgttgcaaccaaccattaatgctagtacaattcacatcctaaagtaccttactggctctgccaagacttatgtaaatgcaactcaggcttacatacatgtgagggatgtggcattagcccacattcttgtttatgagacaccttcagcttctggtcgatacatatgtgccgaaagttcgctgcatcgtggtgagcttgttgaaattttggccaagttttttcccgagtacccaattcctaccaaatgttcagatgaaaagaatccgagagtaaaaccctacatattttcaaatcaaaagctgaaagatttgggattggaattcacccctgtgaagcagtgtctatatgacaccgttaaaaatcttcaagagaacggccaccttcctgtccccccaaaacaagaagactcctattga

SEQ ID NO: 6952 - DNA, 99 bp, Glycine max
  Peptide Sequence Number=SeqID_98637
atgggtacaaacaccattcctgctcaaggttttgatcaaaagggatacatcttaatatattctccactggtactgcccaatgtccattttattgaataa

SEQ ID NO: 6953 - DNA, 270 bp, Glycine max
  Peptide Sequence Number=SeqID_98638
atggtttattctccaacaaattggtatcatagaactctaaagttcaaggacccgattgaaggtgttgcaatggcttccgcaacaaacgctggtggattcatacatgtgttactagttcttgatggcaagaactatgatcaatgggttgtgaggatggaagcgattcttggcttccatgagattcttggcattgtgaaggaaggaatctcagagaagaagaaagatgatgctacaattatgaagaaggacttcaaggcaaagatgatgtag

SEQ ID NO: 6954 - DNA, 621 bp, Glycine max
  Peptide Sequence Number=SeqID_98639
atgggattattgaatggaaaaagaagcttcctcgggatgaggataaaggggcttgccggaaaatataaaaaagaaagaaagaggtggcaacggaaaagaggatcctttctgcttcttctcttctcttccacacaaagacatcgtttcattgctctctctcttgtgcggacacaatttttgatggggatatacctcagcactcccaaaacagagaaggcctctgaagatggtgagaacgacaagcttcgcttcggtttgtcttccatgcagggctggcgtgctaccatggaagatgctccaccaacaagtgtcatgttcactgttcttttgtatgatatatgtcatttgatgctttggttatacacaagggaagctattcatgcagctcatccatgtttggacgagtccacgtcatactttggtgtttatgatggccatggaggcaaagcagtttcaaaattctgtgccaagtatctacacctgcaggtgcttaagagtgaagcttacttagctggagatttaggcacatctttacagaaatcttttctcaggggagatttggcatcatggtctctgcaagatataaatatagctggaaagcaagatttggacacttattaa

SEQ ID NO: 6955 - DNA, 2259 bp, Glycine max
  Peptide Sequence Number=SeqID_98640
atgtttgattctggttacaagtcacagtatattggaggccagaaggagaagttcgtaaggttggatgatctggattcgaattgttctatgccatcaagctcaagggggatgaaaaaattaagattcaatttagattctctgcctattcctcttcctggtcgtggaagaaaaagagcatcgaaatcgtttaggcaaggaatgaagaagagttcagatggactaaagacatttggaagatcactgaagactggagtgactacttgggcagtgttcccagaagatcttaaagtgtctgagaaaaaagtatttgatcctcaagataagaaccttctgtattggaacaagttttttgagattctgtgcattgtttctgtagcatgcgatcccttcttcttttaccttccttatttcaaccacaagtcattttgcctcgccatagataacaacctagcaagttttgctgtcccaatgagaacaatatgtgatttcatttatctcctccgcataagttttcaattccgcactgcttacattgctccttcatctcgggtatttggacgaggtgaacttgttatagatcctacaaagattgccaagagatatttacaacgttacttcatcattgacttcatttctgtgctgcctatcccacagattatagtgtggaaatatctatacagatcaggacgtgtagaagtactggaaacaaaaacggcactgttgagaattgtgatcctgcaatattttccaagatttctacgctttttacctttagcttcagaagttaaaagaacagcgggtgttttttctgagaacgcattgctcggtgccatgtactatttgatctggtatatgcttgctagtcatataactggctctgtctggtacttactagccattgaacgtaatgacacctgctggaaggatgcttgtaaaaaagttgaaggatgcaatacacatttcttgtactgttcgaattcgaacaagcatatgtcagggtatgaatcttggagaaatgtcagcgagactgttctgaaaagtcgttgctttgttgaggatgattcctcagaatttaactatggaatcttctctcaagctatacagtctgatattgttgcttccgtagaagtttttcctaaattctgttactgtttgtggtggggccttcaaaacttgagtacacttggtcagggacttctaaccagtacctaccctaaagaggtcttgttttccatagtaatagctattatggggcttatcctttttgctcttctgattggaaacatgcagacctaccttcaatcaatgtcagttcgtcttgaggaaatgaggatcaaaagacgcgactctgagcagtggatgcatcatcgcttgcttcctccggagctaagggaaagagtgagacgctatgaccaatacaagtggctgaacacccgaggagtagatgaagagagcttagttcagagtcttccaaaagatctcaggagagatatcaaacggcatctttgtttgaatttagtcagaagggttcctctctttgccaacatggatgaacgtttgcttgatgctatatgtgagcgactgaagcctagtttatatacagagggaacttacatagtgagggaaggggatccagttaatgagatgcacttcatcatacgtggccgtctagagagtgtcactacagatggtggaagaagtggatttttcaacagaggtcttctgaaggaagctgacttctgtggagaagagctactaacatgggcattagaccccaaatctgctgctagcttgccaacatcgacgaggacggtgaaagctataaatgaggttgaggcatttgctttggaagcagaggagttgaagtttgttgcttcccagtttaggcacattcacagcagacaggttcagcacaccttccgtttctattcgcagcagtggagaacatgggctgctatctacattcaagctgcgtggaggcggcattacaggagaaagattgcagaacagcgcaggagggaggaagaagaattctgtgactctgattatgaaaacggtgatggttcagcaagcgccttggtcaagcgtagagatacttctgtttccccttcagggcttagacttggaacaaccgtctatgcttctcgctttgctgctaatgcacttcatggtcataggcttcgtggttcaagttcgagggagacgatcaaactccaaaagcccccggaacctgactttggtaatcttgatgatgactga

SEQ ID NO: 6956 - DNA, 753 bp, Glycine max
  Peptide Sequence Number=SeqID_98641
atgggcaccggccaagacctcctcgttcgccgaggagagtccgtaccactcaatttcgagggccccatttttgtgtgcacgaggaacgatgatcttgaatctgtgcttcaatctacaccttcttctagatggggtggagttgttattggtcgtgccttagatttggtgttcttccagaacggaatgctggagccgtggcttgagagcaaaggtttggaagatgcaaaccaggtgttggcttattttgctgtgtccaaaattggagaaacccctattgatggtaggactgatatcaatcctgaaggactcactgctgcatatggcaagtgggcttctattgtagctgctagattaaatgctggaggcctctcttgcaaggttcttgacaaggaggtgtttcaaaagcagatgttggagaagcttatatggatttgttccgttatgcttgttggagcacgtcatggaggggtttcagtaggtgtcgtggacaaggaattccgcactgaattgtccagccttataacagaactggcatcagcagcatcaagtgaaaaggggttaacatttgaagaggccatggaagagcgcttatgtgcatattcccgagccgtagcccactttcccacggcagttaaggagttcaaatggagaaatggttggttttattctctctctgagaaggctacggctcaaggcaagccagacccatgccctttgcattcccaatggctaaaagagttgagaattgtatga

SEQ ID NO: 6957 - DNA, 1620 bp, Glycine max
  Peptide Sequence Number=SeqID_98642
atggcctgttatgacacattgcagtatcttgatgagaacaagaagctgattgtagcaataatggaaaatatgaaacttgggaaaattgataaatgtgccgagtaccaagagaaaattcaacagaatttaatgtatttagctacaattgctgatttgcagcattcacaaacactaatcatgcctccacagatgattccaccaccctctaggatgcaaccagaatactatatgcaacatcctcagggtgtagcaatggttcagcaacaagggattttccctccaaatatgcaattgcaatttggtaatccacaacaacaactacaccagcacgccattcaagggcagataacaaggataggtaatggaacgtatcccatgcatagtgagaatgttcttgaaggtggccatagtggtggctcaacttcaactgcaagtccaaataatgcatgtggtggaagcatgcaaggaacttctgaagatggagatggcttcgctctcgtcgccgactttctatgggcctctacctcttccactcttcccacctccaccaaaccctccgcatttgtggttccctccaaccacaataagaagaaatatgagaatgccactgcttctggaagattccttgccgcggcttacgccgatttggatgcgccgcagctcaagtggcaaaagatggctcctgctcccgtccctcgccttgacggagccgccattcagattcgggatctcctctttgttttcgccggctacggcaccatcgatttcgttcattctcatgttgatgtatataattttactgacaatacttggggaggaagattcgacatgccgaaagagatggcgcactcgcatttgggaatggtgaccgatggaagatacatctatgtggtgactggacagtatggcccgcaatgcagaggtcctactgctcataactttgtgctcgacactcaaactaggaaatggcgggatctacctcctttgccggtacctagcattaaacataaacaacagattcaaagggaaggggaaggatctggtcaaactcacttattcccaccttctttcttggatgctggcttcactctctgcctttgttgcttttggatgctcactgtttttggctctaagaaaatcatgggtagacttcatgtgatgggtggcagtaaggagaatcgacatacacctggattagaacactggagtcttgctgtgaaggatggaaaagctttagaaaatgagtggaggagtgagatacccattccccgtggaggacctcacagggcttgtgttgtggttgatgatcgtctttatgttcttggtggtcaagaaggagattttatggccaaacctgggtcacctattttcaagtgctcacgcagacaagaggtggtttatactgatgtttacatgttggatgatgatatgaagtggaaaacgctgcctccaatgccaaaagcaaactcacatattgaatttgcttgggcgcttgtaaataactccattgtcattgttggaggcacaacagagaagcaccctataaccaagaagatggttttaaacggagaagtagtccagtttaacttgaatactttggtaacaacttcttctttttaa

SEQ ID NO: 6958 - DNA, 768 bp, Glycine max
  Peptide Sequence Number=SeqID_98643
atggaagaaaacaggaagataactatggagattgtgcagcagaacagaatacttcatcagtttagcccacccgagcctttcaacctcactcaattcttacttttacacttttccttccccctctttaccctcatgcccacagttcagcctttccacagttcagatccaatattttcattttctcctcttgcaattcacacaaggaatttgttggctgacccaagatgcacactggttgtccagatacctggatggagtggcttgtccaatgcaagggtaactctttttggggatgtctatccacttccagaagatcaacaggaatgggctcataagcagtatattgcaaaacatcaacagggtccttctcaacagtggggcaacttctactattttaggatgcagaatataagtgacatatatttcattggaggctttggtactgttgcttgggtggatgtaaaggaatatgaaacccttcaacctgataagattgcagttgatggtggtgaacagtatttaaaggaactcaatgctatcttctcaaaacccctaaagaaacttctatctagtgagactgaggtagatgacgctgcactcatatctatagacagcaaaggaactgatattagggtccgtcaaggtgctcagttcaacattcagaggatatcatttgatgaagggcagagtgtagaaacattggaagaagctaaagctgctcttcggaaattaatacacaaaggaaaagtgtacaatttgcagaaataa

SEQ ID NO: 6959 - DNA, 510 bp, Glycine max
  Peptide Sequence Number=SeqID_98644
atgtggcttatcctctgggacactgatccatctgaatcccaattgcttgatatgtcacactatgatacaatgctggaaactggagccgcatttgcgcgcccatttggcgaaggtgatgtggttctggagaaaattgatgatttgattcttaaccgatcatctaatgggttggtccaaggagagtggtgttcaaactcagaaataaataagactacaaaggcttcagaagctgaggaagagttctgctcacaatctagcaatgttgatgctgtaaagcctgggccatttggcatcaagcttaaaactctacaagcagaaattgtgaactcgaggaaattcagaactagccagtgcaaatcctttgaaaggccttgggagtttggaacagaagattcgagattgtgtttgctcaaagctgagtttgtttcgatttctctacactcacagcacaatcctttttgttcaaattttatctcttcatacttacagttgaagcaatcaagctcctag

SEQ ID NO: 6960 - DNA, 2628 bp, Glycine max
  Peptide Sequence Number=SeqID_98645
atgaatgtgcgagttgtgactattaacagcctgcaaatgcatgcttgtaccgggcatagaaatagaagctcagacctattaaaaaatggaaagaatgaaaattctaagatgcttctgtggcagcactgcttttcagattggccgatgttaagagaaattaacaggagtggtcaactattggcacaaaatctgaaaaaaagaaacagtttggcattgatgctgtcggttttaatgataagtacagcagcgtcacccccaactccagccggtgactatgatattgggctcgaacaacttgtttcaatggctaaggatcagaatatttctgctttacaacaatatggaggggcaagtctacaacatattagaggcttatcaaatttaataaaatctaatccggataaaggtgttagtggagatgatgctgatctgttaaaaaggaaaaatgcatttggaactaatacatatcctcggaaaaaaggaagaagtttctggaggtttttatgggaagcttggcaagatctgactctcataatactgataatagctgctgcggtgtcattggcacttggaataaaaacagagggtttggctgaaggatggtatgatgggggaagcattgcttttgcagttcttcttgtcattgtagttacagctgtcagtgattatcggcaatctctgcagtttcagaatttgaatgcagaaaaacaaaatatacaattggaggttattagaggtgggagaacaattaaaatttcaatatttgatattgttgttggtgatgttataccccttaaaataggagatcaggttcctgctgatggagtattaatcacgggccattcacttgcaattgatgaatccagtatgactggtgaaagcaagattgttcataaggatcacaaaacaccattttttatgtctggttgcaaagtagcagatggagttggtcttatgctggtaactggtgttggtataaataccgaatggggattgttgatggctagtatctcagaggacaatggagaagagactccattacaggtacgcttgaatggagtagcaacttttattggtgtagttgggcttagtgtagctgttttagtgcttgctgtcctcttgggcagatacttttccggccataccaaagatttagatggaaatgttgaatttgttgccggaaagactagtcttagcaatgcagtagatggggtcatcaaaatttttaccattgcagtcacaattgtggttgttgcagtgcctgaaggtctacctttggctgttaccttaaccttggcatactcaatgcggaaaatgatggcagacaaggccttgatgactgtagttgaggcatatgttgggagcacaaaagtaaatccaccggatgactcatcaaagttgcatccaaaagcattgtctctgataaatgagggcattgcacagaatacaaccggaaatgtttttgtacccaaggatggtggagaaacagaggtatccggatctcctacagagaaggctattctttcatgggcagtcaagttgggtatgaattttgatgttataagatcaaattcaacagttctccatgtcttccccttcaattctgagaaaaagcgaggtggtgttgctttgaagctgggggattctggaatacatatacattggaagggagccgcagagatagttctaggaacatgtactcaatatcttgattcagatggtcaattgcaatccattgaagaagataagaaggcttttttcaaggatgctattgatgacatggctgctcgcagcttgcgttgtgtagccattgcatacagatcctatgaactagacaaagttccatctagtgagcaggatttagaccaatggtccttaccggaatatgagcttgttttgcttgctattgttggaataaaggatccttgtcgccctggtgtcaaagatgctgtaaaagtatgcactgatgctggtgttaaggtacgcatggttactggagacaaccttcaaacagcaaaggcaatagctttggagtgtggcatactggcttcaattgaagatgctgttgagccgaatataattgaaggaaagaaattccgtgaactatctgaaaaggaaagagaagatattgccaagaaaataactgtgatggggaggtcttctcctaatgacaagcttttgcttgtgcaagctctacgtaaaggaggggaagttgttgcggtcacaggagatggcaccaatgatgctcctgccctacatgaggcagatattggtctttctatgggcatctccggaactgaagttgcaaaagaaagctcagatattataatcctagacgacaactttgcatcagtagtaaaggttgtccgctggggccgctctgtatatgcaaatattcagaaatttatccagttccagcttacagttaatgttgctgctcttgtaataaatgttgtggcagcaataacttctggtgatgttcctttaaatgcagtgcagcttttgtgggttaaccttatcatggatacacttggggcgcttgcactggctactgaaccaccaacagaccgcctaatgcacagatcaccagttggccgaaggtttggattgattggctttctcacttag

SEQ ID NO: 6961 - DNA, 2013 bp, Glycine max
  Peptide Sequence Number=SeqID_98646
atggagagccttgaagcagctagaaagtgcttgacaactagtttggaaacttcgagcgccattgcctctgcacttgatgaatctcgatcgagattgcagctacttaaccagagatatctgtccttgcaagcttcccttagacccatctcgaagcagaagtgctcatttgtcaacattgaccaatgtatagacagtgttctatgttctgctgctgcactcctcaaggtttctgactctgttcagcagttggagcattctctcttaacagatccctcttctgatctatacacctatgtctcagacacaaagaagctcgaggaagcattgaagcttctaactgataattgcaggttagcagttggctggttgaaggacgtctttgagttcttacaagacaaagcaatcaccaatgagctttacctgttgaatgtgaagaaatctttgagaatattgcaagaattgcaggtcaaggaggaaagttctcgccttgatggaggtcttcttagtactgcttttgacaaactagaacttgagttccacaggcttatcatagcaaactccatgcctcttcctttggtttcgttgacatcacacatcggtcagcaagccagtattgccaaacaagctttgccattgacaagttctttagcaggggagttgcatgccatcattgagagattacatgctaatggcaggctagacaagtgtcaatctatctatgttgaagttcgaggtatgaatgctcgtcgaagcttgaagactttagatttgagttaccttgagattctaacagctgaatttgagggtgcacagtgtatagagagctacatagaccaatggggttgccatttggagttggttgtgaagcaactgctcaagaccgagtgcaggctctcagctattgtctttgagaaaatcggtccagaagcatggatggggtgttttgcaaagattgccattgaatcaggaattctttcttttattcaatttggaaggattgttactgagaggaagaatgaccccttcaagttgttgaacctgctgtccatattcaaggtcttaaatggtctaaggctaatattcaaccagcttttcagtgtgaaagcttgtaaagaaattaggactgtgactgaggatctcataaaacaagtagtcaatggtgccagtgaggtattctggcaacttccagcacaagttaggttgcaaagaccgacttctcctccctctgatggcagtgttcccaggctggtaagctttgtaattgattactgcaatcagctgctcggggatgcctataggccacatttgacacaggttttgggaatacatcttagctggagaaaggaagcatacgaagagggtattgttttctgccaaatatataacgcaattaaggaggttgcggtaaatttggattcttggtcaaaggcctatgaagatatcacattgtcctacctttttatgatgaataatcactgtcatttctgcaatttgaggggtactgtgcttggaaatatgatgggagattcttggttaaaagcacacgagcaatataaggactattatgctgcactttatttgaggaacagctggggaaagcttctatctattctcgtagttcaaagggacatactttcacccaccagtgcaagtgtgacaagccaagacttgacaaagagactaaatgctttcaatctagcttttgatgaaaggtacaaaaagcaatctaattgggtaatctccgatgagatcttgagggaaaatgtatgcaagcatttggtggaaggtattataccaatttatagggcctacgtcaagaattattgtttgttaatagaaaatgatgctaaggttgacaagcatatgaaatatacggcacagagtttggagaacaagattaggtctctgtttcagcccaggcagaggaagggtagtagcagtaaacagacagacttgattagtaaaataaaagaagtaagtcatcagtttcgcttgactctagctgctctataa

SEQ ID NO: 6962 - DNA, 231 bp, Glycine max
  Peptide Sequence Number=SeqID_98647
atggccattactgagaaagttgaaaaatatccattttggttaaaggaaggagtggacagtgtcagatccacgagtttagaatcctatgagcagctagcgcagtacaaggcaaggcaagtttttggtctgaatgcagtgcaggaaaagggcagcggggatgacatacatcacatactcaaacatatgcgcgaatctggtcaggaattgcctcaaggaaccctacaaggctga

SEQ ID NO: 6963 - DNA, 1371 bp, Glycine max
  Peptide Sequence Number=SeqID_98648
atggctgtcaagaagaatattgaagatgtacaaggaaaagataattacccatgtggacagcaattgttgattcacaatggcaaggttttgaaagatgaaactacattagtagagaataaagtctctgaagatggctttcttgttgttatgcttagtaagagtaaaacatcaggttctgctgcagcttcatctgttcagcctgccagtaatcctcctacgactgtatcaacgtcaaattccacccctccttctgatcctccagtgcaaactcaagctgcaaacaacagtacatctagcacagatgccccaactacaaatgtgtctgcagatacctatggtctggctgcttcgaatttagttgctggtagtaatcttgagcagactattcaacaaattatggacatgggtggtggcaattgggacagagacacagttagtcgtgctcttcgagcagcttataataacccagagcgtgctatagattacttgtattctggaatccctgaagcagcagaagttgctgtgccagttcctcaaacagctgggatttcttctggagcagttcctgtaggacctaattcatctcccttaaatatgtttccacaggagacgatttctagcactggtgctggacttggatcgctagacttccttagaaataacccccagggcagagtggccgcccccaaaaatgctacaatagatagcgttcatcatgctattttaaaccctgaatctgaaaaggaacagagaagaaaaagatgggtcttcataaacgctggagattggctggaaaactcaccaggaaaaagatgggtcgctgctggaaaatcgcggaccaggttgtggatgtcggagtttggccagaaaagatctctgtcagtactgggctgcggctggggcatcgaagaagatagaggttcagaatataaagggataggattttccaagagcggctgcgaagggtgtgagtcgtgccatgatggctgcgacttgaatttgcgccatgatggcttcacctggagtaggatcagcctgcaacacactgtgctagtgactactctgcctgtgcttcaggaacttggtaagcagaatcctggtcttttaagactgattcaagagcatcatggggagtttctgcagttgataaatgaacctgttgatggttctgaaggagatatatttgagcagcccgagcaagacatgccccatgccatcaatgtgactccagcggagcaggaggcaattggaaggctcgaggctatgggatttgatagagcctcggtgatagaggcatttttggcatgtgaccgtgatgagcaattggcagccaactatttattggagaatgctggagactttgaggattaa

SEQ ID NO: 6964 - DNA, 483 bp, Glycine max
  Peptide Sequence Number=SeqID_98649
atgaggggagtggtggtgactgacaggttaccggtgcagggtgctccattaagggccactctcatcaaacactttgatcatcaaatccatttaagtgaattggttgaatctgccaaaacgggtctccctctgtggatgcttggtttgggtgcggacctcttgtgggccgacatgaaccgtctcctcgcctttctcttccaccagggagtgttggatgagcaattcttgcagcttcagcagctgcaggatgagacctccccaaacttcgtctccgaggttgtcaacatttatttccacgaatccgaaaagcttctcagaaatctcagagctttgctgatggagaaggagttttcggactataagaaaatggggatccatttgaatcagttcatgggtagcagttccagtattggcgccaagagagttagaaatgtttgcgttgcctttcgtgccgctactgaacagaataaccgtgctgggtaa

SEQ ID NO: 6965 - DNA, 225 bp, Glycine max
  Peptide Sequence Number=SeqID_98650
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttacttataagattcaattggatgatactataccataccgatattgttaagatggaaaatcgacattcacattaa

SEQ ID NO: 6966 - DNA, 1998 bp, Glycine max
  Peptide Sequence Number=SeqID_98651
atgaataggcaattcaaaattcagcgaccgggttcagggggtgacttgccccaaggaggtgagtacaacccttcttcttcttttcctgtggcacggagagtgaattcctcccattctataatgatggaggatgacatggagaccggtactttgggggcttaccaggacaagctaagaaccttccccaacatgcgcactaaaccttacaccccactgatatttcgtattctattgggtatcaatgttcgtgtcctcttcattcttttgctcttcggcttgggagctatcttttacgtcggagcttctacttctccaatcatcgtctttgtcatctctgtttgtattctcagcttccttgtggccatatatcttacaaagtgggtcctcgcaaaagatgagggccctcctgaaatggttcagatatcagacgctatacgagacggagctgaaggatttttcaggacccagtatgggagtatatctaagatggccatgttgcttgcacttgtcattctttgcatatatttgtttcgcagtacaaatcctcaacaggaatcttctggcctgggaaggacaacttctgcatacatcactgtagcttctttccttttaggtgccctttgttcgggtgttgctggatatgtagggatgtgggtgtcagttcgtgccaatgtcagagtctctagtgctgcaagacggtctgcaagagaggcattgcaggaatttgtgcagatagctactcgtgcaggtggtttatctgctatcattgttgttggtatggctgtaattggtatagcagtcctttatgccacattttatgtttggttggaagtggactcgccaggttcaatgaaggttactgatttgcctcttcttctagttggatatggatttggtgcctcctttgttgcactatttgcccagttgggtggtggaatatacacaaaggccgctgatgttggagcagaccttgtcggaaaagtagaacagggaatacctgaagacgaccctaggaatcctgctgttattgctgatctggttggtgacaatgtgggagattgtgctgctcgaggtgctgatctttttgaaagtattgcagctgaaataattagtgccatgatacttggtggaacaatggcacaacgctatccatctggcttcatcttgtttcctcttgttgttcactcattcgatctgatagtttcatcagctggaatattttctatcaggggtacacgtgaaactggagttatagttcctgtggaggatccaatgacaattcttcagaaaggatattcttttacgattgttttagctgttctggcattcggtttgtctacccggtggttactttacactgagcaagcaccttcagcatggttcaattttgctttgtgtgggttgattggtattatcactgcttacatatttgtctggattgccaagtattatactgactacaagcatgagcctgtgcgcatattagctctttccagttctactggccatgggactaatataattgcaggagtcagtttgggtctggaatctactgctcttcctgtccttgtcatcagtgtgtcaattatctcagctttctggctgggccacacctgtggactagtagatgaaacaggaaacccaactggtggcctgtttggcactgctgtggcaacaatgggaatgcttagtactgctgcctatattcttaccatggatatgtttggcccaatagctgataatgctggaggaattgtagagatgagtcagcagcctgaaagtgtccgagagataactgatgtccttgatgccgtaggaaacacaaccaaagctaccaccaaagggtttgctattggttctgctgctcttgcatctttccttttgtttagtgcttatatggatgaggtttcttcatttgctcatgaaccttttaaacaggagggggggcctagcttagaggtgaaaattggatacccttccacaactcacatggtttaa

SEQ ID NO: 6967 - DNA, 135 bp, Glycine max
  Peptide Sequence Number=SeqID_98652
atggaagattttggttatggatatatgttaagacatcccaagaaatatatgaaggactccaaagttattaggaaagccacttatagtgggtgcaaacaatctaacatggacattgatgaagtttatcaactctga

SEQ ID NO: 6968 - DNA, 1533 bp, Glycine max
  Peptide Sequence Number=SeqID_98653
atggagtttttgaaaatcaaaaagttcagaaaatctcagaaagcaaatggagaaaaggatttggcagacaaggcagtgcctgagcctgaggaaccaaagctgaacaccgatggtcctgatcagtgtaaatcagaaaacgcagactctgcaggtgaagcagaggatgacgatgattttattaccaatgaggttaagaggaggctaaaagaattgagaagaaacagttttatggtgttgattcctgaagaagattcctgccctgaggaaggggaggatgaagaggaagaggaagccggagagacatgctcaaatgaatggagggatgtggaggcagaaggtcagcaatggtggcgtggttttgatgctgtatttgaaaagtactgtgaaagaatgctgttctttgatcggatgagcactcaacagcttagtgaagttggcaaaggttcacagtatacttcaactccatctccaagatctgcttcaaagaagctggcttctccccttcgttgtctttccttgaaaaaatttgaagaacctgatgatgagactgaacatcttcaacagcctgagcatgacccctaccaggatattgaaacagcatatgtaggtcaaatttgcttgacttgggaggcgcttcattgtcagtactctcatatgagtcagaagatatcttggcaacatgataatcctacctgttacaaccatagtgcacaagagtttcaacagttccaggttctattacaaaggtttattgaaaatgaaccttttgagcagggccgtcgagctgaaatttatgctcgcactaggaacaatttgcctaaactgcttcaggttcctaatatacgaggttcagatcatgaattgactgatgattcagagatgagagttcttgctcctgatcttatcgggataattgaaagttctatccttacattccaccttttcatgaaaagggacaagaaaaagtcaagtggtgctaccaatcagaaccagcttgatactcctctacaacagattcagtcgactcttgaaaagaaagtggtgaagctgaaggaactgcgcagaaagaaaaaaaattggaagaagaattcttggccccaaaagcacgaggacattcaggttttgcttggccttattgacgtgaagatcctgtcaagggttctgaggatgacgaggatgactagagaacaactgttttggtgtgaagaaaagatgaaaaaactggatttatcaaatagtagctttagttctttctcctttggatcgataactgttgctggttttgaagacgtcatcaaatcggccctacagctgtttaggatttcttgggaagaattcgggatactgtatgacaatgagggcaagaataattgggaattgcgatggatgggagaggcggaagcagaaggaggaaaggcgataatcgcgttggagagtgcgaacgcgatagtggcatggttggctaatacgattggtgccacgacaagaggctgtttctcaaggtcattctcttaccgttgcctatgccggtag

SEQ ID NO: 6969 - DNA, 1661 bp, Glycine max
  Peptide Sequence Number=SeqID_98654
gttggggaagcgaaggagaggatgtggaggctgaagatagcagaaggtggaaatgaggcatacatattcagcacaaacaattttgttgggaggcagacatgggagtttgatcctgaagcagggactccagaggaacgagcccaggttgaagcagctcgtaaggatttctaccaccaccgcttcaaggtcaagccctgtgctgacctcctttggcgttttcaggacctaatggaggtcattataatgcttgtgctagagcaagaaattggattcgagatcatggtgatacttggtgtatttgattggtgtggaagcaacccaatgcccccagagttttggatccttccatcgtttcttcctatgcatccggctaagatgtggtgttattgtcgattggtatacatgcccatgtcttatttatatgggaagaggtttgtgggtccaatcacaccactcatcttacaattaagagaagagctattcactcaaccttatgaaaaagttaattggaagaaagcacgtcaccaatatgcaaaggaagatctttattatccacatcctttggtacaagatctaatatgggatagtttatacatatttactgagccattgcttactcgttggcctttcaacaagttgattagagaaaaagcccttcaagtaacaatgaagcatattcattacgaagatgagactagtcgatacataaccattggttgtgtggaaaaggttttatgtatgcttgcttgttgggtggaagatccaaacggagatgctttcaagaagcatcttgcaaggatcccagattacttatgggtttctgaagatggaatgaccatgcaaagttttggtagtcaagaatgggatgctggctttgctgttcaagcttttcttgccactaacctaattgaagaaattggtcctacacttgcaaaaggacatgacttcatcaagaagtctcaggtaaaagataatcctcttggagattttaaaagtatgtatcgtcatatttctaaaggatcttggacattctctgatcaagatcatggatggcaagtttctgattgcactgcagaaagtttaaagagtaaaaaaggtggtttagctgcatgggagcttgcaggagctcaagagtggttagaattactcaatcccacagaattttttgcggacattgtagttgaacatgaatatgttgagtgcactggatctgcaatccaagctttagttttgttcaagaatctatatccaggacataggaagaaagagatagaaaatttcattgccaatgcagttcgattccttgaagatacacaaacagctgatggttcatggtatggaaactggggagtttgcttcacttatggctcttggtttgcacttggcggtctagcagctgctggcaagacttacatcaattgtgctgccattcgcaaagccgttaaatttctactttcaacacagagggaagacggtggatggggagagagctatctttcaagcccaaaaaagatatatgtacctctagaaggaagtcgatcaaatgttgtacatacagcatgggctcttatgggactaattcatgctggacaggcggatagagaccctaagcctcttcatcgagctgcaaagttgctcattaattctcagttggaaagagg

SEQ ID NO: 6970 - DNA, 184 bp, Glycine max
  Peptide Sequence Number=SeqID_98655
ggtttctagatctgagaaagagaaggagagccgttgtcgttgccgtcgctgctgtcgctgctacggtgggttcacggagtgggttgttggtggatttcctgttgcggtggttttgccgtcgttggctcttggtggcagcgatgccaattgttattggtggatgagacctggagagataggatag

SEQ ID NO: 6971 - DNA, 2535 bp, Glycine max
  Peptide Sequence Number=SeqID_98656
gatgttttctttcaaggaggttggcatttcaacatgttagcaactcctttgtccaatgatattaagaataagttactgagcattgttctagatgaccagttggatgatgttgttatttggaacccttctccaaccgatggacaccacaacctcatcttatgcgatatgaagatcttcaaggataagaaatggcagccttggttcattataaatcaagcaaaaacaacatatgatattgctttctctcctccccccaatccaaaggctcaaaagcaaccgcttgcagtatctaggtcctcactagctgagaactcaatcaagttggacgtggatggcagttcgctaggcaacccagggaaggcgggtttcagcgaaatcctttgtgacaaccttggtcaatggctctcaagttttttgggtagttgtggttttgcaacctctcttaatgcagaattacatgtcttgtttcatggcctctctcttgcttggaactctggctacaagagtgtagaggaagccaacatttgtgcaaattggctttcgaagaagggttcatcctctacagaacctatgtctactttggttccttgtccaatttctttatcccctatgtcgttggttgatgctcttaggatattcatggcggcaacccaaccaccgcagggtccggatcgtaccaccgaagagataccggccgaaccagataacttgaaggagcagggtacaacaactataggtcattcaagggagaccacaagtcaatcaggatctttaggttcagttggagattgtcctctgtatcctcctaatgtgtatgctccccaagcccaggctttctactatagaggttttgacaatggcaatggtgaatgggatgaatattcttcatatgtcaattctgagggtttagacattggatctcctggtgtttacaatgaaaatccatctcttattttccattctgggtatggcttcaacccacaagtgccttatggaccatattccccagttaccacacctttgccttctgtaggtgtagacacacagttatactcccctcagcaatttccatacactgggccaccttattatcatcagctggttcctcctagcttaccatatcttaattcccctactccagtttcacagccagaactcaccaacctggtaggtattgaccaacaagttgataacatgttttttggaccaagagcgggctatccatcagtgggatcttttggtagaggcaactttcctgtagcgcctggttcctttggctttcatgaatcccaacaaggatttgaaggatcaagatctggtggaatctggtcagactgctcaaaaccatcagaaagacagagatctttgatgcccctatcgccatctgtttctccacagccaatgggctcacttgggtcatttgggcctagtgttggaatggcttctcatcaacagcaatcattgtatgggtttggatctggttcaaactcctatggtagaggatacctgcctaaccagggttctagctttggaggcacttccatttccaatcttaatgataggagttttgcttctcttgaaaatagcaggcggcaagggagaccaactgcttctctttgcaactgtaatggtactcttgatatccttagtgagcagaaccgaggaccaagggcctcgaagttgaaaaatcaaatttcaactgaaaataattctgtggatagtagtaaaaatagtgcatctactgccaagttccaaaatgaatcactcaatcggtcagattttgccacagattacaaggatgccaaattttttgtcatcaaatcttacagtgaagataatgttcacaagagcattaaatatggtgtctgggctagtacaccaaatggaaacagaaagttagatgatgcatatcgccaagcaatggagaagcaagatgcctgtcctatatttctctttttttcggtaaatgctagtgctcagttctgtggggtagctgaaatggttggacctgtcaattttgacaagagtgtggacttctggcagcaagataagtggagtgggcagtttcccttgaagtggcacataattaaagatgttccaaatagtcagtttcgtcacattattcttgaaaataatgataacaagcctgtgacaaacagtcgagatactcaggagggggttgaaatgttgaccatttttaaaaactatgaaactgatgtgtccatcctggatgattttgatttttatgaagaccggcagaaggctatgcaagaacggaaggcaaggcagcaaagcagcatggtggctactggattagttggagaaaatgagcatagaagttctgctaacactaccggtgatttcatgaagcagatgtcgaagagctttgctctagttgtccgcttagatgagaataacaaggaagttgttgcagatagagatagtttagtctctcatggtcatggccccattggtaatgtagttaaacctgatgatggtcaatcagtgactgcctcttcaactcaaaccagttag

SEQ ID NO: 6972 - DNA, 1329 bp, Glycine max
  Peptide Sequence Number=SeqID_98657
atgaaatgtgaagaaaaagaggcaagaggtgtgaagggacaaagtgaggaagaagaaagtaggaggtccaaaggaagaggaaagacgggggctgaaggcccaacctacacagtagatgatgctcttgtggctttgggttttggaaatttccaaattctcgtgcttgcttatgctggtgtaggttgggtttcagaagcaatggaaatgatgctactctcttttgtaggccctgcagttcaaactgcatggaatctttccgctcatgaagagagtttgataaccagtgtggtttttgctggcatgctaattggtgcatactcatggggcattgtttcagataaacatggaaggaggaaaggattccttatcacagcgacagttactgctttggctggttttcttagtgcatttgctcctaactatatatttttaattgtcctccgttctctggttgggattggtttgggaggtggccctgtattatcatcttggtttctagagtttgttcctgctcccaatagaggtacctggatggttgtcttttcagcattttggactcttggtacaatttttgaggcctcacttgcatggattgtgatgccaaaactgggttggagatggcttcttgcactgtcttctcttcccacgtctttccttcttctgttctacaaagtgactcctgagtcaccaagatacctatgtttgaaaggtagaacagctgatgcaattaatgttttggagaaaatagcaagagtaaatggaagagaacttccttccggtatccttgtttctgagcatgaaattgagttacacaaaattgataaccctacagaggacgcacgcttgctctcaccaagaacaaatgaagatgaacatcctaaaggaatagtttccaatttaggtgctatctcatcgttgttagtgcttctctcaccgaaattggcaaggtcaacccttctattatgggctgtgttctttggcaatgctttttcgtattatggccttgttttgttgaccactgagttaaacggacatagtaaatgcatgtcagataaattgcagacagagaagtcccaggatgttagatacaagagtgtttttattgctagttttgcagagctaccagggcttctcttgtcagctgcagcagtagataaactcggtcgtaaactctcaatgtcaatcatgttcttcatgtgcttacatggatgtcatcaaactgcagctgtccttctgtttgagatcgtatctcttgtttcaggaatatgtgtcatgttcttcccaattgaaaccatgggccaggaactgcgaaataatgtgcaagtctaa

SEQ ID NO: 6973 - DNA, 589 bp, Glycine max
  Peptide Sequence Number=SeqID_98658
gatgttggataagagagctgcaactctgttttgtgccacatggccctgtgtgctatttgggaaagatggtatgatgtctatggttgttaagtctacgacaaaggattctgtgaaatgtgcagttgttgatggaggagagctcaagtcaagtgcatctcatgggactatggttgccagaggggatcttggcgctgagctccctattgaagaggttccacttttgcaggaagagataatcaacctatgttgtaacatgggaaaagttgttattgtggcaacatatatgctagaaagcatgattgttcacccaactccaactagagcagagggtttaatggttgaagagatgtttcttgactacatacttattgtaacagatagagtggcagacatagaaaatggtcttttcccacacaaagcaacacctctgtttgataagcttgcatttgagaagacacaacaagcactaggtggacatcttgaccatcactatcaccttgaggacaaggtgtttttcaatggcataggggatgttaggaagggaataatggctcaacaagatactacaagcaagcatagacacgaatga

SEQ ID NO: 6974 - DNA, 428 bp, Glycine max
  Peptide Sequence Number=SeqID_98659
gattgagggattttctccatcgaatctttgaggaggattttgaggattctgctccgattaaagtgttcctcttggtgtgggagtccaacggcagctcacggtggccatcggtggtctcgggacgtatttataacctgcaactttctcttagcggcgcaccttctaggcgctcagcgcactttctctcggttggaattgggcttagcgcagctttgggccgctcagcgcaattcccctcgattggaattgcgcttagcgcgccttactcgtttagcgggagaccaaaagtcactattttcaagatcccaacggtcaaactgaatgacagtggcatagaggcttatgttagcttaaaggtggaggacatgacaaagtttgaagcagacgaggagttgcttgcctgtgtgagtaaagcacctgtttgttga

SEQ ID NO: 6975 - DNA, 420 bp, Glycine max
  Peptide Sequence Number=SeqID_98660
atggcggtgagaagaagcgattcccggccggtggcactggccttggtggctattgcagcgtgccactctttgaatagcaggctgagatttttcatctcattcgcggttcaagggaactcccaatctaggtcaacaccgtggaacccgaaggttcgtgcgagggtgatgggggagttgatgaaggtggcgcgcggtgtagcgatgagagagaagagagtggtgttagagttggcgccgctgatggagatgagggtggcgacagtggagccaagggtggtcgtgaactttgcgaggtttgtggatgtggagtttgaagcgtgtgcgttgtcgacagcattctcggaagaagctattgcaagagagagaatgagatacaacataatccacggtatcatcctttttcaaggtaatttaagttaa

SEQ ID NO: 6976 - DNA, 1494 bp, Glycine max
  Peptide Sequence Number=SeqID_98661
atgggaaaaaatggcgaaaccattaagaaggatatagagattcctggggctgatgctcttgttgtaagagttgtgtcatctgttgacaaaaagttagaagtgaaaccgcggtttctggagatttttcaggaagagaattacccaacagaatttccatataaatcaaaggtagttttgttgtttcaaaagatagaaggtgtggaagtttgcctatttggcatgtatgttcaagaatttggatctgaatgtcaatttcctaatcagcgccgcgtgtatctttcatatttggattctgttaagtattttaggcccgaggttaaagcagtgactggagaggctcttcggacttttgtttaccatgaaattctgggagaagattatattttatattgccatccagaaattcagaaaacaccaaaatccgataagctacgtgaatggtatctggccatgctaagaaaagcttccaaggagaatgttgtggttgatctcaccaacttgtacgatcatttctttgtatctactggtgaatgtagggctaaggttaccgctgcaagactcccatattttgatggtgactactggcctggggctgcagaggatttaatttatcagcttcgccaagaggaagatggaagaaaacaaaataaaaagggaacaactaaaaagactataacaaaaagggctttaaaagcgtctgcagaactaaagcgtgaggagagagaaagacatcctattaaccacagggagaaacatactctttatccggttgaaattactgatgttccttctgatacaaaggacaaagatgatattcttgagagcgaattctttgacactagacaggcatttctgagtctctgccagggaaatcattaccagtatgatacactaaggcgggccaagcattcctcaatgatggttctctatcatcttcataatccaacggctccagcatttgtgacaacttgcaatatatgctatcttgacatagaaactggtcaaggttggcgttgtgaggtttgccctgagtatgatgtatgcaatgcttgttatcaaaaggatggaggtattgatcatcctcataagttgacaaatcatccatccatggtggaccgtgatgctcagaacacagaagcaagggaggttcgagtagtgcagctacggaaaatgcttgatctccttgttcatgcatcccaatgtcgttctgcacattgccaatatcccaattgtcgcaaggtgaaggggcttttccgccatggcatgcactgcaaaacacgggcttctggaggttgtgttctttgcaagaaaatgtggtatttacttcaacttcatgctcgtgcttgcaaagaatctgaatgccacgtaccacgttgcagagatttaaaggaacatctaaggaggctgcagcaacagtctgattcacggcgtagagctgctgtgatggaaatgatgaggcagagagccgcagaagttgctaacaatgctggatga

SEQ ID NO: 6977 - DNA, 1659 bp, Glycine max
  Peptide Sequence Number=SeqID_98662
atgatgaacgccgcaacagcagctaatagcagtgtttattcacagacacagtgcagactactttcctcggatcttcgaagttcgattcctttcttgaatgaacgcaagtcacggttggtggtaagggctggcggtcgtcctcctcaaaatatgggcaaggacgaggatgagaagcagcagcagcgtgtcatacaacaacaacaacaacaagaacaacaagcacctccgcccgtgtctcttagcctggacgacgtgaaccccgtaggactgggtcgaagatcgcggcagttgttcgatgaggtttggagaaagttctcgggattgggtcagatttctaggacaatacggtcggatgatcaggaggctctggatgcccttctggtccgagaaggtccgatgtgcgagttcgcaatccctggcgctcagaatactactgtactcgttgttggtgccaccagccgcatcggtcgcatcgttgtgagaaagctcatgctcaggggctacgctgtcaaggctctggtaaggagggcagaccaggaggtgcttgagctccttccaaggtctgtagagatagtcattggggatgttggtgatcccgccactgtcaaggctgctgttgaaggttgcaacaaaattatatattgtgccactgctcgctctgctataactggggatctcttccgcgttgatcatcgaggcgtttataatcttactaaagcatttcaggtctctccctccctctctctccacactttcacaaggaatctttacttacttagacttcttcattttcaggatcacagtaacaaattggcacaatcgcgggctgggaaaagcagcaaaagtaagctctcgattgccaaattcaaatctgcatcgtcactcaatggatgggaagttcgtcaaggaacttacttccaagatgtagttgccacaaaatacgatggtgggatggatgctaaatttgatttcactgagactggagatgctgttttctcagggtatgtcttcaatagaggaggctatgtggaactatccaaaaagctttctctgccactaggttatactcttgataggaaattctttcatgcattcaagcataataagttcatcaataatgataggtacgagggtctggttctttctgtcggtggcaatggaagatcttatgtattaattctagaagctggtccttcggcagatccaagtcagagtagattgtattttgcaagaattagtacaaaagtgggattttgtagggttagagtaccattttcatcattccgcccagtgaaaccagatgatccagtgttagatccttttcttgtgcatactttgaccatacgctttgagcctagaagacaggtattacggcccctacttggtgctgataaaggttggggtagtggctttccaacttcaattgccaaaacatgcttgaattaccctgtcttccatgcgttgcaattgaagcgagcggtgggtcatcatctagtggaggcagaattacatcaggagttacagctagatcctattatttacttgccagctaaggtttttgctgagagtgtggtcacgcggaaggaggagaagatacctcaagtcctaaataaatggcaagggaaaactaaggaagaggcgacatgggaagatgtataa

SEQ ID NO: 6978 - DNA, 117 bp, Glycine max
  Peptide Sequence Number=SeqID_98663
atggaaagtggtaattggtcttgcttgcatgcatgtgatgtgggtgtgattgtgattctctatggttatttacacgcacagccgcacagggaagatgctgagacttgcttggatgag

SEQ ID NO: 6979 - DNA, 183 bp, Glycine max
  Peptide Sequence Number=SeqID_98664
atgggtggtttaacctctcattatcatgagaggcttacaaatacaaaaaggaagcaagatgaatggaaaagaataaagaaaatggaggaatgggtccccaacataatcatgttttttgacattaactatgcactaagcctacatatgtgcactgagcgcacatgcaaagtccagctgacttaa

SEQ ID NO: 6980 - DNA, 1264 bp, Glycine max
  Peptide Sequence Number=SeqID_98665
gtctccagcatcttcttgttcatcatccacttcctctgttgggtttgaagttcatcatcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtaaacaaggggcatatgatactgaagaatctgcagcacgtacctatgaccttgcagcccttaagtactggggaaaagatgccaccctgaatttcccgatagaaacttataccaaggacctcgaggaaatggacaaggtttcaagagaagaatatttagcttctttgcggcgccaaagcagtggcttttctagaggcatctctaagtaccgtggggttgctaggcatcatcataatggtcgctgggaagctcgcattggaagagtatgtggaaacaagtacctctacttgggaacatataaaactcaagaggaggcagcagtggcatatgacatggcagcaattgagtaccgtggagtcaatgcagtgaccaattttgacataagcaactacatggacaaaataaagaagaaaaatgaccaaaccctacaacaacaacaaacagaagtacaaacagaaacagttcctaactcctctgactctgaagaagcagaagtagaacaacaacacacaacaacaataactacaccacccccatctgaaaatctgcacatgctaccacaggaacaccaagttcaatacacccaccatgtcactccaagggatgaagaatcatcatcactggtcacaattatggagcatgtgcttgaacaggatctgccatggagcttcatgtacactggcttgtctcagtttcaagatccaaacttggctttaagcaaaggtgatgatgacttggcaggcatgtttgatggtgcagggtttgaggaagacattgattttctgttcagcacacaacctggtgatcatgagactgagagtgatgtcaacaacatgagtgcagttttggatagtgttgagtgtggagacacaaatggggctggtggaagaagcatggtgtatcatcatgtggataataataataagcagaagaagatgctttcatttgcttcttcttcttcaccatcatctacaacaactacagtttcttgtgactatgctctagatctatga

SEQ ID NO: 6981 - DNA, 405 bp, Glycine max
  Peptide Sequence Number=SeqID_98666
atggctcaagtagtttttggtattctgattggtttgagggccggttacagattcgtgaggtctttagggtggggaaatgacacttggagcaattattttctcccgttcctaatgatatatgctagaaaattcaagatgcatgtccatttgcatatgcatgataacgttctagacttgctaacttgggagccttgtctggctggtaattatactaccaaccctggttacagctcttccgatcctacttgcaagatgatctcagaccgccatatttcaatttcttccccctgccctaggtgtaatcatggtgaggaagcttcattgctcgaatgtgaggatgctccagcttctatgcgtttggttctggactctaatgacaaggatgtgagctacttgagagtgtag

SEQ ID NO: 6982 - DNA, 213 bp, Glycine max
  Peptide Sequence Number=SeqID_98667
atgaccctcaacaccaattacctctgtggcaccatgaatgcaaaggaagaagaacaagagataggtctcgtggctccctttgtcaaggagcttgcggtcggagaagccattggtggcagctttgaggtaattggtgtcgagggtcatggctacacgaagggagaggaactgcagtctttgcctttgcagaaggcgggggcctcccggaagtaa

SEQ ID NO: 6983 - DNA, 333 bp, Glycine max
  Peptide Sequence Number=SeqID_98668
atgatactcaaatttcacgacgatccaacggtgaacggattcgagatcgtcgtttttctgagattggtttggtgggctgcgggaaaaatacaacaacaacaacaacaacgccttatcccactaggtggggtcggcttaaaaacttcgtaccccattgcccagaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcgccctcaaaatggcaggcacaggacacattag

SEQ ID NO: 6984 - DNA, 477 bp, Glycine max
  Peptide Sequence Number=SeqID_98669
atggcggttgcagccttcaaatcgtcttcgcgaagaggaacccaatcttccgctcattcgaacgcgcctccgaacacgacgtcgtcttctggcagatcttccaccagagctccgaacccgactcgcaggtcgaggagcgtgagcgcgttctccaggggcagtttcgacatttccaccatcaccgagttcctcaacaagagggacaaccctctcttcttcgacgaaacgcaatccaccaaagctcttcttaccgaaacttccacgcccgcgaattcggcgcgaagtgccggaccgggtcggagggaaacgggtcgggtcctatcaatagcggattcgggtcgacgcgcccgctccgcttcgcagtgcccggtttcgaggcggcatctgaactattctacttccgagcattttgagtgtttggaaacccgaatttgtgttgagaaaattagcggttcatactacaaaaaattcacgtaa

SEQ ID NO: 6985 - DNA, 666 bp, Glycine max
  Peptide Sequence Number=SeqID_98670
atgggtggtgataataatgttagtaaccctcccgcgaaagaaagaaagacgccagcttatcattaccgctaccgccattgcaaaacgacgatagtaaggggtttaaggttggacaggtttattcctaatcgctctgcgatggacttcgattatgcgcattatatgctcacggaagggaacaagaagggaaaagaagagaaaaagaaccctctggtgatgtcaccatcgcgagaagcgtaccagaagcaactcgctgatgccttcaacatgaaccggacccgaattttggccttcaagagcaaaccccgaacgcggcgggttgaactcattcccaattccatcttttcccctcctcctccacccatttcctctaagcatagacgccacattcctcagagttcggagagggtattggatgctccggatatactggatgacttttatttaaatctgttggactggggcaacaacaatgttttgagcattgcccttggaaacaccgtgtatatatgggatgcatcttatagctccacggctgaacttgtcactgtggatgaggaagagggtcctgtcacaagcgttgcctgggctcccgatggatgccatgtagccatcggtttgaacaactcgcatgtcctgctctgggattctaatgtttctaggctg

SEQ ID NO: 6986 - DNA, 381 bp, Glycine max
  Peptide Sequence Number=SeqID_98671
atggttcctcatcagaatcatttaagagggagaaaaacgaaagttgtctacttccttgttgccatcttggctctgacatcctctgttgtctctgcctatgacccagtcctctgcaaatttgtgtggcagccaaagaaaaagatggtgggtgatgtgtttgtgttcccaattggtctcattcacttccaactcaatgtgggatatgacaaagctgttgccattcctgctcttagcagccaaaatgcaggaactacaactattgcaaatgctttgtttaaagccaatccacctatttctcctgaggttctcaccaaagcttttcaagtggatcagaaagtaattgatgagcttcagaagaaatcatggtgcgacacgaattaa

SEQ ID NO: 6987 - DNA, 348 bp, Glycine max
  Peptide Sequence Number=SeqID_98672
atgaatggaatatgtaggacccatgttgaatcactaacacatgcgttgcgagactgtgattgggtggtggaggtttggaagaagatcgatatggaatgcgcgtattcctccagaatttatgagtcaagatctggatttgtaattgcgattgcgaactgctatttaaaaccatgttggaagatcggaggcagggtcaaacttcagataccactgcttgatgtccagtgcagtggaatcctacaccagatggatcgagtagtgaagatcaattgtggtggtgcagttcacttgggaaatcagaaggcattttgtggtgccgtctttagggactctaaggatagcttttga

SEQ ID NO: 6988 - DNA, 939 bp, Glycine max
  Peptide Sequence Number=SeqID_98673
atgtctgctgctgtgtgcggaagcaagagatctttcttcgaagagcttcctccttctccgccactctccaagaggctccgttgttcctcttcgccgattcgattccctcctccctctcccgtcgaccaacttcgccctctctttccccacatggacgacttgtttcttctcattttgtctaacttacttcctttttttcctttctttgtgagtttcgggagtatccccaattgtatgtcttctaatggttccctcttaacggtttccccttttatggagagtggtgtgaatggtgccttaggcacgtgcgaggggcaggttcttgagagagctctccaagaatgtggcaatgatatagatgctgccatcaagaggcttaatgagctttgcttgggaactgccgatagaaatgggattgctgaagaattggaggttgtcattaatctggatgcaggtaatttggaaggtgatggaaatgcttctgtttctgaggagcagcctgctttgaacaaccaccttccggcagatggagcagaatggattgatttttttgtcagggaaatgatggttgctactagtgttgaagatgctagagcacgtgctgccagaatgctggaggttctagagaaatcaatcagtgaaagagcaaaggctgaggcaactgatgtgcttcagaaggaaaatttgatgctgaaagagcaaattgaagcgttgattaaggagaaaaattctttcaaaaatgcttttagaatccagcatgaacgatctgctgattatgaggttaagaaccaagagttgcagcatttgaagcaattggtgtctcaataccaggagcagattaaaactcttgaggtgaataactatgctttggcaatgcatttgaagcaggctcaacagagcaacccctttcctgggcgcttcccacctgatgtcttctaa

SEQ ID NO: 6989 - DNA, 221 bp, Glycine max
  Peptide Sequence Number=SeqID_98674
atgtccattggatttaatgatgaaatatgtgcaatttcagcatcaaggcctcgcgctaagcgtgggatcagtgcgctaagcacaacaggtgtcttcagccaggctcagcgcacgactggcgctaagcccaaatccacttacccgcgagcacaccacagtgcctacttcggggaaagagctctggaggcagcaagaagagcagcttttgcagagatacctag

SEQ ID NO: 6990 - DNA, 285 bp, Glycine max
  Peptide Sequence Number=SeqID_98675
atgagttggtgcttaatgaaggggattgggtttggctccatcttaggaatgatagatttcctactaagagaaattaaaaaattagcccagaggctagacctcccagaggagtatggagttagcaacacctttaacattactgatttggttccttttgcatgtgtagttgacttacatgatgaggggtctgcatatttgaggataaatcctcatcaagatggaggggatgatgcaatcctcccaaggaggggacctatcaccaaagccatggctaggagactctag

SEQ ID NO: 6991 - DNA, 660 bp, Glycine max
  Peptide Sequence Number=SeqID_98676
atgtctttagagggatcttcaactggaatgttcaagcctgtggatgataaggtagatgtcttttggaaatggaacagcttaaaggataaaaataacaggaagagtgtaacctgtgatttttgtcacaaaacgtctactggaggaatttctagagcaaaaagacatcaacttcaaataaaaggagatgtggattcttgtaagaaagtaccagagaatgttaaattagaaatgattgctaattatgagaagaaaatagttgaaattgcagtatacatggaggcaacgcaagaagaagacgaggaagaggaagatgggatcctagagatttcaagacttaaaagtggaaaaaggcgtccaacaacatcaaatgaagcctcctcaactgcttccaagaagaggatcacaaataaaaaaggccctcttgattttttgttctccaaagaacctgaagaaagtatcaaattgggaaaaaccatgagacaaaaaagtgtaaatgaatcttataacaaggcatcaagagacagggcagttcagtacatttctcgtttcttttttaggaatggaatagcattcaatgttgctaaatcaaaaagtttcaagttgatgattgaggcaattgggaacctatggttctcatttaaagcctccaagctatcatga

SEQ ID NO: 6992 - DNA, 339 bp, Glycine max
  Peptide Sequence Number=SeqID_98677
atggtttgcaatgaccaggctgacatgactggcagattacttgctaggtcatttactttcgattgtcgcatcaagcactacattattgttcacattttgcttcctcggtctacaaatcttgcccaagcctctaaggaggatttgattctgttgtgggcccttcaaactggtcgtcagatcgactgggcccatcttttcaatactgaatgcataaggcattacgggccaatgcacctctaccatatcctcaccttgttaccctctttcttcatcatttcaaagttcccttggatgatgaaccatttgtcaagcctttgtttggctcttgtcttggtttga

SEQ ID NO: 6993 - DNA, 823 bp, Glycine max
  Peptide Sequence Number=SeqID_98678
gcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgacattgg

SEQ ID NO: 6994 - DNA, 416 bp, Glycine max
  Peptide Sequence Number=SeqID_98679
gttgtaccatttgtagtgaggctcatgagtcaagtcattgcattcccattgaagagcacactcaggaagttcattacatgggaaatcaacagagacaaggatacaaccaaggaggattttcgagattccagcaaggtccctataatcagcaagggcaatggagatcacaccctagcaatcaattcaataaggaccaggccctgaaaaaccttgagatccaggtgggtcaactggccaagcagttagctgagaagtcatctagcagctttggagcaaataccgagaagaatcctaaagaagagtgcaaagttgttataataagaagcaggaagcttgtggtggctgaggatgaggatgttgttgctttgaaggagcaagtttctttgaaggacactacttataaaaaagaagaatga

SEQ ID NO: 6995 - DNA, 623 bp, Glycine max
  Peptide Sequence Number=SeqID_98680
ccgcgattgatgcttttcttgcataccaccatagcaaggagagaccggtggtagctatcttggcggacttatttgatacatttgaccgaagagtagattgggaccaatacttggctgggataggaggccgaacaatcaactggtttcctcgatggaaggaaggaaaggagggagttctcttctcatgtggggactacccaaaaattccgttgatagggacgaggggttgtattaactacaatctcgcacttgctataagacagttagggtaccccatgaggggagcaccgacggaagagagcctctcgcctttccttgtgagagatttcggcgcacaaagtttcaaaattgtacaaagagtccacaaggcgtgggaacgcccgttaaggaaagataaagaacttaggggcatccgtaatggcatcatcggtggttatcatgaatggctgaaagttcatacacgagggttagattggctctccaagttgaaaattatcaacgaggagaacttcgaagcttcggaagaagatgaagatgtccgagctctaaaaatagagttgggaaaggcaagactcgccaaagaaaaattcaagttagtcgctacagacgtccggaactactag

SEQ ID NO: 6996 - DNA, 309 bp, Glycine max
  Peptide Sequence Number=SeqID_98681
atgccgttccgagtctgttttatgcggtccaaacctcttgttgaatccttgaccacagttgcaattctgctcaaagaggggagacacccggaggaaagatatggttttcttcccccgagaggacatcctagaatttccccggagttggtactaattggcgactccatgtggtcgtgggttcgattcccacagagggccgaggcgcttccgaaacgtttccgtaacgttttccgtgaggaatttcgcaaaggtttcaaccgttcttcgacgttcttcattcgttcttcatcgttcttcgatcttcaacgg

SEQ ID NO: 6997 - DNA, 381 bp, Glycine max
  Peptide Sequence Number=SeqID_98682
atggggatttttggagaaaatggctgggagtggaaattttcttggagaagacatctttttgatagtgaattgggggaagccacagcttttatcgaccagacctcagctataagtcctgttgcagacttgaaggatgactgggtgtggggagctcaaccaacgggaatgttctctacaaattctgcttacaactgtctcagatctgagcagcctctccatcagccaaacagtggctttagacaactatgggaaatcaaaatcccccctgcagctttatcctttgcctggagattactctgggataggcttccttctaaggataatttaatcagtagacagattgtcctccaaaacgatctatgccctttctgccaaagccaa

SEQ ID NO: 6998 - DNA, 714 bp, Glycine max
  Peptide Sequence Number=SeqID_98683
atggcaccccataccctaaaaacatcaaatcctcatatcttcttcatttcttcaccaaatcgcttcaaacaaagtgcgaaatacttctcttcgaatcctccacaaaaaccactgattgaaattttcagaaacttcaccaaatggcataatcgtcaaagaggcgcaagggctcatcatcctccaccaccactgtcggccaccaccacggtccttttggtgaccctcaggcaccacccaatccatctttttcctcatcgcgctctctcactctattttccactaatgtccaacgtgagagtgggtttcatgactaagaaatttccatattaccctgaattggttcgagtgtcttataacaacttgaaaattcatgaagaagtgatattttctgaaatgaacaaaataacaattgttgttgatcaatccttgttttactccctaaccaaactaagcagtcaaggtgtgccttttgaaggaactttagttgatgattggaaaccaatttattatagtcttgatgctcataaaatggtttgtgttgcaaatgctgatatgtctcgttgcttacttgttggatcctttacttttgaatgtcgtatcatgcattacattctctgctatgtgttgcttcctcattctactaaccttgctcaagccactgaggaagacttaattttgatgtggacactgcaaactggacgccaaatagagtag

SEQ ID NO: 6999 - DNA, 1002 bp, Glycine max
  Peptide Sequence Number=SeqID_98684
gagattctaggatgtcctcttgcgggaaggaaaccatatcttttctccgggtttcttccctccttgagcaagattgcagttatggtcagggattcggcaagagagttggatcataagtgggtcccgtttatggacttattagcattgctaatctttggggttgtcctctttccaaacgtggatggtttggtggacctagccgcaatggacgctttccttgcatatcaccatagcaaagaaagcccagtggtagctgtcttggcaaacttatttgatgcatttgaccgaaggtgcgacaagagtagcgcacggatcatctgttgcttgcccgctctttgtgaggtagaacaatcagctggtttcctcgatggaagggagggagtccttttcttatgtggggagtacccaaacattccgttgatagggatgaggggttgtattaactacaatcccgcacttgctataagacagttagggtacctcatgaggggagcactgacggaagagagcctctctcctttccttgtgagagatttcggtgcgcaaagtttcaagattatacaaagagtccataaggcgtgggaaagcccgttaaggaaagataaagaacttaggggctttcgtaatggcatcatcggtggttatcatgaatggctgaaagttcgtacacaagagttagattggctctccaagttaaagattatcaacgaagagaacttaaaagctccggaagaggatgaagaaacgtccggaaagagtgtgctgagttacgataagaaaatacagctaccgcaagagcccttgaacaagaaaccaagagggctcgcaaggaagagcatggccgagacaaattccgtggagctttgtgggacagcaacagtgagctcaagcttcgaagggaagagagagaccaaagatggaactacagaacatgtgcaaaaagggggcacggatctttcaaagaatacgcccaaagatgtagagacttggcaactcaagtga

SEQ ID NO: 7000 - DNA, 1051 bp, Glycine max
  Peptide Sequence Number=SeqID_98685
gtcgactctagaggatcccctcggaaaaagattctatcaagtcaagattaagggcctagatgtcactagccttaaggagttagggcagttgatgggtcagctccagcggcaagcttttcgcaaaacttacgataaaatctgggacctagccatgatagaagtctccacagaggccatttcctccctcgaccagtattatgatcagctgttaagatgctttacctttggggacttccagctgtcacccatggtagaagaatttgaagagatcctaggatgtcctctagggggaaggagaccatacctcttctcaggattctatccctcattagctagaatttcaaagatagtccaaatctcagcgcaggaattagaccatggaaagcaagtcagaaatggggtggttggaataccgagaaaatgtttggaggaaaaagcaagaaccttggcaggatttcccaatgttcccttgatagggacaaggggttgcttcagttacaatcccgttcttgctataaggcaacttggctaccctatgagaggggcaccgctagaggaagagctcgcgcctgtcatttcacgaggtttcaataaaaccaacggggagacacttcagaaggtggttgaaagcccacgtgcaaggtttggattggctccgctcccgagtttgagaaccgctaaaagggaggaagttgaggcactggaggaagacgaagaggtgcaggcccttagggcagaactcgagcaagcccaaatagtcaaagaaaggttcaaatcaacagctcttaaaatccgaaaggagaatgccgaactaagagatacaaatatagctaccaccaaggccttggaacaagagaccaagagggctcgtagggaagagcatggctggaacaagttccaaggggctctgtggggcagcaacagcgagcttaagctccggagagaggaaagagaccaatcacgagtacatggcatggtcttaaaggaggagttagctgcttgctcaagatccaagaaaagtttggcccaacacttagaagccccggagtaa

SEQ ID NO: 7001 - DNA, 296 bp, Glycine max
  Peptide Sequence Number=SeqID_98686
gcctaactcacaaaaaacagtccccagtggagtcgccaactgtcgcaacatgcccttttgcgggcgagcgaggcgaggctcacgggtgcgctttccaaagaaggaaagatgcgcagagtcgtcaccaacgtttatttgtggaaaacgtcggaaaaaccgaaggaaaccggtcaaaaagaatattccaagttctggagttgtatttacgtttgaggaaggtcgacaaaagcggggctcttgctcctacgtaccctccatcgaagagaaaatcacacctacgtagttcttttttaagg

SEQ ID NO: 7002 - DNA, 444 bp, Glycine max
  Peptide Sequence Number=SeqID_98687
atggctgcaagtgacattgctattctcagagatagagcccacataccaactaagaaaagtcttctggaacttacatcacaagatgcattgttggcacagaacaagttgttgtccaagcaattggaagcattgaccgaaacactaaggtgtgccatctgtggtggagctcacaattctggctattgtatccccaatgaagaaccagctcatgaagtcaattatatggggaaccaaccaagacaaaatttcaatgcagaagagcacggagtctgccataaagaatttggaagtccaagtggtacagctagcaaaacagctgatgaaagtagagctgaagagaaggtggagggatataaacaacagctggtagctaagccggcactggaaccagtttctgattctattgaacttgaggaagttgtggaagatgaagatgaccaatag

SEQ ID NO: 7003 - DNA, 129 bp, Glycine max
  Peptide Sequence Number=SeqID_98688
atggataagagcttgaagataggagaaaatgagtggagggagaaggagagaaggagcacgaaattttatgccccaaatgagcccactaatccaagatcaattccaagattctccactaagtgtgcttag

SEQ ID NO: 7004 - DNA, 357 bp, Glycine max
  Peptide Sequence Number=SeqID_98689
atggcaggagctggtggtgacaatggtggtgtatatcatcaactggacggatttcagcgcttattactggacgcgatgactacacaaatgcaacgtttgttgaaacgtaacaatgaagagctctacaggcgaatagaaggactagagcaccaaatgaatccaaatgctgggagaccttatggtggcaacagaagggtcaatgatggatcgaatcgaatagaggggcaagacagaattgagggagtaaaactcaatgtatcctcttttaaaggtaggagtgacccaaatgcctaccttacctgggagatgaagattcagcatgcattctcctacaatgattatccggaagagcagaag

SEQ ID NO: 7005 - DNA, 612 bp, Glycine max
  Peptide Sequence Number=SeqID_98690
atgttacgcgctgacaagcccatctctccgattgagttctggttttaccgccactaccgcgccgtgcacggcgtacgcatcgctatcgcctttgtcctgtgcttcctgcacctggccgctgatcacgctggtggtggtgatgggaccgatctccacctggggcaatgttttgccgcgcgtggtgcagcgtatcagcggtacctttgccgggctgatatcagggctgatcgcgctgaagctggagctgctgtcactgccgctgttgctggtgtggtgctttatcgtgatgatcgtctgcggctatctgacgctggcgcaaacacccgtatatggccactgctgatcggcatcacgctcgtgcgtggtggtcggcgcgccaccgcgatttcaccgtggcgctgtggcgccggcggcgatgtgattctcggctcgctgatcggcggctgctgttcagcgccatcttgggcgcagcgcgctatactcactggcgcattcagctgtcggacgcctttatcaacatggcgaagattcatcacgctggcttttctgccaatctggtggagaagccaagagcgcctcaatccgcgcttcgaagctgtctcaccagcgtga

SEQ ID NO: 7006 - DNA, 432 bp, Glycine max
  Peptide Sequence Number=SeqID_98691
atgacattgaccatcccagagcttttcttgaggccttaccaggttacatgggatgccaccgtgtttggggtctttcatccagacttcacgctctacataaagcatgaagacctcttcgaaatcgcacacggtggtcaatgtctcagcatatcagtgttacagttgtggattctgcatctgactgaaacaagtatgcgagcgaggaattctgatatctatggattcctcaagccacaatccattcataggtctgggcaatcgcagtttgaggctgaaagtcttgataatgctccacagcctaaatcaaaggctgctgctaggtggattgtcgtcaagtgtaatagacaaaaaggaagcactgattgtggctattatgtcatgcattggatatccaccatcatattaggaagtttcacgaataactgggaagcg

SEQ ID NO: 7007 - DNA, 122 bp, Glycine max
  Peptide Sequence Number=SeqID_98692
tgaaaaatcttcacggatttgctcacggaaatgtctcgcaagcgttacggcagcacctcggcttggattttcatcatggaaacacgttttttcacccaaaacaactgaaatgcgctaagtga

SEQ ID NO: 7008 - DNA, 276 bp, Glycine max
  Peptide Sequence Number=SeqID_98693
atgactaatacaaactgtctgcaagaatcattgcattcagtctcaaacgggaatctaaggcctaggatattctttatcaatggattcctttgcttcttggaagatgaatggcagcggaatgacgaaaggaagagagagaggagacaccacttcaaggagaagatgagtctagaagaagctcaccaccataggaggccatggataagagcttggaggaagaaggagaggaagagaagagcacgaaattttgtgctctatatgagctttgaaatctga

SEQ ID NO: 7009 - DNA, 108 bp, Glycine max
  Peptide Sequence Number=SeqID_98694
atggctaccattgaattatcaagtagatatgggagcaagtcagcatgggacaccggaattggggtggtgttcgtcattggaagtgcggtagacaggctttgtggttga

SEQ ID NO: 7010 - DNA, 222 bp, Glycine max
  Peptide Sequence Number=SeqID_98695
atgcatgtgcatcttgtcatcctgggtgacgaggacatgaccaagaacaagggcaaggatccacttaaaggacttggaggacctatgacaagggctagagcaaggaaagaaaaggaagctcttcaacaagtgttgtccatactatttgaatacaagtgcaagtttcaaggagaaaagtccaaggttgtgagttgtatcatggcccaaatggaggaggactaa

SEQ ID NO: 7011 - DNA, 1053 bp, Glycine max
  Peptide Sequence Number=SeqID_98696
atgaagcatgcggtgccagctaagctgtatgtcggttcctcctcaataatcgtctttccctgccccatgccatcatccagtgcaacacgtccttttcttcacatattccagtgtgctgttctgagattcggagagatgggtttggaagaagcttccagaaactggaggccagtttggctgggacggcgagatgcggtttgtcctagctgtaacgagggatttgttcatgaacttaatgatatggtgcatgttaatccttttgacttatttgaaatggacaacaatgaagaacgagatcaaaggcttggactcatggaaacattctctgcctttatgaggcatcaaatggcagataggggcagaagccatgacatcagggcgcaaacagattcaaatcctgaacacagtgcagggtttgctcctctgttgatctttggtggccaaataccttttagattgtctggacatggtggctttgaagctctctttaacggggcaccaggaattggtctaacacgaggtaacacaggcgattattttattggtcctggactagaagaactgtttgaacagctttcagctaataacaggcaaggtcccccgccagcatcaagatcatcaatcgatgcaatgcctaccattaagatcacgcagaggcatcttcgatcagattcacattgtccagtgtgcaaagataaatttgaagtggggtctgaagcaagacaaatgccatgcaaccatttatatcactcggattgtattgttccatggttggtccagcataactcctgccccgtttgtcgtcaggaactgctgccacaaggattgagtagtagtaaccgcagcacaaatggtagaagtagaagtgcaagtttaagtagtagtggtagggagagccatggaaggagaaatccattttcctttttgtggccttttcgttcttctcattctagcagtaatgatgaagcaacaggaagcagctcaccgacaccaactatccctgagaacagccatcatcatcatgcagggtattctgggtggccatttgaatga

SEQ ID NO: 7012 - DNA, 396 bp, Glycine max
  Peptide Sequence Number=SeqID_98697
atgaaaaggccttgggaatttattagagatagatggaaggaatactcaagaagaaaggaggaaatcaatattggttgggagcctcctactgttggttggatttgtttgaacactgatggggcgactaaattccattatgatgtttcaggatatggagtaaaagccattaagggtaatagaattaggagtactggtggttggaggttggtgcaagctattcaaagaattttggtggccaatcctaattttagtgtgatgagcatctttcacgagggtaatagatgtgcagatactttggcagattatgtctgcaccatagaaagggtgattttgaagatgcaacaacaaccttctttcttgaggcaacaattgcgtagggacaatttaggagtttaa

SEQ ID NO: 7013 - DNA, 1548 bp, Glycine max
  Peptide Sequence Number=SeqID_98698
atgggaaagcccggagaagaccacctctctctgccctccgccgaggatccgcggcggaatgcggcggcggcgtctggatgcgccgtgggactccgatgcctcgtcgtcttgcttttctcggtcgcggttttcctctccgcactcttctggctacccccgttcgctcacttcgcagatcccaaggatctgtatttaaattcaaagtacaaagaaaataatattgtgagggaaaatgtggagtatatagggaaagggattcagactaatccggagttcggttgggaggtaggttatctcttccagtttggtattggcactatggtgcattattattttcccgtgtcttttgacattgttgaatgtgatcatgatattgttgcaagcttttatgtgcagaagccagtttctttgctagaagacaacatcttgcagctttctaatgacatttttgaagagataggagctccctctaccaaagtgatcatcttgtctctagatcccttaccacggtcaaacacgacaaaagtggtgtttgcagttgatcctgatggtaaatattcagaaatgtctgcagctgccattagtttgataagagcatcatttaaatacctggttatacgccaatcatatctccagctcactacattcttgtttggtgttccctccgtttttgaggtgctgaaatttaagggagggattactatcattccacaacagagtgtgttccctctgcaaacagtgcaaacattattcaactttactttgaatttctccatttatgaaatacaatcaaattttgatgagctgacaagtcagctaaagtctggactacatttggcaccttatgagaacttgtatgtcatattatcaaattctgaaggttctacagtagttgctcctactgttgtccaatcatctgtcctacttgcagttgggattccaccatcaaaggaaaggctaaagcaactggcacaaaccataatgggacatcattcatggaacctcgggttgaataacactcaatttggtagggctaagcaggttcgactttcatcgatcttgcaacactcccttcatggcagtggtggtagtggctcgccttccccttcccctctgccttatccccatcatcactaccaccatcatcatcaccaccaaagtcaccaccacaacacccatgtatttcctgaaacttcacctgcacctacacctacaactggggaaggtgctactttacacaattttggtgctccagcccctgcaagaagtgtgcctgccccagggagaagttcttatgctcagcctcctaattgtcgatttgcgcatgtaacacctgcagctccccctactactgctccacactatcctgttgcctcaccatgggttggacccccagcacatggctttgattcttcggttcctgctttgagtcctttaccaaatgtagcatttgcacatgctgaaccccctcctaagaatgaagcagctgctgagcatctgaactctcattttcatggaccatcaccatcttcatgtaagtatttttaa

SEQ ID NO: 7014 - DNA, 322 bp, Glycine max
  Peptide Sequence Number=SeqID_98699
atgggctgcccacacccaggcacaacacgtcctttcaagcagagagtaattcatctcacaggcggtggactttttgctcaagataagaggcctcttggacatcggtggcatgagcacaggaggattcataaggcattgtttgatccttccgaatgccacttgatagtcgtcgttccaccggatggactaattcttgcgcaaaagcttaaagagacgctcataatggcgcatttcaaggatggccttcaccttgttgggatccacctctatccctttctggcttacgatgaagccgagcaattttcccgacttgaccccgaag

SEQ ID NO: 7015 - DNA, 156 bp, Glycine max
  Peptide Sequence Number=SeqID_98700
atgttccctcatgggaagatgcccaggaagtggattttcagaccttactgtgttgagggaaaaagcccagagtttcaaaaaccactagatttgaggtcaaatccttttcaaaggggagggaatgatgcaatcctacccccaaatggcattggatag

SEQ ID NO: 7016 - DNA, 234 bp, Glycine max
  Peptide Sequence Number=SeqID_98701
atgactaaccgcctgagatatcttttgtttccccttacaaagattcaaaggactaaccgtctgagaattctttgtcctaacacattggagggtacatctacttgggtttttatactaagaacaagagaggagaacaagggagggtacatcccttgtggatctttggcttgtaaaggattttacaaggttgaaagaaatctcaagaaccattggttgcttggggactggatgtag

SEQ ID NO: 7017 - DNA, 501 bp, Glycine max
  Peptide Sequence Number=SeqID_98702
atgaatatcttgacagcacacgatcaagggtgggaacaagatttaagtccttacaatcaatataaagaagaaagaactcctaatcttgaaagtgtgtttgaggaattcagggcataccatgctagctcaaaagccaatcaaaattcaatgaaaaatcatgaaattcattttggcaagagctactcaatagaaaactatcaagggagaccagagttacaaccttactatcaaaatgaagcagaaagaggttccaatctggataaattgttgatgcaattcaaggaaaaaactaaatcaactcaacaagcactccaaagtgtagaaatccaggttggtgagctggcagaagcagtgactcaatatatgtccagacaagaaaaatactttgtagaggttgaagctcaagaggaaagccctgtaaaagagcatgagtcaagagaaaaagatgaggaacaagcacaacaacaaggggtgaagtactcaacagtagaaaaccaataa

SEQ ID NO: 7018 - DNA, 374 bp, Glycine max
  Peptide Sequence Number=SeqID_98703
atggggacaaggggttgcatcagttacaatcccgttcttactataagacaacttggctaccctatgagaggggcaccactagaggaagagctcgcgcctattattgcacgaggtttcaataagaccaacatggaggcgcttcagaaggtccgcaaggcatgggagatggtgcaaaagaaggatacgaaactcagaggcaataacaatgggcccattggcagctaccgtaggtggttgaaagcccgcatgcaaagtttggattggctcccgagtttgagaaccactaaaggggtggaagttgaggctcgagaggaagatgaagaggtgcaggcccatagggcagaattcgagcaagctcaatcagtcaaagaaag

SEQ ID NO: 7019 - DNA, 306 bp, Glycine max
  Peptide Sequence Number=SeqID_98704
atggtttctttgaccagacatgaagagtccataaagcatgactttggcacatggtacatcctttgtggtacaagtagaaggtacatctacttgggttgtaatactgagaacaagagagggtacatctcttgtggatcagttcaagtggagggtacatccacttggttgttcaaagagagcaagggagggtacatcccttgtggatctttgcttgtaaaggattttacaagattattagaaatctcaagaaccggtggttgcttagggactggatgtagggcgcgggttatggctgaaccagtataa

SEQ ID NO: 7020 - DNA, 441 bp, Glycine max
  Peptide Sequence Number=SeqID_98705
gcaagggcgtgtagccctctaaaagcgagggcgtgcagtcctctgaaggtgagggcgtgcagtcctttgaaggtgaaggcgtgcagcattctgaaggtgaggacgtgtagcctattgaagtcgaggatgtgtagtcctctgaaggcgaggacgtatagtcctctgaaggtgagggcgtgtagccctttgatggcgaggacgtgtagccctctgaaggtgaagtcgtgtagtcctctaatggcgaggcatgcgaggacgtgtaggcctttgaaggtgagggtacgcggcactctaatggcgaggatgtgtggtcctctgaaggtgtgggtatgtgaccctctaatggcgacgacgtgtagtcctcttaaggcaagtgcgtgtaggcctctgaaggtgagggtatgcgaccctctgatggcgaggatgtgtagttctctgaag

SEQ ID NO: 7021 - DNA, 285 bp, Glycine max
  Peptide Sequence Number=SeqID_98706
atgactgaagcacgtcaaaatggggtacagaaagcgaatgaaaacgagaataaaaatacacaaaacaaatggggaccaccacggagagagagagagaagtgcctaaggggcttaacccttttcatcttcacttctccctctatttatagcaaaataggggagaagcttgccgcccagctcgcccaggcgagcaaggttgcttcctccagaagcaacagccttctggaggaatcttctggagggcccaagtcggcctggttgctatttgcaccccctgtttactaa

SEQ ID NO: 7022 - DNA, 485 bp, Glycine max
  Peptide Sequence Number=SeqID_98707
atggagacacttcagatggtccgcaaggcatgggagatagtgcgagagaaggacaaagaactcaggggcggtaacaatgggcccatctgtggcttccgtaagtggttgagagcccacgtgcaaggtttggattggctcccaagtatgagaaccactaaaagggaggaagttgaggcaccggaggaagacgaagaggtgcaggcccttaggacagaactcgagcaagcccaaacagtcaaagaaaggttcaaatcggcagctcttaaaatccgaaaggagaatgccgaactgagagatataaatacagctaccaccaaagccttggaacaagaaaccaagagagctcatagggaagagcacggccggaacaagttccgaagggctctgtggggcagtaacaacgagcttaaactccggagagaggaaagggaccaatcacgagtagacaatttcatcttgaaggatgagttgaaggcttgctcgag

SEQ ID NO: 7023 - DNA, 630 bp, Glycine max
  Peptide Sequence Number=SeqID_98708
atggcagagccatcaaagaagagaaagggatcatcctccaccgctaccgctgctgcccatcgccgtcacggcccatccggagcacccacaacacctattcctccttctttgtcatctccaagatcatcaacattgttttcatccgatgatcaacgtctacggtacctttctcagttttcttctagaataatcttagaccctaagtacctagacgtagagttctttaatgatgaaacgtttgattgctatcaagtgtttcaaaattctggtcttgttgatttcatgtcatttaaattgccatattatcctgaacttgtaaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaattcgattattcgagtcatgatgctcgtcgcatggtctgcaatgatcaagctgacatgaccggtagattgttggccggatcgactgggcccatttggttcggtaccgaatgcataaggcattacgggccaatgcacctcttccttatccacatttga

SEQ ID NO: 7024 - DNA, 292 bp, Glycine max
  Peptide Sequence Number=SeqID_98709
tattgcacacagagacaggcctagggggatgctccgcaggccgcagatgtgccgccacctcatcaggctggcccagctggatcatttgatacggagtagtatttacggcatttggttcgccagcaggcggccaaccactgggcgcatggcagaggtcgcatggctcggagattggcctgaggcccgagcaggagaggcaccagcagaggctcccaacaaggcagatgaggcccgcgaggacgaggagatgaccgatttgcttgatttcttgggagggagcggagccacatga

SEQ ID NO: 7025 - DNA, 853 bp, Glycine max
  Peptide Sequence Number=SeqID_98710
ctttaccggggtgcgcatcggcattggcatcgctcagggcctggcgctgggcgccgatctgccgatgctcggtatttccacgctgcaaaccatggcgcagggcgcctggcgcgtctgcggcgcggagcgggtgctggcggcgatagatgcgcgcatgggcgaagtctactgggggcagttcgaacgccaggcggacggtagctggttggaaagcgaaagcgaggcggtgttgtcgccggcgcaggcgctggagcatgctgttgccgcaggcgcaagacatgctgccgctggcgttgcacgcctggcaacaggggctggcggtggcggccgggcgatgaaagcctgcaacttgaacgatgaaacgcggtcaaagttacagccatttcaggagattgcgaccatgttaatccgcactgcaagtaaaaagctgtcgctgctggccgtcgcctgcggcgcgctggttctgtccgggtgcgtcaccgtaccggatgcgatcaaaggttccaccccttcgccggtgactcagctttcctcggtacaaaatgcacccaatctgtttaccggcgcggaagcccgcttcggcggcaccgtagtaaacgtcgccaacgagcaggggcgcacggtgctggagatcgcggcggtgccgctcgacagcggtgcgcggccgattctgggcgaaccgtcgcgcggccgcttgctggccacggtaaacggcttcctcgagcctgttgatttcaaaggccagttggtgaccgtcgtcggccccattaccggcctgaaagaggggcgtatcggcatgacgccgtatcgcttcgtgacgatgaacgtgaccggtttcaaacgctggcacctg

SEQ ID NO: 7026 - DNA, 201 bp, Glycine max
  Peptide Sequence Number=SeqID_98711
atgacagatcttgtgagcgcagaagatgatgtaaatctccacgtgtcaacgggcttgtcggccgcgattgacgaagggcgcagaataaccataatttgtctctgcgtgccattggacacaactatgtctgaatggcaaaaaggtgtgcggaatgaccataatttgtctccgcatgtcatcgggcccgccgcctctggatga

SEQ ID NO: 7027 - DNA, 417 bp, Glycine max
  Peptide Sequence Number=SeqID_98712
atgccattgggatatatcaacggtggtatatccattggaacctcttacgtgccgatcaacgtctcattttcgccaaaagttggcccagggctttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 7028 - DNA, 96 bp, Glycine max
  Peptide Sequence Number=SeqID_98713
atgacgggtaggcaaagagaggaagggattgatggagtaaaggtgaagatccctacttttaaagggactcgtgatccgaaagtgtatctcgagtag

SEQ ID NO: 7029 - DNA, 165 bp, Glycine max
  Peptide Sequence Number=SeqID_98714
atggataagagcttgaaggtagaagaagatgagaggagggagaaggagagaaggagcacaaaattatgtgcctcaaaagagctatggttcagcctactaatccaagatcaagtccaagattctcctctaagtgtgcttaggtgtcatgagacatgtaaagcatga

SEQ ID NO: 7030 - DNA, 637 bp, Glycine max
  Peptide Sequence Number=SeqID_98715
atttcaagaatgttgtgattcagtggtttcagccttcaatgaaccaaagcccttatgagttactactcagtctgaaacatgaaggaacagtagaagaatatcgcgagaagttcgaattgtatgcaggtccattgagaggaacaaaacctgagtatttgaaaggcatatttttgaatggactgaaagaagtggtgagggcagagttaaagttgcatccagtaaacaccctccctgaattgatggactatgcgcaacggatagaagagaaaaattcactaatagaaaaaggtaatgttggaggtaatagaggtggtctaactagaagttatagttccacaagaactgtaacgtgggatccaagaaacaaaggcaccacgacaaaaacaagagagacgagttctagctcggaatcaaatagtgtgaagtccactggggcatacagaggacaagatgaagaagatgaaaaagaaggagcaataaatgagaaacaactacagagtattcagttgtgtccctatatagcatactgtggggcctctcataatttcatttctgctgcaatagtgaaacaacagcaaataccaatcacacctactaaaccatatactgtggaagtaggggatggacgaaaaatcag

SEQ ID NO: 7031 - DNA, 741 bp, Glycine max
  Peptide Sequence Number=SeqID_98716
atggctgacgaacagcagcgtgccagtttcgcggaacttgcgcaggaagcgcatgcacttctgcacgaagatggcatcgcccacggccagcgcttcgtcgatgaccaggatgtccgcatcgacgtgcgcgatgaccgcgaacgccagtcgcacgtacatgccgctggagtaggtcttcaccggccggtcgacgaaattgccgatgtcggcgaaggcgatgatgtcgtcgaagcgggcgtcgatctgctcgcgggtcaggccgaggatcgaggcgctcaggtagacgttctcgcgcccgctgaattccgggttgaaccccgcgccgagctccagcagggccgccacgcgccccttgacctcgaccgttccagaggtggcctgcagggtgccgcagatgatctgcagcagcgtcgacttgcccgacccgttgcggccgatgatgccgaccgtgtcgccgcgcctcacttcgaaatcgacgcccttcagcgcccagaactcgtcgtagtagcggcgcggcgcaaggcccgcggcacgaagcaggcgcggcagcacggcctgcttcagccgctggtgcggctggtcatagatctggaagcacttggtgacgccgctgacccggatggcgacatcgctggagggatcagaggacatcggcaaacccccggcgcattttctggaacgtcgcgaaaccgaaccacgcgacaagcgcggcgcctactgcgtacttgcccaaccctatga

SEQ ID NO: 7032 - DNA, 406 bp, Glycine max
  Peptide Sequence Number=SeqID_98717
atggccccgaggaagcttgcctcaaagaggtccaagaaggataaggcagccgaaggaactagttccgctcctgagtatgacagtcaccgctttaggagcactgtacaccaacagcgcttcgaagccatcaagggatgggcgtcgacggtggacatcactgttacccccatggccaagttcgatccagaaatagtccttgagttttatgccaatgcttggccaacagaggagggcgtgcgagacatgaggtcctgggtaaggggtcagtggatcccgtttgatgccgacgctatcggccagctcctgggatatccgttggtgttggaagagggccaggaatgcgagtatggccagaggaggaaccggtctgatgggttcgatgaggaggccatcgcccagctgctat

SEQ ID NO: 7033 - DNA, 553 bp, Glycine max
  Peptide Sequence Number=SeqID_98718
gcttcaaaaagggaactgggagattgtggagacctctggtaatcgattaccagtctgtgtaatcgattacacagaggaatgggtcactggtaatcgattgccagagtctacccctttcctttctttcttgtggatcgtgatggcggcgcagctaatccatgatcgagtggagacggagtgcctagagggagcttgggagaccctcgaaggcaacgcgaggtgccgattttggggcacgattcgattcacggctacttctttggtgcatccagatgaacccgcagcgcacgcttcagcgtactgtggagtggatactacccacgcctacaccataccgtctagtggagccagtccaagtgatcgagaccctgaggaggatcccgaggagctacctcctgagcctgctgtggatgcccttgactttctagagggtgatgaggacccacttcctgaggtggattctcccgaggaagtcatgtcggcatctgaagcagactctacggaggatagtggcccgagagagatggcgaccagtggaggctcttcatcatag

SEQ ID NO: 7034 - DNA, 769 bp, Glycine max
  Peptide Sequence Number=SeqID_98719
aggactacatgtcctcgccttgagaggactacacgtcctcaccttcgtagggctacagccctcaccttgagaggactacatgtcctcgccaacagagggctacacgccctcgccttgggtactagtacccctcgcatcagagaactgcacgtcctcaccttcagagggctacacgccctcgccatcagaggactgcatatcctcaccttgagagggctacacgccctcgccatcagaggactacatgtcctcaccttgagaggctacacgccctcgccttggaggactacacgtcctcgccaacagagggctgcacgccctcaccttcagaggactacacgtcctcgccttgagaagggactacacgtcctcgccaacagagggctgcacgccctcaccttgagaggactacacgtcctcgccaacagagggctgcaggccctcaccctgaagaggactacacgtcctcgccaacagaggagctcacatcctcaccttagaggagctacacgccctgccctatgcttaaccgaggacttgcactcaccttgggccagtagtttccttttaacggttcctagccacgcccttgatattgaggcaactggtgacacaaccaaagagggaggctgtcagacagctattatgcatatcctcaccttcgtagggctacacgccctcacctttggaggactacacgtcctcgccaacagagggctgcacgccctcaccttcagaggactacacgtcctcgccttcaaagggtcat

SEQ ID NO: 7035 - DNA, 850 bp, Glycine max
  Peptide Sequence Number=SeqID_98720
agggccacacgccctcgccttcaaagggctgcacgccctcgcctttagagggctatatgtctttgccttcagagggctgtacaccctcaccttcagagaactacacatcctcgccttcagagggctaaacgtcctcgtcttcagagggctacacgtcctcgccttcagagggctgcatgtcctcactttcagagggctgcaagtcctcaccttcggaggacaaaacgccctcaccttcagaggactacacgtcctcacctttagagagctgcatgccctcgccttcagagggctgcacgccctcgcctttagagggctccataccctcacctttagagggctggacgccctcgcctttagaggactacacggcttcacctgtagagggctacacgccctcacattcagaggacttcacgtcctcacattcagagggctacacgccctcgccgttagagaactacacatccttacctttagagggctacacgccctcgccttcagaggactacgtgtcctcggcttgagagggctacacgccctcgccttcaaagggttactcgtccttgccttcagagggccacatgccctcgccttcagaggactacacgtcctcaccttcaaaggactacaagtcctcgccatcagaggactacatgtccttacctttagagggctgcacgccctcgccttcagaggactacactttctcaccttcaaagggctgcacgctctcgccttcagagggctacacaccctcgccttcagagagctgcacgccttcaccttcaaaggactacacgtcctcaccttcggagggctgctctttctcactttcagagggctacac

SEQ ID NO: 7036 - DNA, 408 bp, Glycine max
  Peptide Sequence Number=SeqID_98721
atggaagttggaagttactggaagttggaagttggaaatgaaagttattggaagttgaaagttgaaaatggaggttggaagttggaaggggaagtggttgtcatcatcaaaaagggggagaatgtaaatcatgaagactttgatgatatcaagaagagtttacttgagaaagggggaaatgtaaatcatgcaagctttgatggtgtcgagaagaaatcaagctttgttgttgctcctaacctacaggtggttgtcatcatcaaaaagggggagaatgtaaatcatgaagactttgatgatatcaagaagagtttgcttgagaaagggggaaatgtaaatcatgcaagctttgatggtgtcgagaagaaatcacatgtttgtcatcatcaaaaagggggagaatgttaa

SEQ ID NO: 7037 - DNA, 201 bp, Glycine max
  Peptide Sequence Number=SeqID_98722
atgatgacaaaggtgatgaacaaaaagctcaaaagatcaaagaacaactcaagtgaatcaagaacaagtcaagagttcaagaatcaagaagaattcaagactcaagaagaaagcctacaatcaagaatcaagattcaagattcaagatctcaagaatcaagatcaagattcaagaatgaagaaaagactcaatcaagataa

SEQ ID NO: 7038 - DNA, 534 bp, Glycine max
  Peptide Sequence Number=SeqID_98723
atggatgactggagtattccagaaatccctcaggacacattgtatgttcctgagacaatcaaagacaaaaataatgtagccatcaagcctttaatttacatgtgcatagatgtcgcagttttaatgtgtcttagagatattaggcacaacaaattcgaagattccttaataggaacggtagaaacaagcttagcacaaggtccaatctatttcaattgctatccaaacaaaacaatgagtttgatggatagaaacattcttgactctatgttcctaaacatccactttcatggacttgacatgaaagaaggatcaatcccagcagcattaatatataggattccgtacaaggtcatgaacacttgtgcatcacgagtccttctaaaaccacgaagaggagaaacaactttgtttatcactgatatgacaaaggccaatgtttctctcccaagaaccataaaatgggatgagataactcttcctgaaaaatgggtcatggataaggccacaccgtcagtccccgacccgctctaa

SEQ ID NO: 7039 - DNA, 309 bp, Glycine max
  Peptide Sequence Number=SeqID_98724
atgatgggagatgcatcgtttacttatatttctcccaagaatagtggacatgtgacttatggcgacatcgataatggtataatccttggagtcagaaaactagtaaagatgatgattcttggtgatgcttgtcaaaaaggaaaacaagtatacatattcatggtgaagagcacaaaggcaaaggaaagggaaatgatgcagactttcaaattgatgaaacaaaaacaagtacagatcttccaagagaatgaagaacttcaagataccatcctcttgataacatcatcggtgacatatctaaaggggtaa

SEQ ID NO: 7040 - DNA, 357 bp, Glycine max
  Peptide Sequence Number=SeqID_98725
atgccaccagatacaccgaaaacgacggaggcccgacaaaaatggaagttgttggaaaatgaacttgcatcctcagtgcaaggtaatcttacaattgttgaatacttcttaaagattaaaaatctttctacaaaactttctgagctagatctgagtgagaaaatcagtgaggcaagatggaccaatcaaccatcattggaggagttacaaaattttctcacaaatcaagaagcttttctgcaacaatctttatcatcacctgcacaagagactggatttgttctcctcttcaaagggaagacacatagccaagacaacgaggaggccgaattgaagagaaagagtgtcaaatgttaa

SEQ ID NO: 7041 - DNA, 216 bp, Glycine max
  Peptide Sequence Number=SeqID_98726
atgtcttccaaggttattttgatgatgccaaagaatcaagagttaagcaaagtttcaagcaaagattcaagaataaagttccaagattcaagattcaagattgaagaatcaagattcaagaataatcaagatcaagattcaagactcaagattcaagaatcaagagaagactcaatcaagataagtattaaaaaagtttttcaaaacattgagtag

SEQ ID NO: 7042 - DNA, 255 bp, Glycine max
  Peptide Sequence Number=SeqID_98727
ttgcatgagctcaatgctaggtttgatgaagagaatactgaacttttacaatgtgtttcatgtttgagtccctcatcatcatttaaagcttttgatgtgaaaaatttgttgaggatggttgaactttatccaaatgattttgtagatgtgccggaagtggtggtgcgacatcaacttcagaatcatgcttctgaagttgactttagtcttgtcggtagcaactacaagcgtggaatgtgttttttcagctatgaa

SEQ ID NO: 7043 - DNA, 849 bp, Glycine max
  Peptide Sequence Number=SeqID_98728
atgaatttggccaacgtcgatctcaacttgctggtggtgttcgaggcgttatatcagacgcgcaacgtcaccgccgcaggccggcgtcttaaccgcgcccagccctccgtcagcaatgccttggcacggctgcgcacgctgctgaacgatccgctgtttgttcgcagcggcggcggcatggcgcctacgccacgcgcccatcagcttatgccgcagatacagcaggtgcttgaacagatccatctggcgttggcgccccctgcccgtttcgatccggccaccgccgggcaacggcgctttacgctggcggccggcgactatgccgatatcctgctgctgcccgctatcatcagtcggttacgtcagacagcacccggcatcgatattcgcgtttcgcgcctggatcgccacaatatttaccggcaactggatcgcggcgaggtggatatcgcgctgggagggcacctttccggagcggaaagccactatccgttcacacccacagttggcggatggccgctgggatctggcacgctacctcagcctgccgcatgggctgtacgcaccggcagacgacggctctgccaggggattggtcgaccggcgcctggcggaaatcggcggtcaacggcgcgtcgccgtaaccttttcacatattgccgctctgccggctgtggtcgccgacagcgatctgatcgccaccctggccgccagcgcggcccggcatttttccgatccgcaacgcgtacgcattctcccgctgcccgacgagtgggcatcgcgcctttccccattgagctgatcgccggcagctggcgcaacgcaaccggcgttaatctggctctgtga

SEQ ID NO: 7044 - DNA, 1561 bp, Glycine max
  Peptide Sequence Number=SeqID_98729
agggcaacacgccctcagctttagaggactacatgtcctcgccatcagatggctacacgtcctccccttcacaggactacatgtcctcgccttcagagggttgcatgccctcagcttcagaggattacacgtccacgccattagaggactacgcgtcctcaccttcagaggactacacgtcctcgccttcagagggcctcacgccctcgccttcagaggattacacgtcctcgccatcagaggactacatgtcctctcctttagatggcttcatgccctcaccttcagaggacttcacgtcctctccttcagaggaccacacgtcctcgccattgtaggactacacgtcctcgccttcaatggactacacgtcctcgccttcagcgggctacacgtcctcgccttcagaggggtacacgccctcagcttcagaggacttcacgtcctcgccttcagaggactacacgtcctcgccttcaaaggactacacgtcctcgccatgagagggctacacgtcctcgctttcatagggctacacatcctcaccttcagagaactacacatcccccccattagagggctacacaccctgccttcagaggactacgcgtcctccctttcagaggactacacgtcctcgccttcagagggctacacgtcctcgccatcaaaggactacacgtcctcccctttagagaagtacacgtcctatccttcagaggactacacgtcctcggcttcagagggttacacaccctcgccttcagaggactacacatcctcaccatcagaggactacatgtgctaccctttcagtgggctacatgtcctcaccatcacagggctacacaccctcacctttggagggctacatgccatcaccttcagaggactgcacgtcctcgccaacaaagggctacatgccctcaccttaagaggacttcacgtcctctccttcagaggactacacatcgccgccttcataggactatacgtcctagccatcagaggactacacctcctcgccttcatagggctacatgccctcaccatcagaggactacacatcctcaccttcagagggctacacgtcctcgcctttagagggctacacaccctcgaattcagaggactacacgtcctcgcctttagtggggtacacgtcctccccttccaaggactacacatcctcgccttcagagggttacacgccctcacctccagaggattacacgtcctcgccatcagaggactacatgtcctcccctttagagtattgcacgtcctcctctttagagggctacacgccctcgccttcagaggactacacgtcctccctttcagaggactacacgtcctcaccttcagaggactacacgtcctcgccttcagagggctacatgcccacaaaggattacacgtccttgccttcaaaggattacacctcctcgccatcagaggactacacatcctcacctttagagggcgacgtgtcctagcctgcagagggctacatgccctcaacttcagaggactaaacgtcctcagcttcagagggtga

SEQ ID NO: 7045 - DNA, 246 bp, Glycine max
  Peptide Sequence Number=SeqID_98730
atgggtgccaagtacctcgaagtgttcaaacgagggtcgcatcccaacaacggatggtccccggacgaaattagggcttatgagaaccctagggccttctttagcagttctggcccaatctacttggagtcttctatccaatgcccttggggggtaggattgcatcatcccctcccccttgaaatggatttaacctcaaatctagaggttcttgaaactttgggcttctttcctcgacacttgtaa

SEQ ID NO: 7046 - DNA, 417 bp, Glycine max
  Peptide Sequence Number=SeqID_98731
atgtcgcgggggtcaggagaccttggggacgtcaggcttagaaatgaaggcagcaggttgtggaggcctctggtaatcgattacacagaggaatgggtcactggtaatcgattaccagatgaacccgcgcggacgcttcagcgcactgtggagtggatactacccacgcctacaccataccgtctagtggagccagtccacgtgattgaggtgacatcatccgaggaagaccctgaggaggaccctgaggaactacctcccgagcctgctgtggatgctcttgactttctagagggtgatgaggacccactccctgaggtggattctcccgaggacgtcatgttggcatctgaggcagactctatggaggatagtggctctggagagatggcgattagtggaggctcttcatcatag

SEQ ID NO: 7047 - DNA, 533 bp, Glycine max
  Peptide Sequence Number=SeqID_98732
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaagactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccaag

SEQ ID NO: 7048 - DNA, 129 bp, Glycine max
  Peptide Sequence Number=SeqID_98733
atgtgggtcacggtattttgcaaaaatgctccaaccatatgggatcaacataggcttaaaggaacactcaaaccgggtgacccccaaggcccacactccgaagagtctgttagagcctctccctcctaa

SEQ ID NO: 7049 - DNA, 255 bp, Glycine max
  Peptide Sequence Number=SeqID_98734
atgccgcgaatcctcttgaaaagagaggggtcccttcgggaacgcggacacaggtggtgcatggctgtcgtcagctcgtgcctttggaaccctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 7050 - DNA, 294 bp, Glycine max
  Peptide Sequence Number=SeqID_98735
atgtcggggaggaggaatgttccatcaagattttgggtggatagagtatggcccggccgtattagccagtgttttaccaatgccggaatggtgtccaaggaagaagtggtcgcagtaggagaggagttccctcaagacccaacaaatttcgtgcaaccatgccatcccgattcccaagtagggaactggcgcgtgataagccaatcagaggtctatgccgctgattcaatatataagggtcgattctttgaggatcctaacaacaagggtttgacgatcgatttcgaccaagat

SEQ ID NO: 7051 - DNA, 321 bp, Glycine max
  Peptide Sequence Number=SeqID_98736
atggaagttggggagtttgctacatttatggcacttggtttgcacttcgtggtcttgcagcggcgagtaaaacttacactaattgtgcttccattcacaaagccgttaaatttctactttcaacacagaaagaggatggtgggtggggagaaagctatctttcatgcccaaaacagtagtattcatcaacttgataacaatgactttggtggaaatagcattccagaatcttatggcaacatctcaaaattgtcaaaacttctacatgcggttcttgtatatagatctttcaattggagaaaaacatttgcaggagattaa

SEQ ID NO: 7052 - DNA, 78 bp, Glycine max
  Peptide Sequence Number=SeqID_98737
atgatgacaggcacgggaggtagcaagtatggccagtctgtcactctgtctctgactgcgactgtacggctgacataa

SEQ ID NO: 7053 - DNA, 180 bp, Glycine max
  misc_feature (151)..(151): n is a, c, g, or t
  Peptide Sequence Number=SeqID_98738
atggcctccatcattgtggctatttgctctttcatggcctccatgtcagccttcatcttctcttgcacctcctctgcttcacccattactctagctctagcacgagttcgaaatgggtttatgatcccaacatggttggctcatggtaccntaacacatgcaactaagaatgcatcatga

SEQ ID NO: 7054 - DNA, 94 bp, Glycine max
  Peptide Sequence Number=SeqID_98739
atggaacataagcttgagaaggtctattgtaaatgtttgcaacataagcttcgggctgctcaattgctccaggttgctgcatggaagggcaaag

SEQ ID NO: 7055 - DNA, 618 bp, Glycine max
  Peptide Sequence Number=SeqID_98740
atggcttccaactcccagcaatttagcgccagaaatgatgctatagccattagaggagtgcatgaggtagctacaaactcagctgcatcatctgaaactaagaagcttgaaggcaaactggatgcattggttaacttggtaacccagctggccttgaaccaaaaatctgtacctgttgcaaggcaacctggagcaattgagcagcctgaagcttatgctgcaaatatttacaatagacctcctcaacctcagcagcaaaatcaaccacagcagaacaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccaaaaacagccaacagttaaggcccctccacaaccttccctcgaagaacttgtgaggcaaatgactatgcagaacatgcatggaataaatgatatgcttgcagtagaagatcccatgaagatggctcacactatgagaaaggaacaaacaaatgaagtaacgagattatattag

SEQ ID NO: 7056 - DNA, 279 bp, Glycine max
  Peptide Sequence Number=SeqID_98741
atggacacgtcattggtcatttctccaaagggctcgcaaaatccaaggtccacccttggtgagtcctacaggttgattctccaaaggctcgtcaaacctaaggtccacccttggctcgttaaacccaaggtctgcccttggcaactctctccaaaacccaggatagataattccctagttgattctccaaatggctctcaaaacccaaggtcctcccttagtgagtcctacaagtcgattctccaaatgctcgtcaaatccaacgtttgcccttggtga

SEQ ID NO: 7057 - DNA, 565 bp, Glycine max
  Peptide Sequence Number=SeqID_98742
atgtgcaacccacaaaagggattcccacacgagaattggcaccgtaagaggatacaaccggatccagatgcattctttggacaaggaaaaacgacattcattactaaagatgccaacttttgctacaagcacatcttaacacatggtagacctggaaaatgtactttcgaggttgacgaaggcaagttcttgggctttatgatcacgcatcggggaatagaagccaacctcggcaaacacactgctattttggagatccacagtcctactaaatcttctcagtttagaggaggcaatgggagcaatggcattagaagaggggaaggtgaagatcgagaagttcgatggcagagatttcagcttttggaagatgcaaatagaggattatctatattagaagaagttgtatcagcccttatcagggccaagaacgtcgcgttcaacatcataaacgagaagactgctgtaggcttaatgaaggcattattagatatgtacgagaagccattggcaaccaacaaagtatacttgatgcgtaggttgttcaacctcaagatgggagaag

SEQ ID NO: 7058 - DNA, 198 bp, Glycine max
  Peptide Sequence Number=SeqID_98743
atggtgatttcccaccatggagatgcagcagaagacaaagaagaagaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattaa

SEQ ID NO: 7059 - DNA, 433 bp, Glycine max
  Peptide Sequence Number=SeqID_98744
gagcgctgagcatcagcagcgcttcgaggccatcaaaggacggctattcctccgggagagacgcgtccagctcagagacaatgagtataccgacttccaggaagagatagttcgccagcggtgggcatcgctggttacccccatggccaagttcgacccagacatagtcctcgagttttatgccaatgcttggcctacagaggagggtatgcaagatatgcgatcttgggtgaggggtcagtggatccctttcgatgcgaatgccctcagccagttcctgggataccctttagtgctggaggagggccagaagtgcgagtatggccagaggaggaaccaggccgatgagtttgatgagaaggtcatcgcccagttgctatgtataccggggcaggattttgcccggtgtaacattccaattttcgtaaactag

SEQ ID NO: 7060 - DNA, 258 bp, Glycine max
  Peptide Sequence Number=SeqID_98745
atgttgatacttcacatagaggtagcatggaaaacaccgtgcaatagtggtatgcataggaaatggccccgaggaaacttgcctcaaagagatccaggaaggataaagcggccgaaggaactagttccgctcccgagtatgatagtcaccgctttaggagcgctgaacaccagcagcgcttcgaggccatcaagggatggtcatttctccgggagcgacgcgtccagcttagggacgacggagtgtgggatcctctag

SEQ ID NO: 7061 - DNA, 582 bp, Glycine max
  Peptide Sequence Number=SeqID_98746
atgagtaatcttgcaattattccggcaaggggtgggtcgaaagattgtgaagatatcgctgccgtagccagagaatatggcgcggaagtcccgttcatgcgtccggcccatctggcgaacgataccgctgcgactgagcccgcgcttttgcatacgctggagtggttggctgaacatgagagttaccaccctgagtataccgtcctgttgcaggctacttctcctgttcgcaaagatgatgcgattgattctgcaatcagaaagattcttgaaaagaaagccgattcactgctgagcgtatgtgagttttggcatttcttgtgggaaaatgaagataatccgaaagcctattacgactacttaaaccgtccgcgtcggcaagatattaagcctgaaaatatcaaacttaaagaaaatggttcaatttacgttacgaaaagcgaaattctcctcagtaccggtaatcgtcttggtggcaaagttgtagcgcataagatgtcggaagaggaaagctttgaaattgacaccatgctggactgggcggttgttgaagtaattttgaaaaattggagtgggagataa

SEQ ID NO: 7062 - DNA, 321 bp, Glycine max
  Peptide Sequence Number=SeqID_98747
atgcagaactatcaacatgcaaagagatgtgattctgcaaaagcgaggatcaaccaaaaacgtattatgcagcagaagcgacatgcttatgctcagtcatcttcacaaccaacagttaattgcacttcagaatataatatgattgtttctgattcatcaaaaagtgaaaattctgaatccacacaaggttcatgctctaattttatgactcccttcaaggattgtcaatctccaactaatcaacctataatcaacactgaaggtaatgactataattctgatttccagtttcagatgctactgtacatgctcttaaattaa

SEQ ID NO: 7063 - DNA, 180 bp, Glycine max
  Peptide Sequence Number=SeqID_98748
atggagaaagatgcatcgcacataaggccatggaatggaggtttcaatcccttcttcttctctctaacgtttgaaaaacctaacagagcaaccggaggaggagctctagagagcaccaaaaatgccacaattgataacggagaacgcttgagtgactacatcgagttgatgtcccaatga

SEQ ID NO: 7064 - DNA, 273 bp, Glycine max
  Peptide Sequence Number=SeqID_98749
gtcgactctagaggatccccagggcgtgtagccctctcaaggcgaggatgtgtagtcctcttcaaggtgagggcgtgcagccctctgttggcgaggacgtgtagtcctctcaaggtgagggcgtgcagccctctgttggagaggacgtgtagtcctctaaaggtgagggcgtgtagccctacgaaggtgaggacatgcagtcctctgatggcgagggcgtgtagccctctgaaggtgaggacatgcagtcctctgatggatgagggcgtgtag

SEQ ID NO: 7065 - DNA, 533 bp, Glycine max
  Peptide Sequence Number=SeqID_98750
ttcgtagatcgcgtcttttccggtttttccgacgttttcctcaaataaacgttggtggcgactccgcgcgtattcctttcgtggaacacgcatcccgcgagtctcgcgtcgccctcccaccgaagggtaggttgcgacagctaccctatgagaggggcgccactagaaaagagctcgcgcctgttatttcacgaggtttcaataagaccaacatggagacacttcggaaggtccacaaagcatgggaagcggtacaaaagaaggacaaagagctcagaggcagtaacaatgggcccatcgatggctactataagtggttgaaagcccatgtgcaaggtttggattggctcccgagtttgagaaccgctaaaggggaggaagttgaggcaccggaggaagacgaagaggtgcagacccttagggcagaactcgagcaagctcaaacagtcaaagaaagggctcgtagggaagagctcggccggaacaaattccgaggggctctgtggggcagcaacaacgagcttaagctctag

SEQ ID NO: 7066 - DNA, 1071 bp, Glycine max
  Peptide Sequence Number=SeqID_98751
ggctacacgccctcaccgtgggtactagttaccctcaccgttgagaggactacacgtcgtcaccttgagaggactacacgtcctcaccatcagagggctgcacaccctcacctccagaggactacatgtcctcgccttgagagggctacacgtcctcaccttggagaactgcatgtcctcaccttcgtagggctacacgccctcacctttagaggactacacgtcctcgccaacagagggctgcacaccctcaccttgagaggactacacgtcctcgccaacagagggttgcacgccctcaccttgagaggactacacgtcctcgccaacagagggctgcacgccctcaccttgagaggactacacgtcctcaccaacagagggttgcacgccctcaccttgagaggaatacacgtcctcgccatcagagggcttcacgccctcacctccagaggactacacgtcctcgccaacagagggctgcacgccctcacctttagagggctacgtgtcctcattttcagtgtgctccacatccgcaccttaaagaatttaaggtcctctatccttaaattcttaaccgagacttgcactcctggttgggccagtagtttccttttacacgttcctgggccaccccctgatattggaggagggccaactgtgcgagcacaatcagagagggaggctatcacacagctactatgcataccggggcaagatttcacccgtgccgctgcaaagagacaacaacgttctgcccagcgaccgcaatgccgatctccccctgcggatgtatcagttggtctgtgtcatcccgacatagggatcgtgcccgcaagacacccagtggacccggagaagtccaacagggtcttggggtttccagctctgattacggacttctgtcagttctacgaagtgtctgtcacccccgacaaggtcatcaggtcccctattaatcaagctttcatcaagaagtattgcgcccccaggcaggcgcagggtgaaacaccacagcagcctgagatggctggcagtgggcaacaaacgcaccgccaccacctctag

SEQ ID NO: 7067 - DNA, 558 bp, Glycine max
  Peptide Sequence Number=SeqID_98752
atggcagaatcgtcgaagaagcgaaggggatcatcctccaccaccgttgttgctggccatcgccgccacggaccatctgaagcacccacagcacctattcatccttccttatcatctccaagatcatccactttgttttcttcatatgatcaatgtctacggtacctttctcaattttcttctaggatcattctagaccctaagtacctagacatagatttcttcaatgatgagacatttgactgttatcaagtgtttcaaaactctggattgattgatttcatgtctttaaaattgccttactatcctgaacttgttaaagtcttttacaacaatttaaaaattcaggatggtattatttcttctgaggtgcatggtatttctatgatcattgatcaatctttgttcttttcattgacaaaattacccagtcaaggtgcaccttttgagggcaccattgttgatgactggaaatttgattattctagtcatgatgctcgtcgtatggttcgtaatgaccaagctgaaataccagtagattgctggccagatcattga

SEQ ID NO: 7068 - DNA, 321 bp, Glycine max
  Peptide Sequence Number=SeqID_98753
atggtgaaagttggaacctcttacgtgccgatcaacgtctcattttgccaaaagttggcccagctgtttcctgttcagctactgacgggaattgttatccgcgtcacaatcggcacaaagcataccgccggacatcagcgcggcaagtgtaagccgggtgcgagtgagctaactcaccacaccgccgttaattgctgccgctacaggctgcccgctttccagttcgaaccatgtcggtgcgcaactgttgaggaagggcgatcgagtgcgggctttcgcgtattacgccaggcgaaagggcggagtgtgcaacggcgttaa

SEQ ID NO: 7069 - DNA, 216 bp, Glycine max
  Peptide Sequence Number=SeqID_98754
atgataatgagaaccgcgactgacagactttcacaggcagcactgcgccggcatcacattggcgtgaaaacaaaaggattgcgtttccgcggtgagctgtatgtgtttcgctataacgccggccattacgacgtgtttcgcaacagcgaatgggtgatgtcgctcgccaccagcaatgtgctggaagccatgcagcagttcaaacagagccagtaa

SEQ ID NO: 7070 - DNA, 354 bp, Glycine max
  Peptide Sequence Number=SeqID_98755
atggcagtgcagttaatccatgatcgcgtggtgatggagtgcctagagggagtttgggagaccctcgaaggcaatgagaggtgccgattccgtggcacgattcgactcactgttacttcattagtggagtcagttcaagtgatagaggtgtcatcctctaaagaagatcctgaggaggacccagaggagttacctcctgagcctgctgaggatgctctggacttacctaaggatgatgaagacccactccttgatgttgattttccagaggatatcatgtcagcatctgaggcagactctacagaggaaagcggccctggagggacagcgaatagtgaagactcttcatcatag

SEQ ID NO: 7071 - DNA, 60 bp, Glycine max
  Peptide Sequence Number=SeqID_98756
ggtgtactcttctatagcggttataagttcttcactagaggaaagggcaagaatgaagag

SEQ ID NO: 7072 - DNA, 738 bp, Glycine max
  Peptide Sequence Number=SeqID_98757
atggaagagaccagccggcgccgcgccaagcagttgcaattcaatgccgaccacggcattaccgcgcgcggggtgcagaaggcggtgcgcgagctgatcgacggtatcgtggccccggtgcagcacgatgcgctggaagcggcggtgccggccgaattgctgaaggacgagaaggcgctggcgcgcgaaatcaagcggcttgaaaagctgatgatggaccatgcccgcaacctggaattcgagcaggccgcggccgctcgcgatgccctgacggccttgaagcagcgggtgctgctggacggcgcgggcgtgtttcgccatttggtgaacgacgcgggtttgggcgatgtggttcgcatcgactccgcgggcacgcacgcgtttcacatcggcgaggcgcctgatgcccgggcgcaggccgcagcgcgcaagcgcggctacgagatcacgcactgcgaggcccgccaggtcaccgcggaagacttccgcgacttcgacctcatcctcgccatggactgggacaatctgtccgccatgcagcagcagtgccccaaggcctatcagcacaagttgatgctgctgatgcgctttgccaacgagttcgaagaagccaccgtgcccgatccctactatggcggcgccgatggtttcggcaaggtgctggactacctcgaagacgcctgtcagggcgtgctcgaactggtccgcaagcgcgctacccaataccaggcggcctga

SEQ ID NO: 7073 - DNA, 159 bp, Glycine max
  Peptide Sequence Number=SeqID_98758
atggttgccgcccagctcgcccaggcgagctcagctcgcccaggcgagccaggtgttgaggaaagaatccatgagtttcaagaacctctggatttgaggtcaaatccttttcaagggggagggaatgatgcaatcctaccccccaagggcattggatag

SEQ ID NO: 7074 - DNA, 123 bp, Glycine max
  Peptide Sequence Number=SeqID_98759
cgcaagtctcggttaagcatctaagggcaaacgaccttctaaaggcgagggcgtgcagccctctgcaggcgaggatgtgcagtcctctgatggcgaggacatacagtcctctaaaggtgatag

SEQ ID NO: 7075 - DNA, 171 bp, Glycine max
  Peptide Sequence Number=SeqID_98760
atgagaaaggttatgcgaaagaggtatgttcctgtagaagcaaagcttcatgatgatgacaaaggtgatgacaaaaagctcaaagatcaatcaaagaacaactcaagtgaatcaaagattaatcaaagaacaactcaagtgaatcaagaacaattcaagagttcaagataa

SEQ ID NO: 7076 - DNA, 1134 bp, Glycine max
  Peptide Sequence Number=SeqID_98761
atgagaacaaaactacttttgacttcaatgcttgcactggctgtacatcaaacagtattagcccaaacagatgttaatgggtatacaacggtcaatttaaccactggtcccaactatcaaaaccgggtattctttgacttcagtacaaataatattatttcgcaacctgcagattcatgggatattgcattttttagaaattcaagtatgagttttggaacaagaatcaatgacgcccaaaatatagaggtttaccaggcctctgcagtaccagcggattgggataatattaacatcgccaatatagcatcatggggatctccattatataatccggaccagacgacttctcttcaggaaggagcatttgagcaaggttcagctacgtacggatggggagactataacggagggacccatcatatcgatggaaaagtaatttttgttttaaaatacctttctagcaatacttatgtaaaatttatgattaccgattacttcggtggttatacttttaagtattctaaatggaacggatcatcgtgggaagcaacgcaaaccaaaacaattgcgaacggaacagatgatgcctactttaattatttctcatttactacgggagacaaagtagctaatcttgaaccaccaaaggcaaactgggatttgatgtttacaagatattggacattctatatgaatattatgatgtacagaatgtctggagttattcagagtcctactactaaggttgcaaaagttcaaccggaaacacaggaagttgcaacttcaaacattccagtatccaccgctttttcctcgaatattacatcaatcggccattcatggaagccaacatccgggatttataatgatgttgtttactatgtaaaacaaggttcggaatattacagaatgtattttacctctaacggtggagcgtctacaggaaatatgtattttaaatataaaaatatcagttcaactttaggaatcaaagaggttggcaccaaagcttcctttggattgtatcctaatcctacaacagctgataaaaaagtgaccgtactttttgatgtaaaagaaaaggcaaacaataaaggaagtatagaagtatatgatctttcaggaaaacag

SEQ ID NO: 7077 - DNA, 1284 bp, Glycine max
  Peptide Sequence Number=SeqID_98762
atgaccaatccgagtgccgccgatgaactggcgctgatcgatcgctactggcgcgccgccaattatctgtccgtcgggcaaatctacctgatggccaacccgctgttacgcgaaccgttgcagcccgggcatatcaagccgcgactgcttggccactggggcacgacgcccggcctgaactttatctatgcgcacctcaaccgcatcatccgccagcgcgaggtggatctgctgtacgtctgcggtccggggcacggcggaccgggcatggtggcgaacagctggctcgaaggcagttacagcgaaatctatccgcacgtcagtgaagatgctgcaggcatgcagcgcctgtttaagcagttttcatttcccggaggcattcccagccatgcggcaccagaaacgccgggctcgattaacgaaggcggcgagctgggctattcgctgtcgcacgcgtttggcgcggttttcgatcatccgcagctgatcgtaccctgcgtgattggtgacggcgaagccgaaaccgggccgcttgccgccagctggcacggcatcaaattcctcaatccgcagcgtgatggtgcagtgctacccattctgcatctgaacggctacaaaattgccaacccgacgctgctggggcgcagcagtgatgacgatctgcagcagctattcagcggttacggttatgagccgctgtttgtctgcgggcacgagccggccgacatgcatcagcagatggcggcagcgctggataacgcgtttgataagattgccgcttatcagcagcaggcgcgcagcggccagacagagcaggcgatcccgcgctggccgatgattgtactgcgcagccctaagggctggaccggcccaaaagaggtggacggtaaaaaggtggaagatttctggcgtgcgcatcaggtgccggtagcggcgtgtcgcgaagacgcgtcgcatcggcaggtgttagagcagtggctgcgcagctatcagccggaggatctgtttgacgaggcgggtaagctcaggccggaactgcgtgcgctggcgccgcagggggataaacgtatgagcgcctcgccctatgccaacggcggccggctacgacgcacgctcaacacgccggacatccgcgagtttgcgctcgacaccggcgcgccgggcagccagcgcggcgaagccactaaacagttcggccactacctcagcgcgatttttcagcgcaacgccgataacttccggctattcgggccagatgagaccgcctcgaatcgcctgacgccg

SEQ ID NO: 7078 - DNA, 1523 bp, Glycine max
  Peptide Sequence Number=SeqID_98763
atggtgctgttcctgacggccggtttggggagtgcgtccaccttccagatgatctccgtgatcttccgtaagctgacgatggatcgcgtgaaagcgcagggtggaagcgaagagcaggcgatgcgtgaagcggcgacggataccgctgctgcgctgggctttatctctgccatcggtgccattggcggcttctttatcccgaaagcgttcggtatttcgcttgacctgactggttccccggcgggtgcgatgaaagtgttccttgtgttctatatcgcctgcgttgtgattacgtggctgagcgttaccttcgctgcaaatcagcaatgtcgatttagagagccacaggctccacacaggagatacccgatgagcaaatttttggaccggtttcgctacttcaaacagaagggtgaaacttttgccgatgggcacggccaggttctggataccaaccgggactgggaagacggttaccgtcaacgctggcagcatgacaaagttgtccgttctacccacggcgtaaactgcactggctcatgtagctggaagattttcgttaaaaacggtctggtgacctgggaaatgcagcagaccgactatccgcgcacccgcccggatatgccgaaccacgaaccgcgcggctgcccgcgtggcgccagctactcctggtatctctatagcgctaaccgtctgaaatacccgctgatgcgtaagcgtctgatgaaaatgtggcgtgaagcgaaagtgcagcacagcgatccggttgatgcctgggcgtccatcatcgaagatgcggataaagcgaaaagctttaagcaggctcgcggccgcggtggctttgttcgttcctcctggaaagaggtgaacgagctgattgccgcctctaacgtctacactgtcaaaacctacggccctgaccgcgtggcaggcttctcgccgatcccggcgatgtcgatggtctcttacgcctccggcgcgcgctatctgtcactgatcggcggcacctgtctgagcttctacgactggtactgcgacctgccgcctgcgtctccgcagactggggcgaacagaccgacgtgccggaatcggccgactgacccgcaccccggacgcccacttctacaccgaggtccgctacaagggcaccaagacggtggccgtgtccagcgacttcggcgaaatggtcaagttcggcgacatctggctggcgcccaagcagggcaccgacgccgcgctggcgatggccatgggccacgtcatcctcaaggaattccacctgtcgggcgcctcggcctatttccgcgactacgtgcggcgctacaccgacatgcctatgctggtgctgctcaaggagcgcgacggcttttacgcgcccgaccacttcctgcgcgcctcgcagctggtacggcgcgctgggcgaacagaacaatccccgactggaagacgctggtgttcgacgaacccagcggcgacctggtggcgcccacggcagcatcgcctatcgctggggcgagggcgcg

SEQ ID NO: 7079 - DNA, 1289 bp, Glycine max
  Peptide Sequence Number=SeqID_98764
tttccaatgtggatggcctagtggatctagcagcgatcgatgctttccttgcctatcaccacagtaaggaaagtccgatcgttgctgtgttggttgatgcctatgacacatttgacagaagatgcgagaagagtggagcaaggattttctattgcacacccgctctttatgtatggctggtctttcacgtttttcgtcatgaaagtaggctcgtttgtcccctacaaggtcaccgcatgtgtgccaagaaagggaaagcaaattgggagcaactcttggctggtatgggagggacatccgttaattggttccgacgatggaaggaaggaggggccagagttttgtcctcatgcgaagggttcccaaacatccccttgatggggatgaggggttgtatcaattataatcccgtacttgccataagacaacttggctgccccatcagaagagcgccatcggaggagagtatcacgcctttcatcgcacgaggctttagtgaccccaatgcaagaatgcttcaaagagtccaaaaagcatggaatgctcgcacgcaagagataacttggctcccaaagctaaaggtttcaagtgaggaagaggttgaaacccctgaggagagtgaagaggtgcaagccttgaaggcggaacttgaaagaacgcaagtagtcaaggaaaagttcaagatgatatccatcagagtcagaaaggaatgtgacaagctgagggatgccaacatggccacggatgaagcattggaacgagaaacaaagagggcccgaaaagtggaatggggccgaaacaagtttcgaggggctttatggggcagcaacagtgaactcaagcttcgaagggctgagagagaccagtcgcgagtcgaagttatgatattagaggataagctaaaggcttgtcaaaggtcaaagaggagcttgtctgaacagttgagtaggacggaagagaacatgtgggccatcattgaccaatacagagagaagttgagtctagttgctggccatgagcaaagattagaggacgaacatgaaaaagtatcggctctccaagcggaaacggaagtaagggagaaagtaatagattcattgcacggagaagctatgatgtggatggataggttcgctttcacattgaatgggagtcaagagcttccaaggctgctagccaaagccaaggcaacggtggatgtgtacttgcttctcgaggaagttcgtcggcttttcgattattgtcagcatatgatcgatttgatggcccacataattaggagctgctaa

SEQ ID NO: 7080 - DNA, 1350 bp, Glycine max
  Peptide Sequence Number=SeqID_98765
atgggcgccagctttatcccgttctccgcgcagacgcgcatgagcggcgtcaacgtgcaggatcgcctgatccgcaaaggcgcggtcgacgcggtacgtcgtcatatcgaagccagccacggcagcttcccggctgaggttaatgcccgggtggaagaggtggcgcgcgccggcggtacgccgctggtggtggccgaaggcgcgcaggtgctgggcgtggtggcgttgaaggacatcgttaaaggcggcatcaaggagcgtttcgccgagctgcgcaagatgggcatcaaaacggtgatgatcaccggtgataacccgttaaccgccgcggcgattgcggcggaagccggtgtcgatgacttcctgtcggaagcgacgccggaagccaagctggcactgattcgccagtatcaggcggaagggcgcctggtggcgatgaccggcgacggcaccaacgatgcgcccgcgctggcgcaggccgacgtggcggtggcgatgaactccggtacccaggcggcgaaagaggcgggcaacatggtcgatcttgactcaaacccgaccaaactgctggaagtggtgcacatcggcaaacagatgctgatgacgcgcggttcgcttaccaccttcagtatcgccaacgatgtggcgaaatacttcgccatcatcccggcggcgtttgccgtgacctatccgcagctcaatatgctgaacgtgatggcgctgcattcaccggcctcggcgattctgtcggcggtgatcttcaacgcgctggtgattgtgtttttgattccgctggcgctgaaaggcgtgagctatcggccgatgagcgcggcggcgctgctgcggcgcaatctgtggatttatggcgtaggcggtttagtggtgccgtttattggcattaaagcgatcgacctgctgctgacgctgtcaggcctggccaacggttcgctgattgagcgcgacggcgcggtgcgcggctcagagcagatcggtcaggcgttcagccagccgggccacttctggggccgtccatcggccaccagcgacgtgccgtacaacgcgcaggcatcaggcggcagcaaccttgccgccagtaatccggcgctggataaagcggtggcggagcgggtggctgcgctgcgcgctgccaatccacaggcgccggcagcggtgccggtggagctggtaaccgcttcaggcagcggcctggatccggatatctcccctgaagccgcgctgtggcaggcaccgcgcgttgcggcagcgcgcaatatgacgctgaaagacgtcgaggcgctgattgcgcgcaacaccgagcgcccgctgctgccgtttatcggcgaagaaacg

SEQ ID NO: 7081 - DNA, 270 bp, Glycine max
  Peptide Sequence Number=SeqID_98766
atggtgaaaccaagaaatattctactaacactgaaggagcacaatgccaatagttatacaacaatcaaacaaatatacaatgcaggaagtgcatattgttcttccataagaggcagtgatactgaaatgcaacaactaatgaagcttcttgaacgggatcagtgtatttattggcatagattaaaggatgaagatgttatagtacctgcaaaacaaagaggtacaggctcctgttacttgactttgttggtgttacaccaacggggatga

SEQ ID NO: 7082 - DNA, 511 bp, Glycine max
  Peptide Sequence Number=SeqID_98767
atggctacctcaccaaaagaaacttcagctcctggttcaccctctgtaccatcatctccgcaccaggaacaaccagaattcaacatccaacccatacaaataattcctggtcaagcttttgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccagatgttgctgtccctgaagctgatgaagatgtcccaacatcttccaccccgaatgtttctgtgcctaatgttgagaaagatgttccaacatcttccggcccaaatgctgaagtactctcttcacccagtgcagacgcatcaacagaagaagaggatcaagcctcagaggagacacatgcaccacgggcaccagaacctgctccag

SEQ ID NO: 7083 - DNA, 312 bp, Glycine max
  Peptide Sequence Number=SeqID_98768
atgcacagtgttttctgcattttctctggaaaacacaatgaactcgctcagctagcttaccgcgctcagcaagatcatctatatttgttgcacataagcgttttccagaagacctcgttgagcatgcccatcacgctgagcgagtgcatcaatatggcattgagaaagagagtaagaactgaagacatcccttcatcttccaacctacctcctccgacaacaaccatggaaccagatgcccaacaagcacatcccataattcctatgttgcagagcgtattcagggggcagctgatgattgtatacaactag

SEQ ID NO: 7084 - DNA, 312 bp, Glycine max
  Peptide Sequence Number=SeqID_98769
atggcctctttaaattctctgtttttcaaaagtaatttcaagaataggtcaaatctgaaatcatttcaagatcatgatgaagacaaagccaacttatgtctcatgacaaaatctcatgagaacaacgaggaagaatctgtaaggaagaagtggtacatcgacagtggatgttccaagcatatgacgggagatgtatccatgtttacaattatttcccccaataaaagtggacatgttacatacgacgacaaaaacaaaggcaaaatcattagagtcggcaaaaataggtacgagttcctctactcccattga

SEQ ID NO: 7085 - DNA, 639 bp, Glycine max
  Peptide Sequence Number=SeqID_98770
atgaatcctatggaacccaaacaagccagagttcacagtacgacctccactagtatgaaatcgtacgctgaagctgtcaagcacgaccataagatgaaaaagaaggagattacgatgcctttgatggggaagaagggaccagaagtttctgacgtttccgtagttattcaaactgggaaaggtatgtttgagaaggcggtggatgaggttgaggagatggtaggtatggatgtgaaggtatcatactggggggacgacaccattatccttcaagatatggacgaggctaaagcagacaaactcaaccgtagagaacaatccaacggagagtcaaccattttttcaatccagaaatggacgccagagatgaagactgaattcaggctgatatggattcatatctggggtgttcccctggagatatgggacacagagcactttcagaccttgctttcgacatttggagagattgttgaactcgacgaggagacagccgaccgttcgaggcttgatgtcgcgcggattctgattcgcacaaagttgaaaccaatcttctccaaatcgatgatggctatggttaatgacaatgagcatcacttgtttctgagggaggaggtagctcgacctatcggaaaatga

SEQ ID NO: 7086 - DNA, 399 bp, Glycine max
  Peptide Sequence Number=SeqID_98771
atgcccttgcggggtaggatagcatcagccgatgggttcgacgaggaggccattgcccaactgttatgcataccgggtcaggattttgcccggaccgctaccaggagacgggtgcggatcatgcgtactagcatgactaccttggcccaaacatggatgacgttgctgcttagcaacatcctgcccagcgatcataactctgacctccctctactgaagtgtatgccgcctaccaagcaccctttagacccagataagtctaatagggccttgggttttccagcattgatcacgagtctctaccagtcattcggggttcccgtcacacctagtaaggtgattcgaccaccaatcacccgggccttcatagagaaatattgcacgcctagacaggcgtag

SEQ ID NO: 7087 - DNA, 480 bp, Glycine max
  Peptide Sequence Number=SeqID_98772
ggggaggtcggaattatgatcggtgggcaggatgttgctgaccagcaaagtcatccatatctgagtcagggtggtcatgttggtgcgcatgatccgcacccgtctcccggcagcagtccgggcaaaatcttgccccggtatacacagcaactgggcaatggcctcctcatcgaacccatcggaccggagctggcggatagcatctgcatcgaacgggatccactgacccctcacccaggacctcatatcacgcacgccctcctctgttggccaagcattggcttaaaattcgaggactatttctggatcaaacttggccatgggggtaaccagcgatgcccaccgccggcgacctatctcctcctagaaatcagtgtactcgtcctccctgagctggacgccgctcctaaagcggtgactgtcatactcgggagcggaactagttccttcgcccgccttatccttcctggatctctttga

SEQ ID NO: 7088 - DNA, 414 bp, Glycine max
  Peptide Sequence Number=SeqID_98773
atgtcatctggttcccccgatggaaagaaggaagaaccggggttcttatttcgtgcggaggatttccaaatgttcccttacaatctcgttcttgctataagacagcttggctaccctatgagaggggcaccactagaggaagagctcacacctattattgcacgaggtttcaataacaccaaagtggaggcacttcagaaggtccacaaggcatgggagatggtgcaaaagaaggacaaggaactcagaggaagtaacaacgggcccatcagcggctaccgtagatggttgaaagcccacatgcaaggtctggattggctcccgagtttgaaaaccactaaaggggtggaagctgaagcaccggaggaagacaaagaggtgcaagcccttagggcagaactcgagaaagcctaa

SEQ ID NO: 7089 - DNA, 303 bp, Glycine max
  Peptide Sequence Number=SeqID_98774
atggctctgaagaaattctccacgaagaggtctagaagagatgccacaggagaagggtccagtgtcgcccccgagtttgatagtcatcgtttccagagtgccgagcaccagcagcacttcgaggccatcaaaggatggtcattccacaaggagaggcgtgatcagctcagggaggatgagtatatggactttcaggaggagatagctcgtagacattggacaccactggtgactcacatggccaagtttgaccctgagatagtcctagagttctatgctaatgcttggcccacggaggaggga

SEQ ID NO: 7090 - DNA, 111 bp, Glycine max
  Peptide Sequence Number=SeqID_98775
atggggacctccacgggggaggagcttgcaacccagcttggccaggcgagccaggttgcttcctccagaagcaaccgccttctggaggaagaatctggaaggcccaagtag

SEQ ID NO: 7091 - DNA, 255 bp, Glycine max
  Peptide Sequence Number=SeqID_98776
atgtcgtcacgcatctgtcgtatgttggtctcgtcttttgtcacgggaagccagaaggtccatatcaccttcttaattgcacacatgggacactgtgccccgaatgcgcatgtaagaagagatgattttcctggctctcgtgtccataattgcattcatatcatgcatcgcataagcatctctttatggcatcatgatgaacatatcgttcctgcatttttccattatcatattccaacatcacattttgcatga

SEQ ID NO: 7092 - DNA, 171 bp, Glycine max
  Peptide Sequence Number=SeqID_98777
atggcaattttgatcgccaatacttcgacaacatttcatagagatgaaagactcgggaatatgctatgcatggaaaatgtaatgatgagattgagatgcccgaagaaacatcatttcctagttaaccacgcattagaggaaaacacaaggatcatgcataagcaaacatga

SEQ ID NO: 7093 - DNA, 557 bp, Glycine max
  Peptide Sequence Number=SeqID_98778
acatagacgatgctaaacttggagaacctaacgatggttatgacgaaatcaccatcccagatgagtttcttatcaaggactttcaagatcctatccaggcaattgttgaagcaacatatccagacttattacagaactatagcaatggaaatttcttgcaaaaaagagttgttctagcctctacgaaagatgttattgacaaaataaatgactatgtcctatctttgattcctagtgaggagaaagagtattgtagtgctgatagtgttgataaatcttatgaactactcagtcctgctttcggagtactaacacctgaatttctaaactcattgaaaacatcaggaatacctaatcacaagctcaaaatcaaggttggtactcccatcatactactacgaaatttggaccaagctgatgggttatgcaatggaactagacttattgttacaaggcttggttcaaatgtggttgaagcagagattattactggacccaatatatgtcataggacatacataccaagaatgaatttgtctccttctgattctccatga

SEQ ID NO: 7094 - DNA, 423 bp, Glycine max
  Peptide Sequence Number=SeqID_98779
atgggtgactcagagaaatgcgggttatacatcgaagaaaatcctccccgcctggttgccctaggaaaactttatgaggggtcggcaactgttcacaacatccctttgtgccattatcaagtcaaggttggtgttgaggaagttacagatgcagatgctcccattcctgtacccactgaagaggttcagttagtgggacaaacacttaataccttcgttgcttgggagacacatcttgagttgtgggactggcaaaacctacagatagaccggatcatgatgtcgataattcctctatatctgatgacactgaccatcccacaattttttcttaagccgctgcaggttatgtgggatgttgccgtgtttggggtgtttaatgataaccttcacttgtacataaagcatgaagatctaatttga

SEQ ID NO: 7095 - DNA, 303 bp, Glycine max
  Peptide Sequence Number=SeqID_98780
atggggctcgcaatctctctcattgctgggacgttcggccggacaaaggcactatttgccgggaaaacctacgttttgcataataaaccagcagctggacgcgagtggcttgcaattcaggagtgctatagggataatgcgccagcgcgttggttatcaacgctctcaatgggggctctgttggttctcccgcaacgctactctgttcaccaggtcagggcccccacccatttgcggcctcgtacaaaccttcctgcgttacctctctctgtagtcattattccacaatactataacgcctag

SEQ ID NO: 7096 - DNA, 300 bp, Glycine max
  Peptide Sequence Number=SeqID_98781
atggctgtcattatttacggacgccacagcgtcagggtcataccactttgggaaaagaggttggtagatcttcccgggagatatcacggccatctggttggcgatgagggacggcaagaggtcttcgtacgtcattgggatcagggtgaattctggaattggcctcgggggaaagttcctctttgcgttggaactggcgccaaagtgggcattgccggccgagcgagttgttgttggagtcggagcttgagggacctccctctagatgggggcgggcgctctaggctgtacgggtgctga

SEQ ID NO: 7097 - DNA, 555 bp, Glycine max
  Peptide Sequence Number=SeqID_98782
atggagcttacatcactggatgagggagaatccttacccgcttactccagatactgcaagatgcctactgatatcagattgattgaggctgctttgtgtatacccagccggggtgttctctcatactccaacctggctccgacttcccacacctcggatttgactacggatagagctaggttaatctttggcctaggctctcaactggacatgaatgtaggagctctcatatctggccagatcacatctatggcccagtctaattcctctagacttgggttccctgcttttatcacaactctatgtaggtccagaggggttgcttctgacagcctagtcttcaaacgcttgagcccggtcattaacttggcctatatcaggaaaaactattggaaccctgctgatctggcatttactattggaggggctaggagagcgagggcaaggccagtcgaggctccttccacatctgcagctcctcttccagcacgtacctcagcagctctttctaccccatcttttgtagactttcaatgtcttgaagccatgctttga

SEQ ID NO: 7098 - DNA, 453 bp, Glycine max
  Peptide Sequence Number=SeqID_98783
atggagatcactcgaacaaaagggaaagattcgcacaagcttggagcgctatccgcagactcaacagaagtcagttgggaaagaaatcagactatgtgcacgaatcttatacccagtggatacctatcgtccaccatcccaccatcatccttgcctatcccctttgatactaaggaagagtttcatgaacaattaaccaaagaaaggcaagaaaaagaaacttggaagaggagatgccaggagctagagcaagagaatgagactttgaagggaaagatagcccaacagagccgtgagctttttatccagaaccagaggatgattgagaaggacgacttgcttcgtcggaaagacgttttgctccaccaagatgctagaaggaagaggaagtttatggacttgttctcccgtgcacattcagattccgaggacccatctactccgggagtttga

SEQ ID NO: 7099 - DNA, 363 bp, Glycine max
  Peptide Sequence Number=SeqID_98784
atgtcgtatgtggaagccgcggaggagtcgatggaaactattttccaatcttttgaggtagtaagtatcgcttccgtagattccctctctcggcaaccatgcctgtccgatgcggcaatgatggtggcccgggtgatgttagggcacggctataagcccggaatgggtttgggtaagaataacggtgacagggccggcctggaaaggaagaacaaaggccaaggcccgcggtcaggacaacaagccaaagaggttctgccttgccacatcagtaggagcttcgtgagtgcgagtttaagacgcgaaggacaagtcgccatgatatgtgatgaggactccctgaggagatcggatttggtatag

SEQ ID NO: 7100 - DNA, 515 bp, Glycine max
  Peptide Sequence Number=SeqID_98785
gtgctccagtggcttctgtttctatcagctgtccctcctgttcagctactgacggggtggtgcgtaacggcaaaagcacccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagaaggatcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgatatattccgcttccttcgctcactgactcgctacgctcgtcgttcgactgcggcgagcggaaatggcttacgaacggggcggagatttcctgaagatgccaggaagatacttaacagggaa

SEQ ID NO: 7101 - DNA, 432 bp, Glycine max
  Peptide Sequence Number=SeqID_98786
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctgccaatccctggggtgagtttcaccagttttgatttaaacgtgggccaatatgggacaactttcttcgcccccgtttttcaccatggcaaatattattacgcaaggcgacaaggtgctgatgccgctggcgatttcaggttcatcatgccgtttgtgatggcttccattgtcggcagaaatgcttaa

SEQ ID NO: 7102 - DNA, 551 bp, Glycine max
  Peptide Sequence Number=SeqID_98787
gtatggtgcctaccaggcaccctctggacccggataagtccaacagggccctgggatttcccgccttgatcacaggactctgccagtcgttcggagtccccgttgcaccaagcaaggtgattcggccgcccatcacccaagcttttattgagaagtattgcacacagagacaggcccagggggatgctccgcaggccgcagacgcgccgccacctcatcaggctggtccagccgaatcgttcgatacggagcagtatttgcgacatttggttcgccagcaggcggccaaccaccgggctcatgtacaaactcgtgattgtctttaccagatgagcctcaggctgcagagccagggttttacttcttttccgtgccctactccggaccagttcagggcagaggtcgcatggcctggagattggcctgaggcccgggcaggagaggcgccagcagaggcaccagcagaggctcccgacgaggcagatgaggcccgcgaggacgaggagatgaccgatttacttgatttcttaggagtaagcggggccacatga

SEQ ID NO: 7103 - DNA, 543 bp, Glycine max
  Peptide Sequence Number=SeqID_98788
atgtgccaaagttttttttttaaagattatcaaggggaaccagagtcacaattctactatcaaaatgaagcaaaaaggagtttcaatctggacattttgttaatgcaattcaaggatacaattggatctattcaacgagcatttaaaagtgcaaaaattcaggttggtaagttggtagaagaagtgactcaagctatgaacagaagagaacaagagattgtcgaggttgacactcaggaggagagccctgtgaataagcatgatttagaagaagaagatgaggagaaagcgcaacaatgggaacaatgcttacaaacacacactcaacaagaagataatttccaagttaacacatgttcgcatcaattgtctatcaaagaagaaaggcatgaagaacatgaaggttcaatcattctaggacaaccctgtctaccatttactagttgtgttttcgacatgggtaaagatgacagtgaagattggtttgaagcaaaaatatcgaagcaggagatggaattaatagcctcagccatgatattataa

SEQ ID NO: 7104 - DNA, 321 bp, Glycine max
  Peptide Sequence Number=SeqID_98789
atgacattctccgcttcttttgcttacttggagggagaatgtcttaataatgttgtttgggctctacagcggtttcagggtcttttcatgaaagttgatgcactcgttggggttattgttaccgacagagatttggttttgatgaatgcagtgaaaactgggagtttggttgactgtccatgtgagagctattttgatgagtaccttaagaactttgaaatggcttgctcttcgtggcctatgtttgtcaactatgtgtgccaaacatgggtgattccgcacaaagaaaaatttgttaaagcatggactaacaaagttgat

SEQ ID NO: 7105 - DNA, 690 bp, Glycine max
  Peptide Sequence Number=SeqID_98790
atgggtgaagtagaggaggtacaagataagatgaaggccgacatggaggccatgaaagagcaaatggccgcaatgatggaggccatgatgagcatgaagaagataatggaagccaatgcggttgcagttgccgctaccagcattgttgctaaggtgaacccgaagtccccattgggcctcaaccaaatgaatcatccaaccttagatatggtaggcaaagatttgggaagtagggacggcctccatgatgtgcaaaatccaaacaagcacgccttcctgccacaaggcctgcctcccaactatacaccacccaatgtggcgtacactctcaatgaggatgtcaataactccactcctatacccattgagagccgacaaccccaaactgttcatgcacatgtctctcaacccatgggtgagacacatgaaattccccatcacaatctagccgacttcgagccttggctcggatatgccactgaagggcaagcagttggtggtataccccttaaaaacacttcggaagcagtatcacccacaactacacctcttgcattccacgacaaaccctcatgctatggcagaaatgggaaagttgaattaagaaaggatgtctcttcgggcatctcaatctcatatttacattttccatgcatagcatgcgtattctcgagtctttcatccctatga

SEQ ID NO: 7106 - DNA, 664 bp, Glycine max
  Peptide Sequence Number=SeqID_98791
caacaccggtgtgcgcaccgatgatataggatttacgttggtagacctaaagaaacttggttaccacaatgaccctttcatcatggcagaacaagctagacaaggcaaaacaattggtgttaatgtagaagatgatgattcatacatggacacctatgttagtcctttgaccgctcaaatcactcctaacgttgtcggagaagaagaagctgacgacgttcatgctaatcgaaatgataacgatgaaggagaattgattaacatcgttggtgctgatccttctagtgagacctccaataaatctaagaattataaggaggaagcacagaagaaaacacagaagcataaaccaaagagggtggagagtgtcaatgctgatgcagaagcctttggccatcaaagtgtgtcattggagaataagacaggagattcaactatgctgaagataggagattcaactaaagttgtgataaaacaagacatgaagggaagaaggcataaatacgggtttaacaacaacaaacgtgagaaggcacagaacaaaagggtggtggatgatgaaactggcgacaaacatcagctggatgaacagcaagagcagctacgcaagaagcttgcacctgaggagggaaggatatttgcagctaatgaacaacttttttaa

SEQ ID NO: 7107 - DNA, 153 bp, Glycine max
  Peptide Sequence Number=SeqID_98792
atgggtgagacagaggaggtgcaagagcggataaaggccgacatagaggccatgaaagagaaaatggccacaatgatggaggccatgatgagtatcaaaaagataatgaaagtcaacgcggctacagtcgccgctgctagcgctgttgctagg

SEQ ID NO: 7108 - DNA, 588 bp, Glycine max
  Peptide Sequence Number=SeqID_98793
atggatgaagatcagtggatatatgagagcataatgtctaaagaagttaatatgaatgaagccaatggagaggaacctagtgtgtttgaaaatattgattgttctgatgccttcaatacttctcaggtgtttgctacccgtgatgacgttttgcattgggctcgttctgttgcatatgatattggttttatcactatgataatgagacatgatgcaatccctcaagttattattaccgacaaagattcagcattgatgaatgcaatgaaaactattttccctggccatcctcatgttgatcatgaattcatggaagccttggttgttggtgctaatattagtattattggacagtttggtgtggggttctactctacatatgttgttggcgaaaaggtcattgttaccagcaagcacaatgatgatgagcagtatgtttgggagtcccaagctggaggttcattcactgtcaccagggataactctagtgaggttcttggcagaggtactaagaccactctcttcctcaaggaagatcagctagagtaccttgaggagcgtcgattgaaggatttgattaagaagtag

SEQ ID NO: 7109 - DNA, 754 bp, Glycine max
  Peptide Sequence Number=SeqID_98794
atggatctcattgaaaatatggttgcaagtgacattgctattctgagagatagagcccacattcctactaaaaagagcttattggagctaaccttacaagatgcattgttggcacagaacaagttgctatctaagcaactggaggcattggctgaaacactaagatgtacaatttgtggtggagcttatgaatctggatgttgtatccctaatgaaaaacaagtcacacatgaagtcaattatatggggaaccagtccagaaaccattttaatgcaggtggatttttcggattccagcatggacaacaatacaaccaacaacagggacaatggaggaaccatcctgggaatcaattcaatagagaccagggatcatccataaggctgcaaccacaagggtctagtctctatgatcgaaccatgaagctggaagagactctagctcaatttatgcaggtttctatgtctaaccaaaagagcacagagtctgccataaagaatctggaggtccaagtgggacagctcgcaaaacagttggcagataggccgtcaagaagctttagtgctaacactaaggaaaatccaaaggaagaatgtaaagctatcatgacaaggagtagaatgacaacccatgtggatgaaagaaaagttgagaagaagatggaggaacataaacaacaactggctgatgaactggcactggaaccggttgatgatttagttgaacttgaagaaattgttgaggaagcagaag

SEQ ID NO: 7110 - DNA, 640 bp, Glycine max
  Peptide Sequence Number=SeqID_98795
atggccccgagaaagcttccatcaaaaaggtccaggaaggacgccaccgaagaaggctccagcgctgcccagccagctgacacggattttggtaggcatcgattccgaagcgccgagcatcagcagtgcttcgagaccatcaagggatggtcattccttagagagaggcaggttcagttgagtgacgataagttccttgattttcaagaagagataggccgtaggtgctgggcgccactcgtgacacccgtggctaaattcaacccggagatagtcatggagttttatgccaatgcctggcctaccgaggagggagctcaggatatgcgctcttgggtgaggggccagtggatccctttcgacacagacgcccttagccagttcttaggccacccgctgattttggaagagggtcaacagtgtgaattcttccagaggaggagtcagttctctagttttgacgaggaggccattgctaagcttttatgcatactagggcaggatttcacttggaccgctgcaaggagacgggtgaggatcatgcacaccaacatgaccaccctgacccaaatatggatgacgttactgctcagcaacatcctacctagtgaccacacctctgatcttcctctaccgaagt

SEQ ID NO: 7111 - DNA, 749 bp, Glycine max
  Peptide Sequence Number=SeqID_98796
atgacgtctgtacacgctatcgaacttgatcgagccttacacgtcatcggacttgattgtctctggatgacaaagggcttttgcttctacgtatcctcaatttgcgatgaggaaatcagacctacgcagttcatcatgggggtgacaaagtcgccagcacacattattttggttggcaatcaatgggagatgaccacttcaagttgtgggcgaggatggaaattcgcatcttgggtcaaggtttatggcaatgctccagcctttgtagatgagctgagatggactctggaggtggcggcggtgcgtctgtcgcccgctgctggccgtccccaggctactgtggggcctgatgaccttgttgggggagacggacacttcgtagaactgacaaaggcctgtaatcagagctggaaaccccagggccctgttggacttctctgggaccactgggtgtcttgggggcacgatcccttcaaacagaggagatcagagttgttgtcactgggcagaatgttgctaagtagcaacattatccatgtgttggtgcgcatgatccacactcgtctccctgtagcggtctgggaaaaatcttgccctagtatgcatagtagctacgcgataacctcctcctctggttgtgctcgcacagttagccctcctcccagatcaggggggaccttgagttctctgaaggcgaggatgtgtagccctctgaaggcgaggacgtacaatcctctaaaggcgaggac

SEQ ID NO: 7112 - DNA, 594 bp, Glycine max
  Peptide Sequence Number=SeqID_98797
atgtcagcatcttccggtggagactttttcaagtctcacccaagttatccagaactacgtaggtctgagttcctcattggaggatacgtaggagcaagagcctcgcttttgtcgaccacaccacccttttgtcatccaaaggcggcgggcccgatgacatgcgcagacaaaatttggtcattccgcacccctttgccattcagacacaatcgtgtccgatggcacgcagagacaaattatggtcattctgcacccttttgtcatccagaggcggcgggcccgatgacatgcggagacaaaatttggtcattccgcacccctttgccattcagacacagtcgtgttcgatggcacgcagagacaaaatttggtcattctgcacccttttgtcatctagaggcggcgggcccgatgacatgcggagacaaaatttggtcattccgcacccctttgccattcagacacagtcgtgtccgatggcacgcagagacaaaatttggtcattctgcacccatttgtcatccagaggcggcaggcccgatgacacgcggagatttacattatcctccgcactcacaagatctgtcatactga

SEQ ID NO: 7113 - DNA, 318 bp, Glycine max
  Peptide Sequence Number=SeqID_98798
atgaatcatcattcatctagtgttaatggtgagggaaggaataggtcacatcttagacctcactcccataggagagaaaaggaaaaaaagcctcaagaggctaacattaacctctcatacttccatgggaaggacaatgtagaggcttacttagattggaaaataagggtagagcaacaacttaaaaggaagtctacttcaaaatcctatggctctcactcatatccaaagaaagaccaaggtcaaggcatcttagtggcaacaccttctaagcccaaagatgataaaaaggaagacaatagaaaagtaaccccttaa

SEQ ID NO: 7114 - DNA, 237 bp, Glycine max
  Peptide Sequence Number=SeqID_98799
atgtggttcaacttcagtttcaggctaaaggatgaagaagaagaaggtggagctgatattggggaggaggaactaacatatttgaggtcaaatcctcttcaagggggaggggatgatgcaatcctccctaggaagggaccagtcactagagccatgagcaagaggctccaagaggattgggctagagctgctgaagaaggccctagggttctcatgaaccttagggtagatttctga

SEQ ID NO: 7115 - DNA, 673 bp, Glycine max
  Peptide Sequence Number=SeqID_98800
gtatatcatgaattcaattattacaatgttgtatttcaacggaagagtatatgaagacaatgatggtgtaatatttgaaggcagtaaaaatgccattcagattaaacgcggaattagtttcaatggtttgaaaaaaaaattggagataagatttttagtttcaggaaaatatgttgcgttgcaaatttgtgatgacgaagatgttgaaactatgatcgaaagttttcaacaacaacagcaaatgtcagttctagaattgtacgtagaaaaagatgttgctggtggttcgatgtttcatgctgcaaattctgttacgtcatgtggacatgatgatgatgatgattatcttgcatctaactcatacgttgaagagtctttcgatgaagatgatagtgatgatggaatatctgatacagacgatgaagtcactgacatcgttgaaccagtttcaattgttcacccaaccgaaggtgtaccacaaattcaaaatccattttggaatgatgctatgcattataataatatcaattggagtcatccggacgaggaggacatatgtggtctggacatgccaacgacttttaatgttggacaagaattatatgttggcatggattttgacagtaaagatgcggtcaaaaatgcactgaaacaatatgtgatgaaggcatga

SEQ ID NO: 7116 - DNA, 1257 bp, Glycine max
  Peptide Sequence Number=SeqID_98801
gaacatttcctgcaggtcgttcaggaagcgccagcccaggggcgtggcccgcagccgggtgggatcggcgtccagcaggcccttggcggacgctgcctccaattggtgcgcaatggcggccagcgacaggccggtgcgctcgttgaacagggtggcggccaccccgtccttgagccgcaaggcattgagcatgaactcgaacggcagttcgtccgggccgacctggcggctctcggccaggtggctgccgtcgcgcgcggcggcggcccgcaaccaggactccgggctgcgcaggcgcgcctcgcgcacgatgcggtcgtggaacgacaacttgccgtgcgcgcccggccccaggccgaggtagtcgccgaattcccagtaattcaggttgtggcggcagcgcgcgccgggccgcgcgtacgccgagacctcgtagcgcgccaggccggccgcggcaagttcggcctcgaccgcgtcctgcatcgcggcgctggtgtcgtcgtccggcaggtcttcggggggaaacttggcgaataccgtgttcggctccatcgtcaggtgatagagcgacaggtgctcggtgccgaagccgatggcctggcgcagatcgtccacgcaggccgccagggtctgcccgggcagcgcgaacatcatgtccagattgacgcgcggcgcggcgcgctgggccatctcgatggcggcgcgggcctgggccgaatcgtggatgcggcccagcttcttcaattgggcgtcgtcgaagctctggatgcccagcgaaaagcgcgtcacgccgctggcggcgtagtcgcggaaccggccggcctcggcggtgccgggattggcctccatggtgatttcggcgtcgggccatacgttcagacaggcgcgcagcatcgccagcagctcgtccaggccggcggccgagagcaggctgggcgtgccgccgccgatgaataccgaaaccacctggcggccccagatcgacggcagcgcctgctccaggtcgctgcgcaatgcgtccaggtaggcgcgttcgggaatctcgccgccgggcgccgcatgcgagttgaaatcacagtacggacacttgcgcacgcaccatggcacgtgcacatagaccgacagcggcggcaggctggtcagcgtggcgccggccggggtgaccaggcgcgcacgggccgcgcccgattcggcgcggatggggatggtgatggacattcggtgttcctgggcgccacggcgcccgtgtcaagcctg

SEQ ID NO: 7117 - DNA, 165 bp, Glycine max
  Peptide Sequence Number=SeqID_98802
atggccacaattgatggaggccatgatgagcatgaagaagataatggaagccaatgcggttacaatttgccgttactagcactgttgctaagagaatcctcatccttccccccgaagaagaggacagcagaatctcctcaagggagagcgaataacgaatcctaa

SEQ ID NO: 7118 - DNA, 549 bp, Glycine max
  Peptide Sequence Number=SeqID_98803
atgagggaagtggttgaaatgcttgcaccagcaaagaaaccaaacacattccaaaagcagtttatcctttggggggagaggaacctctcttggagaaggcccctatttgacaatgaggtagcctcggctgtaggttttttggaacatatatctcacactgcactccaacaacatgcagcagacatctgggtatggaaacctgaatccaatggatactattcttctaggagtgcctacattctgctacaagggaacttagaggagggaaacatggatgatatattcaaggacttatggaaggtaaagatcccagctaaagcatcaatttttgctgggagtattaaggaggaaactgcatctcatctcttctttgattgcagcaaaacacaacatttttggtgggaatccctatcatggataggcacctcgggggcctatcctataaatccaaggctccactttctacaacacaacaatgggatgaaaggtgggaagaaatacaataggtggaagtgttggtgggtagctctaaattggtctatttggtag

SEQ ID NO: 7119 - DNA, 357 bp, Glycine max
  Peptide Sequence Number=SeqID_98804
atgacctctccagcaacaagtagaaccccgggtcgaggaatcatcccaaccttagatggtcgaatccttcacaacaacagcaacaacaacaacaaccttattttcaaaatgctgctggcccaagcagaccatacgttcctccaccaatccaacaacaacaaaaacagcaacaaccccataaacaacaaacagttgaggctcctccgcaacctttccttgaagaacttattatcttctcaatctgtccagaatcccaaaaatgtgagtgccattacattgaggtcgggaaagcaatgtcaaggacctcaaccagcaacatcttcctcatccacaaatgaacctgcccaacttgactga

SEQ ID NO: 7120 - DNA, 750 bp, Glycine max
  Peptide Sequence Number=SeqID_98805
atggaacacgctttacggcacccttaccgaactcgtgctagagctagagtaatgggtgaagcagaggaggtgcaagagaagatgaaggccgacatggaggccatgaaagagcaaatggccacaatgatggaggccatgatgagcatcaagaagataatggaagccaatgtggttgcaattgccgctaccagcgttgttgctaaggtgaacccgatgcccccatctgatgagtcatccaacctcagatatggtgggcaaagatttgggaagtacggacagccccatgatgtgcaaattcaaaacgagcacgccttcccgccatatggcttgcctcccaactatacatcacccaatgtggcgtacactcccaatgaggatgtcaataactccactcccatactcattgagagccgacaacctcatcatgtacatgtctctcaaaccataggggagacacatgaaattccccaccacaatctagccgacttcgaaccttgcctcggatatgccactgaagggaaagcaattagtggtatactcctgcaaaacactttggagggccctctgtatcacccacaaccacacctcttgcattccacaatgggtaaaaaccctcatgctatggcagaaatgggagaaagagtcgttcctagtacccaaacatgggtcattcccaagttcaaggtgtcggactttgacaagtacaaggggactacttgccccaagaaccatctaaagatgtattgttag

SEQ ID NO: 7121 - DNA, 240 bp, Glycine max
  Peptide Sequence Number=SeqID_98806
atgaacacaaaggaaggattgtccttgtgtggttcagatcttgtaaagggattttgcaagatagtggaactctcaagcgggttccttggggactggacggagaagggagacacaaaagaattcaagcggttagtcctttgttcttttggaaaagtgagaagagagacacaaaaagaattcaagcgattagtccttgtcgaattctttttggcaaagggagaagagaatgaaaagatatag

SEQ ID NO: 7122 - DNA, 141 bp, Glycine max
  Peptide Sequence Number=SeqID_98807
atgatcatgaaggcagatgaagaaatcactagtgaatctgaaatcagtggagaagaagaggtggaagaagagcttgaggaggaagctatacagggtgatatgctaatggaagctatgccaatgttgcaagttctaaggtag

SEQ ID NO: 7123 - DNA, 294 bp, Glycine max
  Peptide Sequence Number=SeqID_98808
atgatagatgttttatatcacaagaacaagaaatggtctaccatgaggaaaatagaagcaaaccttcatgatgaatcaagattgattcaaagatgttttgatgataacaaaggtgatgacaaaaagctcaaaggtcaatcaaagaatgagttcaagatgttcaagatagaatcaagaacacttcaagattcaagaggaaagttgatttcaagaattaagaatcaagattcaaggatcaagcttccaagaatcaagattcaagactcaagattcaagaatcaagagaagacttaa

SEQ ID NO: 7124 - DNA, 243 bp, Glycine max
  Peptide Sequence Number=SeqID_98809
atgtctacagatgtaaccttctttgaagacacacctttcttctcatcctctgtagatcattcttcttctctccaggaagtactgccaattccttgtcctctaggacacaaccagctgattctacagtacctgaagcctctcctcgtgatcctcatccttctccaactagtcctccaaccatggatcctgcttccttacttgtctctcatcactctgagtcagactgacccattgccatcataa

SEQ ID NO: 7125 - DNA, 189 bp, Glycine max
  Peptide Sequence Number=SeqID_98810
atgtctcggaacttgacgtattatgcaacaaagggtgccaagtacctcaaagtggtgatgcaagctccattggagcttgtaggcctaggatcttcttcatcaatggattcctttgcttcttggaagatgaatggcagcggaatggagaaagggagagagagaggagacgccacttcaaggagaagatga

SEQ ID NO: 7126 - DNA, 213 bp, Glycine max
  Peptide Sequence Number=SeqID_98811
atgcagagccagggcttcgctcctttttcatgccctactccagaccagttcagggcagaggttgcatggcccggagattggcccaaggcccaagcaggagaggcacccccagaagctcccggcgatggagaagaagcccacgaggatgaggagatggttgatttgcttgatttcttgggagggagtggagacactgcatacatttttgtttag

SEQ ID NO: 7127 - DNA, 747 bp, Glycine max
  Peptide Sequence Number=SeqID_98812
atgaaacttcctttttatcttgaattagttagagctttttattctaacttggaaattcaagaaaattccttgatttccgaagtatatgggattaagatggtcatagatcagtcctttctctttgaactcactcaattatccaatgacggtataccgtttgagggtacacttgatgatgagtggaagttcgatttttttgtttctaatgcccgccggatggtttgcaccaaccaagcggatatgaccggaaggcttcttgccagttcattggcattcaaatgccgcatcatgcactacttgattgtgcgcatcctactccctagatcatccaaccttgcacatgtttctaaggaagatttaataattatgtgggttttcttaaccggtcgtcaaatcgactgggcccatcttagatctttctctatcggtgcgaatgtggtctcctcttttggataccgcaaagagagagatggttcttgggtgaagaaagatgctccagtacaggccgttgaagaccattctccatcaccgcctcctcagagagatgattcttcatctcttatgcacaacattcttgacaggttggatggactcgacaccttcgtcagtgaacgctttgactcattggacagtcgtattgatgctatggatgcacagtttgcaggaatggatacacacatcaccaagcttgaggaggatgtgagttatgttcgtcggtgcttcgaccttccacctccatcctcatag

SEQ ID NO: 7128 - DNA, 159 bp, Glycine max
  Peptide Sequence Number=SeqID_98813
atgaagtcaggtgacatgcggggttaccgtatggttatccgtacctttcgtcaaccgaggcgaatgaattcgacggtttactctagttgtccgaagatattcaagcccaacgacgcacgagattcttctctgctgggcggggatgatcaagttcgatag

SEQ ID NO: 7129 - DNA, 1077 bp, Glycine max
  Peptide Sequence Number=SeqID_98814
atgaatgcgctaagcccagctgtcgtgctaagcgcgttcatcttctttgttgagttatctgttgaactcgctaagcatgactgtgcgctaagcgagtactatgcctgggaccgctacgcaaacaatgtccttggccgaaagatccttctagaaaggaatgtgaagttgtatatcacagaatttgatgaattcataagggaaattgagaggaggaattggcataaggagctcactaacttctcagagggaagcattgatgttgctattgttaaagagttttatgctaacctctatgaccttgaagaccaatcgcctaagcaggggaaagcttgcccgcctactcctgctaaatgcagatgggctgcctttgaagatcttgaggaagaacctgactactctcgcctagtctcggctaagttaatctacgagctcgtcatgacgatggatataaacttgggatgccttatctcaggtcagatttctctcatcgcacagcatgacacctcgaggctagattttccaaccttgattacttccttgtgcaaggcccgaggagtcacatctaattctctgacctttgaatctctgagcccagccattaatttggcttatattaaaaagaattgttggaacctgaatgacccttcggtcacttttcggggaacgcagaaatccagggctaggagatccgaggtcccaccatcttctgctcttgcccctgcttatgcttctacctcagctccctctgcatctacccccatctacttctacagctccagttcctccaattcttacacgttttcccgctcagagttcagaggcttccttgtatatactacagagcctgcattaaggtcagctcctgatcatgcagagctagcagaatgtggtccaccagcggccgaggccacaaagcctacacctcctgagccattcactttagagtctgatccagtggctgatccagctatatctcctcagcctgaatcatttgcaccagtgctggacctgcctctttctcaggatccatcatctgcaccaacactggacctgaatgagcttgcacaagatgattga

SEQ ID NO: 7130 - DNA, 285 bp, Glycine max
  Peptide Sequence Number=SeqID_98815
atgcccgtccccccagcaaggtcatgccaccgtgacatagtgatcgcgcctgcaagacacccagtggacccggagaagtcgaacagggccctggggtttctagctccgattacgggcctctgtcagttctacggagtgcccgttgcctccagcaaggtcattaggcttcctactaaccgagctttcatcaagaagtactgcaccctaggcaggcgcagggcgagacaccacagcagcctagggatggccggtagtgggcaacagacgcaagaccaccacctctag

SEQ ID NO: 7131 - DNA, 408 bp, Glycine max
  Peptide Sequence Number=SeqID_98816
atgggtgttaagtacttcaaagtggtcaagcaaaggttgcaggccatcaaacaatggtcctcggatgaaattagggtgcggataaccataaggtaccctcacatgtcatcggacttgccgtctctggatttcaaaggtgcagatgacgacgcgttgagtcttacagatagcaaaagaatgtttatacggataaccactggggtagtctgcacggaagatgacgtaaatccccacgtgtcaaggggcttgttgatgcaagctccattggagcttgtaggcctaggatcttcttcatcaattgattcctttgcttcttggaagataaatggcagcggaatggagaaggaagagagagaggagacgccacttcaaggagaagatgagtctagaagaagctcaccaccatag

SEQ ID NO: 7132 - DNA, 243 bp, Glycine max
  Peptide Sequence Number=SeqID_98817
atgcagctcacagaatgcaagctaaatcagctgcttctcatatcggatcttcaaaagagtcataatttcacttcaggtgttgctatctttatttcacctttcttattctacaacaaggtagaaccccttacgggaaaaaatttaagggattcccagtctggctttatagaagaaaaagagattttggatattcttgtaaaatctaaccatggcattgacccatatcaaagaggttgcacttaa

SEQ ID NO: 7133 - DNA, 204 bp, Glycine max
  Peptide Sequence Number=SeqID_98818
atgggccccaaatctgccctaaggctcatgagaaccctacggccttctcttgcatctctgacccaatcttcttggagtcttctatccaatgcccttggggggttttgcgctaagtgtgagatcattgtgctaagcgcagaggttgtcttcagccaggctcaactcatgactggcgctaagctcaaatccacttatttgcgctaa

SEQ ID NO: 7134 - DNA, 588 bp, Glycine max
  Peptide Sequence Number=SeqID_98819
atgatgaacgcgctaagcgcgcctgctgcgcttagcctgttcatcgcaactaaggcttccaagaagagaaagtcttttgcttcttcctctacccaagcaagatttgacagatctaggtttcattctcaagaagcttgggagaggtacaatgatataattgtccctaggaaactgctttcagagaggaatgtagtagtatactacattgaatttgacgaatttaaggaggaattagaaaaaagaaaatggcatgaggagtcgacaagcttcactgaaggtagtattaatgtagctattgtcaaggaattctatgcaaacctctacgacccagaagacaagtcacctaagcaggtgaaggtcaaaggtcatctgatgaaatttgatgaagataccttgaacactttcctgaagaccccgatgattctggaagagggggaaaatctttgtgcttattctcagtttgcattcctgaggcctgatcctcaggagttggctgccaagctctgtatcccaaggaggggattcgagctaaacactgatggtcagcctttgaagattttaaggaagaacatgaccactttatcttag

SEQ ID NO: 7135 - DNA, 234 bp, Glycine max
  Peptide Sequence Number=SeqID_98820
atgttgacatctccggaaacggtgcagatgactacattggtctttgcttgtcaatccgacttggggtctccgaatgacaaggtgcagataaccgttaccatcgggtgtctccgcatgccaccgaaatcttgggtcacggtagcaaaaggtagtgtggtcgacaataacagggcttttgctcctacgtatcctcaatttgtgatgaggaactcagacctacgtagttcttgctaa

SEQ ID NO: 7136 - DNA, 234 bp, Glycine max
  Peptide Sequence Number=SeqID_98821
cctgtggtgtggataccacctacacctactccatatcgactagttgagcctgttcaattgatagaggtgtcatcatctgaagaggacccagaggagttacctcctgaacctgctatggatgcccctaacttaccagaggatgatgaggacccactccctgatgttgattctccagaggatattatgtcagcgtctgaggcagactctacagaggagagtggccctggaaggacg

SEQ ID NO: 7137 - DNA, 454 bp, Glycine max
  Peptide Sequence Number=SeqID_98822
atggctaagtttgaccctgagatagtcctggagttctatgctaatgcttggcccacagaggagggagtgcgagacatgcgttcatgggtgaggggtcagtggattccctttgacgcagatgcccttagccagttcctgggtgacgcgctagttttggaggaaggccaacagtgtgagttcagccagaggaggaacagggccgacgggtttgacgaggaggccattgcccagctgttatgcacactggggcaggatttcgcccggaccgttgtaaggaggcgggtgcggatcatgcgcaccagcatgaccactttgacacagacgtggatgacactgctgctcagcaatgtcttgcctagcgatcataactccgatctccctctgcctaagtgccagttggtatgccacccaccaggcaccctctggacccagataaatctaacagggccctggg

SEQ ID NO: 7138 - DNA, 267 bp, Glycine max
  Peptide Sequence Number=SeqID_98823
gtcgactctagaggatcccctcacgaaaaagagtattgcagcgcagatagtattgataaatcagatgaattgctcaatcctgtttttgcattattgccacctgaattcctatattcattgcaaacatcaggtatacctaatcataaattaaaacttaaggttggaactccaatcatgctattacgaaatctcgaccagactgatggcctgtgcaatggaactaggctcattatcaccaaactcggatctaatgtgattgaggttgaa

SEQ ID NO: 7139 - DNA, 246 bp, Glycine max
  Peptide Sequence Number=SeqID_98824
atggttcaactgatttctgataccatctattgtttgcgggaatcgcacccacaaagacacccagtggacccggagaaggccaacagggccctggggtttccagctctggttacgggcctttgtctgtcctacagggtgcccgttccccccgacaaggtcacgtcatcaggacatagggatcatgcccgcaagacacccaatggacccgaagaagtccaacagggtcttggagttgtcaagctctaa

SEQ ID NO: 7140 - DNA, 288 bp, Glycine max
  Peptide Sequence Number=SeqID_98825
atggatctcatggaaaatatggttgcaagtgacattgctattttgagagatagagctcacattcctactaaaaagagtttattggagctaacctcccaagatgcattgttggcacaaaataagttgatgtctaagcaacttgaggcattgactaaaacactaaagaaaaatcccaaggaggagtgtaaagctgtgatgactagaagtagaagggcaatccatgtgggtgagagtgaaactgagaagaagatggagaaacataaacatcagctggcacctactctatag

SEQ ID NO: 7141 - DNA, 405 bp, Glycine max
  Peptide Sequence Number=SeqID_98826
atggagaagtctgaaaagaaaaattttagtgaaaagaaattgaagaaagcatacatcacatgggatgacaatgatatgaaatcttctgaagattcagaaaatgaagagataaacctctgtctaatggctaaaagttatgaaagtgatgaaaaggtgtctttgaggaaggaatggtacatagatagcggatgttcaaaacatatgactagagatgcatcaaagtttacacatatctctcccaagaaaagcgggcatgtaacatatgatgacaacaacaaaggtagaatccttggagttggtagaataggtacaaattcttcaaactccattgaaatgttctacttgttgaaggtcttaagcacaacctgcttagtgttagtcaattatgtgacaaaggctatctag

SEQ ID NO: 7142 - DNA, 707 bp, Glycine max
  Peptide Sequence Number=SeqID_98827
tacacgtcctcgccttcagaggactacacgtcctcgccttcagaggactacacgtcctcgccatcagagggctgcaggccctcaccttcagaggattacacgtcctcgccttaagaggtctacacgtcctcgcctttagcgggctgcatgccctcgccttcagaggactacacgtcctcgccatcagaggactacgagtccacgccttcagaggacttcacatccttacctttagagggctacacaccttcgcctttgtagggctacacaccttcgcctttgtagggctacacaccctcaccttcagaggactacacaacctcaccttaagagggctacacgccctcgccttcaaaggactacatggctacagaccctcaccttcagaggactacccatccttaccttcagaggactacacgtcctcgccgtcagaggactacacgtcctcgccgtcaagaggactacacgtcctcgccatcgaggactactcatcctcgcacatcagagggtgcacgccctcgcctttagaggagtacatgtcctcactttcgaggactaccgtcctcgccattagaactacacgagagggctacatgccctcaccttcgatggatacagttcaagtggaggagtacatccacttggttgttagagatacacgtcctcagggagggcacacctcccttgtggatgtttgcttgtaa

SEQ ID NO: 7143 - DNA, 780 bp, Glycine max
  Peptide Sequence Number=SeqID_98828
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccacctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 7144 - DNA, 642 bp, Glycine max
  Peptide Sequence Number=SeqID_98829
catgagggcagtagtccaactaaagacactgaagttgttgaagcggtcaacgatgttgttatagatgaccccttgcgcgagttgattaagagcctagttgacatttatgagaagcctgtagagttagtgtgggatgttactaaatttggaattccaaatgcaactgcatcattgttcgtaacgtgtgctgatgtgaatgaaataatatcaggcgtacagtgtttgaacatagctatactacaattgtggaccatgtatatggaccaattgagtcaaagagatggtgtaggatcggtgtatggattccttgagccgcaagctatactgaatgcaaacgataaacgtggacaatgtcaagaatacattgaaaaatggcttaaggaatcaaaccgagatgtctatctaggcgcttatttgaatcatgcatttaagactttggaaacaaagagtgaggggaaatttggtcacagtacactgcggtggattgaagtgaagagtcacgttcaaagcggaacctatgagtgtggctattatgtcatgcactggatgtggaacataatcgtcgggcagttgaagactaattggacacgggaaaattttgtcttcattttttgtcttcaatttttagcactacgtaactaa

SEQ ID NO: 7145 - DNA, 1041 bp, Glycine max
  Peptide Sequence Number=SeqID_98830
atgtctcaatcgttgatcgtggcaaaatttggcggcaccagcgttgccgatttcgatgccatgaaccgcagcgcggacgtcgtgctgtctgatgccaatacccgtctggtggtgctctctgcctcggcgggcgtgactaacctgctggtttcgctggctgaaggccaggaactcgagcagcgcgcttatctgctggatcaaatccgcactattcaatatgccatcatcgatcgcctgcagtcgccggacgtcatccgtcaggagattgatcgcatgctggagaacatcatcatgctggcggaagcggcggcattagcccgttcgaccgcgctgaccgatgagctggtgagccacggcgaactgatgtcgagcctgctgttcgtcgagatcctgcgcgagcgccaggtgaatgccgagtggtttgacgtccgcaaagtgatgcgcaccagcgaccgttttggccgcgccgagccggatgtggccgagctgaaaacgctggcagcggctcagctgcagccgcgcaccgcagaagcgctggtgatcacgcagggctttattggcagcgaaggcaaaggccgcaccaccacgctgggccgtggcggcagcgattacaccgctgcgctgctcggcgaagcgctgcaggcgacgcgtgtggatatctggaccgacgtggcgggcatctacaccactgacccgcgtgtggtgccgcaggcgaaacgcatcgaagagatcacctttgaagaagcggcggagatggcgatcttcggcgcgaaagtgctgcatccggcgacgctgctgccggcggtgcgcagtgatattccggtgtttgtcggctccagtaaagatccggctgcgggcggcacgcgcgtctgcaacgagactaaaaatccgccgctgttccgcgcgctggcactgcggcgcaaacagacgctgctgacgctgcacagcctgaacatgctgcacgcgcacggcttcctggcggaagtgtttgctatcctggcgcgccacagtatttcggttgatctggttaccacctcggaa

SEQ ID NO: 7146 - DNA, 96 bp, Glycine max
  Peptide Sequence Number=SeqID_98831
atgacagacgataaatctaaaaaagggaaaaaagaccgcaaacagaaaaatatcgtgaaaagcggtcagaagaaaagactcccgaaccctttgggg

SEQ ID NO: 7147 - DNA, 1016 bp, Glycine max
  Peptide Sequence Number=SeqID_98832
agaaattccgaggagctttgtggggtagcaacaatgagctcaagctccgaagaaaggaaagagaccggtcacaggtgcacgacatgatcttaaaagaagagttagctgcttgcgcaaggtccaagaggagtttggctcaacacttggaagccacggaacaaagcatgctagctatcatagggcagtacaaggaaaagttgaaccagtctgtgacccatgaacaaaagctagtggaggattttgcacaagtgtacgccgaaaaagaagcaagagggagggtgattgatgcattgcatcaagaagtgactatgtggatggataggttcgccttgaccttgaatggaagtcaagacctcccacgactattagccaaagcgaaagccatggccgaattggaattcaccataactaagaaagcacaaaggctcccctataacactcgatccagaaaaatggataatgaagagggcgtgcaagagcagatgaaggctgatctatcggccttaaaagatcaaatggcttctatcacggaggccatgctaaaactccagaaaactctagaggataatgccacagcaaccgcctccaatgcagttagagaagcggaaccagtgctgcagcccacgataaacttgggccgagatagaaacccgacagtgttcggtcggaggtacagtccgcaagcttacccttatggcttgcctccggacttcactccccgtgccgctccagaagatgtgagccaagcccctaccttcgaggggcaacttcctccttatgttgattaccctatgcaagaagacgacgaagaagatacctatctaggccctctgcttcccctcaaggatccatccccccatgaattacctcaaccaaatatagtccgccatgtcccatcttcacccgcacccgtaaaagaatccgttcccttcacagaagataagggaaagattgatgcgcttgaagagaggttgagagcagcagagggcctcacaattacccattctcggatctag

SEQ ID NO: 7148 - DNA, 282 bp, Glycine max
  Peptide Sequence Number=SeqID_98833
atggccattgcacttgatggtgcccatgttcgatacattggatgttgtgtatgttcgtggggggcgaagtgcattggccttgtcgaatggcccatttgtgggggacaaacgtggttaaagaatctaagcatttatgaggggattcttaggcgtttcaattggtccatggtcattggcacttgcttgtggctacgttcatacatcgtatgtagtgtatgttcatggaagggaagtgcattgaccttgtcggatggcccattcgtgggggacaagcgtggttaa

SEQ ID NO: 7149 - DNA, 402 bp, Glycine max
  Peptide Sequence Number=SeqID_98834
ggtacatctacttggggttgactgagaacaagagagggtacatctcttgtggatcagttctagtggagggtacatccactaggttcaaagagaacaagggagggtacatcccttgtggatctttgcttgtaaaaggatttttacaagggtacatccttcgtggtacaagtagagggtacatcaacttgggtttggctgagaacaagagagggtacagctcttgtggatcagttctagtggaggatcaagaactagaagaagactcgttagcaccaacggtgactctaaggtggtgcaggggtccttggtctatgaatgagaagaattgtttggccgcagaaaggttgcatgcattagatctggaggaggaggaggtgtccgacattgaaggagggtggcggg

SEQ ID NO: 7150 - DNA, 360 bp, Glycine max
  Peptide Sequence Number=SeqID_98835
atgttggtgaagaaggacatgaaggagaagattcatctcttctgtcgaagattatggaaaggtttgacggtcttcaaacctttgttggagaaagaagttgtcatcatcaaaaagggggagattgtagaagcaaagcttcatggtgatgacaaaaagctcaaagatcaatcaaagaacaactcaagtgaatcaagaacaattcaagagttcaagataagaatcaagaagtattcaagaactcaagaagaaagtctagagacaagaatcaagattcaaggttcaagatctcaagaatcaagatcaagattcaagactcaagattcaagaataaagagaagactcaatcaagataagtattaa

SEQ ID NO: 7151 - DNA, 204 bp, Glycine max
  Peptide Sequence Number=SeqID_98836
atggagaaaacgatgaagaacaaggagcttgtaggccttggataccacatcaccaagatgaagatgctcttgataccacatgatgtagctccatttagagcttgtaggccttggatcttcttcatcaatggattcctttgcttcttgaatatcaatggcaatagaatggaaaaggaggaaaggttattagagacgccactttaa

SEQ ID NO: 7152 - DNA, 477 bp, Glycine max
  Peptide Sequence Number=SeqID_98837
atggtaatataccaatatgcttttatagataaaaggagcagtcttgctgttggggatatttcggagattatccctgacaaagttgcagatattgctgttctagaggagcctgagcacttgacatggtatcaccatgggaaaagatggaagactaaattcaggctagttatagggataattcatacgaattatttggagtatgtgaagagagaaaagaatggaaccatgcaagcatttttgctgaaatatttaaacagctgggttgttgatttctacatcggttgtcctaacaaccaatgtagaatgtcaaaattcaacatcggtcatttaaccatcgttgtgtttcaacgactccgggttacaacgacgcgtgataaccgatgtagaaaggcgccgataaccgatgtagaaagcctcttttctagtagtgactattataacatgtatttggagttttgtattttaatcatgatgtag

SEQ ID NO: 7153 - DNA, 255 bp, Glycine max
  Peptide Sequence Number=SeqID_98838
atggacccgaaatctatcctaaggctcatgagaaccctaagaccttctcttgcatctctggcccaatcttcttggagtcttctatccaatgcccttgcggggccttggatcttcttcatcaatggagtcctttgcttcttgaagtttgatggcagcggaatggagaatgagaaagatgattggagacgccacttcaaggagaagatgagtctagaagaatttcaccaccataggaagccatggataagagcttga

SEQ ID NO: 7154 - DNA, 599 bp, Glycine max
  Peptide Sequence Number=SeqID_98839
cctaagtgaagaacttcgtgactattacgaagaaagccataggtcacatcttagacctcactcccatagaagagaaaaggaaagaaagcctcaagaggctaacattaacctcccatacttccatgggaaggacaatgtggaggctaacttagattgggaaataagggtagagcaacaacttaaaaagaagtctacttcaaaatcttatggctctcactcctatccaaagaaagaccaaggccaaggcattctaggggtgacaccttctaagacccaagatgataaggggaagacaatagaaaaagaaccccttaaggctagtatgcaagagaagactagctccatgaatagccaagatgaggctactacttcaccttcctatagtgaaagtgaagaagagaaatggaaagaatctagtgaagaaatctacccccaagaagaaggacaacctttaatggttaaggaggagtgtaaggagacacatgttagcactgccatacctcttgggcttgaggttattcctcaagtaaagaatttgttggatgagggtttggttcgtaagagcttaaatccttatgctttgttggtgcccaaaatag

SEQ ID NO: 7155 - DNA, 384 bp, Glycine max
  Peptide Sequence Number=SeqID_98840
atggtgtcatctgcatactacaagatgctgatttttattccatcttttcccaccaataaccccttgtacttgtttgcttttagtgctttttccattaaacccgtcaagccctctgtcacaatattaaataagagaggggctagtggatcccctccgccacaatattatcatagtttggcacaaattattgatgaggacatgaccaagagtaagggcaaggatccactggaaggacttggaggacctatgacaagggctagaacaaggaaagccaaggaagctcttcaacgagtgatgtccatactatttgattacaagcccaagtttcaaggagaaaagtccaaggttgtgagttgtatcatggcccaaatggaggaggactaa

SEQ ID NO: 7156 - DNA, 450 bp, Glycine max
  Peptide Sequence Number=SeqID_98841
atggtgaggacgtgtagtcctctgaaggcgagggcttgtagccctctgaaggcgaggacgtgtggtcctctaaaggtgaggacgtgtagccctctgaaggcgaggacgtgtggtcctctgaaggcgaggacgtgtagccctctgaaggcgaggacgtgtggtcctctgaaggcgaggacgtgtagccctctgaaggcgaggacgtgtagtcctctgaaggcaaggacgtgtagccctctgaaggcaagggcgtgtagccctctgaaggtgaggacgtgtagcccgctgatggcgaggacgtgtagtcctctaaaggtgagggcatgtaaccctctgaagattgactgtccttttgaaagaggtgttaattcatgcaaccttatcctatcttttgcaaatctctccgggaactccctcagagtgtatgttctgtttgatttagtcacttga

SEQ ID NO: 7157 - DNA, 180 bp, Glycine max
  Peptide Sequence Number=SeqID_98842
atgaaactgggttcacaagggttggaagtgtctatgcatggtctgcattctatggtcctccaaagccagaacgatatgattgctctcatccaccacgccatcgaaagcggtgtcacttttcttgacacttctgatgtctatagcaaaggctttgaagggaggggtgagagagaaggttga

SEQ ID NO: 7158 - DNA, 396 bp, Glycine max
  Peptide Sequence Number=SeqID_98843
tactgcacgcagagacagatccagggtgatgcaccacaggccgcggacgcgccaccacctcatcaggctggcccagccggattgtttgatacagagcagtatttgcggcatttggttcgccagcaggcggccaaccaccgggcacatgtacagactcatgattgtctttatcagatgagtctcagcctgcagagccagggctttacttcttttctgtgccctactccggaccagttcagggcagaggtcacatggcctggagattggcccgaggcccaggcaggagaggcaccagcaggggcaccagcagaggctcccaacgaggcagacgaggcccgcgaggacgaagagatgaccgatttacttgacttcttaggagggagcggagccacatga

SEQ ID NO: 7159 - DNA, 89 bp, Glycine max
  Peptide Sequence Number=SeqID_98844
atgtcgatgacattatatgcgaaaagtacgacattagcaaggagaaatgggtccaattatgtcagagccatagagacccttcgtgggag

SEQ ID NO: 7160 - DNA, 147 bp, Glycine max
  Peptide Sequence Number=SeqID_98845
atgacgggagatgcattcacacatatctctcccaagaaaagcgggcatgtaacttatggtgacaacaacaaaggtagaattcttggagttggaaaaatagcaaagatgatgatccatggctatggcataaacggattgctcacataa

SEQ ID NO: 7161 - DNA, 444 bp, Glycine max
  Peptide Sequence Number=SeqID_98846
atgcgacttaggactgcatctggagacgtggtccctatcaacttggaaatcgaagccacttgtcggcgtaacaacgctgcaagaagaagaagggaacaggacaccgaaggaagcagtcacacatcacctcctctctctccacatcacactgaaatggacggggaacaggcacgaagagtcaccttagaagacttctccaacacagccactcctcagttcttcacaagtatagcaagaccggaggtgcaagccgcaaatatctcctacccgcattcccttattcagcttattcaagggaatctcttccatggtcttccaagcgaagatccatatgctcaccttgcctcatacattgaaatatgcaacactgtaaagattgctggagttccagaagatgcggagaggcaaaacgatggttgcactccttcaaaggcaacagcttaa

SEQ ID NO: 7162 - DNA, 413 bp, Glycine max
  Peptide Sequence Number=SeqID_98847
atccaggaaggataaagcggctgaaggaaccagttccgctcccgaatatgacagtcaccgcgttaggagcgctgaacaccagcagcgcttcgaggccatcaagggatggtcatttctccgggagcgacgcgtccagctcaaagacgacgaacatagtcctcgaatttaatgccaatgcttggccaacagaggagggcgtgcgtgatatgaggtcttgggtgaggggtcagtggatcccgtttgatgcagatgctatcggccagctcctgggatatcctttagtgttggaagagggccaggagtgcgagtatggccagaggaggaaccggtccgatgggttcgatgaggaggccatcgcccagttgctatgtataccggggcaagattttgcccggactgctgccgggagacgg

SEQ ID NO: 7163 - DNA, 700 bp, Glycine max
  Peptide Sequence Number=SeqID_98848
agggctacacgcccttgcctacagagggctagaagccctcaccttcagaggactacacgtcctcgccttgaggactacacgtcctcaccttcagagggctacatgccctcaccttcagaggactacccgtcctcgccttgaggactacataggacaacatgtcctcaccttcaaagcgctagatgccatcgccttcagaggactacacgtcctcaccttcaaaaggttacacgcccttaccttcagaagattacatgtcctcgccttaagagggctacacgccctcgcctttagaagactacacgtcctcgccttcagaggactacacgtcctagacttcagagggctacacgccttctccttcagagaactacacgtcctcgccttcagaggaatacacgtcctcgccatcagagggctacacgccctcaccttaagaaggctgcacgtcctaacttttagagggttgcacgccctcaccttcagaggtctgaacaccctcaccatcagaggactacacgtcctcaccataaggggttgcacgccctcacctttaaagggctacatgtccttgcctatagacggctgcacgccctcacctttagagggctatgcgccctcacctttagaagactacatgtcctcgcctacagagggttgcacgccctcgccttcagagggccgcacaccctcgcattaa

SEQ ID NO: 7164 - DNA, 162 bp, Glycine max
  Peptide Sequence Number=SeqID_98849
atggtggttttggtgattggatctagtaacgagaaggctagtggtattgcgatggtggtgggcgatgaagatgcatgcaaagtccaatgctgccgccgttggtggatgaccaacgtcaagaaatggaaggcgacaaagtgcagtggaggtgaagagacgtga

SEQ ID NO: 7165 - DNA, 635 bp, Glycine max
  Peptide Sequence Number=SeqID_98850
atggaaaatcctaaacaaaaaacaaaatcaaaaataacgtgctacaattgtggaaaacaaggccacatcagcaaatactgtaggctaaaaaagaagttaagaaaccttaacctagaacccgcaattgaagagcaaataaacaatttgctcatagaaacctcggaggaagaaacaaaaacttcatcctccgtgctttccgatgaaaacctaaacctaatccaacacgatgaccaactatcatcaacagatgatgatgatgggcaaatcaatactctaacgagagaacaagatctcttgtttgaagcaatcaattccatacctgacccccaggaaaagaaggtttttctggaaaaactcaagaaaacattagaggtaaaacctagacaaaaggattttatcacaaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttgaggaagatagcgattctgaaagtaccaacaacagtgaagaaaaccaaccagaaaacttagaagatgatat

SEQ ID NO: 7166 - DNA, 223 bp, Glycine max
  Peptide Sequence Number=SeqID_98851
aaagacaaagtgctaaacgcacaagtcaaaatcgaaagggccattgagaaagctctgctctccgacggctgctccctgggcttggctggcttgattgccgttggtggttgtggcgggaatgaggggcaagcgggggtatcctcaaataataacgaggcccgtcccagaaatggggcggggaaggagaagtgggcatgtgggtctccttcacttgactatttag

SEQ ID NO: 7167 - DNA, 399 bp, Glycine max
  Peptide Sequence Number=SeqID_98852
atggcagcacagttgatccatgatcgtgtggtgatggagtgcctagagggtgtttgggagaccctcgaaggcaatgagaggtgccgattccgtggcacaattcgactcactgctacttcattacagcctgtggagtggatactacctacacctactccatatcgactagttgagccggttcaagtgatagaggtgtcatcctctgaagaagatcttgaagaggacccagaggagttacctcctgaacctgctatggacgcccttgacttacctgaggatgatgaagacccactccctgatgttgattctctagaggatattatgtcatcatctgaggcagactctatagaggagagtggccctggagggacagcgaatagtgacgactcttcatcatag

SEQ ID NO: 7168 - DNA, 243 bp, Glycine max
  Peptide Sequence Number=SeqID_98853
atggagtcgccaactgtcgcaacatgcccctttgtgggcgagcgaggcgaggctcacgggtgcgctttccaaaggaggaaagatacgcggagtcgccaccaatgtttatttgtggaaaacgtcggaaaaaaccgaaggaaaccagccacaacgaaatttctaagttcaggagttgtatttatgtttgaggaaggtattagcacctctcacatttgtctcaaaggacaacaacctattttttag

SEQ ID NO: 7169 - DNA, 441 bp, Glycine max
  misc_feature (395)..(395): n is a, c, g, or t
  Peptide Sequence Number=SeqID_98854
atgaactcgctaagcgagttcatcaatactcattgtatgaaagtagagctttatcacactgagctagatgactttaaggatgaattggagaggcgtaatttccataaacgcctcaccaatttagtcgatggaagcatagacctgactttggggaaagagttctatgcaaatttatacagttatgaggaccgtccaccaaagcagtccaaagtcagaggtcatttggtgaagattgatgctgacagtctcaacgcattcctagagacacatgtggtattagctgagggagagactctacccgcatactccagatactgcatgttgcctatggacttcagagagatagaggttgccttatgcatacctagccgagggttcatcttgaactctgaggnccatcctgggaagattctcatgaaggatttgactacattggcttag

SEQ ID NO: 7170 - DNA, 264 bp, Glycine max
  Peptide Sequence Number=SeqID_98855
atggatcattttaaggtccaacgccttaaaaggaccaccttccaagtgctaataccttcctcaaacgtaaatacaactcccgaatctggaatattcttcatgaccggtttccttcggtttttccgacgttttccacaaataaacgttggtggtgactctgcgcattttcctcctttggaagacgcacccgtgagcttcgcctcgctcgcccgcaaaagggtaggttgcgacagttggcgactccactggggactgtttttgtga

SEQ ID NO: 7171 - DNA, 636 bp, Glycine max
  Peptide Sequence Number=SeqID_98856
atgccttgcttctcagagggctacacgccctccctagaggactatacacgtcctcgccttaagagggctacacgccctcgccttcagagggctacacgccctcgccatcagagactacatgtcctcgcatcatcgcccacagagggctacacgccctcacctttagaagattacacgtcctcaccttcagaggactacacgtcctcggccttcagaaggctacacgccctcgctttcagaggactatatgtcctcgcctttagaggggtacatgccctcgccttcatagggttacatgcccttgccttcagaaggttgcacaccctcgccttcagagggctacatgccctcaccttcacggggctacacgccctcacctttagaggactacacgtcctcgccttcagagggctacacgccctcgtcttcagagggctacacgccctcaccttcagaggactacacgtcctctccttcagaggactacacgtcctcgccttcagagggctacaccccctcacctttagaggattgcacgtcctcagcttcaaaggactacacgtcctcgccttcagaaggctacacgccctcgctttcagaggactatatgtcctcaccttcagaggggtacagtga

SEQ ID NO: 7172 - DNA, 649 bp, Glycine max
  Peptide Sequence Number=SeqID_98857
atgacgtatctccgtttgttatcaaaccctcaagccatcatagcagaagtgagactttttcgcggtcttggccggaagacgctgacatctccgagaagggtgcagatgactacattggtctctgcgtgtcaacgggctcgcttgcctctagttgatgaaagtgagacttttttgcggtctcggccagaagacgctaacatctctgggaagggtgcagatgaccacattggtgcggatagccataaggtatctctgtatgctaccggacccttgagtcacgatagcagaagtgagactttttcacggtcttggccggaagacgctgacatctccaggaagggtgcagatgaccacattggtgcggataaccataaggtatctcttcatgctactggaccctcgagtcgcaatagcagaagtgagacttttacatggtctcggccagaagacgctgacatcttcgggaagggtgcagatgaccacattggtatggataaccataaggtatctccgcatgctattggaacctcgagtcgcgatagcagaagtgagacttttacacggtcttggccggaagacgctgacatcttcgggaagggtgcagataaccacattggtctctgcgtgtcaacgggatcgcttgcctcta

SEQ ID NO: 7173 - DNA, 735 bp, Glycine max
  Peptide Sequence Number=SeqID_98858
atgatcggccctctcaatgagtcaatctcatgttttctcacaagggtggacctttgggtactagaacctattgccttcaaaggaccaagcgtcctcgccatcagagggctgcatgccctcaccttcagaggattacatgtcctccccttcagagggctacatgccctcaccttcagaggactacatgtccttgccttcagaggactacacgtcctcgccatcagatggctacatgccttaacctgtagaggactacacgtcctcgcctttagaggactacacgtcctcgccatcagagggctacatgtcctcaccttcagagggcagcacaccctcgccttcatagggctacacgccctcacctttagagaactacgagtcctcgcccttagagggctacgcgtcctcaccttcagaggactacatgtcctcgccattagaggaccacatgtcctcacttacagaggactacacgtcctcgccttcagagggctgcatgtcctcaccttcagaggactgcacgtcgtcaccttcagagggctacacgccctcacccttagaggactacacgtcctcgccatcagagggtcgcacgccctcaccttagagggccgcacgccctcacttcagagggctgcactccctcaccttcagaggactacacgtggggatcctcttagagtcgacctgcaggcatgcaagcttggcactggccgtcgttttacaacgtcgtga

SEQ ID NO: 7174 - DNA, 309 bp, Glycine max
  Peptide Sequence Number=SeqID_98859
atgtcatcttcctgtagagatagagcgcaaagcctactggattcctatgagaattccaaattctacaaggagaagaccaagaagttccatgacagcttgatagctaagaaggactttgtggttggacagaaatttttattgtataactttaggcttggactcatgagcgttgagatcaaaagtgaatccacagataagagcttcaaggtcaatggacaccggctgaaaccattcctcacaaatccctccttagtgaatgtagtggtggaggagacctccttacttcaccctacttctcttctgccatga

SEQ ID NO: 7175 - DNA, 216 bp, Glycine max
  Peptide Sequence Number=SeqID_98860
atgactactaatgactgccatgagctgtcgttccttgccgccggagcacggcatagggatgaacactttaatcaaagcagaatcttcaaaatccacctcaaggattggtttcttcgagaaaaatacttgtacttgggggcatgtcactcggtttggaactttcttgagactcaggttgatcaccatagggggaagttgcctggttttcctaactga

SEQ ID NO: 7176 - DNA, 243 bp, Glycine max
  Peptide Sequence Number=SeqID_98861
atgtcggaaaaacgggaaaggtgtggtctacgaactttaagtgtgaaaggttcgggagttgtatttacgcacggggaaggaaaaagggggaggaggttgccgcccagctcgcgcaggcgagctgggttgcttcctctagaagcaatcctgcttcaaaaatactctggaaggcccaaattcaaaatttcaaaaattgctatttgcaccccctattttgataagttcaccccccttctttcgtaa

SEQ ID NO: 7177 - DNA, 717 bp, Glycine max
  Peptide Sequence Number=SeqID_98862
atgcacgttttcacctctctctctctctctctctctctaaactctagcccaaaaaccctaacacctcctcgtccaccacccacgaccactggtagctaccatgagcatccgttgcttgtcgtcataccaccgtacaaagatgaacgctttaatcagagtgaaatcttcataatatacctcaaggattcgataaagaacaaagctctcaacccttttttcgttgtttcttcgaggagtgcgggcccaatgaagaacaagaagaatggaccccaaaatcaaggaaaaccataccagacccctcctaagcaatatgataaagacatgacatgcttcaattgcaaacaaaaaggccatattcagagagatcacccatatcccaagaatgagcataatggtgggggtctaaatgaccaaactagacgtttgaaggccacgagaagagtcttcactcttgatggtgttaaagcttcgaaatccaaagatataatccaaggttccactcaagaacttataaaggaacataaagtggaaaaagacaagattgcatcaaaaagggagaagcttaaaattcctaattttcagatgaagcgtaacctagaggcatatcttaagtgggagatgaaagttgaccaaatctttgcatgtcatgagtatagtgaagagaagaagattaggttggctatcttgggctttgatgacaaagcactcacatggtag

SEQ ID NO: 7178 - DNA, 294 bp, Glycine max
  Peptide Sequence Number=SeqID_98863
atggtaaccaagaagaaccggtacatccatagtgacaaaattgttgtggaagaagaggatgctaatattactctcattcttggacgcctattcatgtctactgcaagctgcgtggtagacatgggaaataagatactgcaaatgggcatagaagatcagaagatcaactttgatttgttccatcaggacaaagatccacctagccaaaatgtttgtcttaaagtgcatgtgatggaggaaaagagacctgagaagaaggtccttgaagtaggaactttgttggatcctgaataa

SEQ ID NO: 7179 - DNA, 601 bp, Glycine max
  misc_feature (8)..(8): n is a, c, g, or t
  Peptide Sequence Number=SeqID_98864
gatccccncggctgttaggatccgaaaaaagaatgccgaactaagagacgtcaacatagccaccaccaaggccttagagcaagagaccaagagggccagcaaggaagaacatggccgaaacaagttccgaggggctcagtggggcagtaacaacgaacttaagctccaaagagaggaaagagaccaattgcgattagatggcataattctgaaggacaaattgaagacttgcctaaggtcaaaaaggagtttgtctcagcagttatgtgagaccgaaacaaacatgttggccatcatcagccagtacaaagaagaattaaatttggccaccgcccacgagcacaaagtggcggacgaatacgcccaagtgtacgcagaaaaggaggctagaggaagagtgattgactcattacatcaagaagcgacgatgtggatggaccggtttgctctcactttaaacgggagtcacaagcttccccgattactggcaaaggccaaagcaatggcggacgtgtactccgcccccgaggaaatccacgggctcctcagctattgtcagcatatgatagacttgatggtccatataattaggagtcgttag

SEQ ID NO: 7180 - DNA, 534 bp, Glycine max
  Peptide Sequence Number=SeqID_98865
atggcttctagaaagagaaaaagtattggttcaagacccacagcgcagtatgacacaaggaaattctcttccttagatgcttggacgagatacacagataatgttctggggagaaacattttaccagagaggaaagtagaaatatatcattatgagctagatgagtttaaggctgaattggaaaggcataatttccataaatgcctcaccaattttgtcgatgggagcatagacctaactttggtgaaagaattctatgcaaatttatatagtttcgaggatcatccaccaaagcagtcgagagtcagaggtcatttggtgaagattgatgctgatagtctcaacacattcttggagacgcctatggtattagctaaaggggagaccttacccgcttactccagatattgcagattgcctacagactacagagagaaaaaggttgccttatgcatacctggccgagggttcatcttgaactcagagggccatcctgggaagattctcaggaaggatatgactacactagcttag

SEQ ID NO: 7181 - DNA, 306 bp, Glycine max
  Peptide Sequence Number=SeqID_98866
atggggggtgaagtgaccttgttggatatccttggtgggggaaatataatggttaaagagtttgaagcatctctggagtgggatgacttagaatctttaattatccatggtcagtgcattgatggtgcccatgtttcatacttcatattgcatggaaatagtacaaactttgttagctatttccttggggatggtaccatgtggttggtacctgtgatgatcgcgagcccttcttcatgggagcataatgacaacagtagagtacaggaagcgagattcttttgtggagccgccgagccgatgtga

SEQ ID NO: 7182 - DNA, 207 bp, Glycine max
  Peptide Sequence Number=SeqID_98867
atgatggcacatcaggactaccagagacaactatcatcaaagagaaaaactctagatgaggtttcactgtcaatcaaagcaagtcggagaactcagcatgatcacagattcacctccatttcctatgttcccacggacccgggtatagggccctttttcaactcaccgtgtgtgcaaaaagtgttggtgtttctgtgcatcaaatga

SEQ ID NO: 7183 - DNA, 210 bp, Glycine max
  Peptide Sequence Number=SeqID_98868
atgcggctaccgcaagagcccttgaacaagaaaccaagagggctcacaaggaagagcatggccgagataaattctgaggagctttgtggggcagcaacaatgagctcaagctccgaagagagatccaagaggagtttggcccaacacttggaagccacggagcaaagcatgctagctataatagggcagtacaaagaagagttaaactag

SEQ ID NO: 7184 - DNA, 282 bp, Glycine max
  Peptide Sequence Number=SeqID_98869
atgttaatcattcccaacttggcaataaatttaccaaaaatcaggcttggaagtgcttttgtaaaaacatctgcaacctgtgggttgtttcttagaacgccaagaaagaaggatatttcccaaaaagacacaaaagccagaagtggatcttctggtatcaacacagctggcccaatcagcatccgcaaaggcagtgaggctgagagagttctgagcagggaaaaacaaaccttgtctaggagcagatttgatatactacagaagatgatgaacagcatgtag

SEQ ID NO: 7185 - DNA, 309 bp, Glycine max
  Peptide Sequence Number=SeqID_98870
atggatcgagttacatcgctgctgcgtctactgccaaacacatttaggacttttgatgtccttgttacttccagtttcaccttgacgaagatgtcatggaccataaaagaacatgttttatggcacccttaccgaactcgtgctagagctagagtaacgggtgaagcagaggaggtgcaagagcagatgaaggccgacatggaggccatgaaagagcaaatggccacaatgatggaggccatgatgagcatgaagaagataatggaagccaatgcgattgcagttgtcgctaccagcgttgttgctaag

SEQ ID NO: 7186 - DNA, 366 bp, Glycine max
  Peptide Sequence Number=SeqID_98871
atggcattcttgggagagacaagcagacagacagttgtgaactccacattaggttttatttttccaaatggatccattgttcacaacgacagtggtgtttcctttcaagcttccactccagttcccattcgaatgcctaacaagtgtgattttcaaacgctaaaaaccagaatacacaatacccttaagctaaccaacaagcaatttttggatgaaatttactaccggcagcctttcacatatgcaggaaaaaatcccaaaaagtttgacattcccactggatgtacaatggatgaactgaaggatttgatcaagcaagttgcgcctcctgggattcccccttatggtattgatgaaatacaaatg

SEQ ID NO: 7187 - DNA, 123 bp, Glycine max
  Peptide Sequence Number=SeqID_98872
atggagacctcagccggcctacggcgggctgccatggccaaaacacccaagactgaaacaggggaaacgtttaatggaaaaactgaaacaaaacacacattaaacaaaataccaggacactaa

SEQ ID NO: 7188 - DNA, 513 bp, Glycine max
  Peptide Sequence Number=SeqID_98873
atgcagatgctccagttcctgtacccactgatgagcttggccgacacatctggtcaagtctttatcacagcagttgtgtctccgacaaaaccacctccgaagcccgatccggaggtcaatgatccgctttatctgatgagattgaccatcccagagcttttcttgaggccttatcaggttagatgggatgcctccgtgttcggggtctttaatccagatttccccctctacataaagcacgaagacctctccgaaatcgcacacggtggtcaatgtctcagcatatcagtgcatctcactaaaacatgtatgcgagtggggaattctgatatctatcgattcctcgagccacagttcattcagaggtctgggcaatcgcagtttgagtctgaaagttacataaagagttggatgcagagttcacaatgcgatgtctatcttggagcctacctaaatgggttccactgcagcggacactggcagatggtggtcatcctgccaaggaacacctag

SEQ ID NO: 7189 - DNA, 666 bp, Glycine max
  Peptide Sequence Number=SeqID_98874
atggccaagttcgaccctgagatagtcctagagttctacgccaatgcctggcccatggaggagggagaccagcagtgcgagttcagccagaagagttaccaggcctctggctttgatgaggagaccatcgcccagctgttgtgcataccagggcaggactttgcccggaccgctgtggggaggcgggtgtggatcatgcgcaccagcatgactactctgatccagatatggatgacgctgctactcagcaacattctgcccaacgaccataactctgacctccctctgcctaagtgccaactggtgtatgccatcctgacacagatgaccgttcatgtggcccagataattgctgacgccatttatttgtttgcagggacggcgcccactaggcaccctttggacccgaagaagtctaatagggccctggggtttccggccttgatcacgggcctctgccagttttacatagtacctgtcacccccagcaaggtaatccgaccaccaattacccgagctttcatcgagaaatattgcacccctaggcaggcacaggggggcgcacaacaggcggccaaccaccgtgggcaggggccggactccactccttttgtatgccctaccccagagcagttcggggctgaggtcgcgtggcctggagactag

SEQ ID NO: 7190 - DNA, 414 bp, Glycine max
  Peptide Sequence Number=SeqID_98875
atgaccatgattacgaattcgagctcggtacccgagattgtcaaagccttgctcagtaaagatcctcagttggctcggaggaccgacaagaaagggcaaactgcattgcatatggctgtaaaagggcaaagttgtgatgtggtgaaattgcttcttgaggcagatgctgctattgttatgcttcccgacaaattcggtaacacggcgttgcatgtggcaaccaggaaaaagcgagtagagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 7191 - DNA, 168 bp, Glycine max
  Peptide Sequence Number=SeqID_98876
atgggtgccaagtacctcgaagcggtcaagcaaaggttgcatgccatcaaacaatggtccccggacgaaattaggctagtgctcaagttaccaaatggattcatgtcggcagaagcaagaccaagccgtaggtttcttggttcctctccaaattctggatacaagtga

SEQ ID NO: 7192 - DNA, 1860 bp, Glycine max
  Peptide Sequence Number=SeqID_98877
atgagtcaatttgagaatgcatcgatcgtattgaacagccaccctgatggcgccgctacgctggaaaacttcagattggagaccagctcgttgaggccattggatccaggagagtttctggttgagaacaaatggttatcgatcgatctctatctccggccacggctcaataaaagcaccaaatacgtgagcccgataaagctgggggaagtgattcagggagaggctattggggaaatcgtggcttcgcgtaatcctttgtttaacgttggcgatcgcgtattcaccttctccggttggcaaaagtattatatcggtgatgctcaaaacttcactgttcatcgtttgccggagacaacattaccaccttctatttttctcggtgcggtcgggacgccgggccgatcggcctatttcggtttaaacaaaatcgcgaagccaaaaccgggtgaaacattggtcgtttctgccgcctcgggctcggttggctccgtcgttgggcaattgggtaaactggcgggatgccgcgttgtgggattggccggcagcgaggataaatgccggtatgttgtggaggagctgggttttgacagttgccttaactacaagactgccgaccttaaccgggatttgcgcgccgcgtgcccccagggtatcgatatctattttgagaacgtgggcggccgcgtatcactgtttgtcgccaagttgctgaatgagggggcaagggtgcctatctgcggtaatgcggccaattacaataaaggcactgatgttgatgcatccggcccggcggactttttctctgccctgccggatgcgcctttaaatcgtttctttttggtaaccgaatggttcaaagactacgccgaatcagatgcattcttgttaaatgcggcagaaaacgggtttctttattggttgctttattggcgctactttcaaaccaccgacaatgcttacgtgcaagcagacattacaaacgtcagcgcccgcatcagcgcggtggtggttaactctatgattcgggacaatcatcgggtgaataagggcgacttgttggctcagttggacgacagggagtttgttgtcgcgttgcagaaagcagaggcgactctggcgcaaagtcgggcggcgttaacgaatgcccaggcaagttatcaaatgcaaaaaagtgctattgacgagtttcgcagcgatgtgaattctgctgcagccactctgcagtatgcgcatcagcagtatctccgttttcaaattttgcagaaaaagaattatgtttccaagggagacatggataacgccacatccagttatcgcgtcgcagaggcaaaataccaccaaacgcaagcgagcttgaaaacgcaaagcgataaactccaggtcttgcaaagcgaaattgagcaaagccaggctaatgttgaacaggctcaggcaaacctggaacaggcgaaattgacattgagttacacgcggattattgcgcctattgatggggtaatcagcaaccgtagtttgcaagtgggtatgatggttcaggcggggcagtccattgccagtatcgtctccggagcggccccatggataagcgccaattttaaggaaacgcagaaagcacgtatgcgtaaaggattgcctgtggaggtgaaagttgatgcgtatccagggaaaatatttcatgccagggtggatagtatctcaccggctacaggagcaacttttgctttattaccaccagacaatgcgacagggaacttcaccaaaattgtccagcgcgtcccagtaaaaattgtttttgactctccgcaacaaatagacagcggcctttcggcctctgttacggtagatacgcggggatag

SEQ ID NO: 7193 - DNA, 273 bp, Glycine max
  Peptide Sequence Number=SeqID_98878
atgggcagggctccttgctgcgacaaagcaaacgtgaagaaaggtccatggtcaccagaagaagatgctaaactcaaatcgggtaccgagctcgaattcgtaatcatggtcatagctgtttcctgcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 7194 - DNA, 431 bp, Glycine max
  Peptide Sequence Number=SeqID_98879
atgactagaggcaatccatctgacttacaaccctttgatcttgagatagataggacatttcatagattagttaggcagcattttataccttttgagcatcctgattttgagcattctgagaacatggcacaacctccaccccgtgagaggactctaagggaaatggctgcacctgatttcacctatgaaagcttgtgcatccaataccctgatgagggtgttccatatgttctcaagactggactaatacatttgctacctaagtttcatggtcttgcaggtgaagatccttataagcatcttaacgagttccatattgtttgtttcaccatgaagccccctgatgtccaagaagatcatatctttctaaaggcttttcctcattctttggagggagtggcaaaagattggctatactaccttgctcccag

SEQ ID NO: 7195 - DNA, 435 bp, Glycine max
  Peptide Sequence Number=SeqID_98880
atggccccaaggaagcttgtctcaaagagatccaggaaagacaaagcggctgaaggaaccagttccgctcccgaatatgacagccattgttttaggagcgctgagaaccagcagtgcttcgaggccatcaaaggatggtcattcctccgggaaagacgcgtccagctcagggacgacgagtatacggacttccaggaaaagatagttcgccggcagtgggcatcgctggttacccccatggccaagttcgacccagatatagtcctcgagttttatgccaatgcttggcctacggaggagggtgtgcgagatatgcgatcttgggtgaggggtcagtggatccctttcgatgcggatgccctcagccagttcctgggatacccgttagtgctggaggagggccaggagtgcgagtatggccagaggaggaactag

SEQ ID NO: 7196 - DNA, 180 bp, Glycine max
  Peptide Sequence Number=SeqID_98881
atgatgaaggacacttaccggtttgatggacttcaaacctatgttggtgagaggtttgactccttggaatgtcaagtggacacacgatttgaggagatgaactcaaggattgcaaaggttgaagaagatgtcaccattattcgtgactgccttgatttacctccaccaccatcaatttag

SEQ ID NO: 7197 - DNA, 234 bp, Glycine max
  Peptide Sequence Number=SeqID_98882
atgaaaaagacgatagcgcgcgcatgcctctcccttatcactcttgcaactcttggcacgacttccgcctgggctcaagaactgaccattcctcaaaagaatgccgtgcgctcggccaagcaatacctcagtttttccggattctcacgcagtggcttgattcagcagctgtcgtccgacgcgggtgacggatacaaggttgcggatgccacaatcgcggtggacagcctcaag

SEQ ID NO: 7198 - DNA, 288 bp, Glycine max
  Peptide Sequence Number=SeqID_98883
atgggggtgtatttagtaaaaaagggtgtgcaaatagcaaccaggcccacttgggccttccagggggttccaacaaaaggtggtgccttctggtggaagcaacccagctcgcttgggggaaagagggcagagtatattcgttcatcccttctgaaaaattgtttccgtgaagaaaatccacgccgaagcactttcataacgtttccgagacgtttccgtgagcgatttcgagaagattcttcaccgttcttcatcgttcttcgtcgttcttcggtcttcaaccggtaa

SEQ ID NO: 7199 - DNA, 345 bp, Glycine max
  Peptide Sequence Number=SeqID_98884
atggagtgcctagagggactttgggagaccctcgaaggcaatgcgagaggaacccgcacgcacgcttcagcgaactgtggagtggatattacctacacctactccatatcgactagtagagcccgtcaagtgatagaggtgtcgtcatctgaagaagaccctgaggaggacccagaggagttacctcctgagcctgctgtggatgctcttgactttccagagggtgatgaggacccacttcctgatgtggattctccagaggacgtcatgtcagcatctgaggcagactctacggaggagagcggcgctggagggatagcgactagtggagactcttcatcatag

SEQ ID NO: 7200 - DNA, 221 bp, Glycine max
  Peptide Sequence Number=SeqID_98885
gtggccttgttggtgcttgcgcgcttagtgcaactttggctcgcttagcgcgcattagtgaatttcggcttagcgcgcgtcttttcgctcaacggatggactcaagcggtgcacttagcaggattagccctcgctcagcgaacatacatagctcatccttcttccatatgcttcctcgtgctcggccaaaggagtgttgcactcagcgaatggcttgctaa

SEQ ID NO: 7201 - DNA, 381 bp, Glycine max
  Peptide Sequence Number=SeqID_98886
atggcgagagcccaagagaacggttcactatggagaggcctgaagactgtgaatttcagagagcatagagcagagcaaggggccaagttttcatcttttagggagattagtgagtttttgagagattgtgagattccaagaggtggaggagtcatccccactcctttagggtacatctacttgggttgtaatactgagaacaagagagggtatatctcttgtggatcagttcaagtggagggtacatccacttggttgttcaaagagaacaagggagggtacatcccttgtggatctttgcttgtaaaggattttacaagggactttagcattgggaaatgcactatttccttagaacatgatagagcagggactgaataa

SEQ ID NO: 7202 - DNA, 762 bp, Glycine max
  Peptide Sequence Number=SeqID_98887
atgcaaaccatcaacaacaaagaatgcagtgcaaaacagaaggagaagactcacaaagtgccaaagcagaaaaattcagaagctctccctctctctcatgcagccttcttcttctcttcttcctccaccattgttgcccaacaaagctccaacctttggccatcatttctgctccaaatcgcgaaaggagggcattttcaggaggctaagatggtctctggcttgaaaacgaggtcaggaagccatgagggcttctggcttagaaaggggactggaacattgtggaggcctctgagggatgggtcattggtaatcgattaccagatcgtgatggcagcgcaactaatccatgatcgagtagagatggagtgcctagagggagcctgggagaccctcgaaggcaacacgaggtgccgatttcggggcaccattcgattcacggctacttctttggtgcatccagatgaacctgcacggacgcttcagcgcacggtagagtggatactacccatgcctacaccatatcgtctagtggagccagtccaagtgatcgaggtgacgtcatccgaggaagaccctgaggaggatctggaggagctacctcctgagcctgccgtggatgcccttgactttctagagggtgatgaggatccacttcttgaggtggattctcccgaggaagtcatgtcggcatctaaggcagactctacggaggatagtggcccgggggagatggcgatcagcggaggctcttcatcatag

SEQ ID NO: 7203 - DNA, 506 bp, Glycine max
  Peptide Sequence Number=SeqID_98888
ggccctgggatttccccgccttgatcacaggactctgccagtcgttcggcgtccccgttgcacctagcaaggtgattcggccgcccatcacccgagcttttattgagaagtactgcacacagagacaggtccagggtgatgcaccacaggccacggacgcgtcgccacctcatcaggctggtccagccgaatcgtttgatatggagcggtatttgcggcatttggttcgccagcaggcagccaaccaccgggctcatgtacagacccatgattgtctttatcagatgagtctcagcctgcagagccagggctttacttcttttccgtgccctactccggaccagttcatggcagaggtcgcatggccgggagattggcttgaggcccaggcaggagaggcaccagcaggggcaccagcagaggctcccgacgaggcagatgaggcccacgaggatgaagagatgaccgatttacttgatttcttaggagggagcggggccacatga

SEQ ID NO: 7204 - DNA, 324 bp, Glycine max
  Peptide Sequence Number=SeqID_98889
atgggtgccaagtacctcgaagtggtcaaacgagggttgcatcccaacaacggatggtccccggacgaaattagggtcgtgcagatgagggcgcacagtgtatactcacgtcaaagcacaaggggatcctgcaggctcctcccctgcctgggcatcgggccagtctccaggccatgtgacctcagccccaaactgctccggggtagggcatacaaaaggggcagagccctgcccctgctgactgaggctgaaccggtagagacactcatgtatctgtacctgcccacggtggttggccgcctattggcgaaccaaattctgtag

SEQ ID NO: 7205 - DNA, 109 bp, Glycine max
  Peptide Sequence Number=SeqID_98890
ggcggggatggaaaaaccccgtcatcatgcctacttgaatagcagtggctctcctattcaagagacacagggttaccactgttcaaggcttgtcagaaccatttgcact

SEQ ID NO: 7206 - DNA, 807 bp, Glycine max
  Peptide Sequence Number=SeqID_98891
gcgtcgggcaaggagctgccggaagctggtcgactcgatccgcgcgcaccaggcccaggggtatcgggcgatccgggtgcagaccggggtgccgaccctgaaagcgatctacgggatcgccgcgcaaggcgcggacgtcggcgacgcgacggtgcgatacgaccacgagcccgcccggcgcggtgcgcgaccggtggaggaggactgggacacccgcgcatacctgaaccacctgccgggggtgttcgaagcggtgcgcaacgagttcggccccgacatcccgctgctacacgacgggcaccaccggatgacgccgatccaggccgcacgcctgggcaaagacctcgaaccgtacgacctgttctggctcgaggactgcaccccggccgagaaccaggaagccttgcgcctggtgcgccagcacaccaccaccccgttggcgatcggggagatcttcaacaccgtctgggacttcaaggacatcatccgcgaccagctcatcgactacgtccgcggcgcggtcacccacatgggcggcatcaccgcgctgaagaagaccctcgactacgcggccatgtaccagatcaaatccggcatgcacggacccaccgacatctccccggtcggcatggccgccgcgatgcacctcggactcgcgatccacaacttcggcatccaggaatacatgcaacacggcgcgcgcaccgaccaggtgttccaacagtccttcacctggaccgacggatacctccaccccggaaacaaccccggactcggcgtcgacctcgacatcgacgaagccgggaa

SEQ ID NO: 7207 - DNA, 246 bp, Glycine max
  Peptide Sequence Number=SeqID_98892
atgtaccctctcttgttctcagttaaaacaacccaagtagatgtaccctctacttgtaccacaaaggatgtaccctccaatgtgttaagacagaattttcaggcggttagtcctttgaatccttgtaaggggaaacaaaagatatctcaggcgattagtcctttgaaatcttttgtttatgggaaagggaagaatcaaaagaattctcaagcggttagttctttgaactacctggggatgctctag

SEQ ID NO: 7208 - DNA, 186 bp, Glycine max
  Peptide Sequence Number=SeqID_98893
cttaagattgtgtctcaacatggtcttttcatcgtgcgagcccgatttggatatctggggcaagacaaatcgtgtgatgcaatcctccctaggaagggaccaatcactagaaccatgagcaagaggctccaagaagattgggctagagctgctgaagaaggccctagggttctcatgaaccttagg

SEQ ID NO: 7209 - DNA, 171 bp, Glycine max
  Peptide Sequence Number=SeqID_98894
atggaccctaagagaataaaggtcattcctgattggcccactccaccaagtgtcgaggaaaggagcctagagtatgaagaacctctggatttgaggtcaaatcctttccaaggtggaggggacctagtggatggcgccttttctcacctcttctcctttgtcttccgctga

SEQ ID NO: 7210 - DNA, 492 bp, Glycine max
  Peptide Sequence Number=SeqID_98895
atgaagagatgcttatgcgatgcaagatatgaatgcatttacggactcgagggcccgaaaaattatctcttcttacttgcgcatttgggggtgcagtgccccatgcgtgccattaagaaggtgatatggaccttctggcttctcgtgacaaaagacaagaccaacatacaacgcatgcgtgacaacatgatgcagatgcgcaaaagcgcaactggggatgcacacagcatggcaatatcctcaaataatcatacaacaaaggcgtacatgacatttagattcacttccactccttatggtcctgtcgcaacctaccctttggcgggagggcgacgcgtgactcgcgggatgcgtgttccacgaaaggaatacgcgcggagtcgccaccaacgtttatttgaggaaaacgtcggaaaaaccggaaaagacgcgatctatgaacttttaagtgaaaggttcgggagttgtatttatgcacggggaaggtattag

SEQ ID NO: 7211 - DNA, 306 bp, Glycine max
  Peptide Sequence Number=SeqID_98896
atgtcgcagaacttcacggattgcctaacgatgggtgttaagtacctcaaagcggtcaagcaaaagttgcaggctatcaaacaatggtccccggacgaaattaggggaaagggaagaatcaaaagaattctcagactgtgtcgttttgaattctttgacaagggagaagggagacacaacaaaattcaggcggttagtccttcgttcttttggaaaagggagaagagagacacaaaaaaattcaggcggttagtccttggcgaattctttttggcaaagggagaatggaatgaaaaagaagaatag

SEQ ID NO: 7212 - DNA, 405 bp, Glycine max
  Peptide Sequence Number=SeqID_98897
atgatcttagaggaaggacaaaggagtaatttgagcatccatcctggtgctaccaagatgtatcaggatttgaagatgatgttttgggggctcaacatgaagagagaggtggttgtcatcatcaaaaagggggagaatgtaaatcatgaagattttgatgatatcaagaagaatttgcttgagaaagggggagatgtaaatcatgcaagctttgatggtgtcgagaagaaatcacatgtttgtcatcatcaaaaagggggagaatgtgaatccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 7213 - DNA, 243 bp, Glycine max
  Peptide Sequence Number=SeqID_98898
atgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacggtgaatgctgtgaagattttcccagacgcccaaaatggactcggatga

SEQ ID NO: 7214 - DNA, 585 bp, Glycine max
  Peptide Sequence Number=SeqID_98899
atgggtgaccaagaggaggtacaggaacagatcaaagccgacatgtcaactttgaaagagcaaatggcttccatgatggatgccatgctaggaatgaggcaactaatggagaagaacgcggccaccgctgccgctgttagttcagctgctgaagcagacccaactctcccagctatcgtgcaccaccctatcccagacgtggtaggacaagaaagaagcacactggggcacatcagtaacccccatctggaatacaaccgagtggcttacccttatggattgacacctaattacacaccaccagtcatatgtgatgacgcgggtcgtgtccctccccccatccttgaaggagaacctcctcgacagtcggacgaggtccacgaggatcgtcgggagcatgcccaaggagacatcaattcccactccccgttccccgccgaggagccggcgcttaatgcactacctcagcccaacctcatgggaaaacctcgaaacccctcagcacagccaatattcttttccgcatacgagccacccccggtagccaagaaaggaggaagctcgatctcatcgaaaagagattga

SEQ ID NO: 7215 - DNA, 108 bp, Glycine max
  Peptide Sequence Number=SeqID_98900
atgaaacacagctccaaactcgaaggtggagggcacatgaacagcgcaatcatgaaacacagctccaaactcgaaggtggaggacacatgaacaacgctaggcaatga

SEQ ID NO: 7216 - DNA, 330 bp, Glycine max
  Peptide Sequence Number=SeqID_98901
atggcaaccaaaggaacacgaaatggaactgtcgcaacctacccttcggcgggaaggcgacacgagggctcacggtgcatcttccaagggaggaaggcgcgcggagtcaccaccaacgattattcgaggaaaacgtcggaaaaaccggaaaggtgtggtctacgaactttaatcgtgaaaggttcgggagttgtttttacgcatggggaagggtgtttccctcgctcctacgtatcctcaattgcgaagaggaaatcaaacctatgtagttcttttagaactaaacattggttaagttgttttgatctttttccacaagatcgattttaa

SEQ ID NO: 7217 - DNA, 278 bp, Glycine max
  Peptide Sequence Number=SeqID_98902
atggatttcaacagtgatgatttcatggacaaattgcgtgaagccttaaggaacgttgacatgagagatgaacgatggaggcctagaaggggtgaaccacgtccaaacgtggatgagttcaaaatcaccgaactacctgaatttaatggtagtgcagacccggaggtttatctagaatgggagcgcaagattgatagaatgtttgacttcaaggatcttgatgatgagaaacgttgcaaatatgctatcctgaaacttagcaaaagtgcatcgttgtg

SEQ ID NO: 7218 - DNA, 310 bp, Glycine max
  Peptide Sequence Number=SeqID_98903
ggatttcctgtctgttgtatctctcgttacaatctttcaaagaaatgaacgtggattcgaggcttttagtcctcacgggcaggatcaccttgggctaccttctggaatggagacaaaacatgaacggcagaaaccaatcaaggtacttaaggatgaacgcaagcggggatggggtcacgaccgaccgatcgttacccttctctgtgcgaaacaagcagggaatgtcgctgcaaggcagcccccgcctaattctgacctaagtaagttcaagttaggcaaaatgctaatccctgagaagggaggggacatg

SEQ ID NO: 7219 - DNA, 387 bp, Glycine max
  Peptide Sequence Number=SeqID_98904
ggatcgcacccacaagacacccagtggacccggtggagcccaacagggccctggggtttccagctctggttacgggcctctatcaatcctacagggtgcccgtcccccctagcaaggtcatgccatcgtgacatagggatcacgcccgcaagacacccaatggacccggagaagtccaacagggtcttggggtttccaactctaattatgggcctttgtcagttctacggagtgcctgtcgcccccagcaagggtgagacaccacaacaacctggggatggccggcagggggcaacagacgcaccgccgccacctccagagcccctcagctcatctacaaaggttggagcattgcctacaacccgtggccgaccagtaggagactaa

SEQ ID NO: 7220 - DNA, 397 bp, Glycine max
  Peptide Sequence Number=SeqID_98905
gaatcatccccttcgaaaaacatattacggcagcagggactaccagcaacaatatgttatcaaagagaaaaactctagatgagggttcactgttatcaagcaagtcagagacccagcatgatcacagattcacctccactccttatgttcccatggacacgagtatagggccccttttcaacttaccgtgtgtgcaaaaaggtgttggtgttgtgaaaaaggaaactgatgaaagggaaaacacaacttttgaacaaaagattaataggcctaactctctaaaaacaatccccagcggagtcaccaactatgtcaacctacccttcgctgggagggcgacgcgagggctcacgggtgcgtcttccaagggaggaaggcacgcggagtcaccaccaac

SEQ ID NO: 7221 - DNA, 822 bp, Glycine max
  Peptide Sequence Number=SeqID_98906
atggagctagtaactgctgttcttggagaccatggacagcgtccccaagaagattatgcggtagttacagcagttactgaactgggcaatggaaagccaaagttctattcaactccagagataattgctttctgccgaaaatggcgccttccaacaaatcatgtgtggttgttttcaacaagggttgcatcagaagtagtggatatttctacttatgtttgtaagaaaaggtttgtgactccagcttttatttatataacgcttctttcttcgctgcctatgatgccttatgtgaggagggtactgcaacttctgtatgcaaggctcttgatgaaattgcagacatctctgtaccagagcctcgtttcaatcctcgtttcttctttcatggcttccgcttccattcctcctccccctcctccgccgttgaatggtggaactctgcttggttctgcggtggttgtcactgccaaagaatatttgcactccatttcgcagaagttaaccaactccaattatctcctctggtgtcaacaagttgaaccagtgctaaaaggtcatcacctctatcatcttctcgcaggactacaaattccaccacgacatctcaccatcgccgattgcaatgctggtattacttcttcttttgggagcaacaagatcagcttcttctgtcgtggttacagtccactatttctggtgaagttcttccacgactcgtcagatgcaaaattgcttggcatctttgggataagcttcatacacatttctactccattgttctcaacaacagttccatttctgactatttttttgggataa

SEQ ID NO: 7222 - DNA, 2061 bp, Glycine max
  Peptide Sequence Number=SeqID_98907
atggcttctccttctccaccgaaatcgaagttcagtgtctatcaaaatccttccttttctgcggttctcacttccaacagtcttcaaccttccaattccacaatcctctccatcctctccttcttctctgcctccgcattcgtttttctcgctgccttcttcagggaaaacggcttcgtccacattttgtgctttggaactttgtcccctgtcacagcttattggcttgccaagacgctacaagctatagtgggttttatcttcattggaactgtttctgcactcttcaacgttgtgtttctgcgtagagctaggtatgctggcggaggtgctgctgttgcggctaagtctctgtctgattctaacagtgttcataggaatgagattttgctaaccaaacatcaattagggcttttaggagtgaagccaaaggttgatttggttcaacctgactcggcgaagaagccccccaagtctaaaccccaactgccttcttcaggtttgctggttccccttcaccagccaattcccagtcccactcgaggttcttcgtctcgcattgatgccgatggttcaaactctaataggggtggtgctgctcgttctattggtactccatcaaggtcaccaggtttggcgtcgttgtatctttcaccgggtgtggtttctccacctaggagtttggctggcgtggattcggtggtttcgagtccttggtctaacaggcgagtctcctctgctaacaagataacgtccgaggaaaagctggagagattcttagctgaagtggatgaaaggatcaatgaatcagcggggaagatgtctaccccacctcctacagttcctggttttggcattgtgagccctagtacagttacaggctcagctaatacctcaggaactgcaaggcgtacaccactgaggcctgtgaggatgtctccgggctcgcaaaagtttaatactccccctaagaagggtgagggcgagtttcctgcaccaatgtccatggaagaatttgttcaagcttttgaacatcttggcatctatcctcaaattgaacggtggcatgatcgactcaggcaatggtttgcttcggttctgctcaatcctttgcttaacaaaatcgagacaagtcacattcaggttatgcaagcagctgctaaacttggtatttcaatcacgattagtcaagtgggcagtgatatgctgtctactggcatcccttctgctttgccaacaattgataagaatcaagagtggcaacctgcactgtctctcaatgaagatggattacttcatcagttacattctactcttgtgcaggctatagattcttccaaatccaagttgcttgtatctaatatgcagcagtctccacagcagacttctttagtttctatcatgcaggattgtgtggatgctatcactgaacaccaaaggcttcaagccttggttaaaggagagtgggttaaaggtttgctacctcaaagcagtgttcgtgctgattacactgtgcaaaggatccgagagcttgcagaaggaacatgcttgaagaattatgagtatcttggaagtggggaggtttacgataaaacgaataaaaagtggacacttgagctaccttcggattctcacttgctgttgtatctgttctgcgctttcctagaacatccaaaatggatgttacatgtggatgccatgtcatatgctggagctcaatctggcaaaaacccattattcttgggagtccttcccccaaaggaaaggtttccagagaaatacattgctgtagtgtctgctgtcccttctgtgctgcacccaggagcatgtatactagcagttggaaagcagggtcccccaatttttgccttgtactgggataagaaactgcagttttctcttcagctatggatttgtcagggaagaacggcactttgggattccatcttgcttctgtgccataaaattaagatcgggtatggaggtgttattaggggcatgcatttaggcgcttcagctttaagcattctcccggttatggaagcagaatatgaagattaa

SEQ ID NO: 7223 - DNA, 420 bp, Glycine max
  Peptide Sequence Number=SeqID_98908
atggagaagcttgcccaaatacggtttcagtccaggttacattcgttcccttcttttcctctgtcccaaaacactccaagtgacggactgacggtggcggcgctcggtggtgacggcggcgccactctgttcagcgacctaacatcgataaatgacatggcgttcagagggaaagagatgttgaagaaagttctgaagacagtgggagagaacggtttgagtcgaagagaaaaggaatcgttggagagatgcttgcctcgaagcaagattgtgatgaaccgcgccaaacgcggtctcttcgccgggaaacacattcagtttgggaaccgtgtcagtgaagatggcggtaacaataatggtggaatgttccatgctgtagccactggtgttagatcagtttttacagcttctgttgtttag

SEQ ID NO: 7224 - DNA, 534 bp, Glycine max
  Peptide Sequence Number=SeqID_98909
atgacattctcggtttgtggaaagcgtattgtgcgaggcgcagttgacatcgagaagggtgcagtggggctccgacaagatgctgaaggccgacgcgagctccgacgggatgatggaaacgtggtcctcgatgccgcagtgcctgtcattctttgtccaagaaatatctttaacaaatacaagaacaaacatatattgaacatcattcaaagacaactagatctaatggacacagaaaatcctatgtattcccctcaagggattcccctcaagggataccagaatatatttgcaattatcccatcattgtgcaaagaggagggatacataggatctaaatatgctattgaccaccttaattgccgccatgtatatgccttgtgcaccgatgcatcaaaagtgaatttgtacacagtaaaaagcacgtcacttcaaagcgggatccgtccaatcagagtcattcaaaagactcatatatcacatgttacagtgtatgcaataaatgcgatccttatcttgttacggaaatgttag

SEQ ID NO: 7225 - DNA, 225 bp, Glycine max
  Peptide Sequence Number=SeqID_98910
atgtctaacaaagctttcaaagatggttatttgttattaaccgtcttggaaaataaatggcagcggaatggagaaaggaagagagagaagagacgtcacttcaaggagaagatgagtctagaagaagctcaccaccataggaggccatggataatagcttggaggaagaaggagatgaatgaggggagagggagagaagagcacgaaattttgtgctctaaatga

SEQ ID NO: 7226 - DNA, 930 bp, Glycine max
  Peptide Sequence Number=SeqID_98911
atggaagtgagaaaaacaaaaggcaaacatagcactttaactatttatacttcattcttgttgttgctgagagtagatgttatgacagagttagctctcttaaaagggaggtacaaagagagattagacaagtgtaccaactttttaaacatagtgagcatttcaaatccactatacagtcatgttcaagaagtatatgaagaaaggtatgagcataggctaattgatgagatgctggcatatgcagtcaaaagtgaaggtcgatatgtttgggcttgcaagaattatgatggtcatgtcgaaagtgatttacttgctgaaggtgtcgtaactggagcagttacaactcctcttgatgtagtaataaagaccagattgatggttcagggatcacaaaaccattacaaaggcatttctgattgtgtgagaacaatagttaaagaagaaggaagtcatgctctttttaaaggtattgggtctgagacttccgtttatccagaactggctaacttttttacatttgcattgtcaatgctttattattttggctttatgtgcaagatttacaaacataactacttcatactaggatcctgttgtagagaaagcgcatgttactacattggtgcctacctcaccaacaatgtagaaaattcaagttacaacatcagtgccttagccaccactgatgtagaaaatccaggttactacatcggtgcctacctagccaatgatgtaaaaaatccaagttacaacatcggtgcctcagctaccaccgttgtagaaaatccaggttactacatcggtgcctatctagccaaagatgtagaaaatctaggttacaacatcggtgcctcagctaccaccgttgtagaaactaaggtttctacgtcgaacaaatgggtagcaccgtattcaaaaacaatgtaa

SEQ ID NO: 7227 - DNA, 258 bp, Glycine max
  Peptide Sequence Number=SeqID_98912
atgtgcgaggtttctaggtttgggaaagctttaaaaaggataggggaggcatcttttcagttgttgaaaatgtttcagacgcctcataatcgattgcctaaggtggtaattgattacatgttcagacagagaaagttgatgcaatcctatcccgcaagggcattgggtagaagactccaagtagattgggctagagatccaagggaaggccctagggttctcatgagccttagggtatattttgagcccatgggctaa

SEQ ID NO: 7228 - DNA, 1590 bp, Glycine max
  Peptide Sequence Number=SeqID_98913
atggagaatcttccctttgacctatcgcacaccatatacatcaacatcttgagaaacttgaaaggcttgggtggtctggatgacatctattatgctgctctcatcaacaagatgttgtgtgatcaaggcatgtatcatgtcttcaacaagatggacaatgattataagcatactctaatagccaagggttcagttgttgctaaacaacaaaaatttggaaaaactaacctaaaagttatgaaggttgctctagaacaaagtcaaaataaggctcctcaggtggacttggatgccataaacaagaggaagcaaaaaaggctaaccaaagccattactaataaagatcaagggcttaacagttttgggatctccaaaaaaatacaaaagataatggtgaaagctaatccaaggaaaccctttatagatgcacaaaggtttcttctagcatttattaatggtaattcaatgtttgaaactccctactctgaattcatctccattgcacctgttcaaagggaaaccatcagtgtccaagctactacatggacaaagtgtgactatgagcactcgccatctgaggcttttaaggctctaccaacatatgccataattcatcttccattcccacaatggacttgtccagtgcaactaaacattatcaagatgcaaccacattggcttgcacctggcactcagcaacgagttcatccttcaatagagaagaaggtgcatctatggacactaatcacaaagctcttactagtgcctccaacagatcttaacctatctcaggaagaccgcttatctcttagcaacctccatgcacaaatgtatgtgagagatcaatcccctgcctaccctgttggtctgcacatctcaagggccactgatgtcaagatagttgttgacaaggtgtgtccacgtctacctatttgggatgctaccaaaaagaaaggattcaagttgtacaacaacaaggagattcctttaagaaagatgaaagtggaaacagtcaatcaccttcataattgggattccctattcagcgggaaaaggcttgtttatgctcctggtgcttatgaagccaggaccttttggaatcagatcgtatggatggacactcagaaagcctccacttttggttatgatgtaagtggaaatgttgagcaccacgacatcattcaaacattacatccagttaggaaaaaatgcttccttcgtccagaagcatctactaaagttatggatgacaccattgtgcatggggtcatcatcaatcttatcaacattggtatcatggacgtaactcctaagacatccgatgcagccatagttgatgaagttgaacataatgctctagagcctagatccaaggatcaagtgaaagacatgatagggcaagcaatggaatccttcaccaaattccagcgtcaagaaaataagcaattcaggctctccatgaagaacgccatcaccactcagttctccaatcttgttgttgttgcacctgcacccgtacttgtacctccacctccacctcctccatcttcaccttcaccttctcaacctcaaccaccaccacatgcttag

SEQ ID NO: 7229 - DNA, 528 bp, Glycine max
  Peptide Sequence Number=SeqID_98914
atggggtgtacccatgggcccgaaatctaccctaaagctcatgaaaaccctaaggccttctcttgtatctctggcccaatcttcttgttgtcttctatccaatgcccttggggggcaggattgcatcagtatgtctacttagcagcaagatggaggcaatttaagtctacactggccactaaatttgtctatgctgacactgagggtcaactccagcaacaagatccttctgtaaaatatggtctcgatcaacaaacttgggaagaatttgctgcaagccgcaagaccgcaaattggcagaactgtttacagggacaaaccacgcaaggtacctttgttccccatggtcgtgatgacatactaactactacaattggaagaccggagcacccaggtcgtgttcgtgcaacagggtccggtatgacaataagtcattattatggaagggcatcacatggctctagcagttcctcaacctccatcacccaacaacaactagctgacattattggaaatcttaaggaataa

SEQ ID NO: 7230 - DNA, 561 bp, Glycine max
  Peptide Sequence Number=SeqID_98915
atggactggagcggtgtgcttagcgagatggccctttgctcagcgaacatgcacatctcatccttcttccagattcttcctcgcgcccagccgaggagtgttgcgctcagcggatggctcgctaagctgacaggttggcttagcaagagggtgaaaatcaacactatacaaactcgcttaattaacctgaaaaacctcacaatcactcacagactcatctcatgctctccagatggcttcctcttcaagctcagttctctgccagtcttcggacaacaaaagctctcaaaactctctggaacttggacctttctctctctagaaatctctaaaaacacagaagctcaaggaaaagcccaaactccctctccatttctgatttcaggcttaaataggtggccttctcatccttcttccaaattcttcctcgcgctcagccgcaagagtggtgcactcagcggatggcttgctaagccggcagattggcttagcgagcagatcaaaatcagcacttcacaaacttgcctaattaacctgaaattgaaaggaaatgattattaa

SEQ ID NO: 7231 - DNA, 156 bp, Glycine max
  Peptide Sequence Number=SeqID_98916
atgactctaagacagcatagattaagcctaggatcttcttcatcaatggattcctttgcttcttggaggatgaatgacagtggaatggagaaggaagagagagaggagatgccacttcaaggagaggatgagtctagaagaagctcaccaccatag

SEQ ID NO: 7232 - DNA, 1998 bp, Glycine max
  Peptide Sequence Number=SeqID_98917
atggaaattgatctgaaccatgaagtgactgaggttgagaagaatgcattctgtgatagggaatgtgagaaaggtgttggtgttacttgttggtcctcttccacttgttcatcctctacttcttcctcttcagcgcttgtgtcctcttcttaccttgagctttggcatgcttgtgctggccctctcacttctcttcccaagaaaggaaatgtggtggtctattttccacaaggtcacttagaacaagttgcatctttctctcctttcacaccattggagattcccacctatgatcttcagccacagatcttttgcagggttgtcaatgtccaactacttgccaacaaggagaatgatgaggtttatacacaagttactttgcttcctcaagctgagttggaagggatgtatttagagggcaaagaacttgaggaattgggagcagaagaggagggggatgatagatcaccaactaaatcaacccctcacatgttctgcaaaacactaactgcctctgataccagcacacatgggggcttttctgttcctcgccgagctgctgaagactgttttcctcctttggattataagcagcagaggccatcacaagagcttgttgccaaagacctgcatgatgtggagtggaaatttcgtcacatttacagaggtcagccaaggcggcatctactcactactggatggagcatttttgtcagtcaaaagaatcttgtctccggtgatgcagtgctcttcctaaggggtgaaaatggtgaactgagattgggaatcagaagagctgttagacctagaaatgatcttcctgaatcagttattggaagccagaactgctatcccaatgtcctttcttctgtggcaaatgcaatatccaccaaaagcaagtttcatgttttctacagtccaagagcaagtcaagcagactttgttgttccctaccaaaagtatgttaaaagcatcaagaatccagtgagcattggaacaagattcaaaatgagatttgaaatggatgaatctcaagagaggaggtgttgtagtgggatgttgattggaacgagtgatttggatccttatagatggcccaaatcaaaatggaggtgcttgatggtcagatgggatgaggatattgagactaatcataaagacagagtatctccatgggagattgatccttctgctcctctgccccccttgagcattcagtcttccccaagactgaagaagctgcggacagcacgaggcagaggattgatagactttgaggagtctgtaagatcacccaaggtcttgcaaggtcaagaaaatgcaggttttgggtcactctactacggatgtgacacagtaaccaagccaccaggttttgagatgagctctcaaagtcatccaaatcttggatcagctgaagtaagaaagattacctcttctgagctgagtagtgtgcaccctttcagttatgcaggctttgtggaaaccaacaggtttccgagggtcttgcaaggtcaagaaatatgtccattgaaatccctgacaggaaaggttgatatgaaccttggtgcttggggaatgcccaatcttagttgcacaactttcaacctccaccaggcaaccaaaccaagctttcaactttcattgtttccttacggggatattcaccaagccagtcaagctagcttgttttgctcgaaatccaccactttccagagagagaatgtcccatttaacaagccatccactcaggcagggatcattgtaaatgaagttggaagatcagatctcccaaatgaccataagctgcagggcaataatatttctgctgctgggaatatgggggtttctattgacaacaatgtccagggaaaggtaaatgcctgcaaactattcgggttttctttgtctggggaaactactacccaaaatttgcagaactctgctaaaaggagctgcacaaaggtgagggatgataacaacaaaattatgttatga

SEQ ID NO: 7233 - DNA, 576 bp, Glycine max
  Peptide Sequence Number=SeqID_98918
atgaacggcacccgcagttacactcactctgaaaagaaaaatctaacgggtatggtttcgaataccggatttcgtgatccagatcagatccatgatcgcgaagaggaatcaaacggtggcgccggaggaacgatagcggtagagcttgccgaagacgtggagcgcggtgacgaagccgatgaagcagaggctcatgacgagcaccaccgtgggggagatcttgaggcctggagcgtcgtcagtatagaaccgcagcatgttgcttcctccggcgccggagcctccactgacggaggcggagcttgttcctccgccgaggcgacgacggcgcatgccggcggtggcggcagcggtgccgcgaggagccatcacgcccggtcgcgtggtggcatgggacgctgtggattgagattgggaggcgcctctcgccatgtcgaagatcacgagggaaaagggggtgtcgtcggagaaagaaacagtgttgggagtatgggatcaatagaggcacagaattatttatgttgccaaaagttatgtttatttaatatcatttgcttgacttatccacttgtttaa

SEQ ID NO: 7234 - DNA, 825 bp, Glycine max
  Peptide Sequence Number=SeqID_98919
atggacttctttactgttgctaaagcaccggcaaaggcaccctcattggctccagaggcgcctaaagaggataaggagaagtcactatccccagattcctcagaatcatctgagattaattccacaaacgacaactctggcactgtgaaatcaatttgcatggaaatgtctcccaacggtgcccctacacccgccaccgcaaaagctcctacaattgacattgctcaaatcctgagtaaagccaaaagattttctgttctgattcggcttctgaagacgacccagttgatcaaccaactcaactctcaactcctcacatcaggttccgggggattgaccattttctccccacctgattctgccttctcgaagctaaaagcaggcttcctaaactcactcaacgacaagcaaaaggtggaacttttacaattccacactctttcttccttcgtctcaatctccaacttcgacactctcaccaacccggttcagacccaagccggtgacgatgctcaaaggctgcaacttaacgtcaccacttacggaggaaaccaagtgagcatggccacgggtgtcgttaacgccactattaccagcactgtttacttggacaacaagcttgccatttatgaggtggacaaggtgcttcttccacttgacgtcgttcttcctaagccaaaggctccagcaccttcaccgtttaaaggagaatcacctaaaacgaagtcatatacagaagaaagtggtgatggtaacaaaaatagtgatgatgatggtgctgttacggtaaacgcttctgctggttccgtgaatttgatcaacaac

SEQ ID NO: 7235 - DNA, 519 bp, Glycine max
  Peptide Sequence Number=SeqID_98920
atggctatttattggaaaaagccattttggggtaaaggaagctcgcccaggcgagctggttgcttaggcacgaagccatttcatggcctaggcaagccagatgctagcctgggcgagctaggtgccaaaggagtcatcgcgctaagcgagctcaatgcgtttagcgcgcatcaacagctaagcccagcaccagcgtgcttagcgagtaaaggggaatctggaaagacatatgttacgcaaatacgcgctgagcgcgttatcagctcgctaagcgagtcgtctcgtgagaatggcgctgagcgcgacgtcaagatcaagaagccttttttgagcctgatttgcacagaattgaggggaagcgaagagaactattcaatactcaaatgcctgaagagtgtgaatttcagagagcgtagagcagagcaaggggccaagttttcatcttttagggagattagtgagtttttgagtgattgtgagattcctagaggtggaggagacatccccactcctttgtaa

SEQ ID NO: 7236 - DNA, 1188 bp, Glycine max
  Peptide Sequence Number=SeqID_98921
atggagtggttacttgatcctgagtcacatcgtaactgcatcagtgacccattggagaaacttcctgatgcttctcttcttttggatgcacccactgtctcatctaatctaatgagtgctagtgaccacttctctcgagttgccgctgctcaagctgaaaatgcttcacggaagcgagactcaaatggaatggcatcctctactgttcgtagtaaagttcccagagcaaacttgccccattcaaggaatgttccagaaacttctggtagtatgctagttccacctcagatcagtggaagtattattattcaagtatctgagtctcaatttggtatcatagcgggtcaatcccgctctgcctggtttccgctgccagccattgtctccagccaccgtccaccgccgatgtttatctggcaaacaccagatctagagtgcctttctgagcgaggcagaacccaagtggtcacaggtcctatttcattcccacgtgcagcttttgtacaccaccttgctcctggtccctttttaggccctgattcgtcgtttcttccgtgtttggtttgtgggtttgaatgtaaccctttcttggtcttgggtctgatcttcctcaccatgcctaacaagaggattactagaaaagaccatattgaatgcacattttgcaagaggaactgggcatacttggaaaaatgcttgaatttatttggtatccctaacaagacaacagatgcatccaaactcaagagagccgagcctaaattctctgatgaagaatatcaggaatatctaaggttaaaagccagcagacaagctcaacctcctttaacctctagtatttcaacagcttgcatttctcaatctatggacattcaaggtccatgggtgattgacaaaggtgcttttgatcatatttctggtgatgcatctttgtttacctccatgtcttcccaaaagtttcctcatcttataaactttgcaaatggatccaatgaaggtggtacaggtcttacaattggagtaggacgtgagtcaagaggactctactatctggaaacaagttcttttgtgtcctgtgttgctgctccatctcctaaacttcttcatgatcgcttatgtcatccaaatttgtcaaagttaaagcaaatggttcatgatctcattagattacaagtgttaagagtgtga

SEQ ID NO: 7237 - DNA, 699 bp, Glycine max
  Peptide Sequence Number=SeqID_98922
atggatgatggaaatgctgagctttctgataagctttcagataataatgttctatttttgaatccagagtcatgtagcagttttcaggcttcaagtagcagcagaacatgcacacacactcacacttgcaatccacctggccctgatgctgctcatacacacacatgctatcacacacacacccaagtttttgcaccagaagatgatggcaggaagcactcaaactccaagcaaaaaaggccttctggaaaccgagaagcggttaggaagtatagggagaagaagaaggcacacacagcatacttggaggaggaagttaagaaattgcatatggtgaatcaacaactagtgaggaagctacaagggcaggcacttcttgaagcagaattagcaaggttgaggagcattttggcacgacttaaggggaaaatagacagtgaattgggtgcttggccctttcaaaaacaatattgtaacacttcttacattttcaaagaaggggatgctggtcttgagtgtcagaagaacaatttgccatgcttccatccacatgtaggatcatcatcccaggtcaacatttgtgcatgtggaaaatccatgattccattggatggaaactgccaacctgaaatgccagacaaaaatgtctttcttgtgagtttctatccaattgctatcacagatgatttgtttgtttag

SEQ ID NO: 7238 - DNA, 419 bp, Glycine max
  Peptide Sequence Number=SeqID_98923
atgcctagagatggagggatctacaactcatgtagcgcccccaatgatggagaaggaaatgatcacaatgataatagacactttacatgtgttctgctacaagaagatggtgggatatatgccctcgagttttgcagatctgtactcgcatggccaaaatccccgcaaacccctcacaaccctatgtatcagtatcccccgcaccaatataattactcagccaatatcggatctcccccctgcccaacgcccttccgaccgagaatgcctaatcaaccacaaagacctccccaacatcacccacaaaatccattccctacacagcccaaaccgagtgcaaatcccaacctcaatacaaacaccaacccaaggaggaacttcccaaagagaaaacccgtggagttcaccctaatcccaat

SEQ ID NO: 7239 - DNA, 168 bp, Glycine max
  Peptide Sequence Number=SeqID_98924
atgcaagaacaaatagaggaagcaaaagaacatcacctagatgaagatgctctgataccacataatgtagctccatgtagagcttgtaggacttggatcttcttcatcaatggaatcctttgcttcttgaagatcagtggtagcaaaatggagaaggaggaaaggtga

SEQ ID NO: 7240 - DNA, 1617 bp, Glycine max
  Peptide Sequence Number=SeqID_98925
atggttgagcctcaacatgttcaagggttgcaggtttgtcaagaccccccagcctggacaagtgttgtccaggttgctttgtatggggtactcatgcttgttgttctacaggaaaattcagagtgcgcattaaagagggacattctatttctctttgttgcgagcggtttcgcatggacattcttggtgaagcacgtcggacttcctggtgatgatgtgcctccttctaccgttgagcctcttgtaggaaaaatgggtcaacttgctactaggtttggccctgatgatgatgaagctgttgagcatgatgacggggttggggtatccgaacctaagaagtcaagtgtggaagcaatgccttccaagaacaagagagggtacatctcttatggatcagttcaagtggagggtacatccacttggttattcaaagagaacaagggagggtacatcacttgtggatctttggcttgtaaaggattttacaaggttgaaaagaaatctcaaaaatcgccatttgatccaacatcaagggctcccttcagtctccaagaccttaaactggtgaccgggttgatgtcagggctgacccgttcaccttctgtttccttggtcatccaggctactattgctgctctcactccttcgacaccttcttccttgcctactcaggaggtttctgtctccctatctaccatggttgctgcactagtccctttggccgctcctatcatggctcctccttccatcactgttacacctttgcttagtgttggtgtagtgactatgagtactttggtggtcccacctccttcttcttccacttcaccagtttcaacttcatttgtgttgtcgttggtgttgccttccttctcttcttgcccagtgtctccctatatcatggtttcctctttagagactaaggttgcagagtggagggccactactcgaacaatatggagagtgaagcatcccaaggtggtcaatgttactgtcacccttgatgaggccactcggcattataaggacttgctaagagagaaaaatgacttgactgacaaggtggagagcactattgtagagaaggaagagcttgttgttgagtctattaaggtgattactggtctccgggcccagttgaaagagtcagagtccaagcaggaggagtttgagctcaaggcatcgaaggggaggaaggccagtaaagagcttaaagaggagttgttggagttcaagaaggaagccatggagccacacaagaagggcttttacaaggccgttaggcaggtcgggttcttcacaaaagatcttaacttgggtctttttgacccatttaaggacttccaaaggagtaagcttaccaagggcatgccttgggtttctataggaattcttaccaaggatggaccttgggtttcttgtgttcctacaaagataaaagttgataataaagaagcttgtcaagggtggaccttgcataccttagattcccgcaaacaaggctcaccaaggccggaccttgggtttgatgagcctttggagaaactagactcaccaaggggggaccttgggtttgatgagcctatggataatccaccagggatgcatcaatcctag

SEQ ID NO: 7241 - DNA, 1137 bp, Glycine max
  Peptide Sequence Number=SeqID_98926
atgcagcggaatctgacagtggtcacgaataattggtttaatgaccttcctcaaccaaatcaccttcttccttatgggaccttcgttttctcttcagatggggagaggagaaactgtttgttgatttggtatattggagaccataaccctgccttgtgttttaaacctattagggaactaactgaaatatcagctttgacacagttgttacttgctaacaatccactactgtctggtgaaattccaaaattcagtgaacatgttgaagttgtatcttctgaaactggcctgggaatatctatcagtggcagttctcattgcaatgttcttgttggccttgtcatcctgctcattgtgtcagtgtcacgacactattacagggttaatgatgagcatttaccgtcaagagaagatcatcaacatcctcaggtcatccaaagtaacttattaactcctaatggaatacacagatcaagcattgacttctacaaagccatggaagctgttgttgaagcattaaaagatgttactctgaaaacaaggttttcaacttattataaggtcatcatgccgtccaaatcaatctattttgtcaagaaactaaactgttctgacaagatattgtcagtgggaagtcatgataaatttgtgaaagagctagaagtgttggcacatttgaacaatttaaatgtcatgactcctttggcgtatgttctgtccattgataccgcttatatactatatgaatatatctcaaagggttccctctttgatgttcttcatggaagtatggaaaactctttagattgggctagtagatatagtatagatgttggggtagctcaaatactgcctttacttcatgaatttgcctctagtccaataatgctccttgatttgacaagtaaaagtattatgctgaagtcccttaaggagcctctagttggggatattgaacagtacaaggtgactgatccctcaaagagtacacggaatttttatgcagttgttggttctgttgattatattcctccaaatcagaaactcttcaaccttatattccttcctattagtttgtcatatatgttcatccaccaaagactatataaatttttaggggcaatgggggttaaatag

SEQ ID NO: 7242 - DNA, 432 bp, Glycine max
  Peptide Sequence Number=SeqID_98927
atgtttcttttaccttttgttttcaaacccccaacaagaaagaaccacaacttaggaaccaacatgagttttcattcttcatctagtgttaatgagcttaactccttgtgctttgttggtgcccaaaataggtattatgaggcaccgaatccctatgataggtggtataatgaatgtgttagtggtgcaaccctcttttgtaaaatcactcatgcatccagcatcttcatgattcacatgcataggaactcattaggtagtgatcaaggggttcccacgaaccctaagagaataaaggtcattcctgagtggcccactccaccaagtgttgaaggaagaagcccagagtttcaagaacctattgatttgaggtcaaatccttttcaagggggagggaatggtgcaatcctaccccccaagggcattggatag

SEQ ID NO: 7243 - DNA, 655 bp, Glycine max
  Peptide Sequence Number=SeqID_98928
atggagtggagagaagtcagaaggagagagatgaggcgtcgttctttctctaagcatcaatctacatggaggcaatcaaacaaagtggtaggtcgatggatgggtcataaggacgaggatggtgaatacctcaaactttacaagaggggtgtggaagttgacgacagagaattctcgactaatcatgggaagagagatgaggaaaacaaatgggtgatataccaatattcagagaaggcgggtcatagaggtgcccatgcacaccttgggatctcttacactaattccacaaggaagatcattccaaagtttgacactcatgggaggagagagttcctttatgttgaagaacccattgaaagtagggaatgtcttaattttgcaagatttttcaatcgtatgaatatgaaggatctcgtcaatactatgattagagttcatattaccaaggacatctttgagattaagctagttgaagaagaagtagaggattgtgcaaaccgccttctatgtagaaaatgtgcagttagtctggtgatgaatgtcgacactaatgacatggaagatgacttcgatgagtcattcataaacggggatatccaaaggtttttggcgaaggatttgaaattgaattcaaatttgaatttcaaatctt

SEQ ID NO: 7244 - DNA, 351 bp, Glycine max
  Peptide Sequence Number=SeqID_98929
atgcaagggtgttggaaaacccgaggggacgcacccggaactggaaaactcgaagagcttgccagtgttggagaaaactatgacagcaacctcggcgtcacagagaatggaaagttcctgagccttcttgaacaaccctgttctccgcttcgagaacgtgacttgtctgctgctagcattgtcgattcttttgatctcgattttccctcgacccattggctttattttctcgctctctcagaaatgcgcaaacatgcccaactgaacgaggaattaattagaggtggtggtggtgctttgggaggagaagcgaattcagggttgaagatacgaacgaagacactaagttaa

SEQ ID NO: 7245 - DNA, 2613 bp, Glycine max
  Peptide Sequence Number=SeqID_98930
atgagtgacgaaggagaaagaacttgtcctctctgtgctgaagagatggatttgacagatcagcaattgaagccttgcaaatgcggttatgagatctgtgtctggtgctggcaccacataatggacatggctgagaaggatgacactgaggggcgatgcccagcatgtcgatctccttatgataaggaaaagattgttgggacagctgcaaactgtgacagattggtgaatggagttaatattgagaaaaggatgaagactcagaaaacgaagtctaaatcaactgatgggcgtaagcagctcagcagtgtgcgagtgattcagaggaaccttgtttacatagttgggttgcctctcaatcttgcagatgaagatcagaactctgttagcactgtaagaggttcacctccaaatggaatatatgggaaaaatatggcccttcctactagtgctgcatggggtactcaggtcacaaattgtcagccccctgctggaggtctatcatatccaaatgggccatccaagccaaaacctgatacaggcagcagcacactggtattttctgcagctgttacaggctcaattcaggcttctgatgttacaaagaggccaccatcgagtaatgggagtcatagtatgacacctagagtgaaaagtgaattgttgaaacctgtcaaacaatataacaatagtgtggacagtctggttagtgaaggagaaaaaactttagcttctgatgtttctcctatgcttgtgaatttgaacaggcagttgtctcctctaccgttgtcccgagatagtgatggaaattgtactacagcaaacacaataaattctactaacatgattggacagtcttgtaactttggtcttgaggaagcaatgactgctaccaatgaagagattcagaatttgtccaacgagttgtcctcaattaacattgatagaaatgccgaacattgcggtataaccaaacctaataatagcccacctactgatcatgcattgattaaatctcctcaaattcaaggatcacagtataatgttgacagatttagagatgaaataactacagatgtggctggtaaagctacctcagattttttggtttgtaattctactgaacagtgtgattggaaattggattctcaatctctagtagtatcagataatgctgaaattgatgatgatgtgacatcttttgataatcaaagactcaaggatccagaagttgtttgtcgttcttattttccaaagtcaaccagattcctgcaagcatcaaaccattctagcccttgtcttctgcagcatggtgaaccttgtactgccataaatgcaggttctgtatctgctgatgatagagttcgagatgaatctatgttacatgcatccaatatattatgtaatggtcaccctgaaaaattggtcagcagcagctcctatggtctgcttcatgatgaaagaaatgggcatatcattcaaagattagttggtgaagcagttaattctggacatgatattgctagggataaaggtgaaagtagtataatttctaatatattgtccatggactttgatacctgggatgactcactaacatcacctcataatttagcgaagttgttgggtgacaatactgataaccagcctggtcctttaaacaaatctagttcttggaaaggtcacagtaacaatcaatcaaggttttcttttgcaaggcaggaggaatccaaaatccaaatgtttgatccacatgcatcttatggtgtcagccatcaacggccaaaccgtacagtcttcctgaattgtgcagaaagagacttgtatatggataagttgggcattgcaaatggattttctaccagtaactttgaggaagctgagaatatggtcagtggtcattccattgcatcttctaataagttttctgccatctcaagagcacaagtttcagccccgccaggattttccattccaagcaggttgccaccacctggtttttcttcccatgagagagtggagcaggcttttgattccatttctgggaattctttgcttgaccattcttccctcttgagaaattcatatcagacaccttcagctggaaaccttggtagtgcaggggacattgaatttatggaccctgctattatggcagttggcaaagggagacttcaaggtgcactgaacagtccggcactggacattcgatctaatttcatgccacaattaaattactttgaaaatgatgctagactacaattattgatgcaaagatctcttgtaccacagcaaaaccttagattttctgaaattgggaatactttttctcaacttggtgattcctatgctgtttcttcgaggttagaccaatcacaagtcagtaatctaggcccattccaacagctgtctctgcagcagtctacaaatgccgtcttgtctaatgggcaatgggatgggtggaatgaggtgcagagtggaaatggtttgggtgtggctgagcttttgagaaatgaaagacttggattcaataaattttactcaggatatgatgattcaaaatttcggatgccaaattctggggatctttacaacagaacatttgggatgtga

SEQ ID NO: 7246 - DNA, 342 bp, Glycine max
  Peptide Sequence Number=SeqID_98931
atggtgaagccgaagggtccaatggcggcaagtggtggtggccgaaccgaagccaaggaggaggtcgaggttgcggaggccgatgtcggcgttgatggcgaccacgaagaagccaagacgggtgagggagaggctgatgttggcggtggtggtggtcttgcccacgccacccttgctggaggtgatgacggcgacgcggggggtggagctggagagctcaggcttgcgattccactggaggagggtggagagatgacattgggaaggggagagagggagagggagagggagaagaagaagatgaatgatgatgaagaagaagcacaatggtggagtgaatga

SEQ ID NO: 7247 - DNA, 669 bp, Glycine max
  Peptide Sequence Number=SeqID_98932
atggtgtgcataaggaaggcgacggtgaaggaccttctggcgatgcaggcgtgcaacctgttctgcctccctgagaactaccagatgaagtactacctctatcacatcctctcctggccccagctcctctacgtcgccgaagactacaacggccgcatcgtcggctacgtcctcgccaagatggaggaagaaaccaccgactgccacggccacatcacctccctcgccgtcctccgcacccaccgcaagctcggcctcgccaccaagctcatgaccgcagcccagaacgccatggaacaggcatgccattccccctatccccctttcttttcctttagtttccactctttctttttgtcctgcatcagagatcgtgggtgttctccaactcattgggtgtttggtgccgagtacgtgtccctccacgtgcgcaagagcaaccgcgcggccttcaatttgtacacggagacccttggctacaagattcatgatgtggaggccaagtattatgcagatggggaggatgcttatgacatgaggaagcagctcaaggggaagcagcaccaccatcatcaccataatcaccatcaccatcaccaccaccaccacgagcacagtggtggctgttgttcaggggaggccaaggggaatcctgccaaagccacctga

SEQ ID NO: 7248 - DNA, 99 bp, Glycine max
  Peptide Sequence Number=SeqID_98933
atggagaagtgcatcttggttgaaatgaactatgggagtggtggtcatgaggggttgaatttgtttgttgttggttcaagaagtgaattagtggaatga

SEQ ID NO: 7249 - DNA, 639 bp, Glycine max
  Peptide Sequence Number=SeqID_98934
atgcccatcaacacacctcatttcccaacctgtgagaaatgtgggattgtacacggacatgagaatgcacgtcaaggacaagacttcgggaaaaatcagaatcaagggatgtataggcctccacccatgcaaaatcagtggcctagacaagaagagagacaacccaccttccaagaaatcatgcttcaacaatcgggcaaccgtcttgcacaatttgaacttaaccctaagaatgaggatgatgacacctctctaaaagctataaatgacatcctcattgaagaggaccaagcacctaagaaggataagacccctactgatgggaaccaggtgcatgacaaggaagaagataaaaagaaggagatattgatgtctcctaaggcagatgaggatgtccctaccatattggggcgaactttccttagtacaggcttggatgcattcccaagtctggggatgcctgaccctccagagacagttctcactgatgaggaccaagacagggagctaaacctagacatggaggagacagtaacactgctacaaactcatcctagccctaggacatcttattttgagaggttagagtatggaaatggtccaaaggaaaagccctccattgaggaacctcctgaataa

SEQ ID NO: 7250 - DNA, 984 bp, Glycine max
  Peptide Sequence Number=SeqID_98935
atggccaagttcgacccagacatagtcctggaattttatgccaatgcttggcctacacaggagggtgtgcgggatatgcgatcttggttaaggggtcagtggatccctttcgatgctgatgccctcagccagttcctgggataccctttagtgctggaggagggccaggagtgcaagtatggccagaggaggaatcgggccgatgggtttgatgaggaggccatcgcccagttgctgtgtataccggggcaggattttgcccggactgctgctgggagacgggtgcgtatcatgcgcaccaacatgactaccctgacccagatatggatgacgttgctgctcagcaacatccagcccaacgatcataattccgacctccccctgccgaagtgtcaactggtgtatgccattctgacacggatgagcattcatggggctcagttgatcgttgatgccatttatctatttgcaggtatgccacctactaggcaccctttagacccagataagtctaacggggccttgggttttccggcattgatcacgggtctatgccagtcattcggggttcctgtcgcgcccagtaaggtgatccgaccgtcgatcacccgcactttcatagagaaatactgcacagctagacaggcacagggtggcgaccctcaggccccagatgcaccgccgccacctcctcaggctgacccagccgagtcatttgacacggagcggtatttaggggcctctagagtcgccagcaggcggccaaccacagggcgcacgtgcagacccatgactccctatatcagcttagcctcagcctgcagagccagggttttgcttcttttccatgccctactccggatcagttcagggcagaggtcgcatggcctggagattggcctgaggcccaggctgcagaggcaggggaggcacccacaaaggctcctggcgaggcagatgaggcccgcgaggacgaggagatga

SEQ ID NO: 7251 - DNA, 345 bp, Glycine max
  Peptide Sequence Number=SeqID_98936
atgtcaactaaacctcaaaaggaaagcaatggtgacaaggacaatgaaagtgaagaagacgatatctccatgatctccacaggctcatgggtgcgctttccaaaggaggaaagatgcgcggattcgccaccaacgtttatttgtgaaaaacgtcggaaaaaccgaaggaaaccggtcaaaacgaaaattctaagttcgggagttgtatttacgcttgaggaaggtattagcacctctcacgtcgacaaaagcggggctcttgctcctacgtaccctccatcgaagaggaaatcagacctacgtagttcttccttaagagtgaatcaagcgattctttttacttga

SEQ ID NO: 7252 - DNA, 552 bp, Glycine max
  Peptide Sequence Number=SeqID_98937
atgaacaacatgatctcgttgcaacacactacaattaaggcatcttttgagacaagtacacatatgggtggacatgtttttaaagctacctcagacaagagactacttggcatggtatcaagactaagtttttcaaaccaagggttacttgagcctgaagtgagcataaccgaagatatgaaaaccatatccaagcggtttgaagagcttgatatttgtggcaaagttactttgaagaaaaaggtgaaaacaatatgtgctcagaagaaaccgatgagcaagcaacaaagattaacaaagcgtgattcgtcttactgggagtatgttgatgcattacattcttcacagaataatttatggtcattggtgttcaaccatttgcttaaagaacttacaaaatggtctaatgagtatatcaacctggttggtggcatagacagatttgaggaattaaaacagtccctacttgttgatggattatccatggttaccatggacaagtggatgaatataaccgacatgggatatgttattgcatcaaggtatttctaa

SEQ ID NO: 7253 - DNA, 96 bp, Glycine max
  Peptide Sequence Number=SeqID_98938
atgagcggtggacgtgatgaaagtgcaatgtttgagcttggaagggaagaagatgagagttccatgggggattgtgatggtgcaggtgatttttag

SEQ ID NO: 7254 - DNA, 1305 bp, Glycine max
  Peptide Sequence Number=SeqID_98939
atgtcttcaaggcgcgcctgttccacttccccgtcactcaaccctacacacacaaagtgccctttcgaaaccctaaaattcctcctcacactcctagacttcccttccaccaccttcgcatccatccacatctatgatcatgaacctttcagagaacttggcaattcctacctcctcgccggcggcagcgaaggcatcgtcgcttcccaagccaattccatccacgacgatggtcgttcctacatccgattcgagaatataaccttcaggagaaccaaagcttcaactaaggcacgcggttcggtgtcattacacatcataatttttgaggctgttgatcgtaatgatataggtggttctgcttatggtggacaacgggaaatttgttgcagttctgatttagctaagatgagagtttgtaagcaatgggagattattaggagaccttttgcaacaaacattaattgggcagtcattttagatgtacaattcaaaggcagatctaaaactgcaagtctaaattctcagaaagtttctatcacaaagactggaatgtataatttgttttttgtagcttgtgaacccaagctcaagggcatagtaatgagtgggaagacagcatggaaaaacccttatgcgtatttacctagtaggatggccccactaatgagtgggaagacagcatggaaaaacccttatgtttgccttaacatcatttggttttttcaatatgtgagattttgggatgatgtactgcaacttcagcactgtatcataactgtcattgctcttggattgtttgagatgattctctggtattttgagtatgtgaatttcaacaatactggaatgagacctattgtgctcacaacatgggttgtcactgttggggctataaaaaaatcaatatcacgacttcttattctctctgtttcaatgggttatggtgttgtgcgacccactttgggtggtcttacatcaaaggttcttttacttggaataacttactttctagcatccgagaagttctcaaatgcattagcagtaacagtgatctcctcagttgcttggataggatatgaggttgatccttccaacaaccttcctttggagtgtgtcataaggagagtcttcaaaagttccgagagagatgaatgtatatgttgctctgccctgttgacacttcttgactatgaaatgattatgatttgttttaagtgcatacctgtccaaatactgaagagcacaaaagctgatggatggtggatatggagcggacaactagagtattgcatgaggatatga

SEQ ID NO: 7255 - DNA, 426 bp, Glycine max
  Peptide Sequence Number=SeqID_98940
atggagatcaaacaacctgttagtgtgagcatagatgcaactgaccttcaattttatgtggctggagtctatggtggtgagaattgctcaaagaattcaacaaaagtgactcttgtttgtttaatcgtgggttatggttcgatgggtggcaaagactattggattatgaagaactcgtggggagaagaagtgccaagaaggtacacattttttatagttggtaaaaggtttcagagtaggcttttgatggaaataaattatatgctagcttatggatctggtgaagcttctttgaggctactatggagattcagacttctagatatacttctcccatttcaggctacttattttgttcgtggtggatttcgaagacgggacaaaagaaccaattttggtaaccccatccttctttatgaagtttag

SEQ ID NO: 7256 - DNA, 558 bp, Glycine max
  Peptide Sequence Number=SeqID_98941
atggtggtttgtggtagctactggtggttgtgggtggtgaagaagaagcttgggacgttggggaagggttttggaagaaagaaggagaaaggaatggttgttttccaaggctacacgaaaaataacgttcgcaacactctagtgcttttgctctcaagaaaagaagcgtttctcacacacaagaagacatatcgcagatcgcaacggtcagattgtggacatgtgcctatgaacctccagaccaaatttcgagaagatccaacgtgggttaagcgtgcatccatcgctaagtgcagcttcagcgcgcttagcgcgacagaagaatctgccaggctctacgcacaactggcactaagctcaaatccacttactcgcgctaagcgtgagggtggcgctaagggcaacggtacaatgcctagggcacagaattccacagcacaccacagtgtctatttcaggaaaagagctttggaggcagcaagaggagcagcttttgtagagatacctaggttttgtaagcttattattgttagggtttcttctgtaatggctggctaa

SEQ ID NO: 7257 - DNA, 1061 bp, Glycine max
  Peptide Sequence Number=SeqID_98942
atgactctacaggatgtctcacaagcgtgtttgtacatcttgaataacacacaagaggcttattctgcacacttttgtagtgcatcagacaataactcgattgaagccttgatgccttactttggagtcattgaagaaatctgggagcttgattatattcaattcagagtgcctattttcaaatatccgtgtaattcaacattgtcagtggttctacaaggaagaccaattggtatcaatcaccagaatgatgattcaatacttgacatttgtgagatgcctgctttttccacaaaaataccttctatcactgaagaaaacgaggtcgatgaagtatatgcaaattgtaatgatcatgatgaaggtctatgggagaacactcacatgatcatgggaacaccgccaaggtcccctccgcactcagatggtcattcagagcctacgtctaggaagagtaaacaatcaacacggctaagaaggcaatttaagtctacactaaccactaaatttgtgtatgatgacattgatggtcaagataaacaagatccttctataaaatatggtctggatcaacaaacttgggaggaatttgctgcaagccgcaagaccccaaactggcagaactctttacaagaacagacaacgcaaggtacctttgttccccatggtcgtggtgacatactcaatactatcattaggcgaccgaagcacccaggtcgtgttcgtgcaacagggtctagtatgacaattagtcattactatggaaggacatcacgtggctcaagcagttcctctacatccatcacccagcaacaactggctgagattattggaagtcttaaggaagagtggaggaatgagttggaaaaggaaaaaaaacggagcctagagaaaatgaagcaagagttgaaagaggggagcaatgttgatattgttgtcaattcatcaggggaagaacatgttgattatatgatgctgactatggatgatgtggtaagggtcagtgttgaaaaagttgttgaaggtgaagctcaagtcccctttctgacttcagaaattca

SEQ ID NO: 7258 - DNA, 401 bp, Glycine max
  Peptide Sequence Number=SeqID_98943
atggcacgcaaagacaaattatggtcattctgcgcctttccatccaggcccgatcgtgtccgatggcacgcagagacaaattatggtcattctgcgccttgtgtcaaccaagaggaacgaattcggcagtatcaggatgatgttggccgttcggtgctgatcattttcaaaatttttgcaggttccgctggcggggagattgaccggccgaatgggaccatctgtttgttgggatgcgacccttgcttgaccactttgaggtacttgacacccatcgttaggcaatccgtaaagttccgtaacattccggaagccaaagaagggatgattgcgggggtacaaatagcaatcaggcccacttggaccttccaggatcttccaacagaaggcggtgccttctg

SEQ ID NO: 7259 - DNA, 378 bp, Glycine max
  Peptide Sequence Number=SeqID_98944
atggcagtggcatatttcattgatattcaaaaactgatgttgtgttctgatgttaactttgtgttgccctctcttctcgcgcttagtcttattctctgtgatggttcttcaactcctctctatttctctcaccctgactttgactctcgctctcgctctcactctaactctctgtggcggtgcttgaactgctcactcttagcactctcaccctcactctcactctccgctgcaatgcttctcaactctcactcacaactctacgtagtggcgatgaggttacaaaaggtgacccttctttcatggagtgatagaggattatccaaggaggaagactttggtttgggtgggatcaacatggatggaccaatcacttga

SEQ ID NO: 7260 - DNA, 636 bp, Glycine max
  Peptide Sequence Number=SeqID_98945
atggcagaagtagagcaaaccatggcagaattagcaactggtccaggaactgatgtgaggccactcatttccccaaacaccaaggacaaccaaatcaattttccctcatgggtccacaacaacctcaaccacaaagaagagaacccaaagggccattgcaaagctattatctccaccatagagtgtgacgtgggaggtgaagaagaagaagaggtagaagaaagcactatgctagaggaagagatgaaaacacaaaccaacccttcaacccaaagtatgcaaccctcacttaatcctccattcttcaagtttagcaagctaagcatccataagcaaggagacgatgtgaggattgtcaaattcaaaaaatacgtgaagatgctacaaaggaagaaggaggaaccacctattgaaaaactcacatgggacatgctacatcgagatataaaggaggacaagcatattccaatcattctgggcaaatccttcatgagaactgctcatgtaaccatcaacgctcataaaggagtctacacacttagagaggggaagaaacaaatgttctactacattcaagtcattgaagattttcccaatgaatcggctcaccaacaacaccatcatacaacatcttga

SEQ ID NO: 7261 - DNA, 1372 bp, Glycine max
  Peptide Sequence Number=SeqID_98946
tgaaaagaaccaagaaaaaggaaactatctcatcaatccacctcatcctactcctcaagtcatgcatccaaagactatttcttcaaagaaaattccatggaagcccttggagaagaagacaaccatccaagtgctaagggatttgagtgaaacaaaagatgaagctcctctcatcccaaggaaggtcaagggaagtgatcagtatatcctgatgcaatcctatcccgcaagggcattgggtagaagactccaagtagattgggctagagatccaagggaaggccctagggttctcatgagccttaggctaagctctagcttctttaggaatcttcttaaggaagcttctcaaggaggtgagcttagttataagagggcatcctctctaagcttcttatccaaggctcatcttggtggtgaagctccttcttccatggcttattccttagtggatggcgcctcctctcacctcttctcctttgtcttccgctgcatctccatgaccacttgtccatcctctgaaagcagagaagagcctaaaaagaagaagctgacaagtagtgatgattcctttaaaaaaactttcaatgctatacctcaacaaatcatcagaatggatccatcacagaagaatttgtccctttgggttcaatggtcaaggaatgtcaacattttcactttcattacaaggtttctacctagcaattttgttgatctcaatccttccaagattgagttagacatgatagatgatagccacgatgctcacgcttcatggaaccaaactatctggtttgataccaagaaatcatccatttctaattctggagatgttccaattgatgatcacaaggattcaatagaagtattgtgtccaaccaaggtttatcattttgatgataccttcgcatgctttataaaaaatcctgaagatggatttatatcaagattggcaaagctccccattattttcaacaagactatcttcgatcagaacaagatgggtgaagaagagttcactgcctgtgacatgcatgtaatcaatgaactcgatacctttagtgatcaacatggagaggaaactccactcgcgtctaatgttgacaaagcaactgagcaacatccaccagcgtccactcagctagaaccatctaatgaagccactttagcacatatgaagcaatctaaagatattgcacctatcaactacattgctcttgctgttgtgacaaaagaacaaattcaagaaatgatggctcaggccttgctgaagcaacaagaagagacaaaacaggagttgcttaaagaaagaaaaaagacaaaactatatctgcaagcctttgctgaacaacaacagtttgagaataagtag

SEQ ID NO: 7262 - DNA, 339 bp, Glycine max
  Peptide Sequence Number=SeqID_98947
ggtacatctacttggttgttcaaagagaacaagggaggatacatcctttgtggctctttgcttgtaaaggatttttacaaggaaaggaaatctcaagaggcgtggcagaggcaagtggctcgcaaagtcgtggaagtgatggctcacaaaggtgggtggctcacgattcaggaaaggtggtggcttatggaggctcaagtgcaagtcatgacgggaggcgcaggggtttgggtcactatcagaggtgggtggttcgcgagatgggttgttggggttgaaggatgtgcggggctcgaggtcattattggaggtggggtcggggttgttggggttcgttga

SEQ ID NO: 7263 - DNA, 636 bp, Glycine max
  Peptide Sequence Number=SeqID_98948
atggtccatgagaattatgaaaacttggaggcaagtaaacataacttatgggttgaatgtgaacaatataagaaaagcttgaaattctcaaatggtaaacttgaacaatatgagaatctcaaaaagcaacctcaagatgttgttacactccatcaagagattgaatttctaagagaaactctatccaaatttgttggaagcattgaaaagcttaacaaaatgttaagatacaacaaattcccaactgacaaatctggaaatggatataaagggaagaaatatgtaggaaagataagtattgatctctatcctctaattgataatgtatgttttgttaaagggcttaaacaccatctgcttaacataagcctaatatgtgacagtggacttaatgtttcctttagtaaagaagggtgtgtcgtccaagacaaaaataggacccaacttttcactactaagaggaaagagaaacgcgaggaactggaatcagagaaacgatacacaaaccgaggcaagattttagcgtttcaaaggtcagattttttctcactttttgtggctgagtatgggtcaccatcaaaagagaaagtgggcccttttggctccactcaaatggagacatgtggcatagcttga

SEQ ID NO: 7264 - DNA, 1716 bp, Glycine max
  Peptide Sequence Number=SeqID_98949
atgtatacatactcactagtggaagccacaacaagagcggatgatgtcggagttgcactagagctggaactcaaaattgctggagcagtagaggttgaagtgctcacccctgtagcatcaattatccactcacctctcagtcaaaagcatgcaatgacagaacctatctcaagtaatgcaacaaatttgaccaagcatagctcaccaaatgcagaagcggtaacactagaaactgccaccgttgacgacttattcgaaaaggaaaacccagtcccaaaagaagcagtggtcgctgtgcttccaacgccaaatcctgtaaaagacgatcctccactggcagcagaagatgcagcaccagtagaagcaacaggagttgcggaagcactcgcggcagcagaagatgcagcaccagtagcaccaaatgcaggcacagaaggcgccaaggtcgtgctgccggtagacacggtggaggcggtggtggtggtcgtcaccgtcgagaacagcggcgccgaagacgtggtgaacgaaaaagttgaacccgaagagggcctcgaagccgccggtgtaccagaagctgtggaagcagctgaagaagccgaagccgaagctgcattgggaaatccaaaagagggagtagacggctttgcaaaccctgaaaacgacgtcgttgaggccgcggacgaagaagctccggtattagcaaatgcacctgagaacaaaggagagctatttgcagctgaagaagaagcattcaacgctccaaacggcgtcgttgcggctgaagaagatgctccaaaagctgaacttgagtcagaggcagaggcagtactactactactactactaccaccaaacggcgtcgttgcagaagctgttccgctgaatccgaatagtgtcgatgaagatgacgttccagcaaacgccgttaatgaagcagacgacggtgcaccaaacggcgtcgttgaagctgaagacgctgcaccagacggcgtcgttgaagctgaggacgctactccaaacggcgtcgctgaagcagaagacgctcctccgaacagagtcgtggatgtagttgttgttggcgttgaggaagctgtgccaaacggcgccgtaggagctgagggcgttccaccaaacgccgttaatgaagctgagggcgctccgccaaacggcgtcgttgaagcagaggatactccaccaaatagagtagtggaagcagaggaccctgctccaaacagattagttgaaaccgaggatgctgctgctccaaacggcgtcgttttggcagagggcgttccgccaccgaaaggcgacgccgcggcggaggaagctgctgctccaaacgacggcgtcattgcggacgaggaagaagccccagacggcgccgttgcgggagaagagaacaagggggaggcagaagtggcggcaccgaagattgaagaagcggcggcggcggcggatgcgggtgcgggagaggcagaggaagcgaaggagaaagtgagaggggagggcgaagaagacgcggcggaggtagggtttgtggtgaagagagaggaggatccaaatgagaaagcgggggtggagctaagtgagaacggggaagaagaagaagaagaagggtttgtgaaggagaatgcagaagattgggaagaagaagatccgaaggagaaacccgacattgttgttgtgcgctatctctgctttgcctgtttggagtga

SEQ ID NO: 7265 - DNA, 516 bp, Glycine max
  Peptide Sequence Number=SeqID_98950
atggtccaccggggacaccttgaggcggagggagagaagactagtgtgatgctagctggagatgcgtcacgcatcatgtgcgtgaacttcatgtgccagggccctgcaaggggccgggtgcggcagtgttttgagttggttgggcacatggacaatgtggcagtctttagcaatggcaacggttcagggagcctggcatcagatacgaaggctggaaatatggccagatgcgtcgccacgtgtcggaacagttgggcgctcaaatgctgtttggtgcgcaaaggaagcgcacatcgaagcatgacaatgctggtgatggggtcacttgatgggaaggtcatcggaattccgatggtgtacagcggcgcagttgttgaaaaatgcaccagaataggagaaaaatcgtcggaaaaagggaaagtgagtagaaaagttcaccgaaagacaggagacaagaagaaaggtccccagtggagcacgggttttcgttattcctctctctcaagaagaacctaa

SEQ ID NO: 7266 - DNA, 348 bp, Glycine max
  Peptide Sequence Number=SeqID_98951
atggcaccaagttatgatacctcaatggggctagggactcacgatccaatgcccaattacatgtgtgttttgccttattcaccttctcgctctttgtcatccgcaacttctatggtcgatatcgctatgttggaccgtgttaatgatgtcagcgatgaggaggagaatccttccgaggatatgagcgacataagggagtcattagggattgaggagtacccagcaatcgaaggaggagttctagagagcactagaaaggccacaattgctaacggagaacgtttgagcgactacatcgaggtaagggatgagttactcacgcttggggataagaaggaacatgtatag

SEQ ID NO: 7267 - DNA, 153 bp, Glycine max
  Peptide Sequence Number=SeqID_98952
atgaagttcctatttgctgtgctagcaatttttgttgttgctttaccttgtgcgtggactaaactggagcttgatgcaggtcctagcttcaatgttatcgattatggtgccacgggcaatggtcaaactgatgattcccaaattttattatga

SEQ ID NO: 7268 - DNA, 453 bp, Glycine max
  Peptide Sequence Number=SeqID_98953
atgggggcttgggagttgtttatgcacggggaaggtgatgaggacacaactaagggcaaggaccatgaagcacatgaagggcctatgactagagacatacttaaaagggcccaacacagtgatgaggatacaactaagggcaaggaccatgaagcacttgaagggcccatgaccagaggcatacttaaaagggcccaacacagtgatgaggaaacaactaagggcaaggaccatgaagcacttgaagggcccatgaccagaggcagacttaaacaagcccaacacgtcacagagacaagactggttcctgttgaaccaaattctgacttatcaaggttgattccttgtggcgtcaccgtgacttatcttccatctctggaagtggtgtccctctccgtcaacaatcctgtgtcaaacgttccgccccgtaagattcacgtcagaaggtattag

SEQ ID NO: 7269 - DNA, 288 bp, Glycine max
  Peptide Sequence Number=SeqID_98954
atgagtttgggtgtccccgtttgtaaacaaactgtgaattggtatattgaaccacttcctgcagggtcatcaactaagtttgaatttgaaaacttgcttgttggtcaagctattccatcaaattttatccctgcaattgagaagggtttcaaagaagctgccaactctggtgccttaattggacatccagttgaaaatctccgagttgtcttgatagatggtgctgcccatgctgttgattccagtgaacttgcatttaagttggcttctatctatgcttttagacag

SEQ ID NO: 7270 - DNA, 351 bp, Glycine max
  Peptide Sequence Number=SeqID_98955
atggagaaacaacaaaacagtcttatcccactagatgaggcaagcacgcttcagggaaatacgactttggttcttgatgtgacgctggaggatcctgtccctcttaacaatatgtttggatactctacagctcttcgttcaatgacacagggcaaaggtgaattcacaatggaatacaaggaacattcaccagtttctcatgatgtacagacgcaactgataaacacgtacaagggaaataaggaaggtcgggtagttaaatggttctgggtcccaagtgtaagttacacatgctcgtacttgtcgatgaagatgactcttagattggtgattaagagctcttcggaatga

SEQ ID NO: 7271 - DNA, 459 bp, Glycine max
  Peptide Sequence Number=SeqID_98956
atggaagctgaccttcccttaagttggaaaccgctcaacctagagcgctatgatggaaccacaaacgagaatgaacatccgaacgcattcctcaccctggaaaatctctacaccaacgacaacacaattttgtgtcgagttttcctaacgtccctcaaaagggcaacattgatatggttcggtcgaattgttgttcagattaggaaccttaaccccgaagtagccctgcactccatgctgctcgtcttacggcctggaaagttcgtagatagtctgtgcaaacaaaaagcctcccaacaacatggacgagtaacacgaacaagccaaaggctacatctaaatggaggagatgtcaaggttcagaaacgaggtccgacaggccggacagaagcgggacaaaagagaaggacgcaccaagatcgactcacacaagttagacaaaaggcacaagctagataa

SEQ ID NO: 7272 - DNA, 588 bp, Glycine max
  Peptide Sequence Number=SeqID_98957
atggtcattgatgttgttgtgtggaaggaagtagtcggtctggatatgggtggagtctgcaagtttgatgaaacggctgatgggtataacaagatgcaaacttataggggaatgcttcttgaccctgctaggaacttaaggaatcacttaggagttgatggactggctgtagaggacataatgttagtttacatcactacctacattctcactctgaggtcaagtagtcatgctcaggtaacggatgatgatctacagattgtttatggtctaatattgggtatcaagatgaactgggtactactgattgaagacattatgttgaagagtcatcgtctagtggattatgaatttccttatgttgtacttgcctcaagattcattgactacttcaatgttgatgtctctaatgacactgtggactttaccaaagcatccaatgagattaccgaaaggcatctcaagaagcttagaatgaggtttgttgatcatgaatggataatggcgggagagacaacaactagaaacattgaacagatggaagaagatgttgaagccgaagcttcacaagagcctagacatcaatag

SEQ ID NO: 7273 - DNA, 1626 bp, Glycine max
  Peptide Sequence Number=SeqID_98958
atgggtgacttctcatggaggcctttggggaagcaggacagaatttctagtgggactgtgccaccttctgctatcgatcctcctattagagaaggaggtcaacctgctgctagggctgaccccaatgatgatgaagttgttaaggtctcccccaacgtgccttcctctattttcgctaagatgaagtgtgatgacgacactaggtttgcagggtctgcctttggcttcattggtcgtccaggctactgttgctgctcctgctcctttaactcctctttccctgccttcttagaaggtttttatctctcatctttctttggttactacaccgatctctttggtcgcccctgtcatagctctaccttccactgttgttgcacccgtgccgagggcggtgtgacggctgcgggtgcttcagaaatattgcctctttcttcttcaacttttccgatttctacttcggatgttttggcatcggcgccgccttcccccttttctcgccctagtgtttccctagatcacaatcttattcgatcagttggggttcaaaatgccactaattctgcaaaggtcttcctccagagaagtctggtgattcaggaggaaaatggacaaaggcgccaggaagctctgagcaacgtcgcatttatagaggctaagagtcccaaggtggccaatgccactgtcgcttttattgaggctgttaagtcgaaccaccagttgtcgtccaaggtggagaacactgctactgaaaaggacaagctcgccaaggtgattactgacagcgaggcttggttgcaggagtcagaatccaagctggagaagtctgagctcagggtgtcaaaggagaagaaggccaacaaacaactagaggaggagttattggtgttcaagaaggaggttgggttctttgccaaactgcttgacgaagaagaaataactgttgtggaggaggatgctggcgaggagcaaggagatggggccaattttgatttccatttggttgaaggtcttgctaaccagtcgggtggtacctcttatttgaggataagttccttaatctgggcctttggctatactcgttgtagttctaaaggagaaggcttacaagggcgtgccttgggcgaaacttggcaacgaagaggctcaccaagggcagaccttaggtttgacgagctttggactagggacgcgtttgtcctgggttttggcgaggatcttgggtttgtcgagcctttggagaagcgagactcaccaagggtgaaccttgggtttgatgagcctttggagaagcgagactcaccaagggcagaccttgggtttgacgatcctttggagaagagatactcaccaagggcagatcttggggcagaccttgggtttgtcaatcctttgaagaaacaagactcaccatgggcggaccttggaggctcaccaagggcggaccttagctttaacaagcctttggacaagcaagactcaccaagggcagaccttgggtttgacgagcctttggagaaacaagactcactaagggtggaccttgggtttgatgagcctttagagaatcgaccagtgacgtgtctgtcctgggttttgtcgaggctcactaagggcagaccttag

SEQ ID NO: 7274 - DNA, 393 bp, Glycine max
  Peptide Sequence Number=SeqID_98959
atgattggaaccaataatcagggattttcccccaagacagacaacaacaccaaatccaatggtccgatctttgagcacaaaccttctgaaaggaagatatatcctcctggtgcaacaatatggagaaacttagaggcagactcatttgagaagaacaaaatgcatctgtcctttatgtgttctcaattttcttgtgtagtcacctccaactcgaagtttcatcttgtagtgcacaagcctatctttcataaaaaggcaaactactacaaaggtaaggagccgatggcagaagacaatgaaggtgctcttccaacaagattcatcaaagctcatcctggcagactcttcaaacatgaagtcaaggctctacaagaaaaggccaagctctcatga

SEQ ID NO: 7275 - DNA, 1467 bp, Glycine max
  Peptide Sequence Number=SeqID_98960
atggcgagcgggaacgagcgttgtcgttttggcacgttagtgacgcggattttacgagatgaggcacgagggtgttgtggatttacgaaaaaccatccaacggtagggggacatgctaggaagaaggttttctcagtagaacaatttattctaccagaagaacctttttttggagaaattatcggaagaagttcttccggtaacttctccggaagaagggtgggtgattgggctacaccggatctagttgttaggagagttactttcggcaccttgcagaattgctgctccgctatgccatttttgttgctttcgtgtttctttcgccgttgctgccatcgttcgcagtcattggtgtcgattgtcactcagtcgtggtttgtcctcgatttctcctttgttgtgattatagttagaatcagaggtttgggttggactttaagtagagttatcggaagagcattatgtagaaaagtaagtcgtgatgccgatgaaggccccaagcggcgaaggcccacaacatctgcacataggcaacgaaaagccgctcctgcacatgttgttgaggatgttgaacatgtggatcatgtttctaaagaggattttccaagcgggcctcatgacacatcagttttgatggactatgttcatcatgtggttgtgacaatttggaatggagagatattgccctcctatggaaagaaggtagagaaatttggcaggcttgctcctaagattgaaggcttagtgactgccacaagattaagtcatttgatcgcatgttcgatggacactggtgatcggggacttatgctttcttttgcggagaggtggcataaggaaactagtagtttccatctaccggtagcagaggaactgagacggtacaataccacgaggcatatgtttgtctatcctggctgcgagacatatatcaaaaatgtcacagacgtgcatgtggtattcgtggacacatttcgtgacctgaagcaaagtgaaagctacgcatggggagttgttgcactgattatgatgagaggaaaccacgtgctcgtcgttgaaagtctaggcaggcattaccagtgtcgacatatcactggggatcttcctagacatccacctacggtgcgcgatgacacatttgttgaagcatatgttccccaacagccggtggcagcaacgactatggacaaagcacttgcagatgcacatgctgatgcagagcagcctcaacatacagcggacgcacagtttggtgatgacgcatgggaggcgctgctgccacttgaaccagacgttgcggtggtggaggcaaaggagctcgaggacaacagagatctgatcgacgactttttcttgcgtgagggaatcggggccgagcgcgtcgaagaagtggtggacgaagacggcaaagtcgttggcgaagaatgcaacgtttccatttattcgactaattacccattttag

SEQ ID NO: 7276 - DNA, 129 bp, Glycine max
  Peptide Sequence Number=SeqID_98961
atggataagagcttgaacgtaggagaagatgagtggagggagaaggatagaatgagcacaaaatttagtgcctcgaatgagcccactaatacaagatcaagtccaagattctccactaagtgtgtttaa

SEQ ID NO: 7277 - DNA, 402 bp, Glycine max
  Peptide Sequence Number=SeqID_98962
atggttagaactagaggtttgggtcgggctttaaacagggttataggaagagtcataggaagagaagaacgtcctgagttaaagttatcctcctatggaaggaaggttgagaaatttggtaggcctgctccagatattgaaggcttagtggctgccacaagattaagtcctctgatcacatgttcgttggacactagtgatcgaggacttatatcggcttttgtggagaggtggcataaggaaactagtagtttccatctttctgtaggagaggtgactatcacccttaatgatgtggcattcttgcttcatcttcccatcacaggtgtcttccataacttcgaggctcttcatatggacgaagtcatgttgttgttagttgaattgcttgaagttagttaa

SEQ ID NO: 7278 - DNA, 543 bp, Glycine max
  Peptide Sequence Number=SeqID_98963
atggccacgctccttcttcccaaccctttctccaccaagctccccgcccagcgctactcgcaccggcgcttcacctgctcctccatcaccgcccaatcacgatccgccaaggagcaactcctcgccctcatcgccgaccaggaccgcggcatcaagacccagagcgaccccgcgaagcacgccgcgatcgtcgaagccatcaatgcgatggccgcggcgggcgaaggctccgtgaccaccggggatgcgctgtcggcgacgtggcggctgctgtggacaacggagaaggagcagctcttcatcgtcgagaaggctcccttgttcggaacccaagcgggtgacgtgttgcaggtcatagatgttcggaatcggacgctcaacaacgtcataacgtttccacctgatggcgttttcattgttcgatcaactattgaggttgcgtcgccgcagagagtcaatttcaggttcgcctgttccggcagacatctgtggagggggaggttaggaagtctcatatcggttgccttaattctcggggtgtag

SEQ ID NO: 7279 - DNA, 315 bp, Glycine max
  Peptide Sequence Number=SeqID_98964
atggaagcgcagacacgaactccacaaacgcgaactcgacaatgtggttgcagtcacagaagcgcagcccagtttgcgacaaacacgaactcaggaagaaggagaaacaacaataaagccctgggacgtacctcaatggataagtgccaaagacgatctccacaaacacgatctccacaatgtggttgcagtcatggaagcacaggcgactttgacacaaggagaaagaagaagaacgatatggttcaagcgcaaggagaaagaagaagaacgatagggttcaagcgcgcgggttgtgcaatttcagaactttaa

SEQ ID NO: 7280 - DNA, 96 bp, Glycine max
  Peptide Sequence Number=SeqID_98965
atgactgacattggttgtttagatttacaagtgcagtattatgtgggaagaactgggaaataccattgccaccatttggacagggttgcagtttaa

SEQ ID NO: 7281 - DNA, 609 bp, Glycine max
  Peptide Sequence Number=SeqID_98966
atgaccgatagattgctggccggatcattaacctttgattgtcgcatcatgcactatattattattagaatcttacttccccgttcttcaaatttggttcaagcctctgaggaggacttgattttcatgtgggctttccttaccgatcgtcaaattgactgggctcacttggttaggtaccgaatgcataaggcattacgggccaatgcacctctccattatcctcaattggtcactctgtttctccctcattttcaaattcctcttgataatgaaccttttgttcaagtcaagcattcctttgctataggtgttggtgctgtaacttcatttggttactgtaaagatcgggatggtcaatggctaaagaaggatgcgctacctcaacaagacgagcatacttcttctcttcctcctcaacgagatgattcctcagcccttatgaatgaagttctttcagagttacggggcctccgcacatatgttggtgaacgattcgattccttggatggtcgctttgaaggcatggatacccgcatcacccagcttgaagaagatgtgacttatctttgtcggtgcttcgatcttccaccaccttctaagtcttag

SEQ ID NO: 7282 - DNA, 183 bp, Glycine max
  Peptide Sequence Number=SeqID_98967
atgttgtacgcagccttacccttgcatatgcaaagaggccgtttccggattcgaacccatgaccaacaagtcaccaaggcacaactttaccgctgcaccagggcagatgtgattgtagttatccacaaacagtcctcgcaacagctgagccatagtggtatttttgtcttgcatagaaagtaa

SEQ ID NO: 7283 - DNA, 186 bp, Glycine max
  Peptide Sequence Number=SeqID_98968
atggtaaaaacagtaaatgaaaatccttcttgtaagactaggcttaacataaacaacattattgatgcaatcctccctaggaaaggaccagttatcagagccatgagcaaaaggctccaagaggattgggctagagttgataaagaaggccttagggttctcatgaaccttagggtagatttttga

SEQ ID NO: 7284 - DNA, 348 bp, Glycine max
  Peptide Sequence Number=SeqID_98969
atgtcggctgaaaaacatcatcagttgacgtcagtcgaaaaaactttgcacatcactacccaaaaaatagctctaaccaaagttggtcgagaaaaccatagtcaatgtcatctgaaaaatagcattgaccgatgtcagaccttatgggctaaaaggaccctatgggctcaacacgaatccaccgctaagcgcaacttcagcgcgattagcatgacaagggaatctggaagagcacaaggatcaaggttgcgcgctaagcgcgagatcaactcgctaagcgagatgtttgtctcttgccaggctcagtgcacgactggcgctaagctcaaatccactaacttgcactaa

SEQ ID NO: 7285 - DNA, 207 bp, Glycine max
  Peptide Sequence Number=SeqID_98970
atgaatgggccaaagcatttgtctccaagggagaaaatgagcggagtcgccaccaacgtttatttgaggaaaacgttagaaaaaccaaaaagacgaaggtctgcggattttgaaaatgagggttcaggagttgtttatgcacggggaagggtgttgccctcgctcctatgtatcctcaagttcgatgaggaaatcagacctacatag

SEQ ID NO: 7286 - DNA, 237 bp, Glycine max
  Peptide Sequence Number=SeqID_98971
atgaagtccttcaatggtgattttccaccatggagatgcagtagaagacaaaggagaagaggtgagaggaggcgccatccactagggaataaaccatggaagaaggagcttcaccaccaagaatgtgccttggataagaatcttggagaggatgcttcaatggaggaaaagaaagagatagagaaagagagaagggggagcacgaaattgaaggaagaaaagaggaagagaagttga

SEQ ID NO: 7287 - DNA, 399 bp, Glycine max
  Peptide Sequence Number=SeqID_98972
atgtcagcatcagaattaatcaaagaatttgagaatatttacttttggcactgctcaatctccaagactccaacgttggctttgcaaattgtccttctcaagacgagctggagctactcaaagaatttgccttcaaaggattcccaggtacttgtctctggggatatttggggatatgcggatttagccgtctccattcacatgcaggtcaccccgcactcttacacagatttaatacattggtatatccccgcccgatggaccctgcaggccaaatgggttggtccgcggtggtggcagtgcgatggtggcacgatggtggcgtggtggtggtacaacgaaaaagatagatcgagtgtggtgaggagatcagagtgcgagttgtggtgggaagaatag

SEQ ID NO: 7288 - DNA, 549 bp, Glycine max
  Peptide Sequence Number=SeqID_98973
atggcatttgggaacatggcagctcgcccaggcgagctcatgcttactcctgaagtaactggctcgcccaggcgagctggttccttaagcctgaagcagtttggggacccaggcgagccagaggctagcctgggcgagctggggtccagaaaactcattgaaaagacccttttgcccctcccttttggtatctttcgcatccttgatcaaaacatcgaacgatcttttgtcttgtgcacgattcgtctatcgctttccaagcttagcctgagattggcgctaacctcaaattcatttactcgcgctaagcgcaagaatggcgttaagtgcaacgtcgagatcaagaggccctttttaagcctgatttgcagaaagccaggagccaaaagcgaagagaacggttcactactcagaggcctgaagagtgtgaatttcagagagcatagagcagagcaaggggccaagttttcatcttttagggagattagtgagtttttgagtgattgtgagattcctagaggtggaggagacatccccactcctttgtaa

SEQ ID NO: 7289 - DNA, 873 bp, Glycine max
  Peptide Sequence Number=SeqID_98974
atgcaccaaagggaagaattatctaagaagcgcaaaggtttaacttcaaccaccaccactgcaagccaacgccgccacgacacttccagtgactctcctgcaccacccaatccctccatttcctccccacgttccttaactctgttttcctccaaaaaacaacatcaaaggtactattcctcattttccaatcgagtcattcttgatcctaaatatttagacttagagttctttgaaggagagaattttgattgttgtcaagtacataaaattcccattgtggttgatcagtctttattttattcattgacaaaattaagtagtcaaggtgtaccttttgagggcactttgtttggtgactggaagcatctttattcaaatcatgatgcccgcaaaatggtttgcattgaaaatgctaatatgaccggccgattgctagttgcaaatcctgctcaagcttctaagaaggatttaattttgttgtgggtccttcaaatcggtcgtcaaattgactgggcctatcttgtctattactgtatgcataaggcattacgggcaaatgcacctcttccatacccccaacttgtcactctctttctccaacattttcatgtccctctagatgatgaaccctttgttaaggttaaacgatctttggctattggagctgctgttattgcctcctttggttatcagaaggatatgaatggtcagtgggttcagaaacaagaccttccacctactgttcctgatgaacgtacaccctcaccaccaccacaaaaggattcctcgtcttcactgctgcatgatgtgctcactgaacttcgggagctttgggcctttgtaggtgattgttttgatgctatggattga

SEQ ID NO: 7290 - DNA, 528 bp, Glycine max
  Peptide Sequence Number=SeqID_98975
atggggatagttagtgatatcgtagcgacgaggcaggtcattacatacatcatgcatcatcatgtagagatagaagctaaggcaaaacaacagcaggagaagcttgaatttgacgaacagttcaacaatcttcatgcgcatcttgaacctcctctgtttgatattacttcacaacctccacaagttatggaagataccttgccaccattggcacttccaaacactctggagtctttgctcaaatccttcaacgattctattctctacaacgtgaaactgatgatgcaacaaaggctgcctcctaacttggttccactccatcaatcaattgtccaacaccagtatgcacccatacctcaaccacctctaccaccaccaaccactgttgtgaaacctcaccctggggttcccgtaccaatggttcctacatcagaggctgccatacctaatgatcctatgcctgagcctccacctacgccaccaaaatcaccacctcctatccctcaacctctgtccactgaaggttga

SEQ ID NO: 7291 - DNA, 198 bp, Glycine max
  Peptide Sequence Number=SeqID_98976
atgaaggcatgggctatggtggtgtgttttaaggtggcttggttggtgtttggggttgttgtgtggtggacagtaaaggtgaaggtgcggtttgcgacagtggtgtgtagcggagagatggggtcaacgacgaaagtgacattgtgtaggatgacacttttagggttagatgcaacagagagagtagcaaccaagtag

SEQ ID NO: 7292 - DNA, 897 bp, Glycine max
  Peptide Sequence Number=SeqID_98977
atggcttccgcatctcaaggttttgcttcgcactcttttccgacgtccatagctgagaagctagacgattccaactacctacactggcggcaacatgtcgaaccagtaatcaaatcacacaagctgcaacgttttgtggaccaaacgctcctcatttggctccaatccactcttttgaagtctgttctcacatgttttaggctcgaatcactcctatcagtttcgcttgaaggaaaatcaatggatgaatatctccataagattaaaggctatgtcgatgagcttgcagatcttcaaacacttgggttaatcctaatcccaagcctgttgctcagccaaccaatcaatcaacctagtgctatgcttacaaactcagattctcatggcaacgatcaagttcgttcaacctggattccagattctggagctagcttccatgtgactgtactggttcctcatcctttgtgcctccttatgactcatattattttcaaacttgataagctattgcatcttccttcaatttccaaaaatttgttaagtgtgagtcagtttgctagggataattctgttttctttgagttgcatcctcacttttgtcttgtgaaatcacaggcgaccaataaagtactccttcagggtgttgttggtgctgatggtctttattcattccataacttcaaatttcaagatcactctcctcagctgttgtcaacttcgacttttgcttcaatcacatctcctactcttgatgtcaacaatgcttttcttaatgggttgctagaggaatctggttttatgactcagcctccaggctttgaggttggagataaatccctggtcggtaagcttaattgggctctagggcttgaaacaagctccaaggcaatggtttga

SEQ ID NO: 7293 - DNA, 632 bp, Glycine max
  Peptide Sequence Number=SeqID_98978
atggcctcttctggaccactttggttccttggccaaggacatcatgaccatttggagaaaggagttgatgctgttccaaatgaccgaaaacttgagtgggagaagcttgactatcaactctgtgttgcccaagagatccttgcaaatgacattcaaagcctctttgatgcaaccatgaaggttacagctctcaaacaaactggacatgacatgattgcacatgtaggaaaggctagggctgcagttgaagagctgaaaaagtttctggtagctgactcattggaagaaatgaatagaaaactggataagttttacatggtcctcatcctgaggagtctacactctgactttgatcatgtgcgtgatcaagttcttgctggagatcaagttccatcaatggactctctcatcactaggttactttgtgtgcctcatgcgctgaaagaagaaaatccagctgatgtggtggaaacttcaacaatggttgcatctcgtggaagagagggaggccgtaatagtagaggaggccgcaatggaaaaggtggacgtcctcaatgcacatattgcaagaggatgggtcacactcaagagaattgttattccttgcatggatttcctgaaaaagttccaag

SEQ ID NO: 7294 - DNA, 414 bp, Glycine max
  Peptide Sequence Number=SeqID_98979
atgaagacattatcatggaaaaataccttaaagattagaaaagaggatgaatggggaagaatgaaattcgaaataagcaagcatggaagcaaaggaatttcggagaaaggagacaagaactcaaagtcaccacacccgacatgggacaacactcgtccatgctttggggctcaagaaactcatcatcctcctgcttttcaaaactactaccctagacatcagacaatcttcaacactggacaacctctttcgcctacaagctggctcagagcttgggggccttatgtactgtccagggtaaacaaaatacacgtggcatcctacatggcacttctagacacgtgcccaccctccatgttagccctagcacaggagcatggacgtccaacccttagtagccgggttcccccatag

SEQ ID NO: 7295 - DNA, 858 bp, Glycine max
  Peptide Sequence Number=SeqID_98980
atggtagttggaactggctattttgatgtatttgagagagatttttattctgctattcatgcagcatactatggtcctaaagttcagtccacgaagcttcttcctgacttctttgaggctgaggagaggtctttttatgaaactcttgaggttttgcacttagtttcagaacgtgatcttttcgggatggtttgcctagccaacaaggttccagagatatcaattactaacaatgagaagttaacatcttttagatccttccattcaggcctgtgtcaatctataacaaatttgaacatccacaagaatgcaaaaagattagatgattttgaaactcaccaaggtcacagctctaaaacttcaagtattgtatcagatgcatatagacatctagaattgcacatctttggaatagtgattgctacaacatctaagaccctacctagatgttgttctgatgagatgcagacaaaatatattgaagatcacattcatgtgttccttaatttatatgaagatcccaaacatatcagcagtgatgtttggaaagattaccttgcaaatggtgcagttggaagaagaattcacttaggaagcatagatggactttctttttgggttttaattttgatgaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggacacgatgtcctga

SEQ ID NO: 7296 - DNA, 1644 bp, Glycine max
  Peptide Sequence Number=SeqID_98981
atggaccgagaggtcatttccattggaggttcctccttgaaggataatcaccatggcacctctcgcctccatgggaaggtgcgaccttccgctgcttccccgaccagggatcaaggaaaaatggatgatgttccgaagtataagtcctccctcacctctatggcgagtgttgttgatttgcaacgccaggtgaaactggcgaatcttgaggactcctgcaaaatggtcgtacaagcttgcaggagtgatgacttccctttcttgaggcacttgaatgtggccccttcccaacttcactcgaatagttgggccatggtgaaggcctttgaaattttgtgcctcttcttcaacatccagcctggtgtgccggtcttcctatttttcttccaaatgaagctgattggcaagattggttgggtctccttgaacaatgtatccaagaagttgtttgagttcgactcaaacatctttcaccacttcaaggatcagtttttcaagcaatttgaccccaccaggttcaagtcttttgacaaggatctattgacccttgtggagagggtcaataaagctattctggaacagttgtcggcctcactggacatgcgggccattctatctcttccttcagtgaataatcctctcgctgccttggacagtaaaatgcctaaccttgtcggacctaaagatggaaccgtgccaccgttcattgtcactcctgctactgtagaaaagggtcaacctgctggtgaggttggtcttgttgttgttgttgttgaggttactcctactgctggagttgatatcccagctacttcagccaatgctgttacggcgtctacatccaccattgccacacccttgctgagtgccagtgtaacgaccactaatgctcctatgatttcgtctcctccttctccggcgtctactgtgttggtggtggtgtcaccttcctcgtcttctagtccccatgtttctttggaccacctgtacacttccagtgatgcagattcactgtggggtgccaattacaaactgaagcagaagacctcggttgactttgtgtcagcctttgatagaaacctcattcgatcaagaggggagaatggacaacgacaccaagaggctttgggcaaggtgtcatccttggagacagaggttgccaaatggagggctactgcttgcacgatttggagacaggagcgccctaaggtagctattgccaccatcaccttcgttgaggctgtaaggtcgaaccaccaattgtcttccaaggaagagaaaaagaacttggccggcaaggtggaaggcatcgcggtgaagagggatgagcttgccaaggcgagcaaggagagggaggccaacaaggagcttgaagaggagcttacaatgtacaagaaggaggccatggagcagcatgaaaaagggtttcaaaaggccatcaggaaggtcgagttcttcaccaaggatcttgacttgggtctttttgatcctttcaaggacgcaaaggaaggtgttcttcttaaagaagaagaaattgttgtgaaggaggaggctactgatgacaagcaaggtgaaatctttgatggcacaggaagcaagaccttattgatgtggaggcaagactttggtggtcttgtgaaataa

SEQ ID NO: 7297 - DNA, 204 bp, Glycine max
  Peptide Sequence Number=SeqID_98982
atggaagctctctcacgtagtaactgcatccttggttacatacttcctgatgtctgccagaagaaggattatatcaaaagatactctgccaaaatcactgaaaataataaatattattataaagaatggacaaaacctggtatgccaagtgtgcgtcaaagtccagaagcactcataatgggtgagagaggatttggcagttga

SEQ ID NO: 7298 - DNA, 207 bp, Glycine max
  Peptide Sequence Number=SeqID_98983
atgaagatgctcttgataccacatgatgtaagctccattggagcttcgaaatggagaaggaagagagagaggagacgccacttcaaggagaagatgagtcttgaagaagctcaccaccataggaggccatggataagagcttggaggaagaaggagttgaatggttcagtccactactccaagatcaattccaagattctccactaa

SEQ ID NO: 7299 - DNA, 240 bp, Glycine max
  Peptide Sequence Number=SeqID_98984
atgttcgtattcaatagtgctttgaaaggacttgacgatactccacaacgtaaatccaaggctgctgctaagtggattattgttaaatgtaatagacaaaaaggaagcactgagtgtgggtattacgacatgcactggatgttaactataatcttaggaagtttcaacaataattgggaaacgtatttcaatgatgctagaccattgaaaccagagagattgaagatgtttcacatctag

SEQ ID NO: 7300 - DNA, 255 bp, Glycine max
  Peptide Sequence Number=SeqID_98985
atgttgagtcaacatcccaatattttaaactacactgactctgtgatgaagagagaatctcctctatccctgcattacaaactgtttgaggggacacatgtcccagacattgtctcgacatcagggaaagctgctgcctcaggtgctgtgtccaaggatgctctgattgctgaactcaaggacacatgcaagctgatagaagatgctgcagcaagagcatggagacagggggagcagaacgctgatgtcacatga

SEQ ID NO: 7301 - DNA, 204 bp, Glycine max
  Peptide Sequence Number=SeqID_98986
atggcatggtatcaagatcaaggtttatatgaggctgaggtgaccataactaaggagatggaaatcatatcgatgcaatttgagcagctcgatgtttgtggcaaagattctattgaaaacattattgatgtcaaagcggatggtggttgtggttattgtgcaatagctaccttattgggtatgggtgaagatttattgtcattg

SEQ ID NO: 7302 - DNA, 297 bp, Glycine max
  Peptide Sequence Number=SeqID_98987
atgcagaattttgctgtcaaaataggtgcagcaggatttgagcttggtgcagaaaatgcttgtgtgtggttggctgtggaaagagtagtacagaatgagttctggatgttgctagtagatcccaacggtcacaatcttgagaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 7303 - DNA, 678 bp, Glycine max
  Peptide Sequence Number=SeqID_98988
atggaggcagtttcaatcacacctcacgaggaaatgggcccttgcatccgatcaggacggtgtggaggacactgtctgatgtgcgcaaaaaggcacaacccatccagaagaagaacactgcaccccacgttttgtctcgtggggacgaagaagaagctggaggaagctgtgcagtcaggaagcattgatggtgtcatcggccctccatccccggtcaaacgccacgtgaagtggaagatggcccgcacaaagaaaacaggggagatgacgactaaggccgcaaaggaaatcgctgcgaagatcgattcctttgaggagcaggcgacacagagatccttcgtcccccaaagatgtcaggattttctcaccgctgctattggacatccagagcaccctggacatgtccgtgctgctggagccggtgtcaccatcaagcaatactttggatcggctccatggatgtcccgcatctcttcctccctgcctcctgaagaattgcagcagctgacccagcaaatcagggaccagctaaaggagtccatcatagaaaaagtgacgcggcagctcatgcatccttcagccagatgcagtcccagattcagtcctagatgcaatctcagggacttgaactgcctcccgagcctctggttggtccctcaggtcctcgagtcagcataa

SEQ ID NO: 7304 - DNA, 747 bp, Glycine max
  Peptide Sequence Number=SeqID_98989
atggcacaacctccaccccgtgagaggactctaagggaaatggctgcacctgatttcacctacgaaagcttgtgcatccaataccctgatgaggatgtcctatatgttcttaaaactcgactgatccatttgcttccaaagtttcatggccttgcaggtgaagacccacacaagcatctgaaagaattccatattgtctgctccaccatgaaacccccagatgtccaggaggatcacatatttctgaaggcctttcctcattctttaaagggagtggcaaaggactggctttattaccttgctccacgatggcttcaaacttccagcaatgatgctattgtcattagaggagtgcataaagtagccacgaattcatcttcatcaggtgagactaagaagcttgaagcttatgctgcaaacatctacaacaaacttcctcaacctcaacagcaaaatcagccacaacaaaataattatgacctctctagcaataggtacaatcccgggtggaggaatcatcccaaccttagatggtcgagtcctacacaacaacagcaacaacaacaaccttatttccagaatgctgctagctcaagcagaccatacgttcctctaccaattcagcagcaacaaccccagaaacagcaaacagctgaggttcctctgcaatcttcccttgaagaacttgtgagacaaatgactatgcaaaacatgcagtttcaacaagagaccagtgggatcctctag

SEQ ID NO: 7305 - DNA, 478 bp, Glycine max
  Peptide Sequence Number=SeqID_98990
gttacaggttgtaccatctatggtgaggctcatgaaacaggccaatgtattcccattgaagaaaacactcaagaagttcactatatgggaaatcaacagcgacaaaggtatactcaaggaggattttccggccagtggaggtcacaccttggaaatcagttcaacaaagaccagggtggaccttcgaacaggccaatccaacaagggcctaacatctttcagaggactactaagctggaggagactttgactcagtttatgaaggtaacaatgtcaaatcataaactgaagaaccttgaggtccaggtgggacaactggccaagcagatagctgacaagtcatccaacaattttgtggcaaatacagaaaagaatcccaaggaggaatgcaaagctgtgatgacaaggagtaagaggtttgtggaggctgaggatgaggagagtgttgtgcacaagaagaaagctgctgaaaagaaag

SEQ ID NO: 7306 - DNA, 391 bp, Glycine max
  Peptide Sequence Number=SeqID_98991
gtatggaaaatccgaaaacaacaagcagtatccgccgttacaaagacatgcctttgtaaaatggtggtcacaatttgatacctcaaaggctgctccagatcaagtcgagaactggtttcagagcaaccctgagttcctcaaacctgctgatccagagacatccttatttctaaatcagaagtctcaactcgcagcattcttggcaagctcaaagtccaaagaaagtcttgcccacaatctcaaggaagttctccaactacttcaacaagaagaagatgaagaactcccaaaaaaggaggttgaatcatcagaaaataatgatgaccaagatgatgatccattctaccagaatgaggacgattgttttggtatatcactagatgatgattaa

SEQ ID NO: 7307 - DNA, 261 bp, Glycine max
  misc_feature (247)..(247): n is a, c, g, or t
  Peptide Sequence Number=SeqID_98992
atgactccgagaaagctttccgcaaagagatctaggagggacaccgcggctgaagggaccagtgccactcccgagtttgacaaccatcattttaggagcgctgagcaccagcagcgtttcgaggccatcaaacgatggtcgttccaccgagagagacgcgtccagcttagggacgatgagtacacagattttcaggaagagatagctcgccgacgttggacgtcgctggtcactccatggctaagtntgacccagatatag

SEQ ID NO: 7308 - DNA, 444 bp, Glycine max
  Peptide Sequence Number=SeqID_98993
atgactagaggtaatccatctgacttacaaccctttgatcctgagatagataggacatttcatagattagttaggcatcatttcataccttttgagcatcctgagcatcctgttactggtgagtctgtgcattctgttattggtgattgtgaacttcctgattttgagcattctgattttgaacattctgagaacatgtcacaacctccaccccgtgagaggactctaagggaaatgactgcacctaatttcacctacgaaagcttgtgcatccaataccctgatgaggatgtcccatgtgttcttaaaactggactgatccatttgcttccaaagtttcatggccttgcaggtgaagacccgaacaaacatctgaaagaattccatattgtctgctccaccatgaaacccccagatgtccaagagaatcacatatttctaaag

SEQ ID NO: 7309 - DNA, 255 bp, Glycine max
  Peptide Sequence Number=SeqID_98994
atgaaaacaaaaggtatgcagtttgtagaacaaaaagaacgatatgttcattatgatgccatgaagagatgcttatgcgatgcacaatatgaatgcatttacggacacgagagcccggaaaatcatctcttcttacttgtgcattcggggacgcagtgccccatgtgtgcagttaagaaggtgatatggaccttctggcttcccgtgacaaaagacgagaccaacatgcaacgcgtgcgtgacgacatgatgtag

SEQ ID NO: 7310 - DNA, 387 bp, Glycine max
  Peptide Sequence Number=SeqID_98995
atgccaaatttttacgcaggacatggggtgaatcaatttagattttcaacatggtcccatgacatctttgtcaatgtgaagctggaagtaacaaggatatcaacaatcctaaacgtgtttggtagtagacgaagcaatgatgtaacacgatccatcttttgccccaatttttgcaagatggttacttccatgcttcaacttgactcgatgaaccttttcgtaaaagcgcgagcttggttcaaccccataacccagggaatgaccattttgatcgccaatacttcaacaacatttcatagggatgaaagactcgagaatacgcatgctatgcatggaaaatgtaattatgagattgagatgcccgaagagacatcctttcttaattaa

SEQ ID NO: 7311 - DNA, 781 bp, Glycine max
  Peptide Sequence Number=SeqID_98996
cattccccaacacctctcagagattcacgaaaccactccaaaggctctgcttctccatggctacctcaccaaaagaaacttcatctcctggttcaccctctgtaccatcatctccatcatccaccaaagcaccatcaaaccaggaacaacctgaattcaatatccaacccatacaaatgattcctggtcaagcccctattcctgagaaactggtccccaaaagacaacagggagtgaagatttctgaaaaccctagccttgcaacaagtcctagggaagtagacacggagatggataagaagatccgcagtattgtgagtagcattctgaaaaatgcttctgtccctgatgctgataaagatgttcccaacatcttccggaccccaaatgctgaagtcctctctcctccagcaaagagagatcaacagaggaaagatgatcaagccacagaggagacccctgcaccacgggcacccagaacctgctccagaaagcgattacaaagccgaaagggaaaaacccccattaagaggtctggacgaatcaaacatatggcacagaagaaaagtactccaatcactcctaccacatccagacggagcaaagttgcaatcccttccaagaagaggaaagaaatttcctcatctgattctgatgatgatgtcgaactagatgttcccgacatcaagaaggccaagacatcagggaaaaaggtgcctggaaatgtccctgatgcaccattggacaacatctcattccactccattggcaatgttgaaag

SEQ ID NO: 7312 - DNA, 1428 bp, Glycine max
  Peptide Sequence Number=SeqID_98997
atgtatgaacagttggcgctgtatatcgacggcgaattcgtcgccggcgagggcaggcgcacccaggacgtcatcaacccggccacgctggaagtgctcggccagctgcctcacgccaccgaagcggatctggaccgtgcgctagccgccgcccagcgcgcgttcgaatcctggaagaagtcttctcccatggatcgttcggccatcctgcgcaaggtcgccaccctgtcgcgcgagcgcgccaaggaaatcggccgcaacatgacgctggaccagggcaagccgctggccgaggccatcggcgaagtcacctcctgcgccgagcacgccgactggcacgccgaggaatgccgccgcatctacggccgcgtgatcccgccgcgcaacccggacgtgcgccagatcgtggtgcgcgagccgatcggcgtctgcgccgccttcacgccctggaacttcccttacaaccaggccatccgcaagatcgccgccgccctcggcgccggctgcacggtagtgctgaagggtccggaagactcgcccagcgccgtcatggcgatcgcccgcatgtttcacgacgccggcctgcccaagggctgcctgaacatcgtctggggcgaaccggccaagatttccgactacctgatccgttcgccgatcgtgcgcaaggtgtcgttcaccggttccgtgccggtgggcaagcagctggccgcgctggccggcgcgcacatgaagcgcgtcaccatggaactgggcggccattcgccggtgctggtgttcgacgacgccgacatcgatcgcgccgcgaccatgctggccaagttcaaggtccgcaacgccggccaggtgtgcgtctcgccgacccgcttctacgtgcagaacggcgcctacgagcaattcctggcgcgtttctccgacgtgctcaagaacatcaaggtcggcgacggcctggaagccggcaccgacatgggcccgctggcgcacgagcgccgcgtacccgccatgagcgccttcatcgacgacgccaagaagcatggcggcaaggtggtggtcggcggcggcccgctggaccgcaagggcttcttctttgcccccacggtggtgaccgacctgcccgacaactccatgctgatgaccgaagagcccttcggcccggtggcgccggtggtccgcttcaccgacaccgatgaagtgctggcgcgcgccaacagcctgccgttcggcctgtcttcctacgtcttcaccaattcgctgcaaaccgccaccaaggtctccaacggcctggaagccggcatggtcaacatcaaccatttcggcagcgcgctggccgagacgccgttcggcggcatcaaggacagcggcatcggcagcgaaggcggcctcgaaaccttcgacggctacctggtgacgaaattcatcacgcacatttga

SEQ ID NO: 7313 - DNA, 340 bp, Glycine max
  Peptide Sequence Number=SeqID_98998
tccaacagggccctggggtttccagctctggttacgggccttctgtagtcctatagggtgcccgttccccccggcaaggtcccgtcatcatgacatagggatcgcgcctgcaagacacccactggacccgaagaagtccaacaagttctacggagtgcttgtcacctccggcaagggcatcaggccccctgctaatcgagctttcatcaagaagtactgcgtccccaggcaggcgcaggacgcaccgccatcacctctagagttcacctcagctcatccacaaaaagccatcaagcgtccagctcaagacgttaaagaagcgctactaggaggcaaccta

SEQ ID NO: 7314 - DNA, 420 bp, Glycine max
  Peptide Sequence Number=SeqID_98999
atgcaatctcaaggagttgcagtgcctcctgagcctgtggttggtcctagtccctccggtcctcgagtgagtgtggaggaggttagagatgcagatgctccagttcctgtacccactgatgaggtttccttagtggggcagacacttcacaccttccttgcttggccgacacatctggtagctgtgtctccgccaaaaccacctccgaagcccgatccggaggtcgatgatccgctttatctgatgacattgaccatcctagagcttttcttgaggccttatcaggttagatgggatgccaccgtgttcggggtcgttaatccagatttccccctgtacataaagcacgaagatctctccgaaatcgcacatggtggtcaatgtctcagcatatcagtgttacagttgtggattttgtaa

SEQ ID NO: 7315 - DNA, 795 bp, Glycine max
  Peptide Sequence Number=SeqID_99000
atgaggggagcaccgacggaagagagcctctcgcctttccttgtgagagattttggcgtgcaaagtttcaagattgtacaaagagtccacaaggcgtcggaaagccctttaaggaaagataaagaacttaggggcatccgtaatggcatcatcggtggttatcatgaatggctgaaagttcatacacgagggttagattggctctccaagttgaaaattatcaacaaggagaacttcgaagctctggaagaggataaagaagtacgagctctaaaaacagagctaggaaaggcaagactcgccaaagaaaaattcaagttagtcgctacagatgtccagaaagagtgtgccgagttacgagaagaaaatgcagctaccgcaagagcccttgaacaagaaaccaagagggctcacaaggaagagcatgaccgagataaattccaaggagctttgtggggcagcaacaatgagctcaagctccggagagaggaaagagaccagtcacgagtacatgtcatggtcttaaaggaggagttagctgcctgctcaagatccaagaggagtttggcccaacatttagaagccacggaggaaaacatgttagatataatagggcagtacaaagaagagttaaaccagtctttgacccatgagcaaaagctagtagaggacttcgcacaagcatacaccgagaaggaagcaatagggagggtgattgatgcattgcatcaagaagtgaccatgtggatggataggtttgccttgaccttgaatggaagtcaagacctcccgtga

SEQ ID NO: 7316 - DNA, 334 bp, Glycine max
  Peptide Sequence Number=SeqID_99001
gtcgactctagaggatcccactttaattggtgctgctgtgattgcttcttttggttaccgcaaagagcgtgatggctcttgggtcaaaaagggtgttccacctgctgatgatgaaggccacataccagttgaagataattccactcttcttcaaaggcttatggacaagtttgatggacttcagacttttgttggtgacaagtttgatgccatggaattgcaagttgacatgcggttcgatgctatggaatcaaggatcactagggttgaagaagatgtctccttcattcgaacttgctttgatccaccaccaccgcctccttcatcctcttag

SEQ ID NO: 7317 - DNA, 253 bp, Glycine max
  Peptide Sequence Number=SeqID_99002
atgaccatatttaaggttcccaacaaaacactcattattctaagggaaaattgcctaaaattattacacgctgtcgcaatctacccttcggcgagagggcgacgcggggctcatgggtacgtcttccaagaaaggaaaatgcccagagtcgccaccaacgtttattcgaggaaaacgtcggaaaacccgaaaaggtgtggtctacgaactttaatcgtgaaaggttcaggagttgtttttacgcacagggaag

SEQ ID NO: 7318 - DNA, 75 bp, Glycine max
  Peptide Sequence Number=SeqID_99003
ggaattggaaaggaggattggtgccatatcttgaagaatttgagtcaagaagcaaggggtgaaggaatccattga

SEQ ID NO: 7319 - DNA, 1299 bp, Glycine max
  Peptide Sequence Number=SeqID_99004
atgggtgaagaagatgaaaccccaaaatataatagaattggtggtggtggtagaagacctattggaagaccatgcaaaattccatacccaaaattggtgccacaaagaggacttggagtggcacagcttgaaaagtttagacttgaacaagaacaaaaggagaaggcagctataatagccacaagtgcatcatcatccaattccgatatcccttatgataagcatcttcaatttctaaaatttcataactccaatcaaccttctccaaattcatttcctttaagcactgcttcaattgcaaacaatggtggatctgatgctggcaggcatgaggctctagttttggggcatgtaagtgggccccagttacgggctccccatgattttaaatttgtgaagaagaaaattgggatgaataccggaatgacttttgcatcaacattgccttgtgcgtccaacactatcatgcccttcccgaattgtgtgcagaaaacacaacagcatcaacaacaacatccttcttcatcaatggtgagtgtctcctcaaggacttcatcaacaattgtgcctcattcctcgttagagccctattcaaccgaaacctatgtttctaagagactagagaagatgatagggattaaaagaccaaacccattctccctgaagataacacctgtgtcctcttccaattttaaaccttttgagtccaaccctattaggccctcccctaattggatgcacagaacacaacaacatccttcttcatcaatgctaggtgtcaacccaaggacttcatcaacaattgtaccccaatccttattagagccaccttcaaaccaaaactatattggaagctatgtttctaagaggaaggaggagaagatgatatggactaaacaaccaaagcccttctccatggatattccacctgtgtcctcttccaattctaaacctctcactttccctaatccacctatgtcctcttccaattttaaacctctcactttccctaatccacctatgtcctcttccaattttaaacctctcactttccttgctcctatgaaagcaagtgaatccaattcatgcatcagtggaagaagattcaacttggattttggaaattcaactataagggaaattccttctgtttcagcaaccaactcagagctgatctcaaagaaaaacaaaaaagggaaaaagaatattggtggagattttctcacagtggctcctcctactgaatgctcatgttccaagttaaagtctccttcaggtttcgtaccatttcgccaccag

SEQ ID NO: 7320 - DNA, 303 bp, Glycine max
  Peptide Sequence Number=SeqID_99005
atgatactggcgactcaactgaaacattgtgcttgtcacccttactggcgattgaaaaaagcttttagtggaagtcaagagcatgatactgcgccgatactgttgactagagaagaggttcttgagcgggttgacgacgtctatactgtttttggaaaagacccaaaagaaggaaaaaaactattgagttttgttccgactacatggaaaaggcaaaacctattggtgttttggagtctcaccatggcaatagagtgggagataagggttcaagaggactgcatgttatcactccaagtatag

SEQ ID NO: 7321 - DNA, 288 bp, Glycine max
  Peptide Sequence Number=SeqID_99006
atggaatttcatgtgcaggtgtcacaacctagccttttgcgggtaagcgaggcgaggctcacaagtgcgtcttccaaaggaggaaaatgcgcggagtcgccaccaacgtttattgaaagaaaaacgatagaaaaaccaaaggaaaccggtcatgaagaatattccagattcgggagttgtatttatgttagaggaaggtggtcatttaaggcattcgaccttaaaatgatccatttttacttggtgagaaaagctgaggcgttggaccttaaaacattttttcagtga

SEQ ID NO: 7322 - DNA, 336 bp, Glycine max
  Peptide Sequence Number=SeqID_99007
atgtttgcacattcgattaaaggctgccgtcccttgggacgggcgtgtggggtgctaataccttccccgttgcgtcagggagatatcacaaccatctggttggcgatgagggatggcaagaggtcttcgtacgtcattgggattggggtgaatgttgtcctcgggggaaagttccttatcgtgttggaaccggcaccaaagtgggcattaccggccgggcgagtcggggttggagccgtagcttggggggtctccctctggatgggcacaggtgccctagcttgtatgggtgttgagttggaggagtccccggcgcgagctgagaagctcgggtga

SEQ ID NO: 7323 - DNA, 683 bp, Glycine max
  Peptide Sequence Number=SeqID_99008
aagctaagaggtggcttcattcattcaaaggcaacagtcttaagacatgggatgaagttgtggagaaatttctaaagaaatattttcctgagtctaagactatggaaggcaaagccgccatctcttcttttcaccaatttccatatgaatctttgagtgaagccctagaaagattatgtggctacagtccaagcagctgtttagacacttctactgggggaaaaataaagttgaagacccccgaagaagccatggatcttattgaaaatatggctgcaaggtgtgtcatcagtggtggagctcacgattctagatgttgtctctccaatgaagaaccaataactcatgaaggacagtggagaaatcacccaggaaatcctttctacaaagaccaggatggaccatccacaaggccacaacaacaagggcctagtctctatgatcgggcaacgaagctggaagagactctagctcaatttatgcaggtatctatgtctaaccagaagagtacagagtctgccataaagaatttggaagtccaaaatggcaacccgtgttgcgaaggaaaagctgagaagaaggtggaggaacataaacaacaattggtagctgagccgacacttgaacccgtttctgacttagttgaacttgaggaagttgtggaagatgaagatgaccaatag

SEQ ID NO: 7324 - DNA, 132 bp, Glycine max
  Peptide Sequence Number=SeqID_99009
atggctacaccaatgagcactgcctgctatttagataaagatgaaatcagtcagtcaatagatgttaagcaatatcgagatttcaatcaaatcccaaacaatcacatcttagtggtgttaaaagaatcataa

SEQ ID NO: 7325 - DNA, 405 bp, Glycine max
  Peptide Sequence Number=SeqID_99010
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagccggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 7326 - DNA, 1444 bp, Glycine max
  Peptide Sequence Number=SeqID_99011
gacatcgcctacctgtcgcgggtatggaacgtggtcgagcgtcgtggccgcgaagcggcctcgtgcagcaacatctatgaagacctgagcctgccgctgcgatcggtacgcgacctgatccgcaaggatgtggacaaggtgaaggtggactccaaggagaccttcgcgcagttgcaggcctttgttgccaagtacatgccggtgctggcggagaagatcgagctgtacagcggcgatcgcccgatcttcgacatgttcggggtggaggacgagatcggccgcgcgctggacaagcaggtgccgctgaaatccggtggttacctggtgatcgaccagaccgaggcgatgaccaccatcgacgtcaacaccggttcgttcctcggccagcgcaacctggaagagacggtgttccgcaccaacctggaagcggcacaggcggtggcacggcagctgcgcctgcgcaacctgggcggcatcatcatcatcgacttcatcgacatggatgatgccgagcaccgccgccaggtattgcgtacgctggaaaaggcgctggcccgtgaccatgccaagaccacggtgtacgacttctcgccgctgggcctggtggagatgacccgcaagcgcacggtggaaagcctggagcgccagctgtcggaaacctgcccgcagtgcagcggccgcggcagcatcaagaccaccgagacggtgacctacgagatcttccgcgagatcacccgtgccgtgcgccagttcgatgccgcgcgcctgctggtgatcgcctcgaccaatgtggtcgcgcgcatcaccgacgaggaatccgcggcggtggccgagctggaggaattcctcggcaagagcatccgcttccaggcggacgagcagccggcggtggccgatgagcgcgccgccgcgcctgcgactgcgaaggatccgccgtcatttcattgggcgaactgcggtgcggtgggccgctgggctgcactgcgccggggctggggaccctcgataccacgctgcccgcatcgacgtgcgcctgcgggtcaatggcgaccgcctgcgtgtaggcgtgcgcgcctgggcccagaccgaagcgctgccgttgacggcagtgctggacgtggaccgcgtgcgcggcacgctcaggcctggctgggcgccgatccggtcgattttcatgcctggtcccgatgctggcggccggcggtgtgctgcgtatcgaaggcaagggcgaactcaacactgtggctgacctgccgatttcgcgccgctcctgcagcggttgcggacgcctgcgctggcagcgccggccgatggctgggcattgcacgtgatcgggggccgcctgggcgtgcatgcgccggggtgccgcgcctgcgcctgaaaaccgaagaacgcgagcagcagctcgatgggctgcagctgcagctcggcaagcagcttgcgt

SEQ ID NO: 7327 - DNA, 324 bp, Glycine max
  Peptide Sequence Number=SeqID_99012
atgactagaggcaatccatctgacttacaaccctttgatcctgagatagatagggcatttgataggttagttaggcatagtgtgcatcctactttccctgaacattttgtaccttttgagcatcctgagcattttgttattggtcagtctgagcattttgtggttggcaattttgaacatcctgattttgagcattatatttttgaacattctgagaacatggcacaacctccaccccatgagaggactctaagggaaatggctacacctgatttcacctacgaaagcttgtgcatccaataccctgatgaggatgtcccatat

SEQ ID NO: 7328 - DNA, 288 bp, Glycine max
  Peptide Sequence Number=SeqID_99013
cgcccttttgtcacctagaggcggcgagcccgatgacatgtggagacaaattatggtcattccacacaccttttcgccattcagacacgatcgtgtgagatggaaggcagagacaaattatggtcattctgcgccttttgtcatccagaggcgaggcggcgagcccgatgacatgcagagacaaattatggtcattctggatactttttcaccattcagacacgatcgtgtccgatggcacgcagagacaaattatggtcattctgcgccttttgtcatccagaggcg

SEQ ID NO: 7329 - DNA, 261 bp, Glycine max
  Peptide Sequence Number=SeqID_99014
atgggctcaaaaatctaccctagggttcatgagaaccccaaggccttctttagcagctttagcccaatcctcttggagtcttctatccaatacccttggggggtaggattgcatcaaagagtgtcccaagtatgccgcatgacgtgtgaagaaagggttgcctgtggaatcgaccgccaagtgatgatgaaaggttcatctttgtgggtgatggcaagaaggttgcagtggaagctattggaacttttagattacagttaa

SEQ ID NO: 7330 - DNA, 210 bp, Glycine max
  Peptide Sequence Number=SeqID_99015
atgttgcaaaactttacggattacgcaataatactctttttgactgtcggaatgttgctgaactttacggattacctaacgatgggggttatgtacctcgaggcggtcaagcgaaggttgcatgctaccaagcaatggtccccagatgaaattagggtatgccagttgcccctctttacttaccttttatcgaagataggaggaaagtaa

SEQ ID NO: 7331 - DNA, 216 bp, Glycine max
  Peptide Sequence Number=SeqID_99016
atgcaaactgccagccccattggcgcgtttgttgtggctgtgacacatggcgaagacgccactgccactggcgggttccatggtgttgccagccctattggcaatttcaccatgcaagggggagtagccagtcaaactagcgagttccaagcacagggcgcaggcttctcagccttttcaagcttttcagttgacagaggcaggggtacaggctaa

SEQ ID NO: 7332 - DNA, 636 bp, Glycine max
  Peptide Sequence Number=SeqID_99017
atggcggaaccaatgaagaagcgcaagggttcttcgagtagaagccaacgacactccgaggctcaggatactccaattccttcctccatttcctcctcctcactgttctcattggaagaacaatgtacatggtacacaaacctcttctcctctcgttctatcattgaccctaagttcatagatatggatttcttttatgatgagagattcgaatgcattcaagcaattcataactcatatctcattccctttatatctttaaaactgcctatgtattacgaattggtaaaagctttttattctaaccttgaaattcaagaaaataccttggtttatgaggtctttgggataaagatggtcattgacccatccctcttctatgatttgacccacttgtctagcgaaggtgtaccatttgaaggacacttaccggctggagaggattcttctctccttcagagtattttggacagatttgacggacttcaaaccaatgttggtgagaggtttgactctttggaacatcaagtggacacacgattcaaggagatggactcaaggattaaaaaggttgaaggagatgtcacctttattcgcgattgctttgacttaccaccactgccaccatcagtttag

SEQ ID NO: 7333 - DNA, 723 bp, Glycine max
  Peptide Sequence Number=SeqID_99018
atgtcttggaagaggccattacttctcaatgccccaccatcaaaaaccatgattatgaggggccaagacatttatagtagccaagatgaggctactacttcaccttcctctagtgaaagtgaagaagcaaaaggggaaggatctagtgaagaaatctacccccaagaagatggacaaccattagtggttaaagagaagtgtaaggaggtaagtgtctcctccaagaggttagctaagaaggaaactcattttacaataaagatagacattaaagaaactttccctcttagacaacctccacatcttctcctttgtaaaaagacacttgttagcactgccacacctcttgggcttgaggttattcctcaagtaaaggagttgttggatgagggtttggttcgtaagagcttaaatccttgtgctttgttggtgcccaaaataggtattattaggcaccaaatccctacaataagtgatatgatgaatgtgttgagtattgcaacccgcttttgtaaaatcagtcatgcacccaacgtcttcatgattcatgtacatagggactcattaggtaggaataatcaacataaaaatacagaaaaaggtacactttattacattactttccttaattttttaaatagtgatcaaggggttcccacagaccctaagagaataaaggtcattcctgaatggcctactccaccaagtataagggaaatctag

SEQ ID NO: 7334 - DNA, 246 bp, Glycine max
  Peptide Sequence Number=SeqID_99019
atgtccctgtcaaaacataaagggttaaggggtgtcgcaacctacccttcagcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaagggtgtttccctttgctcctacgtattcctcaatttgcgatgaggaaatcagacctacgtag

SEQ ID NO: 7335 - DNA, 420 bp, Glycine max
  Peptide Sequence Number=SeqID_99020
atggagataagatttttagtttcaagaaaatatgttgcgttgcaaatttgtgatgacgaagatgttgaaactatgattgaaagttttcaacaacaacaacaaatgtcagttctagaattgtacgtagaaaaggatgttgttggtggttcgatgtttcatgctgcaaattctgttacgtcatgtggacgtaatgtatctcatcatgagtcggaactgccaagaaatataagcaatttacatgatgatgaagatgatgatgatgattatattgcatctaactcatacgttgaagagtctttcgatgaagatgatagtgatgatggaatatctgatacagacgatgaagtcactgacatcgttgaaccagtttcaattgttcaccgaaggtgtaccacaaattcaaaatccattttggaatga

SEQ ID NO: 7336 - DNA, 759 bp, Glycine max
  Peptide Sequence Number=SeqID_99021
atggtggaaccatctaagaagtgcaaaggttcttcgagtagaagccaacgacattccgaggttcaggatactccaattccttcctccatttcctcctcctcattgttctcatcagaagaacaacatatacggtacacaaacctcttctcctctcgttctatcatagaccctaagttcatagatatggatttcttttctgatgagagtttcaaatgcattcaaacccaattgtctagtgacagtgtaccatttgaaggtgcactggacaatgattggaagtttgatttttttgtgcatgatgcccgccggttggtttgcaccaaccaagcagatatgaccgaaaggctgcttgccggttcattggctcttgaaagccgcatccttcactatcttattgatcgtattttactcccaagatcttcaaaccttgcacaggtttctgaagaagatcttatagtcatgtgggcctttcataccaaccgacaaattgattgggcacatttagtccgatctttcttgatcggtgctgttgtggttgcgtcctttggttaccgcaaagagcgtgatggctcttgggtaaaaaagggtactcaaccaaatgatgatgaaggacaattatcggttgaaggagactcttctctccttcaaagtattttggacaggtttgatggactccaaacctatgttggtgagaggtttgatgctttggaacaacaagtggccatgcgatttgatgcaatggactcaaggatcacaaag

SEQ ID NO: 7337 - DNA, 297 bp, Glycine max
  Peptide Sequence Number=SeqID_99022
atggcttttaggaagcgtaagagtatcgattcaagacccacaacacaatatgatacaaggagatttcactccgtagatgcttggaaccggtacacggataatgtcctagggagaaacatcttgcttgagagaaaggtggagctctaccacaccgagttggatgattttaagactgagttggagaggcataatttccataaatgcgtcaccaatttggccaatggaagcatagatttggctttggtgaaagagttctatgcaaacttatacaactctgaaggcccttcaccaaagtaa

SEQ ID NO: 7338 - DNA, 243 bp, Glycine max
  Peptide Sequence Number=SeqID_99023
atggcattcatggggctcctaaaaaaaggcgaggttggagaattgcaggaagttgtcgcaacatacccttcggcgggagggcgacgcgtgactcgcgggatgcgtgttccacgaaaggaacactggcggagtcgccaccaacgtttatttgaggaaaacgtcgaaaaaaccggagaagacgcgatctacgaacttttaagtgaaaggttcgggagttgtatttacgcacggggaaggcattag

SEQ ID NO: 7339 - DNA, 447 bp, Glycine max
  Peptide Sequence Number=SeqID_99024
atggcaagaatagcaaaagtggtcgagatctcggaacaagagctagaccgagtgaagcaaaataggaatggagcggcaggggtaccaaggaagcacttggaggagaaggcggaagctctaaccagccaaggagaatgggcaacattcatcgatgtattagctctgatagtgtttgggacagtactgttcccgaatgtagacggaagacaagataaagagattaagggaagtagcaatggcgtcattggcggctatcacaagtggttgaagtctagaccgcaagggatgacttggctcccaaagctaaaaagtctaagtgggaaaaaggctgaaattcttgaggaaagtgaagaagtgcaagctttgaaagcagagctcgaaaagacaagagtggcgaaagagaagctaaagacgacagtcactagggttacgaaagagtgtgattag

SEQ ID NO: 7340 - DNA, 491 bp, Glycine max
  Peptide Sequence Number=SeqID_99025
catgggtcagcagcaagcacccacaagtaaaaggggctcccttatatcacatcaacgagagtttcgttagcgtgggctggatgtgtgaagggcagatcgccatgatccacgatgaggtctctcaagagccatcagactgggtttggccatgccctcctgagttcaagttggggaactggcagattatcgaacaacccagaatttccgtggggtctctaataactactcccaatgatccatatctcacatggctgttttctagaggtatcatcactcaagataataatattgcggcggcgaggctcacgggtgcgtcttccaaaggaggaaaatgcgcggagtcgccaccaacgtttatttgtggaaaacatcggaaaaaccaaaggaaactggtcataaagaatattccagattcgggagttgtatttacgtttgaggaaggtatcagcacctctcacgttgacaaaagcggggctcttgctcctacgtag

SEQ ID NO: 7341 - DNA, 80 bp, Glycine max
  Peptide Sequence Number=SeqID_99026
gcttatgagaatcctggggccttctcttgcatctctggctcaatcttcatggagtcttctattcaattcccttggggggg

SEQ ID NO: 7342 - DNA, 623 bp, Glycine max
  Peptide Sequence Number=SeqID_99027
atgggatcgaatcaagcaccattgtttaagaaaaggttctatcaagtcaaaattaaaagcctagaggttgccagtttgcaagaattggggcaattgatggatcagctccaatgtcaagctttctgtaagacctatgggaagatttgggatctagctatgatagaagtctctattgaagccattgtgtccctcactcagtattacgatcagccactaagatgcttcacgtttggggactttcagttagtaccgatcgtagaaaagtttgaagagatcttaggatgtctgctaggaggaagaaaaccatatcttttttctgggttctatccctccatggaatggggtggccgaaataccaaggaagcacttggaggagaaagcgaagatctagcggcgatcgacgccttccttgcttaccactgttggatttcccctgcggttactttttgttcgagtttttcttcgttcaaatatattcaagggaaatccggtttgccggaaagcgcaccggatcgtcaacctaaaattactaaacctcgaccccccggtagaccgaatcaatccaagcttcgtcctttagatccctcttggttggataggcccattttagacgaccctcttag

SEQ ID NO: 7343 - DNA, 369 bp, Glycine max
  Peptide Sequence Number=SeqID_99028
atgtcacgttggcacgctaagcgcagctgcacgctaagcgcgccatacgaatttcagtttttaaaaagtagagtcagaggcacttgggttgctaccttggcacccaaacctctgcactctctcatccctgagcatttctgtttctgttgtgtgcttatctgcccctctgcattcccttgcttcttcacactctacattacacaatccaaggttaggtattttaggactttaggggtgaaaacccctgagtatcttttgggattcgcgatgaacgcgctaagcgtgcctgctgcgcttagcctgttcatcgcaactgttaaaatttttcagatttctgatgatcgcgctaagcgggccatgtcgcgctaa

SEQ ID NO: 7344 - DNA, 1083 bp, Glycine max
  Peptide Sequence Number=SeqID_99029
atggtgatgattctgaaggtgctccctaatgccgaaggccgaccgcattggcacgcaggaaacaagtacctatcactgctggcgatgattgatgctgacgcacaggacaccggtgtagaggctaacgcacacgataccggtgcagacgatgttacagataaggctgaggcctttcctagtggacccagggacccatcagtgctcatgggctatgctgaccatgttgcagcgagcgtatggtccggagagacttctagtttccatcttcctataggggaggttttgatcacgctggacgatgtcacctctctccttcatctttcgatcgctggtgacctccatgccttccagcctctgcacatcgacgaggcggtgctaatgctagttgagttactgatggtctcaccagagcactttccgtcagttgcggagtgcaacgctgatcctgactacgacgaggattccagatgtctgttggatgccatatgcggagcatcaaccggtctaggagtttcactgatttcatgctattctggtcagctctgctgggggcatgttgctgtcaggtaccgaccagagagggttatgcgacagtttggatacgtgcaggccattcctgctccgcctgtcgattcatgggtttcatttaatgacatagatgattggtggatgcattactctaaccatcttgcgccagcaggtgagatgtgcgttgtgtcaggtcagtgtgcgctagactacattgactggttcttccgtatttctcatccattcaccacgacacaaccattagattctccggtagatgcacctgctgcacaacccaaacatgtccctcaggtcctagagtcagatatccctcaagtcctagatgatccagccaggtctgatgtcgacgagcctagacatatagtggaggcttgcgatgcgatcgctgagaggttggagtgtcaccttagcctaggggtagtcacaccaggcacatcgacacatgaggtcatcgaagaatgccttaggattgccaggagtgtcatcgaagaccgcattgtgtacgtgaggtctcgacataggcctaaactttga

SEQ ID NO: 7345 - DNA, 606 bp, Glycine max
  Peptide Sequence Number=SeqID_99030
atgacggcagcaacggcgcagcgtgtaggacagggcaggtcatccaaagaggaccgcgaccgtcgcctcgtgcgttactggctttatgcagttttcgtcgtgctgattgccatcgtcatggtcggcggtgccacacgcatgacgggttctggcctttccataaccgaatggaagcccattcacggcgtcatcccgccgctcaaccacgccgaatgggtggaggaattcgacaagtatcgccagattccccagtatcagcagatcaacaagggcatgtcgctggaggaattccagtacattttctggtgggaatgggcgcatcgcctgcttgcgcgttttgtcgggtttctggtcgccgttccgctggccttcttctgggtgacgggacgcctccgcggtggcctcaaatactcgcatgctgggtctgctcgcgctcggcggcctgcagggcgccatcggctggtggatggtggcctccggcctgagcgagctgacgagcgtcagccagtatcgcctggcgatccatctgacgacggcctgcgtcatcataacggcgatttacctgggtgggctcgtggccgggctgcatgccggtctgacctataa

SEQ ID NO: 7346 - DNA, 447 bp, Glycine max
  Peptide Sequence Number=SeqID_99031
atgatgatgaaggacaattgccgattgaaggagactcttctctccttcaaagtattttggacaagttcgatggactccaaacttatgttggtgaaaggtttgatgctttggaacaacaagtgcacacacgattcaacaagatggactcaaggatcacaaaggttgaagaagatgtcaccttcattcacacgtgctttgatctaccaccaccatcgtcttagagattgtcatcatcaaaaagggggagattgtggaagcaatgtcttccaaggttattttgatgatgccaaagaatcaagagttaagcaaagtttcaagcaaagattaaagattcaagaatcaagtttcaagtttcaagattcaagattcaagaatccagatttaagaatcaagatcaagattcaagactcaagacttaagaatcaagagaagactcgatcaagataa

SEQ ID NO: 7347 - DNA, 258 bp, Glycine max
  Peptide Sequence Number=SeqID_99032
atgaataaaaaatctgtacctgtcgccaaactctatggtttatgctcctttgccgaccaccacacagacctttgcccttctgtgcaacaatctgaagcaattgaacagcttgaagcttatgctgcaaacatctacaatagacctcctcaacctcagcagcaaaatcagccacaacataacaattatgacttctccagcaacagatcatatgttcctccaccaatccagcaacaacaacaacaacagccccagaaatag

SEQ ID NO: 7348 - DNA, 95 bp, Glycine max
  Peptide Sequence Number=SeqID_99033
atgggtgataactggaagtccccaaaggtgaagcacctcaacggccggcttgtcactggagctgacccatcaactgccctaactctttcagactg

SEQ ID NO: 7349 - DNA, 699 bp, Glycine max
  Peptide Sequence Number=SeqID_99034
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaatttttttaaggcagttattggtgctagaatatttatctga

SEQ ID NO: 7350 - DNA, 923 bp, Glycine max
  Peptide Sequence Number=SeqID_99035
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaaaactcaaacttaccaccttacatgaagcttcgggcaaatcagaggttcgaggctgcgacagttgcctgtaggaaagcaaaacacgattatgaaaatgccaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgct

SEQ ID NO: 7351 - DNA, 1029 bp, Glycine max
  Peptide Sequence Number=SeqID_99036
atggccccgaggaagcttgcctcaaagaggtccaggaaggacaaggcggccgaaggaattagttccgctcctgagtatgacagtcaccgctttaggagcgctgtacaccagcagcgcttcgaggccatcaagggatggtcatttctccgggagcgacgcgtccagctcagggacgacgagtatactgatttccaggaggagataggccgccggcggtgggcatcactggttacccccatggccaagttcgatccagaagtagtcattgagttttatgccaatgcttggccaacagaggagggcgtgcgagacatgaggtcttgggtgaggggtcagtggatcccatttgatgcagatgctatcggccagctcctgggatatcctttagtgctggaagagggtcaggagtgcgagtatggccagaggagaaaccggtccgatgggtttgatgaggaggccatcgcccagttactatgtataccggggcaggattttgcccggactgctgtcgggagacgggtgcggatcatgcgcaccaacatgaccaccctgactcagatctggatgactttgctgctcagcaacatccagcccaacgaccataattccgacctccccctgccgaagtgtatggcgcctaccaagcatcctctggactcggataagtccaacagggccctgggatttcccgccttgatcacaggactctgccagtcgttcggagtccctgtcgcacctagcaaggtgatttggccgcccatcacccgagatttttttgagaagtattgcacgcagagacaggcccagagggatgctccgcaggccgcagacgcgccgccacctcatcaggccggtccagccggatcgttcgatacggagcagtattggcggcatttggttcgccagcaggcggccaaccaccgggcacatgtacagacccatgattgtctttatcagatgagcctcagcctgcagagccagggctttacttcttttccgtgccctactccggaccagttcagggcaaag

SEQ ID NO: 7352 - DNA, 393 bp, Glycine max
  Peptide Sequence Number=SeqID_99037
atggctacagccaggtgggcactcaagcatcccgtttatggcattgtgatactacggttgggaatttacacaagcagacccaatgtttccaaattatgttctcccatcaattcaatgaattcatccattcttatctcggacgacgttcctaaaggaaaactctacaagatttcggaacaaacattatcaacaaataacgaatgcctcagtcatagaaacaagataaatgatggaacatacgaatttggggatcccacagtcatgtggcttcgcatgccaccggactcttgggtcacggtaacaaaaggtggggtggtcgacaaaagcagggcttttgctcctacgtatcctcaatttgtgatgaggaactcagacctacgtagttcttgctaa

SEQ ID NO: 7353 - DNA, 216 bp, Glycine max
  Peptide Sequence Number=SeqID_99038
atggagagaagccataacttcaacaatgggaagagatctcaagaagtttctccaatacttaaatgctataaaatgagaaaaaaagctataaagaaagaagatccaagaacgtatattgcttgggatgacaatgactcatccgatggttcagagaaggagatcaaccttctatccaaggactatgaaagtgatgagaacatctctcaaaaagtttaa

SEQ ID NO: 7354 - DNA, 789 bp, Glycine max
  Peptide Sequence Number=SeqID_99039
atggcaatttcattcaagacaaaagatgtcaacgaggaagtaacctctaaagacatgaagagcctaatggaacaagcaaattataccaataaatatttacaagctttaggagaaaccattaaaactaaggtagttcctaaacaaaaatcaattgaggaagcttcgccaagtatccccattgaaaaacctttattcaaacctttcaaagttagtgagaaggctaaacgaaaaattagggaacttagaaaaactaaatccttaattgaaggcgtaggtcattccagatactccccaaacctcgaaaaatacttccaaaatggtaacaagaacgcagttaagacatatctcaatagaaaagtcattactaatgacgatgataaagagattcctgacgctgttaacacattaatttttacaatagcccaacatttcattggagacccatccttgtggatagataggtctgcagaattactatcaaatcttaagtgtagaaccttagcagactttaggtggtacagagatactttcctaactagggtttacaccagagaagatagtcaacaacctttttggaaagaaaattttctagtcggtcttcccaggtctttaggagacaaggttagagataaaatccgtagtcaatctgtcaatggagatattccatatgaaagtttaagctatggtcaattaattccttatgtccaaaaggtagccttaaaaatttgtcaggatgaccaaattcagaggcaattagccaaagaaaaggctcaaacaaagaacgatcag

SEQ ID NO: 7355 - DNA, 171 bp, Glycine max
  Peptide Sequence Number=SeqID_99040
atggatacctcagagccctacactggggcaatgaaaggcaccatgcataaacctcaaccttacactagggcaatgaggggcaccgtgcatgagcctcaagtgaacctaggggcagatcaaaagttctcacccatcgatgtttttaaacaaaaaaaagggtacaaaccctag

SEQ ID NO: 7356 - DNA, 243 bp, Glycine max
  Peptide Sequence Number=SeqID_99041
atgacatctgaggcagcaaaggaaattgctgagaagattgagcaggcgtcacagggttcctttgtcccccatagacgtcaggatgtcttgactgctgccattgggcgaccagaacaccctggtcgtgtgcatgctgctggagccggtgtgacgatcaagcaatactttggaccggctccacggacctcccgcactttcctccatggctcccgaagaactaaagcagctgactcaaaaaattag

SEQ ID NO: 7357 - DNA, 196 bp, Glycine max
  Peptide Sequence Number=SeqID_99042
atgcagcagaaacgacatcctcatgctcagtcatcttcacagccaacaattaattgcacttctgaatatgatatcattgcctctgattcattagaaagtgtaaattctgaatccacacaaggttcatgctctaattttttaactgcctatgaggattgccaatctccaactaatcggcctataatcaacactgaag

SEQ ID NO: 7358 - DNA, 288 bp, Glycine max
  Peptide Sequence Number=SeqID_99043
atggaggattgggggaattatcaccatcgaatccttgaggaggattctgaggattctgctctgattaaagtgttcctcttggtgtgggggttcgacgacaagcaacggctgctcgcggtagccaccagtggtcattggtggtggagaaggagatatcgcttagtgagctcgtctcgcaaagctggagtccacttttcatgcttagcgcgacaatttgggcttagcacaacttcctctgcactagggctcgctcagcgcaattccctctcgggttggaattgcgcttaa

SEQ ID NO: 7359 - DNA, 798 bp, Glycine max
  Peptide Sequence Number=SeqID_99044
atgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 7360 - DNA, 181 bp, Glycine max
  Peptide Sequence Number=SeqID_99045
tctcccgacgaagaagaagaaggttccagcccgacaggctagagctccggaaagggcgggctgggtggacatagatatgcaagatcgtcttaccttacaaggattggacttcagccgtaaaacaagggggaaggatgcagccgcagcggtggactgcgccaaagagaaaagacgtaacaag

SEQ ID NO: 7361 - DNA, 294 bp, Glycine max
  Peptide Sequence Number=SeqID_99046
atgcaagacaaaattgattgcaataacataaatgagataaaggaagagagagatgtaaactcgatttatactggttcgaccacttcccgttcaaaattcaaattcaaaaccctttttaacattaccagagcattggatgtcttagaaatactttgttttgagtttgttaatgatgcaatcctcgctaggaaggaaccagtcactagagccatgagcaagaggccccaagaggattggactagaactgctgaagaaggccctagggttctcatgaacctcaaggtagatttctaa

SEQ ID NO: 7362 - DNA, 523 bp, Glycine max
  Peptide Sequence Number=SeqID_99047
gtaacccttgtggcgtctacccagacttatcttcctttaccggaagtggcgtctacccagacttatcttccttcattggaagtggcgtctacccagacttatcttccttaaccggaagtggcgtctacccagacttatcttccttaaccggaagtggagtctacccagacttatcttccttcattggaagtggcgtctaccctgacttatcttccttcacgggaagtggcgtcatccaaatctctgtaacctgtatcaaacgatccgctcctactcagacttatcaaggtaacccttgtggcgtctacccagacttatcttcctttaccggaagtggcgtctacccagacttatcttccttcattggaagtggcgtctacccagacttatcttccttaaccggaagtggcgtctacccagacttatcttccttcattggaagtggcgtctaccatgacttatcttccttcactggaagtggcgtcatccaaaccttcgtagcctgtatcaaacgatccgcccc

SEQ ID NO: 7363 - DNA, 258 bp, Glycine max
  Peptide Sequence Number=SeqID_99048
gcagcaacaattccaaaggaagaacctctatcttctgaggcatcttctagttttcctattgcagaacattctcatttagatcctagtgaagactacatcatggctgaagagccaagaagagttactctggaagactattcaagttctaatataccacaatttttcaccagcattgcagaacctgaagagaatcaaggtggcttcattcattacaaggctaatggtcttaatcatgagatggcggggagaaatttttga

SEQ ID NO: 7364 - DNA, 282 bp, Glycine max
  Peptide Sequence Number=SeqID_99049
atgccttccaaggttattttgatgatgccaaagaatcaagagttaagcaaagtttcaagcaaagattcaagaatcaagtttcaagattcaagattcaagactcaagaatcaagtttcaagaatcaagattcaagaataatcaagatcaagattcaagactcaagattcaagaatcaagaagacacagtcaagataacacaagaagttttcacaaaatcttttatcaaagagttttactctctggtaatcgattaccagaaggtagtaatcgattaccagtag

SEQ ID NO: 7365 - DNA, 159 bp, Glycine max
  Peptide Sequence Number=SeqID_99050
atggctcacaaattctgttttgaggcacttgatcacagtcttagacatatcatcaaacacaactcaaaggacaatacaatctttggaggtaaagtcatggtctttggtggagatttccggcagatcccgccagtcattccaagaggtatgcaatcttaa

SEQ ID NO: 7366 - DNA, 225 bp, Glycine max
  Peptide Sequence Number=SeqID_99051
atgatgcccatcacaaatacaaacggccattacccgtttcctctggatctccgcgataaggccgagaaacctattggagacacccggaaatcaacaaggaacactcggagcaaattcttacagttggaaagcgttttgacctcggatatccgattgagccccataatatatcatggtagctcgaaagtggaaatcgaatgccgacacaaattcggatggccataa

SEQ ID NO: 7367 - DNA, 110 bp, Glycine max
  Peptide Sequence Number=SeqID_99052
atgttccggttttttcgatgttttcctcaaataaacgttggtggtgactccacgcgccttcctcccttggaagacgcacccatgagcccccgtcgccctcctgctgaagg

SEQ ID NO: 7368 - DNA, 303 bp, Glycine max
  Peptide Sequence Number=SeqID_99053
atggaagaaaacatgtgggccatcattgaccaatacaaggagaagctaagtctagcagcaacccatgaacaaaggctagaggacgagtatgcaaaggtgtcagtcttgcaagcagaaagggaagcgagagaaagagtaattgattcattacacagagaagcaatgatatggatgcataggttcattttcaccttgaatggaagtcaagagcttccaagattgctagccaaagctaaggcaatggcggacgtgtactcggccccgaggaagttcatgggctccttgattattgtcagcacatga

SEQ ID NO: 7369 - DNA, 309 bp, Glycine max
  Peptide Sequence Number=SeqID_99054
atgacaaaaggtgcggataaccataaggtaccccacatgtcatcggactcgtcgtctctggatgacaaaggtgcagaagatgacgtgcctataaccacaaggtaccccgacatgtatcggactcgccgtctctggatgacaaaaggtgcggataaccataaggtacccccgcatgtcatcgtactcgccgtctctggattacaaaaggtgcagataaccataagcggtctcgcttgccccttgttgacaaaaggtgcagatgacgacgttagtctctgcgtgctaccggactctgagtctgacggatag

SEQ ID NO: 7370 - DNA, 339 bp, Glycine max
  Peptide Sequence Number=SeqID_99055
atgaccggtttccttcggtttttccgatattttccacaaataaacgttggtggcgactctgcgcattttcctcctttggaagacgcacccgtgagcctcgcctcgctcgcccgcaaaagggaaattaggagtggaggttgcacagtagctcacctaggcgagttgcttgcttcctccaaaagcaacctagctcgcccaggcgtgttggttacttcatccctaagctttctagtgggactaggggctgaaaaatgttccaaaagtgaccatttttcccttcttttgaatattttgcacatttcctttttgaaacgtcacaaaaccctacggattacatga

SEQ ID NO: 7371 - DNA, 720 bp, Glycine max
  Peptide Sequence Number=SeqID_99056
atggcagctacaagcatagtgagccttggtgctttattagataaatcactagaagtgatgattttcttctgcttttcctttgctgccactagggatggatgcatggttcttgtggggtattcaaagccactatggcatctggaggcagagcctcataagcaggagatagagtgtggacatgatcatacttcatccattgggttggacttactacctcaaggatggatgcatggttcttgtggtaccattcggcatccattaaggacctatcttgaccaggggtattcagagccactatggcatctggaggcagagcctcataagcagcagatagagtgtggacatgatcatacttcatccattggagtgggagttggagttacctcactgtctgacgaaataaagtcaccggaggatggtattctgatgggttcctttggagtcatggacttgcatccagctcgtgtcttcttcttctttggaaaaaaaggatgggatgattggctaatcaagcttctatttcttttggatagtgtcacaacctacccttcggtgggaaggcgacgcgagactcacgggtgcgtcttccaagggaggaaaacacatggagttgccaccaacgtttatttgaggaaaatgctagaaaaaccaaaaagcgggtctatgaactttaagtatgaaaggttcgggagtttgttttacacaaggggaaggtattag

SEQ ID NO: 7372 - DNA, 213 bp, Glycine max
  Peptide Sequence Number=SeqID_99057
atgaccaagagcaagggcaaggatccacttgaaggacttggaggacctatgacaagggctagagcaaggaaagcaaaggaagctcttcaacaacttaggcatcagcctttgggagaccaaatggtgattggctcgatggcttttggggtgacttttggttgccacaatttcaattacactcagccattaagttcttctaattccctaggttag

SEQ ID NO: 7373 - DNA, 1549 bp, Glycine max
  Peptide Sequence Number=SeqID_99058
ggcaagccagcccgttgacacgcagagactaacgtcatcttctgcacctttgtcatccagagacgacgagtctgatgacatgcgggggtaccttatggttatccgcatcttttgtcatccagagacggtgagtccgatgtcatatgggggggcaagcgagcccgttgacaagcagagactaacgtcatcttctgcacctttgtcatccagagacgacgagtccgaggacatgcgggggtaccttatggttatccgcaccttttgtcatccagagacggcgagaccgatgacatgcaaggagactaacatcgtcatctgcaccttttgtcaaccaagggcaagcgagcccgctgacacgcagagactaacgtcatcttctgcacctttttcatccagagacgaagagttcgatgacatgcgggggtactttgtggggtaccttacggttatccgaaccttttgccaaccagaggaaagcgagctcgttgacacgcagggacaaacatcgtcatctgcaccttttgtcaacctggggcaagcgagcccgttgacatactacgagtccgatgacatatgggggtaccctatggttatctgcgccttttgtcaactagaggcaagcgagcgcattgacaggcagagactaacattgtcatctgcagacgacgagtccaatgacatatggggctacctttcggttatcggcaccttttgtcaactagaggcaagcgagtccattgacacgcagagactaacatcagacgacgagtcggatgacatgcggttgtaccttatggttatccgcatcttttgtcatccagagaggtcgagtccgatgacatatggggagacggcgagtccgatgagatgcggggtgactaacatcgtcatctgcacctattgtcaacaaggggtaagcaagcccgctgacacgcagagactaacgtcgtcttctgtacctttgtcatcaagagaggacgagtctgatgacatgcaggggtaccttatagttatccgcaccttttgttatccagagacggcaagtccgatgacatgcggggatggcgagtctgatgacatgcgagggtaccttatggttatccgcaccttttgtcaaccagaggaaagcgagcccgttgacacgcagagactaacattgtcatctgcaccttttgtcatccaggggcaagcgagcccgttgacacgcagagctaaacgtcatcttctgcacctttgtcatcaagaggcgacaaggccgatgacatgcggggtaccttatggtgtctgcaccttttgtcatccagagacggcgagtccgatgagatgcgggggggcaagcgagctagttgacacacagagagtaatgtcatcttctgcacctttgtcacccagagaagacgagtccaatgacatatgggtgtaccttatggttatccgcaccttttgtcatccagagattgcgagttcgatgactttcggggtaccttatggttatccgcaccttttgtcatccagagacgacgagtccgatgacatgcggagatacctg

SEQ ID NO: 7374 - DNA, 438 bp, Glycine max
  Peptide Sequence Number=SeqID_99059
atgagaggactacacgtcctcgccatcagagggctacccgccctcaccttcaagggactacaagtcctcgccttcagaggactacatgtcctaacatttggaggactacacatcctccctttcaaagggctacacatcctcaccttcagaggacttcacatccttcgcttcagagggatacacgtccgcctcttcagagggctacacgccctccccttcagaggactacacgtcctcgccttcagagggctacacgccctcaccatcagaggactacacgtcctcaccttaagaggactacacgtccttgcctttagaggactacatgtcctcgcctttagaggactacacgtcctcgcattcagaaggctacataccctcactttcagaggactacatgtcctcgcctttagatggctgcacgccctcaccttctag

SEQ ID NO: 7375 - DNA, 330 bp, Glycine max
  Peptide Sequence Number=SeqID_99060
ggtgatctgtcttattgggagtatgttgatacttttcattctgttcagagcagcaactcttcagtgaaacatagtgcatcatcttttcctgactcgccaaagccaccgaagccaacaaggatcatcccgatgttggatcaatttgagtcatttatacagggtttcattgacgacattgtggatgtcaaagtggacggtaaatgtggatatcagtccattgccggtttattaggtatgggtgaagattcttggtcgttggtgcgccacgaattgatgaaagaacttggcaaatggtcggatgactacatcaagctcttcggtggcacatag

SEQ ID NO: 7376 - DNA, 420 bp, Glycine max
  Peptide Sequence Number=SeqID_99061
atggcacacagcatatccgcttcgtgcccctattcaagggacctacaagggagggagctaaaaggacttttagtgatatttcccaaggtggtcatatctctcttgatggtctctagaggtatcatcctcttcgaagaacatattgctgcagtagggactactagcaacaatatgttatcagagagaaaaactatagatgagggttcactgaacttttggcatttgataaaatttggtgagagtttctctctgagttccttgttgaaccaatctcagacttatcaaggtaatccttgtggcatctaccctgacttatcttccttcaccggaagtggcatcatccaaacctccgtagcctgtatcaaacgatccgctcctactcaggttcacatcatctggtatcaaagcttcggctcttga

SEQ ID NO: 7377 - DNA, 222 bp, Glycine max
  Peptide Sequence Number=SeqID_99062
atggtgaaagttggaacctcttacgtgccgatcaacgtctcattttcgccaaaagttggcccagggcttcccgaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 7378 - DNA, 860 bp, Glycine max
  Peptide Sequence Number=SeqID_99063
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaggcaagaatcttggcagataaaggcgagtggaccccattcatagatattctcacactattgattttcgagggagtcctctttccaaatgtggatgggttggtggacctggcagcgatcgacgtttttctcgcctatcataaccacaaggaaagtccggttgtcactatgctagccgacctatatgataccttcgaccgacgatgtgaagaaagcaatgcaaggattgtttgctgtactccagctctctatgtggggctggtttcacacctttttctccaagaaggtaggcccgtctatccgctacaaggttaccgctcatgcgtcgaaaaaggaaaggcgaattgggaccaactcttggctagcatgggggggcgtctgttaattggttccctcgctaagaaggaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacacctttcatcgcacggggttttagtgaccacaacgcgag

SEQ ID NO: 7379 - DNA, 294 bp, Glycine max
  Peptide Sequence Number=SeqID_99064
aatggccactgttcaacacctggtgatggacaacaagaagaggaggcccattatctgcagaaccaggctagacctcaacaaaactttcaaggaagataccaaggctataggggtggcttaggttcaaatcaaccttatggcaggagaccacataataatacatattctggtccaaataacacttcttttgcaggtccttctaacaacacgtatggaggttcttcaattaagggtacacaacaacaacaagctcaaccagatagaatgtccaagatggaagataccttaacctag

SEQ ID NO: 7380 - DNA, 684 bp, Glycine max
  Peptide Sequence Number=SeqID_99065
atggcagaggtctccaccgaggccattgcctccctcgcccaatattatgaccagttgttgaggtgcttcacctttggggacttccagttatcacccacggtggaagagtttgaagagatcctgggatgccctctaggagaaaggaaaccatacctcttttcaggattctatccctctttagctagaatttctaagatagtccaaatctcgatgcaggaattagaccacagaaagcaagtcgaaaatggggtggttggagtaccgaggaaatgtttggaagcaaaagcaagagtcttggcaggtaaaggtgaatgggccccgttcacagacatcctcgtgcttttgatcttcggaggggtcctctttccaaatgtggatgggttggtggacctggcagcgactgacgcttttctcgcatttcatgaccgcaaggaaagcccggttatcgctatcctagccgatctatatgacaccttcgaccgaagatgtgaaaagagcagtacaaggattgtttgctgtactctggccctctacgtatggttggtttcgcaccttttccaccaagaggtgagacatgcttgcccgctagaaggccaccgctcatcgacagagaaaaaagaggcaagttgggaccaactcttagcaagcaaagaaggggcgtctgtcaaccggttcccccgatag

SEQ ID NO: 7381 - DNA, 231 bp, Glycine max
  Peptide Sequence Number=SeqID_99066
atgaagaacgtcgaagaacggtcgaaaaccttcgcgaaattcctcacggaaacgttacgaaagcgcctcggcttggattttcttcacggaaacaatttttcaaagcaaattcgaaagagaaagaagaaattgggggagaagcttgccacccagctcgcccaggctagctcagctcccccaggcgagctcagctcgcccaggcgagcagggttgcttcctctaatcgattaa

SEQ ID NO: 7382 - DNA, 384 bp, Glycine max
  Peptide Sequence Number=SeqID_99067
cctccaaagcaagttagggtcagagggcatttaattaagtttgatgcggattccctcaacacttttctggagactccagttgttctagagccaggggagactcttcctggttactccaggttctgcagactgagaccaggccctgaggagctagctgcccaactttgtatccctggtaggggattttttctgaatgctgagggcctgccatggaagctgctgaggaaagacctcactactctggcgcatacttggagcgttctgtcttatttcaaccttgcccctacatcacacacttctgatcaaaacttggacagggcaaggttggtatatggattagtgatgaagatgggcatgaatgttggagccctcatctctggatag

SEQ ID NO: 7383 - DNA, 480 bp, Glycine max
  Peptide Sequence Number=SeqID_99068
atgtacaatcatcatgaaaaaggaagagctcctgatcttgaaagcgtgttagcagacttcatgacatatcaagctagctctaaagctaattgttattcaacgcaacagcagggaactcagtttggcaaggactattcttttgaagattatcaatgggaatcagaatggcaaccttgttatcataatgaagcagaaggattgtttaatctggatgacttgttaatgcaattcaagggtacaattgattcaatgcaacaagcatttaaaagagctgagactcagattgctaagttggtggataaaatgattcaagttgtggtcagaagagaagaagagtcaactactggctatgttgtagatagagataaaggtcgattggaactaagtgtagaggatcagaaaatctcctttgatctctttgaagcaatgaaacacccagatatgagtgatgtatgttttgaagaagaagaggtggagtag

SEQ ID NO: 7384 - DNA, 378 bp, Glycine max
  Peptide Sequence Number=SeqID_99069
atggtccatgacatctttttcaaggtgaaactggaagtaacaaggacatcaacagtcctaaatgtgtttggcagtagacaaagcagcgataggaaaacgcaaggatcatgcatgagcaaacatgaaaataaaaaggaatatgataatggacaaatgcaggaacaatatgttcattatgatgccattaagagacgcttatgcgatgcattatatgaatgcatttacggacacgagagaccgaaaaatcgtatcttcttacttgtgcatttgggggcgcagtgccccatgtgtacagttaagaaggtcatatggaccttttggcctcccatgacaaaagacgagtccaacatacaacgcatgcgtgacgacatgatgtag

SEQ ID NO: 7385 - DNA, 571 bp, Glycine max
  Peptide Sequence Number=SeqID_99070
atgagtcatcattcatctagtgttaatggcaagggtactagtcataaggaccctctatctagaatcttagatgagttgagttccctcaagttatggaaagaaaaactagaaagaaaagtaaaaggaaaagagagggtaaaaataaatcaagatgagagggaacaaataagggaagaagaaagaaggaaaatactaaaagaattaagaaaagaaaaacatgcctcctatagtagtcataactcttgcaaaagcctaagtgaggaacttcgtgactattatgaaggaaggcataggtcacatcttagacctcactcccatatgagagaaaaggaaagaaatcctcaagaggctaacattaacctcccatacttccatgggaaggacaatgtagaggctaacttagattgggaaataagggtagagcaacaacttaaaagaaagtctacttcgaaatcttatggctctcactcttatccaaagaaagaccatggtcaaggcatcttaggggtgacaccttctaagcccaaagatgataaggggaagacaatagaaaggcaaccccttaaggcta

SEQ ID NO: 7386 - DNA, 291 bp, Glycine max
  Peptide Sequence Number=SeqID_99071
atgagaaatgctctcaggaatggaagcttcgcgcacacttcaaacatcttctcaaagatcccaatggtgtcgcaacctacccttcgacaggggtgcaaaaaggccaaaatagatgggccaaatgcgtggacttgtcaccaacgtttattcaaggaaaacgttaggaaaacaaaaaaggcaaggtctgcggattttgaaagtgagggttcgggagttgtttacgcacggggaagggtgttgccctcgctccaacgtatcctcaggtgcgatgaggaattcaaacctacgtag

SEQ ID NO: 7387 - DNA, 864 bp, Glycine max
  Peptide Sequence Number=SeqID_99072
gacttccaactagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttagtgacatcttggcgcttttgatctttggagttgtcctctttccgaatatggaagggttagtggacctagcagtgattgacgctttcctcgcctttcatcatggcaaggaaagcccggtcgtcgccattttgaccatgtatgacacgttcgaccggggatgtgaaaagagcagccgagaattgtttgttgtgcactggctctctatgtgtggctggtttcacaccttttttctccaagaaggtaggcccgtctatccgctacaaggtcaccgctcgtgcatcgaaaaaggaaaggcgaattgggaccaactcttggctaacatggaggggcgtctgggttgtattaattataatcccgtcctcgccataagacagcttggctaccccatgagagaagtgccatcagacgaaagcatcacgcctttcatcgcacggggtttcagtgaccacaacgcgagggatagaaagcttaggggaagcagtaatgggatcatcggcggctatcataagcggctgagagtccgaacacaaggattggattggctcccaaatctaaagactgtgagagacgatgaggttaaagcttcggaagaaagtgatgaggtacaagccctaaaggcaaagcttgaaagagcccgggtagtcaaagagaagttcaagtccatagccatcaaagtctga

SEQ ID NO: 7388 - DNA, 216 bp, Glycine max
  Peptide Sequence Number=SeqID_99073
atgaccctttcatcgtggcagaacaagctagacaagtattttacgtgcaagacccttgtgatgaaaggtggtgcgtggttctgcagggcaaaacaattgagacagaggtcaccaaagcaaatggcatccttaggacttcatacagctcatgtttgtcgccagtttcatcatccaccacccttacattctctggcttctcatgtttattgttgttaa

SEQ ID NO: 7389 - DNA, 543 bp, Glycine max
  Peptide Sequence Number=SeqID_99074
atggttcgcgagaagaagcctaccgtaaacagcagcaggaacatccccaccatcgcgttaccatggcggaactcacgccagccgatataccagcagcctgccatggctgtgcgggatattaatgcgattgtcctgcgtgtcgcgacgcagtacatagcggaaggcctccttgcgtggccccattcccgcaggatgctcacccaccagtttccagccctggtggaagaagctggcgcggcagccgttggagtggtccattggtcggcccagatcgttcctcggtaccgtcccgttagttttgttgtagcaaaagctggtgaaaggcgcgttccagcctgttaccgcatcatcttccaggctttgccagcgcggatcggttttaaaggaggcatagcccaaaagcgcggaaacgataacgatgctcagaaggataccaccagtgagcaccacgcgactgcgacgcatactgtgcaggctgagcagaatgaaggtggagaacaggctgccgaccaggccgatcgttccccagcgggtatcaactaa

SEQ ID NO: 7390 - DNA, 258 bp, Glycine max
  Peptide Sequence Number=SeqID_99075
atggggaatttcatgtgtctcccccacggtttaagagacatgtgcatgatcagtttggggttgttggctctcaaagggtataggagtggagttattgacattcttattgggagtgtacgccacattgggtggcgtatagttgagaggcaagccatatggcgggaaggcgttggatggttcattgatgccggatggggacgtcgggttcaccttagcaacaacgctggtagcggcaattgcaaccgcattgttaagtga

SEQ ID NO: 7391 - DNA, 532 bp, Glycine max
  Peptide Sequence Number=SeqID_99076
atggcatccttcagccagatgcaatccctgattcagtcccaaatgcaatctcagggacttgcactgcctcccgagcctctggttggtccctccggtactcgagtaagcacaaaggggagttgtgttgatccctcacgaaacgattctgagacgggtgactcagataggtgcggcttgtacatcgaagtagatcctgcccgcctggttgccctggggagagtttgtgagggatccactattgttcataacactcctttgttgcctggccaagtaaaggtgagcacttcacaccttccttgcttggccgacacatctggtcaagtctttatcacaacagttgtctctccggcaaaaccacctccaaagcccgatccacaggtcgatgatccgctttatctgatgacattgaccatcccaaggcttttcttgaggccttatcaggttacatgggatgccaccgtgtttggggtctttaatccacatttcccgctctacataaagcacgaagacctctctgaaatcgcacacggtg

SEQ ID NO: 7392 - DNA, 405 bp, Glycine max
  Peptide Sequence Number=SeqID_99077
gatggtgatgttgatttgaatgcttcaccccaagcacttgataagctgctgggttatgaacttgctttcaagataaaggtgcaacccaagttcaggaattatgttgttttgaagtgttcagctgactcgagcttaataaatgttgtgatggatatgctagctgatgctgaggtaatgttcaatacatcttcaaaaatggatatcccggtttctgattccaatcattcttctcaacatgaatctcaatccctctctgtgacagcagaccatgatccactgcttggactccccttgacgcctacaaagcggcagacatttcaagattgtgatgatgaggcaaggacctctcaaatttcacctgcacagctttcatccaacaaattaaaaaaacatgacgcaatttag

SEQ ID NO: 7393 - DNA, 501 bp, Glycine max
  Peptide Sequence Number=SeqID_99078
atgcttagaagtcaagattacctcagagaagctacgaaaggaaggattgagggattttttttctccaccaaatccttgaggtggattctaaggatttcgcttcgattaaaatgttcctcttggtgtgggggttcagcggcaagcaacggtggctcgtggtggtcaccgatggtcgagggtggtgttgaagaaggtagtggagttgcagagatagatggatgcaactcaaggaaaattgcaagaccttggagactgatggtgctggtacagagattgtgttacaaaaatcccgaagtgggtgtaggacctgaaggatcaattgcttgtctggttgcaaaagtttatagggagaaaccacttggatttgttgctcatgggaaatctagattagtttgctacttgtgtcgctatgctttttgtagtgagacaaaccattccatattctatcgatacttatcccaattcccaagttcaggatatctgtttaattgtttgagttga

SEQ ID NO: 7394 - DNA, 474 bp, Glycine max
  Peptide Sequence Number=SeqID_99079
atgatctatgttgtgaagaacgtgaggatacccaagtatctagacttggaatggttctctaagcaagggttcaattttcctaatctaatggaagcactaggtttgtctaaactgttggatatgaaagcaacattctgttcggaactagtcaaggttttctacacctatgcacgcactgaccttgaaggtaatctcttctctactgttaatggagtagaaatggtaactggcactgaagtgtggaaggaagtagtcggtgtcaagatgaattgggtacttttgataaaagacatcatgttaaagagtcgtcgattaatggactacaaatttctttatgtcgtgcttgcctcaagattcattgactacttcaatgtcaatgcctctaatgagatagtggattttacaaaagcatctagtgagattaccgaaaggcatctcaagaagcttggaatgaggtttgctaaccatgagtag

SEQ ID NO: 7395 - DNA, 204 bp, Glycine max
  Peptide Sequence Number=SeqID_99080
atgtcttttcttatggcagtggtcctagatgtagggaacaatttctccaacaacactctcttaagtgtagaagcaaagcttcatgatgatgacaaaggtgatgacaaaaagctcaaagatcaatcaaagaacaactcaagtgaatcaaagatcaatcaaagaacaactcaagtgaatcaagaacaattcaagagttcaagataa

SEQ ID NO: 7396 - DNA, 803 bp, Glycine max
  Peptide Sequence Number=SeqID_99081
atgtacaattatcatgagaaaggaagagctcctgatcttgaaagtatattggcagacttcatgacatatcaagctagctctaaaggtgatttctattcaatgcaacaacagggaactcagtttgaaagggactattcttttgcagattatcaatgggagtcagaatggaaaccttattatcacaatgaagcaaaaggattgtttaatctggatgacttgttaatgcaattcaaagatacagtagattcaatgcaacaagcatttaaaagaattgagactcaaattggtaagttggtggatggcgtgactaaagttgtggtcaaaagagaagaagagtatccagagattgaaactcatcaagaaagcattcttcaagttaacacaatccatcatcaattgatcaccaaagatgaaaaggatgaagtctccattattccagaatatccctacatggcaactactggatatgttgtaggcaaagataaaggtcgattggaacttagtgtagaggagcagaaaatctcctttgacctctttgaagcaatgaaacacccagatatgggtgatgcctgttttgcagaagaagaggtggagcaggagatagcattatcagcttcaaccatggtactacagttccctttggaagaagaacctaattgtgtgacagactgcctagtttgtgatgaagaacttgatgatccacaagacaactctgttggtcatgtagtttttgaagaattggaaaaaattagaccaaaagaaaagcccaaagtagaactgaagactcttccagcgcaattaaa

SEQ ID NO: 7397 - DNA, 318 bp, Glycine max
  Peptide Sequence Number=SeqID_99082
atgtctcctccacctctagaacctcacaatcactcacaacctcatctcaagctctcaagacggcttcctcttcaagctccggtctatgtaggtggctttgtttgtgctagcgcgcttagcgcgactatggaccgctcaacacgcattagtagatttcggcttagcacgtgcttttctcgctcagtggatggattgaaatggtgcgctaagcgggatgaactgttgactcagtgcacatgcacagttcatctttcttccagattctttctttcacttagccgaggagtgtcgcgctcagcggatggctcgctaagctag

SEQ ID NO: 7398 - DNA, 458 bp, Glycine max
  Peptide Sequence Number=SeqID_99083
actctgaagaaacgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaagattaatgaagctggtgcaaaacggtattgcaaattgagtatgggaagaaaatgggttgaaaataggcaaagcttatggaatgaattcaacgatccaaccaaaacaagagatgaaatcataaaaaatgtgccgataggcatagataaagatcaatgggctcgttttgttcattatcgtcataaaccatccacattgctaattatatga

SEQ ID NO: 7399 - DNA, 261 bp, Glycine max
  Peptide Sequence Number=SeqID_99084
atggctacagccaggtgggcactcaagcatcccttttatggcatcgtgacactacggatgacgttcctaaatggaaaactccacacaactccggaatttcaaaaacacactattgacaacaatgaaggatcccacggtcatgtggctccgcatgcccccggactcttgggtcacggtaacaaaaagtgtggtggtcgacaaaagcagggcttttgctcctacgtatcctcaatttgtgatgaggaactcagacctacgtag

SEQ ID NO: 7400 - DNA, 811 bp, Glycine max
  Peptide Sequence Number=SeqID_99085
atggcgcctgatgcggtattttctccttacgcatctgtgcggtatttcacaccgcatatgacaagctgtgaccgtctccgggagctgcatgtgtcagaggttttcaccgtcatcaccgaaacgcgcgagacgaaagggcctcgtgatacgcctatttttatagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcg

SEQ ID NO: 7401 - DNA, 1058 bp, Glycine max
  Peptide Sequence Number=SeqID_99086
atggccccgaggaagcttgcctcaaagaggtccaggaaggataaggcggccgaaggaactagttccgctcctgagtatgacagtcaccgttttaggagcgcgatacaccagcagcgcttcgaggccatcaagggatggtcatttctccgagagcgacgcgtccagctcagggacgatgagtatactgatttccaggaggagataaggcgccggtggtggacatcactggttacccccatggccaagttcgatccagaaatagtccttgagttttatgccaatgcttggccaacagaggagggcgtgcgtgacatgaggtcctgggtaaggggtcagtggatcccgtttgatgccgatgctatcggccagctcctgggatatccgttggtgttggaagagggccaggagtgcaagtatggccagaggaggaaccggtctgatgggtttgatgaggaggccatcgcccagttgctatgtataccgggcaacatcctgcccaccgatcataattccgacctccccctgccgaagtgtcagctggtgtacgccatcctgacacggatgagtgttcatgtggctcagttaatcgctgacgccatctatatttttgcaggactttgccagtcgttcggagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7402 - DNA, 340 bp, Glycine max
  Peptide Sequence Number=SeqID_99087
atgtcgagaaggaatatagctgagaggagaagaaagttattgcaagaaaggatagtagcatccattcttgaggaagaaactcatttttctgattcttcatcacctgactcaccatcatcaagggaatctgcgacctattttccagaattcgtttccatggaaaatgagcatcaacaaagggttacccttgaggactattcaagcagttcagggaacttattccaaggattaccaaatgaggacccctatgcacatttggcaacattcattgaaatttgtaacactgtaaagattgtaggtgtgctagatgaagccaaaaggtggctccactcatttaagg

SEQ ID NO: 7403 - DNA, 153 bp, Glycine max
  Peptide Sequence Number=SeqID_99088
atgactaaagcacgtcaaaagggggtacggaaagaaaaggaaggagatgcttgccacccagctcgcccaggcgagctacgttgcttcctccagaagcaaccgccttctggaggaacatcctggaaggcccaagtgggccaggttgctatttga

SEQ ID NO: 7404 - DNA, 651 bp, Glycine max
  Peptide Sequence Number=SeqID_99089
atgactttgctgctcagcaacatcgtgcccaccgatcataattccgacctccccctaccaaagtgtcagctggtgtacgccatcctgacgcggatgagcatccatgtggctcagttaatcgctgatgccatctatatttttgcaggtatggcgcctaccaggcaccctctggacccagataagtccaacagggccctgggatttcccgccttgatcacaggactctaccagtcgttcggcgtccccgtcacacctagcaaggtgattcggccgcccatcacccgagcttttatcgagaagtactgcacgcagagacaggtccagggtgatgcaccacaggccgcggacgcgctgccacctcatcaagctgctccagccggatcatttgacacggagcagtatttgcggcatttggttcgccagcaggcggccaaccatcgggcacatagtcagggctttacttcttttccgtgccctactccggaccagttcggggcagaggtcgcgtggcctggggattggcctgaggcccaggcaggagaggcaccagcaggggcaccagcagaggctcccgatgaggcagaggaggcccgcgaggatgaagagatgaccgatttacttgatttcttaggagggagcggagccacatga

SEQ ID NO: 7405 - DNA, 645 bp, Glycine max
  Peptide Sequence Number=SeqID_99090
atggccaagtttgatccagacatagtcctcgaattttatgccaatgcttggccaacagaggagggcgtgcgtgatatgaggtcctgggtgaggggtcagtggatcccgttcgacgcagatgctatcggccagctcctgggatatcctttagtgctggaagagggccaggagtgcgagcatggccagaggaggaaccggtccgatgggttcgatgaggaggccatcgcccagttgctatgtataccggggcaagattttgcccagactgctgccgggagacgggtgcggatcatgcgcaccaacatgaccaccctgactcagatatggatgactttgctgctcagcaacatcctgcccagcgatcataattccgacctccccctgccgaagtgtcagctggtgtacgccgtcatgacgcggatgagcgttcatgtggctctgttaatcgctgatgccatctatatatttgcaggtatggcgcctaccaggcaccctctggacccggataagtccaacagggccctgggatttcccgccttgatcacaggactctgccagtcgttcggcgtccccgtcacacctagcaaggtgattcggccgcccattacccgagcttttattgagaagtactgcatgcagagatag

SEQ ID NO: 7406 - DNA, 244 bp, Glycine max
  Peptide Sequence Number=SeqID_99091
ggggcaggtgcagacccatgagtgtctctaccagctcagccccagtctgcagagccagggtttcgctgcttttgcgtgccctactccagatcagttcagggctgaggttgcatggcccggggattggcctgaggcccaggcaggggaggcgcccgcagaggctcccgatgattcagaggagggccgcatggataaggagatgacagatttactcgatatcttgggagggagcggagccacatga

SEQ ID NO: 7407 - DNA, 273 bp, Glycine max
  Peptide Sequence Number=SeqID_99092
gagaccagtaatgtccttcttaaaggagttgttggtactgatggactttactcctttcataatctcaaacttcaggagagtccttcactactgatgtctgctgtttcaagtgttgcctctcctagtccagctctcactattaataataatagttctactgtaatgtctgattctatttcttcttctctcagtattgctaatctttggcatgctaggttagggcatcctaatgatcatgtatacttggatatatcctataaagtccaaagctaa

SEQ ID NO: 7408 - DNA, 632 bp, Glycine max
  Peptide Sequence Number=SeqID_99093
atggggacaaatcaaaacggcaagaggttttatcaagtcaaggttaaaagtctagatgtcactagcctcaaggaattaggacgattgatgggacctctccaaaggcaagccttccgcaaagtgtacgggaagattctagatttggccgcagcggaggtatttacggaagctgtcgtatccctcgcccaatactatgaccagccgttgaggtgtttcacgtttggggacttccaaatggtaccaactattgaagagtttgaggagatattaggatgccctcttggggggagaaaaccgtatcttttctctggatttcttccttccttgagcaggattgcagttgtgattgcagattcagcaaaagagttggatcgtatgaaacaaactcgcaatggaatagtgggcctgccacggaaatacttggaaggcaaggcaagggatatggcgagccaagagaagtggggtccgtttgcagatattttagctttgctgatttttggggttgtcctcttcccgaacatcgacgatttggtagacttagccgccattgatgctttcctcgcgtatcaccatagcaaggaaagtccagtggtggctatcttggcagatttgtttgacacctttgaccggag

SEQ ID NO: 7409 - DNA, 824 bp, Glycine max
  Peptide Sequence Number=SeqID_99094
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgttgcatctcccaatgtgcatgactgaagatgaagaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7410 - DNA, 426 bp, Glycine max
  Peptide Sequence Number=SeqID_99095
atgcagtgcaaccttcttcatcttcagtcatgcacattgggagatgcaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 7411 - DNA, 231 bp, Glycine max
  Peptide Sequence Number=SeqID_99096
atgggtgccaagtacctcgaagcgatcaagcaaaggttgcatgccgtcaaacaatggtccccggacgaaattagggcaatcaattcgtggggctccggactcgatggtggaggatgcatgaatgacaatcaattcatggggctccgaataagatttgatggtggaggatgcacgaatagcgctaggcaatcaattcgtggggctccagactcgatggtggaggatgcatga

SEQ ID NO: 7412 - DNA, 806 bp, Glycine max
  Peptide Sequence Number=SeqID_99097
atgtcgctagtgactcccatggctaagtttgaccctgagatagtcctggagttctatgctaatgcttggcccacagaggagggagtgaaggccagcagtgtgagttcggccagaggaggaacagggctgacgggtttgtcgacgaggcaattgcccagctgttatgcacaccgaggtaggatttcgcctggaccacaacagggaggcggcaatgtctacgccatcctgacacggatgagcgtccacgtggcccaggtgattgttgaggccatctatttgtttgtaggtatgccacccaccaggcaccctttggacccggataagtctaacagggccctggggtttccggcgttgatcacgagcctctaccactcattcggggttcccgtcaccccaagaaaggtgatccgaccgccgatcactcgggccttcatcgagaaggtgatgccaccacctcatcaggccacagacgctctgccaccacctcatcaggccgatcccgctggatcactaggcatggagcattatctacagcacttggttcgccagcaggcggccaaccaccgggggcaggtgcagatacatgagtgtctctaccggttcagcctcattcaacaggggcagggtttcgctccttttgcatgtcctactccagagcaatttggggctgaggtcgcatggcccggagactggctcgaggcccaagcaagggaggagcccgcaggatcccctggtgaggcagaggaggcccacatggatgaagaaatgaatgacttgctcgatttcttgggaggaagcggagccac

SEQ ID NO: 7413 - DNA, 219 bp, Glycine max
  Peptide Sequence Number=SeqID_99098
atggtgaaagttggaacctcttacggccgatcaacgtctcattttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcataa

SEQ ID NO: 7414 - DNA, 432 bp, Glycine max
  Peptide Sequence Number=SeqID_99099
atggcagcacaattaatccatgaccgagtggagatggagtgcctagagggagtttgggagaccctcgaaggcaatgcgaggtgccgattccgtggcacgatccgactcacggctacttcattggtacatccagaggaaccagcacgcacgcttcagcgcaccgtggagtggatattacctacacctactccatatcgactagtggagccagtccaagtgatagaggtgacatcatcagaggaagaccctgaggaggacccagaggagctacctcctgagcctgctgtggatgctcttgactttccaaagggtgatgaggacccattccctgaggtggattctcccgaggacgtcatgtcggcatctgaggcagactctacggaggagagcggtcttgaggggatagtgactagtggaggttcttcatcatag

SEQ ID NO: 7415 - DNA, 198 bp, Glycine max
  Peptide Sequence Number=SeqID_99100
atgacattaggtgctgaattcaatgtggaaagcttaacatgtagagattggaacacatcatcgaaagtatcccaaaaggaatgtgttcggttctgtgcaagaaagaaaaggactacctatataagcatgaagtttagccgcttcaagaagctgagacttggctttgatatgcttatgaaggatagggacacaggctag

SEQ ID NO: 7416 - DNA, 141 bp, Glycine max
  Peptide Sequence Number=SeqID_99101
atggatcgggtcctggccaagtttagtccaacaagaggaatctatggacgatgcttgatcaggattaggctagactatcatgaggaatcggggtttagcatttcaggagacaccatagaacgcataagcattattaagtag

SEQ ID NO: 7417 - DNA, 321 bp, Glycine max
  Peptide Sequence Number=SeqID_99102
atggccccgaggaagcttgcctcaaagaggtccaggaaggataaggcggccgaagggactagttccgctcctgagtatgacagtcaccgttttaggagcgcggaggaaataggccaccggcggtggacatcactggttactcccatggccaagttcaatccagaaatagtccttgagttttatgccaatgcttggccaacagaggagggcgtgcgtgacatgaggtcctgggtaaggggtcagtggatcccgttcgatgcagatgctatcggtcagctcctggggatatccgttagtgctggaagagggctagaagtgcga

SEQ ID NO: 7418 - DNA, 1042 bp, Glycine max
  Peptide Sequence Number=SeqID_99103
atggcgcgctcaccgctgatcctcgcgctggcgaacccggagccggaaatcctaccgccgctggcgaaggaagtgcgcgacgacgtgattatttgtaccggccgttccgactatccaaaccaggtcaacaacgtgctgtgcttcccgttcatcttccgcggcgcgctggatgttggcgcgacggcgataaacgaagagatgaagctggcggcggttcatgctatcgccgagctggcgcatgccgaacagagcgaagtcgtggcttccgcctatggcgaccaggatctcagctttggcccggagtacattattccgaaaccgttcgatccgcgcctgatcgtcaagatcgcgccagcggtcgctaaagcggcgatggaatcaggcgtggcgacccggccgattgccgacttcgatgcctacatcgagaaactgagcgagttcgtctataaaactaacctgtttatgaagccgatcttctcccaggcgcgcaaagagccgaagcgcgtggtgctggcggaaggcgaggagactcgcgtgttgcacgccacgcaggagctggtttctctggggctggcgaagccaatcctcatcggtcgcccgagcgtgattgaaatgcgcatccagaaactgggcctgcagattaaagcgggcgtggacttcgaaatcgtcaataatgaatccgatccgcgcttcaaagagtactggagcgagtactaccagttgatgaagcgccgcggcattacccaggagcaggcgcagcgggcggtcattagcaacacttcggtcattggcgcgattatggttcatcgtggtgaggcggatgcgatgatctgcggaaccatcggagattatcatgagcactatcgcgtggttcagccgctgtttggcttccgcgacggcgtcagcaccgccggggcgatgaacgcgctgctgctgccaagcggaaacacctttatcgccgatacctatgtcaaccacgatccatcgccggaagagctggcggagatcaccctgatggcggcggaaagcgtgcgtcgttttg

SEQ ID NO: 7419 - DNA, 273 bp, Glycine max
  Peptide Sequence Number=SeqID_99104
atgggcgtaggtccagtggcggccccacagttcgcgggtgaacggatgggtgttctccagcgccacttcgccacggttggcctgacggatatgggcaatgacggaacaggatttaatgggataatcctgtaccagtttggctattggcgactgaaagctcggctgcggatctttaaatgtgcgacaccctttcccttcgtaaaaggtaataccccagccgtctttatgcggcccggtgccgcccccgcgctgaaccagcccgggagaagctaa

SEQ ID NO: 7420 - DNA, 222 bp, Glycine max
  Peptide Sequence Number=SeqID_99105
atggattcctttgcttcttggaagatgaatgacagcggaatggagaaggaagagagagagacgagatgccacttcaaggagaaaatgagtctagaagacgctcaccaccataggaggccatggataagagcttggaggaagaagaggaagatgaatgaagggagaggaagcgaagagcatgaaattttgtgctctaaaagagctatgaaatctgaagtttaa

SEQ ID NO: 7421 - DNA, 903 bp, Glycine max
  Peptide Sequence Number=SeqID_99106
atggcagaatcatccaagaagcacaagggttcatccacctccgctgcggcatatagaacatcatgtttcggagccaccggcgcatccccgacaccaattccaacatccttgtcatcctctacactgttttcatctaatgaacaacgtatccggtattcttctctctttcaatcttgtcaaattctcgatcccaaatatcttgaccttgaattctttgatggggaaacatttgattgctatccagtgtttcaaaacactggtctgactccttttatgtcattaaaattaccatattatcttgagttagtacgagtcttttactcaaatttgaaaattcaggatggaactttaatttctgaggtgcatggtatccccatgattattgatgaatctcttttcttttctctgacacaactacccagtcagggtgcaccttttgagggtacccttgttgatgactggaagtttgattactcagtcatgatgcctgccgcatggtctacattgaccagaattttgatgcctcattcttctaatctcgctcaagcctctgaggaggacttcattctgatgtgggctttcttgactggtgccggtgcggtaacctcctttggctactgtaaggacatggacggccaatggatgaagaaggacgcacaacctccgcaagacaaacgtactccttctcctccgcctcaacgagatgattcctcagccctcatgaatgaagttcttttggagttacaaggcctccgcacctatgttggtgaacgctttgattccttggatggtcgtatcgatgctattgatgctcgctttgaaggaatgaatacccgcatcactcaacttgaagaggatgtgagttatcttcgtcggtgcttcgaccttccaccaccttcctag

SEQ ID NO: 7422 - DNA, 540 bp, Glycine max
  Peptide Sequence Number=SeqID_99107
atggaggcaccagctgctgtggaggacattcttgcggacattcctgcgggcgcaggcgcagaggcggctgaggatcagcctcagggatttccgtgtggttcgagcgacccatctgtgttgacagcgtatgcggatcacgttgcttgcagcgtttggacgggagagcgtcctgaattgaagttatcctctcatggatggaaggtccacagtttaggcaggcatgtccctgccattgagggacttattgctggtacaggactaagtcctctgatcgcgtgttcggtagacaccggcgatcggggacttttgtccgcgtttgtggagcggtggcatcgggagacgtctagtttccatctcccggtgggagagctcaccatcacattggacgacgtctcctctcttctccatcttcccgttattggcgacttacacgcatttgatcccttgcacgtggacgatacagttcagatgctggtggacttgttgatggttgtggatgcaattgcctttggtgttttgatgatgatcatgatgatatga

SEQ ID NO: 7423 - DNA, 282 bp, Glycine max
  Peptide Sequence Number=SeqID_99108
atggggaccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgaaccaacccgggcatagtcggtcagtga

SEQ ID NO: 7424 - DNA, 300 bp, Glycine max
  Peptide Sequence Number=SeqID_99109
atggggagtgaccaacgacgtccaatgtcgacgagctacctcttcctgaaagttggtgtactcatcgtccctgagatggacgcgtctctctcggtggaacgaccatcctttgatggtctcaaaacgctgctgatgctcggcgctcctgaaacggtgcctatcaaactcgggagcagcactggtccctttcagtcgcgggcgtccctcctagatctctttcgtggaaagctttttcagagccatttcttgttggagatgaataatagcgcaaaacggaatcaaaaactcgaaaaatggtga

SEQ ID NO: 7425 - DNA, 637 bp, Glycine max
  Peptide Sequence Number=SeqID_99110
gctgaatttgatatccctaaagcttctgagggtaggacaaagaagaaaatacttcagactgttggcgagagagaccccttgtgggaggatgtgcggaaaaaggcacaggccatacaaaagcaaaacaccaccccccacgtgttgtctcgtgggggttatgaatatttagaacataagctgatggctaagaagacaaagaaaaaactagaggaagctgctcaatccagaaacactaagggcgtgattgaccctccatctcccatcaaacgacacatgaagtggaagatggcccgcaccaagaaaactgggcagatgacgtctgaggcaacaaaggaaattgctgacaagattgagcaagcgtcacatggttcatttgtcccccatggacgtcaggatctcctgactgctgccattgggcaaccagaacaccctagccgtggaccagctggaggagtcgattacagaaaaagtgactcagcagctgatgttatccttcagccagatgtagtcccagttgaaatcacagatccaatcataggacttgcattgcctccaaagcctgaggttggtccctcagctgctcgtgtcagcacaaaggggagttgtgttgatccctcaccgaccaatctagacatag

SEQ ID NO: 7426 - DNA, 318 bp, Glycine max
  Peptide Sequence Number=SeqID_99111
atgacgtgtctatctcgtgacatgcgatggaagcttgcttgtgaagcttctatggaggttggatctttgagcttcaatggtgattttccaccatggagatgcagcggaaggcaaaggagaagaggagaggggagacaccatccacaagggaataagccatggaagaaggagcttcaccaccaagaatgtgccttggataagaagcttgaagatgatgctttaatggaggaaaagaaagagggaaggggggagcacgaaattgaaggaataaaagagggagagaagtggaactttgaagtgtgtctcataagactttaa

SEQ ID NO: 7427 - DNA, 317 bp, Glycine max
  Peptide Sequence Number=SeqID_99112
tggtacctggagatatgtcgcgggggtcaggagaccttggggacgtcaggcgagctcctggcagtcaacagataaaagaacaaagaccacaaagcaaggaggcttgtgtggtggctggccagctgtgaactttgagtgttatatgggatatggtctctggcagcatgttgtggaggcctctggtaatcgattactaggctgtgtaatcgattacatagaggaacatgccgctgtgcctagagggaacttgggagaccctcgaaggcaatgcgaggtgccgatttcggggcacaattcgattcacggctacttcattg

SEQ ID NO: 7428 - DNA, 1223 bp, Glycine max
  misc_feature (9)..(9): n is a, c, g, or t
  Peptide Sequence Number=SeqID_99113
gtcgactcntagaggatccccggctgaaagccctcacaatcagagggctgcatgccctcaccttcagaggactacacgtccttgccttcagaggactgcacgtcctcaccttcagaggactgcacgtcatcaccttcagaggactacacgtcctcaccttcagaggactacacgtcctcgccatcagagggctgcacagcctcaactttagaggactacacgtccttaccttcagagggttgcatgcgctcgccttcatagggctacatgccatcacgttcagagggctacacgccctcgccttcagaggactgcacgtcctctcctttagaggactacatgtcctcgccttcagaggattacacgtcctcgccttcagagggcaacacgccttcatcttcagagggctagacgtcctcaccttcagaggactacacgtcttcgccatcagaggactacacatcctcgccttcagagggctgcacgtccctacctttagaggactgcacgtcctcaccttcggaggactgcacatcctcaccttccgaggatcgcacgtcctcaccgtcagaggtctactcgccctcgcctttagaggactacacgtgcttaccttcagaggactacacgtcctcaccttcagagggctacacgcccttgacatcagagggctacgcgttctcgaatttgtagggctaaacgccttcaccttcagagggtttcacgccctcgcctttgtagggctacacgtcctcaccttcagaggactgcacgtcctcaccttcagaggagggttacacgcccttgccatcagaggactacacgtcctcgccttcatagggctacacgccctcaccttcagaggactacatgtcctcgccatcagaggactgcacgtcctcgccttcgtagggctacacgccgtcaccaccaaaggactacacgtcctcgccattagagggctggatgccttcactatcagtggactacgcgtgctcgccttcagaggactgcatgtcctcaccttcagtggattgcacgtcctcaccttcagagggatacacgtcctcgccttcattggactgcacgtcctcaccttcagaggactacacgtcctcgtcttcataggactgcacatcctcgccttcataggactacacgtcctcaccttcttagggctgcacaccctcgccttcagaggattgcatgttctcatcttttaa

SEQ ID NO: 7429 - DNA, 438 bp, Glycine max
  Peptide Sequence Number=SeqID_99114
atgcatactcaaggtattttggctaccgaaaattgcacacatgcacattcgggtatttctaatacctatacatacacaaatttcgtgaggaatcttggctacccacacaataagcccatagctgattgctggccaaaaagggtagcttcacctaatatgcacccactcttgcgttctcttgcatccaaaaacaagcttcggttcctaggcctagggtgtatgtggggcaatcattctagcccttatgaaactgaatacatgctccaaagacagcaaacacgcacaaaccaaattgtcccattggttgtatccctacaaaatcatgcgcaaatgccattgaggcatttcaccgaacacttggtgggcgcacgtttaggcattaatagcaagagaatgggggcaatgtggcatgccccattgctccaaaatgcattatag

SEQ ID NO: 7430 - DNA, 321 bp, Glycine max
  Peptide Sequence Number=SeqID_99115
atggcacgtaacgtgtttgctccgtgcccctattttagggacctacaagggagggagctaaaagggcttttggtgatatttcccaaggtggtcatatctctcttgatggtctctagagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcgcggggaaggtattag

SEQ ID NO: 7431 - DNA, 159 bp, Glycine max
  Peptide Sequence Number=SeqID_99116
ttcgaatatgccaagagtattcctgtagaggttgtcgattcatgggtgtcatttgaagaaatagatgacagctggatgcactactcagaccatcttgcactagcaggtgacatatgtcttgtgccaggtcagtgtgtgcccgagtacatggactggtga

SEQ ID NO: 7432 - DNA, 825 bp, Glycine max
  Peptide Sequence Number=SeqID_99117
atgctcaaggtaacacagtgcatctgccctgtgtttaaacagagtgagcttcatcgtaagcgtacagagaggatattcagaatgaaacttaaatcttgggtaatcacaggcttgctggggactgcagtattctcccaggcacaagccgccgagttgattcaaaacggtggttttgaagtgcagggcgccgatagctacgacattcctggttggcaggtggcagagcaaggctttttgggcagcgtattgtcacaatcaggtaatgtgtctgaagtgactggcaatgccaccgttggcgcttaccaaggcacttattacggcttgctggataactatggcctggcaggtaacgtgttgtaccagtcatttacaacggcagctgtcagccaggcaaccctgtccttccagatgtttatcaataaccagaatgcaacgactgaaatcgacgcggctggcctggattacagcgtggatgcaacggatcatcctaaccagcacgtgcgtgtggatgtgttgaaggcgggcagcgatccattctccaccaacagcgcagatgtcctgcaaagcctgtatatcggcggcgaaaatggcggcctggcaattaataactacgtcagctaccagtttgacctgtcttccagcctggcaaatggtggtagctacctgttacgctttgcgaccgtggcaaaccagagttcgctgcaactgggcattgataacgttagcctgcaaacggtttcatctgtgccagaagcagatagctatgccttgatgctggctgggttgggcgttatcgctgcggtcatgcgccgtcgctacgcataa

SEQ ID NO: 7433 - DNA, 252 bp, Glycine max
  Peptide Sequence Number=SeqID_99118
atgaaagattgcaaaaatacaagtggtgaggatgtcttcttcacctctaggatctcacaaccactcacaaactcatctcaagctctcagactacttcctcttcaagctctggtctctacagatcttcacatagcaaaatctctcaaaactctctcgaacttggacctttctctctctagaatcactagacatgcaaagcttcagctctcagcccaaactcccttcacaaaatctgatttcaggcttaaatag

SEQ ID NO: 7434 - DNA, 780 bp, Glycine max
  Peptide Sequence Number=SeqID_99119
atgggatcaagtcaaaagccttcgcttaaaaagaggttctatcaagtcaaaatcaagagcttagaggtcactagtttaggagagttggggcaattaatgggtcaacttcaacggacttcccagctagtgccgactgtgaaaagagttggaagaaatcccttgggatgcccaactgggaggaaggaagccatatcttttctttgggttctatccctccacgacaagagttgccaaggtagtgaaaatctcagcacaagagttggaaccgtaaagcaaaacagaaatggagtagtcggagtaccaaggaagtgtttggaggtaaaagcaagaatcttggcagataaaggcgagtggaccccattcatagatattttcacactgttgattttcgagggagtcctctttccaaatgtggatgggttggtggacctggcagcaatcgacgtttttctcgcctatcataaccacaaggaaagtccggttgtcgctatgccagccgacctatatgacacctttgaccgaagatgtgaagaaagcaatgcaaggattgtttgttgtactccagctctctatgtggggctggtttcacacctttttctccaagaaggtaggcccgtctatccgctacaaggttaccgctcttgcgtcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 7435 - DNA, 282 bp, Glycine max
  Peptide Sequence Number=SeqID_99120
atggatcttccggcttcccgtgacaaaagacgagaccaacatataatgcatgcacgcaacgtgttcgcttcgtgcccttatcttagggacctacacgggaggaaactaaaagggcttttagtgataattcccaaggtggtcatatctcttttgatggtctctagaggtatcatccccttcgaagaagatattgcggtagtagggactactagcaacaatatgttatcaaagagaaaaactttagatgagggttcactgttatcaagcaagtcggagacctag

SEQ ID NO: 7436 - DNA, 585 bp, Glycine max
  Peptide Sequence Number=SeqID_99121
atggattccagaaagagaaaaagcattggtacaaggcccacatctcaatatgacacaaggagattctcttcattagatgcttggaccaaatacactgataatgtcttgggaagaaacattttacctgagaggaaagtagaactatatcacactgagctagatgactttaaggccgagatggagaggcgtaattttcataaacgcctcaccaatttagctgatgggagcatagacctggctttggtgaaagagttctatgcaaatttactcagttctgaggatcatccaccaaaacagtccagagtcagaggtcatttggtgaagactgatgctgacagtctcaacgcattcctggagacacctgtggtattagcagagggagagactctacccgcatactctagatactgtaggttgcctacagacttcagagagatagaggctaccttatgcatacctagtcgagggttcatcttgaactctgagggccatcctgggaggattctcaggaaagatttgactacactagctcaggtgtcgagtgttctcatactccaacttggcccccacatcacatacctctga

SEQ ID NO: 7437 - DNA, 1052 bp, Glycine max
  Peptide Sequence Number=SeqID_99122
ctgaaaccgaggcggaagccaacgcggcgctggacgagctgaagaagggcgccgatttcgccacgctggcgaaagagaaatccaccgatatcatctcacgccgcaccggcggcgagctgggttggctggagccggaaaccaccgccgacgaactgaagcaggctaacctgaccgagaaagggcagctgtccggcgtggtgaagtcttccgtcggctacctgatcgtgcgtttgaacgatatcgaacctgagaaagtgaagccgctgagcgaagtgcatgacgccatcgccaagcaggtgcagcaggagaaagcggtagacgcgtattacgcgctgcagcagaaggtgagcgaagcggcgaccagcgacaacgaatctctggcctcggctgaagaagcggccggcgtgaaagcggcgcaaagcgactggttcacccgtgacaatattcctgccgcgctgaacttcaagccggtcgtgcaggcgatcttcgacggctcgctgatcggcgagaacggcgcgccgggcagcaactccgacgtgatcaccgtagacggcgaccgcgccttcgtggtgcgcgtgagcggccacaagccggaaggcatcgaaccgttcgaccaggttaaagaccgcgtggcggaactggtgaagcgcaacaaggcgctgcaggcagcgaaactgcagggcgagaagctgctggttgagctgaagcagggcaagggcgacgaggcgatgaaagccgccggcctgagctttggcgccgtgcagaagatggcgcgcgcgccggaagacagccagctggtggagagcgtgttcgcgctgccgcacccgcaggacggtaaaccggtatacggcatgtcgcaggatcgtcaggacaacgtggtgctgatcgcgctcgatgcggtgaagccaggcacgttgccggaagacgaaatgaaaaccttcgttggcaagatggaagagggcgcgaccggcgtctccttcgattcgctgctggcgagcctgcgtaaagaagccgagatcaaaatgggcgccgctgagcaacagcctcagtaa

SEQ ID NO: 7438 - DNA, 714 bp, Glycine max
  Peptide Sequence Number=SeqID_99123
atgccgcagacgaagttcgtggttggcaaggcgctgaaggtcggccttcgcccgatcgtcgccatcaacaagatcgaccgtccggatgcccgccatgaggaagtcgtcaacgaagtcttcgaccttttcgcggctctggatgcaaccgacgagcagctcgacttcccgatcctctacggctcgggccgttccggctggatgaacgtcaatccggaaggcccgactgatgaaggtcttgcgccgctcctcgatctcgtcgtcaagcacgtgccggagcccaaggtcgaagaaggtccgttccgcatgatcggcacgatcctcgaagccaacaacttcctcggccgcatcatcaccggccgtatcgcttccggttcgatcaagccgaaccaggcggtcaaggttctcggccaggatggcaagctgattgaaaacggccgcatctccaagattcttgctttccgtggcatcgagcgcacctcgatcgaagaagcccatgcaggcgacatcgtcgccatcgcaggtctctccaagggcaccgtcgccgacaccttctgtgaccctgccgtcatggagccgatgcaggcgcagccgatcgatccgccaaccgttaccatgtcctttcatcgtcaacgattcgccgctcgccggcaccgaaggcgacaaggtgacgagccgcgtcatccgcgaccgtctgttcaaggaagctggaggtaa

SEQ ID NO: 7439 - DNA, 459 bp, Glycine max
  Peptide Sequence Number=SeqID_99124
atgggaaatttctctcaggataactggaggtgggacttgaaatggaggaggaatttgtttgattatgaaagtgatctagctgtgaattttatggaagaaatcacttttatacctattcagaggcatgttaaggacatcatgatctggaaagctgatcctagtggtgtttattccactaattcagcttacagactattgataaacccctctactccagcctctgatgacactgtttgtcctctctgtggccaagagcaggaggaggtggggcatctctttttcaattgtaagaggatagtaggtctatggtgggagtccatgagatggatcctggctgtgggacctttcccagcttctccagtaaatcattttcttcaatattgtgatgggttaggagcagagataaaccatagttcatggtgtggatggtgggttgctctaactagtaccgtatggtag

SEQ ID NO: 7440 - DNA, 1020 bp, Glycine max
  Peptide Sequence Number=SeqID_99125
atggtaaaggaaagtgtcgttgtggtagagggctttccaccaaaaggcgacacgatagaggacattatttccccaaatagcaccatcatcgtggaagacgaagaagcactaaatggcattgttgtgacactgaaaattgaagaaccagtggtgtcgaatgcgggtgcaagagaggaagaggagtccaaggagaagaagggtatagaggaagaagaagtgaaggagaaatatagagggcatggagaagaggatgacaaatgtagggtttgtggggaagagagcatgcacgggaatagcggggggcaagatatgcgggttaggctaattaagggagagaaatccataactgggaggttatggcgttttgatatatatattgcttgctttcgaaaactggccccgacggacgcagagaaacgcgagaaactggaatcagagaaacgacacgcaaaccgaggcaggattttagcgtttcaaagcttcaagcaaagcttcaacctttggccaccatttctgccccaaatcgcgaaaggagagcattttcggagccgtgaagtgcgtggctacgagtgggacttcgaaaatccaggtttgggtggacttctttctcccttaaatttcgtgggtatggggtgtaaatccagtttgaacaagtctaaatggatgttatggactggtgtgaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctatggtacctggagatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 7441 - DNA, 660 bp, Glycine max
  Peptide Sequence Number=SeqID_99126
gatgtcctggacattgtatccgacatcgtggatcctgcattgtgtgcattgtgcagcaactccagtattttcgggcaggatgtcctggacattgtatccgacatctctctggtggtgaacgagtatttccaacacattctgcgtgtgctgaacacaaacgtagatgggaagcagaagataatgtttgctctcacctctatcaaaggtattggcaggcaattcactaacatttgcagcaaaatagctaatgttgacatgaacaagagctacatgtttcacttcataggtggtacacttctcatcaaagattgcttaagcagcaaggtctcaactccctccattcctccaactccacggacggagggagagatcttgaaatcttcaaacatgaagagcttcaacttcagtgagctaaaaactgctacaaggaactttcgtccggatagtgtggtgggcgtcaagaggcgtcaagttccaaccccttcaaggccatctagatcactaggaaacaatataacaagagttgtaagacatggagcagaaagtgtcggtgtcgacgcaaatgggaattcttttgatatcacaacaaagttgctgcacttagcatgccacccagctgagaattcaattgcttgtgctggtgcagatagcttaaagtaa

SEQ ID NO: 7442 - DNA, 168 bp, Glycine max
  Peptide Sequence Number=SeqID_99127
atgaggcaccctatggctaaccctcacacatgtcctcaagatgaggttgataaaaataagtggacataccagccttgtagcaatcgagatagtgtagaggtagtaccgcttagaagaacaacaattaataagagtagatttcctagcattacctacattctaagttga

SEQ ID NO: 7443 - DNA, 288 bp, Glycine max
  Peptide Sequence Number=SeqID_99128
acttatcaaggtaatccttgtggcgtctatcctgacttatcttccttcaccggaagtggcgtctacccagacttatcttccttcactggaagtggcgtctacccagacttatcttccttcattggaagtggcgtctacccagacttatcttccttaaccggaagtggcgtctacccagacttatcttccttcactggaagtggcgtctaccctgacttatcttccttcattggaagtggcgtcatccaaaccttcgtagcctgtatcaaacgatccgctcctactcag

SEQ ID NO: 7444 - DNA, 309 bp, Glycine max
  Peptide Sequence Number=SeqID_99129
atgaattgcattttcgttcacgtgtcctccaccttcgagtttggagccatgcgtagtgattgcttagtgaaattctccattctcacccttttgcagagcctcatgaattgcgtttttgttcatgcgtcttccaccttcgagattggagctatgcgtactgattgcttagtgcaattctccattctcaccctttttcgcagacccatgaattgcattttcgttcatgtgtcctccaccttcgagtttggagctatgcgtagtgattgcttagtgcaattctccattctcaatcttttcggagccccatga

SEQ ID NO: 7445 - DNA, 891 bp, Glycine max
  Peptide Sequence Number=SeqID_99130
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggattgcgcgacaattagtgttaagcagctcaattcggatggcaagaatccagataaggatcatcctcatcctccttatatgaaggctctaactgccacaatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7446 - DNA, 355 bp, Glycine max
  Peptide Sequence Number=SeqID_99131
gcgagctcagctcgcccaggcgagccaggttgcttcctccagaagcaacagccttctggaggaatattctggagggcccaacacctcacaaggaccaaagaaaggtcgcatgtcatcaagcaaaggtccccggacgaaattagggtatgacatcatcctaagccagaaaggaatagaagtggaccccgaaaaggtgaaagccatccttggaatgccagaattgcgtaccgagaggcaggatcaaacagtgtctcatgaagcctcccgtgcttatgccaccggtgcccggaagacctctcatcttgtatatgacgattttggacgagtcgatggggtgtatgttggggcaacatga

SEQ ID NO: 7447 - DNA, 933 bp, Glycine max
  Peptide Sequence Number=SeqID_99132
atggccaagtttgatccagacatagtcctcgaattttatgccaatgcttggccaacagaggagggcgtgcgtaatatgaggtcctgggtaagaggtcagtggatcccgtttgatgtagatgctatcggccagctcctgggatatcctttagtgctggaagagggccaggagtgcgagtatggccagaggaggaaccggtctgatgggttcgatgaggaggtcatcgcccagttgctatgtataccggggcaagattttgcccggactgctgccgggagatgggtgcggatcatgcgcaccatcatgaccaccctgactcagatatggatgactttgctgctcagcaacatcctgcccaccgatcataattccgacctccccctgccgaagtgtcagctggtgtacgccatcctgacgcggatgagcatccatgtggctcagttaatcgctgatgccgtctatatttttgcaggtatggcgcctaccaggcaccctctggacccagataagtccaacagggccctgggatttcccaccttgatcacaggactctgccagtcgttcggcgtccccgtcacacctagcaaggccgcggacgcgccgccacctcatcaggctggtccagccggattgtttgatacggagcagtatttgcggcatttggttcgccagcaggcggccaaccaccgggcacatgtacagactcatgattgtctttatcagatgagtctcagcctgcagagccagggctttacttcttttccgtgccctactccggaccagttcagggcagaggtcgcatggcctggagattggcccgaggcccaggcaggaaaggcaccagcagaggctcccgacgaggcagatgaggcccgcgaggacgaggagatgaccgatttactggatttcttcccaggaagcggtgccacatga

SEQ ID NO: 7448 - DNA, 459 bp, Glycine max
  Peptide Sequence Number=SeqID_99133
atgacccaagagctggtagcccgcggagacaccttacggttatccgcacctcgtcattcagtcaccccaagtgtgattgatgagcagagtccaatatggtcatctgcgccctttccggagatgtcagcattttccgatggagacttttcaagtctcacaagttacccagaactacgtaggtctgagttcctcattggaggatacaggcgggcgggcccgatgatacgcggagataccttacggttatccgcacccttttgttatccagaggcgacgggcccgatgacaagcagagaccaagtttggtcattctgtacccttgtatcatccagaggcggcgggcccgatgatacgcggagataccttacggttatccgcatccttttgtcatccagaggcggcgggcccgatgacaagcagagaccaagtttggtcattctgcacccttgtatcatctag

SEQ ID NO: 7449 - DNA, 124 bp, Glycine max
  Peptide Sequence Number=SeqID_99134
atggcggcacccaggtcactctcactaagtaagatcatagggagaccagtcagggtcacgatgttttgcgagaatgctccaaccatatgggatcagcataggcttaaaggagcactcaaaccgg

SEQ ID NO: 7450 - DNA, 462 bp, Glycine max
  Peptide Sequence Number=SeqID_99135
atggggtgcactctgtttgctaacaagagtgcaaccaatgtgcatgttgtgtacttggaggcccttcgtgacctcagtcagactgggaggtacgcctggggagtggctactctggtgcatatgtacaaccaactgaacgatgcctctattagcagcaatcgacaacttggtagtttcatcacattgttgcagtgttggatttacgagcactttccctcagtcgcggagtccactgctgatcaggactacgacgaggattccccacgtgcgtgtaggtggattgcgacgaagaagaccgtgaagagcatacgtacgccggtgtacaatgagcgcctggaccaactctggattctgaatgtctgttggatcccgtatggggagcaccgaccggtccaggacttccatttgatatcatgttattccggtctcctgcgctgggggcctgttgtttattacacgtag

SEQ ID NO: 7451 - DNA, 1225 bp, Glycine max
  Peptide Sequence Number=SeqID_99136
atgggatataatcttgtaaaatggatggatgcccaggggaattacatcacctatgaatatgagaagaaccaatatcttacttctcaaccagttccaggtggggatgacaaattattaaatgaggttgtcgtttccactaatggtaatcagtttagaagatatgcattagaatatacggataatggtacgagttatcagtttgtcaataagattacggaatacaacagtaataatgaggcagccaatcccatagctatagaatatgaacctgctcagactgcaggagaggaaacaactaaagaatataatatcaccacgaccaataccaaaaaatatggtgattttgatatggatggtatcacagactatctggaatacgttcccactccagggactgcgggatccacacaggtaggtgttttgaactttaagagctctgtgtacaaagatgttccggttatgccgctacagtatgaacttaatcgatttacagctgctgagtttggtaaggcggcatctgtgactttcaaaaaagacggatacgtaaaaaacaaagcaggaattgttattcctcataccgttgctacaggagatcctaaaaaacccaattatgaattattggtatactctgtagatatttcagatttcagattcaagctggaatattcgaaactaattacgtatgatcagtatgctattggtgatcccggagatgacgatcttcctatgacgggctgtaactattcggttgtaagcttatcggaattgacaacaagctatgattatgacggggacggaattacggaacttctttttaatttcagaagaacgagaacatgtattaatggaggatttgatccggaacctattggtaaaactatttcaaatcctgttgccttggatgaaactacgccgcctacactcccttatatcgagccttcagttaactcatccaatactgaagaatatggagtacctccgatcgacaatggagaggtaaacattattccaggaagtactttaacaagtttttactcatccatattatttgatctaagtgaaaaccttccggttgccgaaagcatttacaaatatgacgagggaacaggagctgctaagaaaatccagttcgcagattttaacggagatggaatccaggatattatctggctcaatagctccaatggacaagcattgggaggattcttcaatggtgcactatacg

SEQ ID NO: 7452 - DNA, 330 bp, Glycine max
  Peptide Sequence Number=SeqID_99137
atgaggtcctttaatggtgattttccaccatggagatgcagcggaagacaaacgagaagaggtgagaggaggcgccatccactagggaataagccatggaagaaggagcttcaccaccaagatgagccttggataagaagcttggaaggatgcttggaaggatgcttcaatggaggaaaagaaagagggagagaaagagagaggggggagcacgaaattgaaggaataaaagagggagagaagtggaacttcgaagtagcttccttgagaagctttcttgagaaaacttccttgagaagcttctttgagaaaacttccttgagaagctag

SEQ ID NO: 7453 - DNA, 1086 bp, Glycine max
  Peptide Sequence Number=SeqID_99138
caccaatcgacgctttccttgcataccaccatagcaaggaaagtccggtggtagctgtcttggcagatctatttgacacatttgaccgaaggtgcgaaaagagtagcgcacggagcatctgttgcttgcccgccctctgtgtttggttggtttcgcacttgttccaacaagacacaaggcatccatgtccgctcctgagccatcgctcgtgtactgaaaagaggagaatcgactgggaccagcttttggctgggataggaggtagaacaatcagttggttccccaaatggaaggaaggaaaagaaggagtcattttctcatgtggaggatacccaaacattctgctggtaggaacgaggggttgtattaactacaatcccgcgctcgctataagacaactagggtaccccatgaggggagcaccgacggaagaaagcatgtctcctttgcttgtaagggatttcggcgcacaaaatttcaaggctatacaaagaatcaataaggcatgggaaaccccgttaagtaaagatcaagagcttaggggcattcgtaatggcatcattggtgggtaccacgaatggctgaaagttcatatacgaggtttagattggctcgccaagttaaaagtcatcagcgaagagagttttgaagcaccggaagaggacggagaagtccaagctctcaaaagcgagttaagaaaggcgaaacttgccaaggagaagttcaaggctcgcaaggaagagtgtggccggaataaatttcgtggagctctgtggggtagcaatagtgaactcaagctgcgaagggaagagagggaccagtcgcgagcacatagcatggttctgaaagaggagttagttgcctgttcaaggatcgcggacgagtatgctcaggtatacgcggaaaaagaggctagaggaagggtgatcgactctttacaccaagaggcgaccatgtggatggatcggtttgctcttaccttgaacgggagtcaagaacttccccgcttgttagccaaggccaagggagattggcgggacacctactccgcccctcgaagaagattcatggggcttctcggctatt

SEQ ID NO: 7454 - DNA, 774 bp, Glycine max
  Peptide Sequence Number=SeqID_99139
atggtgaaagttggaacctcttacgtgccgatcaacgtctcattttcgccaaaagttggcccagggcttcccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataagataccagcgtttcccctggcggctcctcgtgcgctctcctgttcctgcctttcggttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaaagagttggtag

SEQ ID NO: 7455 - DNA, 912 bp, Glycine max
  Peptide Sequence Number=SeqID_99140
cgcgaggaagagaccttacaggccggtcactacacaaatgacgtatccagcctgaacaatggtgcgggcatggtggaagtgggcgagcaggtcgagggttccagcgccgacggagctgcggcctcggcggcacgtgccgcggccgatgctaccgatgctgtggccgatgacgccgctgctgcggtggaagctgccagcccgctgtggttcagtgcgcagcggcgaagcctgcatcgcccagcggcggcagcaccgacccgcgcggttcgtgtccgtgctttgcccggcggcactcaacgcctgctggtaggcctttgccgtggcagtgttgaacgccaccagcacgatgcgcatcggctgtgcatggctgcgctgccacgccagtgtttccgtcactgcgatctgcgcggcctggtacaggggatagccatacacgccgcagctgatcgccgggaacgcgatcgactgcacgcccagcgactcggccagctgcagcgatttccagtagcagttggccagcaatgccggttcgtcgcgctggccgtcgtgccagaccgggcccaccgtgtgcagtacatgctgcgccggcaatgcataagcgtctgtggcgcgcacttcgccggtcgggcaacgcacgcccgggcgcagctccggcagttgctcgcactcggccagcagcgcagggcccgcggcacgatggatcgcaccgtcgacaccgccgccaccgagcagtgtttcattggccgcgttgacgatcgcatccaccgccagggtcgtgatgtcgccctgccaaacttcgatcttcatgcgtccgtctcctgcctggcatcgatactgcgtcatgaccgtctcacgcgctgcgatccgacggccttcacgcacgatggcgggcgacgccttcacgcaggctga

SEQ ID NO: 7456 - DNA, 290 bp, Glycine max
  Peptide Sequence Number=SeqID_99141
atgacatcaccttcagagggctacataccctcaccttcagaggactacacgccctcgcctttacagggctacacgtcctcgccttcagaggactacacgtcctctccttccgagggctacacgtcctcaccttcagagggttacacgccctcgcctttagagggctacatgccctcaccttcaaaggactacacgtcctcgccttcagagggctgcacgccctcgccttcagagggctgcacgccctcgccttcagagggctacatgccctcaccttcagaggactacac

SEQ ID NO: 7457 - DNA, 645 bp, Glycine max
  Peptide Sequence Number=SeqID_99142
atgggttctccacctgtctccactcctcctcctccttctcctcctcgtcctcctcctacttcggacgcatcggcttcgacgtctgccgtgaagcggacacgcaaagcctcacgcctacgatcgttgtccactagaccacctggtgttgagagaccagtggtggacatcacctacgagaactggaaggaggtccctactgctcagaaggacctgatttgggaggatattcaggcggaatttgatatcccagaggcttctgacagtaggacgaaaaggaagttactacagaccgtgggggagagatggaggcagtttaaatcagacctcacgaggaaaatgggcccttgcagcccgatcaggacggtgtcgaggacactgtctgtgacaaatacggcatcagcaaggaaaagtgggcccagttttgccagactcgcaaagacccttcttgggaggcataggccatccagaaacagaatactgccccccacgttttgtctcgtgggggaagctgcacagtcaggaagcgttgatggtgtcatcgaccctccatccccggtcagacgccacgtgaagtggaaaatggcccgcacgaagaagacaggggagatgacgactgaggccgcaaaggaaatcgttgagaagatt

SEQ ID NO: 7458 - DNA, 423 bp, Glycine max
  Peptide Sequence Number=SeqID_99143
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccaaccgctgcgccttatccggtaactatcgtcttgagtccaacccggaaagacatgcaaaaacaccactggcagcagccactggtaattgatttagaggagttagtcttgaagtcatgcgcgggttaa

SEQ ID NO: 7459 - DNA, 333 bp, Glycine max
  Peptide Sequence Number=SeqID_99144
atgagaaacacaaatgcgtcaggaacgttccctcccgtatggcgacaatcttgcagccagaggcatgggccattcggtttcgcgagtgagttatccgatgtcggccggaacagacaaagaccggcgggcgctggtattatcgccccggagatgagcgactgttcaggacgttgcgccgctcctgaacagtctggcagttttgtggttttcctccgctgcgccgtccgggaccggggcgtcgaccggaccgaattcactttcccactcggcacttgcggcatgccactgctcttcgtcctgaccttccggacgaccggcctgctcccacagttc

SEQ ID NO: 7460 - DNA, 288 bp, Glycine max
  Peptide Sequence Number=SeqID_99145
atggacataaactatgatataaggaaagacgaaccacctgcaatcactgatgaacgtagcctagctgacgttgcactatatgagcggtgggagagatccaactggctcagcgtgatgttcattaagaccaaaattttggctgggatacgtggttctgttgaccaacatgaaaagttcatcacttcagataagactttagcaaacatcatgatcatgaagttctcttctcttcagctcacccgtgtgaaaggtgtgcgtgagtacatcaagaaaatgcgagatatttga

SEQ ID NO: 7461 - DNA, 210 bp, Glycine max
  Peptide Sequence Number=SeqID_99146
atgaaacaagatgtaaacaagaatgcaaataacagaacaaggacaaaaacacaaacctggacagaatacaaagaaaaagatttggataggataaaaactgtatcaagagccgaagctctgataccagatgatgtgatcctgactaggagcggatcgcttgatacaggctacgaagatttggataatgccacttccagtgaaggaagataa

SEQ ID NO: 7462 - DNA, 219 bp, Glycine max
  Peptide Sequence Number=SeqID_99147
atggcgacttcgcgcgttctcctcccttggaagacgcacccgttgcgacacaccgctaagcgtagcttcagcgcgcttagcgcgacaaaagaatctggcagggcatcaataccaaggttgtgcgctaagcgcgagatcagtgcgctaaccacaacagttgttttcacccaggctcaacgcatgactggcgctaagttcaaattcacttactcgtgctaa

SEQ ID NO: 7463 - DNA, 1104 bp, Glycine max
  Peptide Sequence Number=SeqID_99148
atgattgccttttctgagttcactcacattgatatgtgggatgttgtagaaaaagacaatcatattgctctagatgttgagaagaaggagatctccagggacaaatggatgaatgatcataaatccatatttcttctcaactcatgcgcaagaaatgccctatcgtgtgttttatcacaagtagaatattccaaggttcacagcttcagaagtgttaaacatatgtgggacaccttagccattacctacgaagggtcttttgaggtgaaacataacaagttgagccttctgacacctttaagagccatcaagaatattgattcaatgactcttgaagagctcgtcaggattcttaaactccatgagcaagagctttctcaagatgaaggatcaaagaaagggaattcgctagcccttacagttcaaagaccaaaacgagaagccaacatatacctgatggctgatgcatccactagtaaagatgaaccaacactgtatgcaagttcaaatgttgaggatcttcagcttgatgacactgtcaactctgatggtgaagagcttggagatctcaagaaaattcatcaagctcatttagttgattttgtcttgaaaaccacttcacctggtgatgtacaagacacctttatttgtcaggaggtcaaggaattactagacgaaaagcttaaaggacctgaggtcttgaagaaactaccttctgagattgaaaaactctataaagagatagaaaccttgagagataacttaggaaaatttgttggtggtcatcaagaccttagtaaaattattaaggtgcaaagaaaccctaaggaaaaatttggccatggtttcaaaggaaaaaaggttgtacatggtgaagaagtcattgttttctatttttgtggaaaagtgggtcatgagacttataagtgcaaagacctccctgaaaagggaaacccattaaagggttcatccagtgcttaccatcacccgcaagctaacaaggaaaaaggatccaaaaagatttgggtacctaagaataaaataattcttattgcatatctccttgatgggaggaaagaaacattagtcatggaacctgaatag

SEQ ID NO: 7464 - DNA, 207 bp, Glycine max
  Peptide Sequence Number=SeqID_99149
atggagcggtatctacagcacttggttcgccagcaggcgaccaaccaccgggggcagtttagggctgaggtcacatggcccggagattggcctgaggcccaggcaggggaggcgcctgcaaaggctcccggcgatgcagaggaagcccgcatggatgaggagatgacggatttgctcggtttcttaggagggagcggagccacatga

SEQ ID NO: 7465 - DNA, 442 bp, Glycine max
  Peptide Sequence Number=SeqID_99150
aaccatcaaagaagtgcaagggatcttcgagtcgaagccaacggcactccgaggctcaggaaacgcagattccctcctccatttcctcttccttgttgttctcatcagaagaacaacggatatggcatttcaaaactcaaatctcattcctttcatgtctttaaaattgtctgtttattctgaattagttaaagctttctattctaacctcgaaattcaagaaagcactttgatttttgaggtttatgggataaaaatggtcattgaccaatccctattctatgacttgacccaattatctagtgagggtgtaccatttgaaggtgcattgaatgatgattggaaatttgatttctctgtgcatgatgcccaccggttggtttgcaccaatcaagcggatataaccgaaaggcttattgccggatcattggcttttgaaagc

SEQ ID NO: 7466 - DNA, 429 bp, Glycine max
  Peptide Sequence Number=SeqID_99151
ccgcccatcacccgagcttttattgagaagtactgcacgcagagacaggtccagggtgatgcaccacaggccgcggacgcgccgccacctcatcaggctggtcctgccgaatcgtttgataaggagcagtatttgcggcatttggtttgccagcaggcggccaaccatcgggcacatgtacagacccatgattgtctttatcagatgagtctcagcctgcaaagccagggctttacttcttttccgtgccctactccggaccagttcagggcagaggtcgcatggcctggagattggcctgaggcccagtcgggagaggcaccaacagaggcaccagcagaggctcccgacgaggcagatgaggctcacgaggacgaggagatgaccgatttacttgatttcttaggaggaagctttttgtttccattt

SEQ ID NO: 7467 - DNA, 267 bp, Glycine max
  Peptide Sequence Number=SeqID_99152
atgtcaatccttaccctcggaagcgaaaaagaaaagaaggaaatttccaatcaaaaaaaaagagaaggaaaatttccaatcaaagagaaagcaaaaaaagagagaaggaaaatttccaatcaaaggaaaaaaggaagcaaggaaattcccaatcaaagagtgggagaaagcgaaaaagaaaggaaaggaaattccaagtcaaagaaaaaagaatgggagaaagtaaaaagaagaagctcctggtcaaagaaccagaagaatgtgtag

SEQ ID NO: 7468 - DNA, 342 bp, Glycine max
  Peptide Sequence Number=SeqID_99153
atgtacaatcttcatgagaaaggaagagctcctgatcttgaaagtgtattggcagacttcatgacatataaagctagctctaaaggtaattgttatacaacacaacagcagagaactcagtttggaaaggattattcttttgaagattatcaatgggaattagaatggcaaccttgttatcacaatgaagcaaaaagtttgtttaatctggatgacctgttaatgcaattcaagggtacagtagattcaatgcaacaagcatttaaaagagctgagactcagattggtaagtcagtggatgacatgactaaagttgtggtcaaaagagtatgcagagattga

SEQ ID NO: 7469 - DNA, 717 bp, Glycine max
  Peptide Sequence Number=SeqID_99154
atgacctctatagcccagtctaacacttctagacttgtgttccctgctctaatcatcgcattatgtagagccagaggagttgtctatgatagcctcacttttgaacgcctgagcccgatcattaacttggcctacatcaggaagaactgttggaaccccgaggatctaatagtttctattcgaggggctaggagggcaagggcaaggccagctgagcttccttctacttttgcagctcctactccagcatccacttcagcagccctttctgtcccagttcagacagattctcagcgctttgaagtcatgcttcaaagcattcatcggggacagatcattttactacaaagtttacaggtggtggcgcctctaggatatattccttcagtggaggaagatgaaggtcccacaacccaggtacctcagcaagtgaaggatgagtcatctgaggccaccatcccagagccattttttataagagaagaggcagagaagacacaggtgagacaggtagctgctgccacacctgagcgatctattaaggctacttcagagccttctgcacaaagggaggatataccctcacctcagcctgcaatagacccatccactcctcttctagagaggccagaggacttgaatacatcagtcctggctatggacacttctcctccaactactccagtattgcatctgacagatgaggaggatctttag

SEQ ID NO: 7470 - DNA, 366 bp, Glycine max
  Peptide Sequence Number=SeqID_99155
atgacatttttgggagaaacaagcagtcagaccattgtcaactgtagatttgcgtttatttttccaaatggatcaattattcacaacaaatctagtgtttatttccaaagttccactctgatacacattcgagtacttgatgattgtggttttgaaatactaaaaagcagaatgcagaatacccttcaactaaccaacaatcaatatttggatgaaatttactatcgacaaccattcacagattcaggaaaaaatccaaaaagatttgacattccttcgggatgtagcatcgacggactgaaggatgtgatcaagcaagttgcacctcaagggattcccccttatggtattcatgaatcacaaacg

SEQ ID NO: 7471 - DNA, 258 bp, Glycine max
  Peptide Sequence Number=SeqID_99156
atgggggatttcatcagcagactctccttccccgcatgtttgcattttagcgaagaaaacaccgagactttttcaagtctcacaagttatcaagaactacgtaggtctgagttcctcattggaggatacgtaggagcaagagccttgcttttgtcgaccacaccaccttttgttaccatgccccaagagctggtagcccgcggagacaccttacggttatccgcaccctttgtcatccagaggtggcgggcccgatga

SEQ ID NO: 7472 - DNA, 513 bp, Glycine max
  misc_feature (208)..(208): n is a, c, g, or t
  Peptide Sequence Number=SeqID_99157
atgtcttggaagaggacacattacttctcaatgccccaccacaaaaaccatgattatgaggggccaagacatttagatgaaagtgaagaagcaaaaggggaagaatctagtgaagaaatctacccccaagaagatggacaaccattagtggttaaagagaagtgtaaggaggtaagtgtctcctacaagaggttagctaagaaggaanctcattttacaataaagacaaacattaaaaaaactttccctcttagacaacctccacattttctcttttgtaaaaagacacttgctaccattgccacacctcttgggcttgagtttattcctcaagtaaagaagttgttggatgagggtttggttcgcaagagcttaaatccttgtgctttgttggtgcccaaaataggtgtcaagggaaggagcccagagtatgaagaacctcaggatttgaggtcaaatcctttccaaggtggaggggatgatgcaatcctaccccccaagggtattggatag

SEQ ID NO: 7473 - DNA, 1924 bp, Glycine max
  Peptide Sequence Number=SeqID_99158
cgaacgcagctcggcttacactaaagcgcggctggccgacgatggccttgatgaactgcgcttcggcggcctgctgacgcctaaacgcgccgtcgctggcaaatgcgtgacgcaactacactatgcccgccaggggatcgtcaccccggagatggaattcatcgccattcgcgaaaacatgggccgcgagcgtatccgcagcgaggtactgcgccagcagcatgccggagaaggctttggcgcccgcctgccggacaacattaccgccgagttcgtccgcgatgaagtcgctgccgggcgagccatcatcccggccaatatcaatcacccggaatccgagccgatgattatcggccgcaacttcctggtgaaagtgaatgccaatatcggtaactcggcggtgacctcttccattgaagaagaggtcgagaagctggtctggtcaacccgctggggcgccgacacggtaatggacctctccaccggccgctatatccacgagacccgtgaatggatcctgcgcaacagcccggtgccgattggtaccgtcccgatttaccaggcgctggagaaggtcaacggcattgccgagaacctgacctgggaagccttccgcgataccctgctggaacaggccgaacagggtgtcgactacttcacgattcacgccggggtgctgctgcgctacgtgccgatgaccgcgaagcggctgaccgggatcgtctcacgcggcggttccatcatggccaagtggtgcctgtcgcatcatcaggaaaacttcctctaccagcacttccgcgaaatctgtgaaatctgcgccgcctatgacgtgtcgctgtccctcggcgatggtctgcgccccggctcgattcaggatgccaacgacgaggcgcagttcgccgagctgcatacgctgggcgagctgactaaaatcgcctgggagtatgacgttcaggtgatgattgaaggccccggccacgtgccgatgcagatgattcgccgcaatatgaccgaagagctggagcactgccacgaagcgccgttctacacgctggggccactcaccaccgacatcgcgccgggctatgatcatttcacttccggtatcggcgcggcaatgattggctggtttggctgcgccatgctgtgctacgtcacgccaaaagaacatctcggcttgcccaacaaagaggatgtaaaacaggggctgattacctacaaaatcgccgcccacgccgccgacctcgctaaaggccaccccggggcgcagatccgcgacaacgcgatgtcaaaagcgcgtttcgaattccgctgggaagaccagttcaacctcgcgcttgatccctttaccgcgcgggcctatcacgatgaaaccctgccgcaggaatccggcaaggtcgcccacttctgctccatgtgcgggccgaaattctgttcgatgaagatcacgcaggaagtccgcgactacgccgcgaagcaaaatatcgaagccggcatggccgatatgtcgaataacttccgcgcccgcggcgccggcgtacgcactattcaattgcggatcaaggaccagcgcgacagcgacgtagaggatgatgttatcgccgccatcgcgcttggccgccgctatcgtgcgcgtctgtttatcaatgattactggcaactggcgattaagcaccgggcgtatggcgtacatctgggtcaagaggacctggaaaccaccgacctgagcgccatccgtcaagccggactgcgccttggcgtctccactcacgacgacatggaaattgacgtcgcgctggcggcgcgcccttcctacatcgcgctgggacacgtcttcccgacacaaaccaaacagatgccttcggcgccgcagggcctcgaacagcttgccgggcatattcagcggctggccgattatccgacg

SEQ ID NO: 7474 - DNA, 204 bp, Glycine max
  Peptide Sequence Number=SeqID_99159
atggccagtgatagggacgagtttttatgggtcccttactctgaagaagtccaagcgttgttgagtcatttatgttttgctgggtctgcaatttggagatgtgtagtgtcgatgatttgtttcaatgttgttgaatggcatcagccagatagagtcatgaggcaatttggactgcaacaacctatacctggccctccattgtaa

SEQ ID NO: 7475 - DNA, 273 bp, Glycine max
  Peptide Sequence Number=SeqID_99160
atgggttgtcaattgtttgataaaattatacaccacgaccaccttagtgaagctgactctagaagatatttccaacaccttattcaagcggaatggagaagaagaagagttaagaggagacgccacttcaaggagaagatgagtcaagaagaagttcaccatcataggaagtcatggataagggcttggaggtatgagaagaagaagggagggagaaggagagagggagcacgaaatttgtgcctcaaaagaggtctgaactttgaagtgtaa

SEQ ID NO: 7476 - DNA, 210 bp, Glycine max
  Peptide Sequence Number=SeqID_99161
atgggtgaaggagaggaggtgaaagagcagatgaaggccgacatggaggccatgaaaagagcaaatggccacaatgatggaggccatgatgagcatgaaaaagataatggaatccatgcggttatagttgccgctaccagcactgttgctaaggtgaacccaatgcccccatctggccttaaccaaatgaatcatccaacctcagatatg

SEQ ID NO: 7477 - DNA, 291 bp, Glycine max
  Peptide Sequence Number=SeqID_99162
atgtatcgtgggccccgtggctcgttcggtgtagaaggtcgatcgaaagtcggcccgtccaatcaagcttatcgataccgtcgacctcgagggggggcccggatatattccgcttcctcgctcactgactcgctacgctcggtcgttcgactgcggcgagcggaaatggcttacgaacggggcggagatttcctggaagatgccaggaagatacttaacagggaagtgagagggccgcggcaagccgttttccataggctccgcccccctgacaagcatcacgaaatctga

SEQ ID NO: 7478 - DNA, 738 bp, Glycine max
  Peptide Sequence Number=SeqID_99163
acccagcgcgacagctacctgggcaatgtgcgcgctgccagcgagttcaactacaagttcaacctgtccaagatcggcaagccggtggacaagaccgagtggggcatgaccccgcagacggtcaacgcctactacaacccgctgcagaacgagatcgtgttcccggccgccatcctgcagccgccgttctttgacccgaaggccgatgacgcgctgaactacggcggcatcggtgcggtgatcggccacgagatgacccacggttacgacgaccagggggcacgcttcgggccgaccggcaacatggaagactggtggaccgccgctgacaagaagaacttcgaaggcctgaccggcaagctggtcaagcagttcgaccagtacaaggtcgacggccaggccgtgaacggccacctgaccctgggcgagaacatcgccgacctgggtggcctggctaccgcctacgacgcgctgcagaaggcctccgccggcaaggaagatgcaaaggtcgatggcttcacccgtgaccagcgcttcttcttcaactgggctaccgtgtggcgcaccaagtacaccccggaaaacgccaaggtccgcctcgcgaccgacccgcacgtgccggcgcagttccgcgccatgggtgagcagtcgaacaagctgacatttgccgcagcattccagttcaaggccggttcgccgatggcccgcactggtgagcagcaggtggtgatatggtaa

SEQ ID NO: 7479 - DNA, 441 bp, Glycine max
  Peptide Sequence Number=SeqID_99164
atgtatcgtgggccccgtggctcgttcggtgtagaaggtcgatcgaaagtcggcccgtccgggcaggcagaaggaatatacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggaccgctacacttgccagcgctgatgtccggcggtgctttttgccgttacgcaccaccccgtcagtag

SEQ ID NO: 7480 - DNA, 505 bp, Glycine max
  Peptide Sequence Number=SeqID_99165
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtatccatggaaccgattgcatccctttctcagtattatgaccagcccctaaggtgcttcacatttgaggacttccagctagtgccgactgtgaaagagtttgaagaaatccatggaaccgattgcataccatttgttttcatgtttgctcatccttgctgtcgcaacctacccttcggcgggagggcgacgcgtgactcgcgggatgcgtgttccacgaacggaatacgcgcagagtcgccaccaacgtttattgaggaaaacgtcgaaaaaaccggaaaagacgcgatctacgaacttttagtgaaaggttcaggagttgtatttacgcacggggaag

SEQ ID NO: 7481 - DNA, 639 bp, Glycine max
  Peptide Sequence Number=SeqID_99166
atggtagaagtctccacagaggccattgcctcccttgcccagtattatgatcagccgttgaggtgcttcacctttagggacttccagctatcacctatggtagaagaatttgaagagatcctaggatgccctctaggggaattagaccacaggaagcaagtcaaaaatggggtggttggaataccaagaaaatatttggaggcaaaagcaagaatcttggcaggtaaaggcgagtgggccccgttcatagatattctcgcactgttgatcttcggaggagtcctctttccgaatgtggatgggttggtggacctggcagcgatcgacgcttttcttgcctatcataaccacaaggaaagcccggttgtcactatgctagccgacttatatgacacctttgaccgaagatgtgaaaagagcaatacaaggattgtgaggcatgcttgcccgctagaaagccaccgttcatgcatggagaaaggaggggcaaattgggaccgactcttagcaagcaaagaaggagcatctgtcaactggttccctcgatggaaggaaggaagaaccggagttcttaattcatgcggaggatttccaaatgttcccttgatggggatgaggggttgcatcagctacaatccc

SEQ ID NO: 7482 - DNA, 228 bp, Glycine max
  Peptide Sequence Number=SeqID_99167
atgaaggtagctcgcccaggcgagctgttacttcattctgaagcaaccttgctcgcccaggcgagctggttacttcatcatgaagttattttggtggcccaggcgagccagaggctagcatggggaagtaaagataaggacactaatttcgttcgggcgatcttgttatccgacccgcaactggcgaaaaccaaggaagggaaaccaagaaaacatgaggaaatttaa

SEQ ID NO: 7483 - DNA, 384 bp, Glycine max
  Peptide Sequence Number=SeqID_99168
atggtactcttgccaaaagtcctaacaacaccccagaagcatatgcccaacatgcataggcaaacccaatttctcaaccaacaaggtgctagaaacattagtacaacttcaactatcaatgatcaaattgcatacattgtcttttatgtggcatcttgtatgaaaaatatgttcacattgctcctcatcacctctgatgaggacatggcaaggattaagggcaaggaacctttagaaggacttggaggacctatggcaagggctagaacaaagaaggccaaggaatctcttcaacaagtgttaaccatgctatttgtatttaggcccaagttacgagtgaagaagcttcagattgttaattgcaccatgttccaagaagagtag

SEQ ID NO: 7484 - DNA, 207 bp, Glycine max
  Peptide Sequence Number=SeqID_99169
atggaagttggaagttggaagtggaagttactggaagttgaagttggaaatggaagttattggaagttgaaagttgaaaatggaagttggaagttggaaggggaagtggttgtcatcatcaaaaaggaggagaatatgaattttgatgatgccaaagaagaatcaaacaaggccgcttcaaaggataagcatttgcttcaagattaa

SEQ ID NO: 7485 - DNA, 671 bp, Glycine max
  Peptide Sequence Number=SeqID_99170
atgttgtgtttgtacggataaccactcggggtatttctgcctaccacctgacacatgggtcaggattaacagatgttgtgtttgtacggataaccacttggggtatttctgccttccacctgatgcatgggttaggattaacagatgttgtgtttgtacgaataaccactcggggtatttccgccttccacctgatgcatgagtcacgacggcaacaaaaggcttgcttgcccctagttgacaaaggtgcggataacccttgggtatctccgcatgtcatcgaacttgccataaccttcgggtatctccgcatgtcatcggacttgcggtcttggatgactaaggctcacttgcctctagttgacaaaggtgcggataacccttgggtgcgaataacccttgggtatctccgcatgccacttgactcacgggtcggggtggtagaactgtgggtgtggggcgagaaagtcgccagcgcacaggatttaggttggcaatcaaagggagaggaccacttcaagtcgtggtttcctttctttccttatttggttgtgactattccgtattgtttggatatttgtctgggcgaggatggacatttttaccctgggtcaaggtttaaggtgagtttaggtcttggctcaaaaggcttgcagaacgattggacatga

SEQ ID NO: 7486 - DNA, 540 bp, Glycine max
  Peptide Sequence Number=SeqID_99171
atgggagattcctgtttgatgtatcccggctcgcaacataacaaggaagcatgtttagcagtagaagacctgttgcaacaggtaatagaccaaggttgtttggaaatcggcaatgaggggggtgaagagccgcacatatgcatgcagtccacagatgaggagggtcttagaaagcctaaacctttggtgatatatttcaccagagacgcagctctccaaatgccccaatacccctcagtagttagacctgttccattcccctacaaaaatagccacgcagttccatggaggtatgcgcctccaagcgaaagggaggaagaagccaccgacatcagctcgttgtcggccaaggtaaccaatatcacgggaccgagcggcgtaacccaaagtgatcgtgtgttcgcacccctcgatctaccagcaccacccgcaaacgttaaagggaagacgaaggtagcggaagaacaaagtgacaaagtgatccccgctccggaacaacttgaatatgaatataaatcaataataaataaaggagtttaa

SEQ ID NO: 7487 - DNA, 414 bp, Glycine max
  Peptide Sequence Number=SeqID_99172
atgggtaaagtagaggaggtgcaagagcagatgaaggccgacatggaggccatgaaagagaaaatggccacaatgatggaggccatgatgagcatgaagaagataatggaagccaatgcggttgcagttgccgctaccagtgctattgctaaggtgaacccgatgcccccatctggcctcaagcaaatgaatcatccaacctcagatatggtgggcaaagatttgggaagtacgaatggccccatgatgtgcaaattcaaaacaagcacgccttcccgccatatggctcgcctcccaaggaggatgtcaataactcctctcccatactcattgaaagccaacaacctcaatctgatcatgcacatgtctctcaacccatgggggagacacatgaaatgccccaccacaatctag

SEQ ID NO: 7488 - DNA, 909 bp, Glycine max
  Peptide Sequence Number=SeqID_99173
atgaggggagcgccgaccgaagaaagtctctcgcctttccttgtgagggatctaggcgcgcaaggtctcaaggttatacaaagaatccacaaggcgtggaggagtccgttgaggaaagacaaggagcttagaggcatccgaaacggcgtcatcggaggttatcatggatggctaagaattcacacgcggggcttagattggctctccaaattgaaagttatcaatgaggagaacttcgaagctccggaggaagatgaagaagtccgagctctaaagttaaagctagggaaggcgagactcgccaaggagaagttcaaatcagctgctacacacattcagaaggagtgcaccgagttacaagaggaaaacgcggccactgcaagagctcttgaacaagaaaccaaaagggctcgcaaggaggaacatggccgagagaaattccgaggagcattgtggggtagcaacaatgagctcaagctccgaagagaggagagggatcagtcacgggtacatggcatgatcttaaaagaagagttagttgcttgcgcgaggtccaaaaggagtttggctcaacacttggaagccacggagcaaagcatgttggctatcatagggcaatacaaggaagaattgaaccaatccatggcccatgaacaaaagttagtggaggattttgcacaagtgtatgccgaaaaagaagcaagagggagggtgattgatgcaacagaagcgactatgtggatagataggttcgctttgaccttgaatggaagtcaagacctcccgcgtctgttagccaaagcaaaagccatggccgaagtgtgtactgcccccgaggagattcatgggctaatcaattactgtcagcacatgatagatttgatggcccatataattaggaatcgttag

SEQ ID NO: 7489 - DNA, 249 bp, Glycine max
  Peptide Sequence Number=SeqID_99174
atgccactctatgccaaatttttgaagaatatgctaacaaagaagaactggtacatccatagtgacagaattgttatggaaggcaaagctctcatagacttgggagctagtatcaatttaatgtctctttccatgtgccgacgacttggagagataaagataatgcctacacgcatgactctccagttagatgacaactccattataaagccatatggagtcattgaagatgttaggttaaacacctga

SEQ ID NO: 7490 - DNA, 186 bp, Glycine max
  Peptide Sequence Number=SeqID_99175
atggaatttccggaagagtcactcgtcagagcagaggaagggaattcggaactcaatcaccaagttaaccttcccattgtctatgccagcaacaaaggaagagattggcttggtgtgcagtggaaagagggtggaaaagagtggccatctttgatggcggtagaacagctagcaagaggtgcccag

SEQ ID NO: 7491 - DNA, 240 bp, Glycine max
  Peptide Sequence Number=SeqID_99176
atggataaatttgacatctttgtccctcatcctctggtaattacatctttgcttccactggaatgtgagtgtaagccattggtttgtttgctcaagcgacctgcgcttctgagtttaatgatgcaatcctaccccccaagggcattggatagaagactccaagaagattgggctagagatgcaagagaaggccctaaggttctcatgagccttagggtagattttgggcccatgggctaa

SEQ ID NO: 7492 - DNA, 234 bp, Glycine max
  Peptide Sequence Number=SeqID_99177
atggtggtgagcttcttcttgactcatcttctccttgaagtggtgtctccaatcatctttcttccttctccattatgctgccatgattttcaagaagcaaaggactccattgatgaagaagatccaaggcctacaagctccacatggagctacatcatgtggtatcaagagcatcttcgtctaggtgatgttcttttgcttcctctatctttttgttcggtcaattcactttaa

SEQ ID NO: 7493 - DNA, 362 bp, Glycine max
  Peptide Sequence Number=SeqID_99178
ggtacatcctttgtggcacaagtagagggtacatctacttgggtttgactgagaacaagagagggtacatttcttgtggatcagttctagtggagggtacatccattaggttcaaagagaataagggagggtacatcccttgtggatctttgcttgtaaaaggtttttttacaaggttgaaagaaatcccaaggaccgcaggttgcttggggactggaggtaggcacgggttattccaagatcatgatgaagaccaagtcaatttgtgtctcatgacaaaatctgatgagaataacaaagaagattctgtaaggaagaaatgttacatagacagtggatgttccaagcacatggacgggtga

SEQ ID NO: 7494 - DNA, 285 bp, Glycine max
  Peptide Sequence Number=SeqID_99179
atgactaaccacctgagatatctttggtttccccttacaaagattcaagggactaactgcctaataattctttgtcttaacacatcggagggtacatcctttgtggtacaagtagagcatacatctacttgggttttaatactgagaacaagagagggtacatctcttgtggatcagttcaagtggagtgtacatccacttggttgttcaaagagaacaagggagggattttacaaggttattggaaatctcaagaaccggtggttgcttggggactggatgtag

SEQ ID NO: 7495 - DNA, 219 bp, Glycine max
  Peptide Sequence Number=SeqID_99180
atggagttcaatattcacttaggatcaacatttcagccagcaattcaatcaccaaaactcaaattcacaatagacacaatcataaggaaacctaaaagttcaagaaaagggaataagccaaggaagaaggagcttcaccaccaagaattgccttggaagcttgaagaggatgctttaatggaggaaaagaaagagagaagggggggagcacgaaattga

SEQ ID NO: 7496 - DNA, 198 bp, Glycine max
  Peptide Sequence Number=SeqID_99181
atgaaggaaaagaatgagaaagatagagtgatgcaatcctaccccctaagggcattggatagaagactccaagaagattgggccagagatgcaagagaaggccatacggttctcatgagccttaaggtagggtaccctggaaatgtaggatttttcagtccttgtattttagggcacctagacaagtttttgtattag

SEQ ID NO: 7497 - DNA, 297 bp, Glycine max
  Peptide Sequence Number=SeqID_99182
atggggatcgcacccacaaagacacccagtggacctaaagaagtccaacaggccctggggtttccagctctgggatcgtgccccaagacacctagtggacccgaagaaggccaacagggtcttggagttgccagccctaaatacgggtctctgtcagttcaagggagtgcttgtcgcccccagcaaggtcatcaggcccccctactaatcgagctttcatcaagaagtactgcacccccaggcaggcgcagggcgaaacaccacaacagcattgggatggccggtagcgggcaatag

SEQ ID NO: 7498 - DNA, 366 bp, Glycine max
  Peptide Sequence Number=SeqID_99183
atgttggtgcgcatgatccgcactcgtctctttgcagcggcacgggtgaaatctttccccggtatgcatagtagccgtgtgatagcctccctctctggttgtgctcgcacagttggccctcctccaatatcagggggtggcccaggaaccgtgcggatgtggagcacactgaaaatgaggacacgtagccctctaaaggtgagggcgtgcagccctctcatggcgaggatgtgtagtcctctggaggtgagggcgtgcagccctctgttggcgaggacgtgtagccctatgaaggtgaggacttgcagtcctctgatggcgaggacgtgtagtcctcttcaggcgaggacgtgtagtcctctaaag

SEQ ID NO: 7499 - DNA, 204 bp, Glycine max
  Peptide Sequence Number=SeqID_99184
atgggggagacccgctacttcaacgaaatatactacctcactaagatggctgtcagcccgagtgcctgtcacgaccacaactaccaagattcaaccgtcttttgttttgctgctgctacgccctttctgacctctgggttgggtgtcacagcttatacctcgagtggctctttatcagtagcggatctcattcatgggtattga

SEQ ID NO: 7500 - DNA, 168 bp, Glycine max
  Peptide Sequence Number=SeqID_99185
atggcaagaatagccaaagtggtcaaagtctcgacacaagatttggaccgagtaaaacaaaatagaaatggggtgatcagactaccaaggaagcacttggaagagaaagtgaaggctttggtggatcaaggtgaatgggcttcattcattgatgtcttagcactattg

SEQ ID NO: 7501 - DNA, 504 bp, Glycine max
  Peptide Sequence Number=SeqID_99186
atgacctctatagcccagtctaacacttctagacttgggttccctactctaatcaccgcattatgtagagccagaagggttgtctctcctagcctcacttttgagcgcctgagcccgagtttacaggtggtgacgcctccaggatctattccttcagttgagcagttcagggagatggcagcctggcccgggacccaaccttctcttcatagggaagatgaaggtcccacaacccaggcaaaggagacacaggtgagacaggtagctactgccactcctgagcgatcccttgaggctatttcagagccttctacaccagtggtgaacctaccctcacctcagcttgcagcaaacccctccactcctcttctagagatgccagaggacccgactacaccagtcctggctatggacacttctcctccagctactccagtattgcatctgacagatgaggaggatgttcaaacacaggacacccaggaccagtcacaggaattttga

SEQ ID NO: 7502 - DNA, 150 bp, Glycine max
  Peptide Sequence Number=SeqID_99187
aaacaaagccaaaaggaagggcaaaatggtctgttcacaaaggtttctgaccccaaattcgcccaggctagaaaccagctcgcctgggctaaagatctgacttcaatcctaagcaagcaactcgcatgggcgagtggatgcgttcactag

SEQ ID NO: 7503 - DNA, 522 bp, Glycine max
  Peptide Sequence Number=SeqID_99188
atgggtaaaatagaggaggcgcaagagcagatgaaggccgacatggaggccatgaaagagcaaatggccacaatgatggaggcgatgacgagcatgaagaagataatggaagccaatgcggttatagttgccgctaccagcgctattgctaaggtgaacccgatgcccccgtctggccttaaccaaatgaatcatccaacctcggatatgacacatggaatgccccaccacaatctagccgacttcgagccttgcctcggatatgccactgaaaggcaagtagttggtggtatacccatgccaaacactttgaagggccctcagtttcgcccacaaccacaacccttgcattttacggtgggaagagcccttcctgctatggctgaaaagggaaagttgaatcatatagaggaaaggctcaaggacattgaaggaggcgaatattatacctttgctaacctagaagagttgttcctagtacccgaacatggtcattcccaagttcaaggtgccggactttga

SEQ ID NO: 7504 - DNA, 781 bp, Glycine max
  Peptide Sequence Number=SeqID_99189
gctcatgagaaccctagggccttctcttgcatttctggctcaatctacttagagtcttctatccaatgctcttgtggggcacaaagtgtttttgctaatgacattcaacaattgtatgatgctgctcagaaattggccactcttaaacaaactgatcatgacatggttgcctatgtttcgaaagcccaatctgcagtggaggagttaaaattatcattggaagccgataaacttgaagacataaagacgaaacttgataatctatatatggtgttggtactacgtgggatgcatccagattttgatcatattcgtgatcaagtcttaattggcaaagaagaggacaagctgaaagaggaggtcgccctcaatgttcttacttctgaaacatctgagataaagtttttgaaagctgactatcaagagtatctccagctaaaagctgccaaggaatctcaaacatcatcttctataagtggtcataactccattgcttgcattgcccaatctagtaataatcaaagtccatggatgattgattcaggtacttatgatcacattgctgcaacaggaatcagccatgtatcacccacttcttctttgtctttaaactctgttttgctcatacctgtaacatttgatgctaactcctttgtcatacaagaacgtggtacgggtcggacgattggcgtaggacatgaatcttatggtctttactacctcaagcctaatctttcttgggtttgtagtgctgccacatcaccaaagcttcttcatgaac

SEQ ID NO: 7505 - DNA, 336 bp, Glycine max
  Peptide Sequence Number=SeqID_99190
atgttgacctctgagaatggtttagttcagtacaataacgctatctgttggaaggctcctgctcctgagaggcgcttcccgcgacataatgacacgtggcactgcacgattggaagcgctgcgcacgagggcaccttggttcgcgcccctgacattggcgcctctgtacgcgcccagggacctggcgccttggctagcgcccctgctgtaggcgcgactgctagcgcaaggcagctaggcgcgtccagctctgttaaaggacagctggtccccccctccccactccctccttctcccccaagcccacctgctccccacttgttccctagctggtag

SEQ ID NO: 7506 - DNA, 459 bp, Glycine max
  Peptide Sequence Number=SeqID_99191
atgcctcataaaatgtatatatgttgcatgtgcctcgtgaatcttgccacaaagagatccaagaaggacgccattggagaaggctccagtgctgcccagccaccaaacacggattatgacagccaccgatttcggagcgccgagcatcagcagcgcttcgagaccatcaagggatggtcattcctcagagaaaggcgggtccagctgagggatgatgagttccctgacttccacgaggagatcccctttgatagagatgccctcaaccagttcttgggccagccactgatcttggaggaaggtcaacagtgtgaatatgacgagaggaggagccaggtttccggctttgacgaggatgccatcgctcagcttttgggcataccagggcaggatttcgcccggaccgctgcacggagacggatgcggatcgtgcgcactagcatgaccaccctgacctag

SEQ ID NO: 7507 - DNA, 99 bp, Glycine max
  Peptide Sequence Number=SeqID_99192
atggcaagagggactcttcccactacaaaaggcaagggttatggttatgggtggggtgtgccaccaaacgcttgcccctcagtggcacatccgagttga

SEQ ID NO: 7508 - DNA, 417 bp, Glycine max
  Peptide Sequence Number=SeqID_99193
atggaggccatgaaagagaaaatggccacaatgatggaagccatgatgagtatgaaaagaatgatgagggtcaacgcggctacagtcattgccataagtaccgccactaaggtggacccgactcacccatctggcctcaatcaagtaaatcctccagtctcggatatggtagagcaggaaggcgcaacgttaggaagtacagatgacccccattttgtgcaagttcagaacaagcattccttcccaccatatggcttgcctcccaactatacaccacccgatgttgcacacgctcccgatgagaatgtcaataactccactcccatactcattgagagccaacaaccccaatctaatcatccaaatgtctctcaacccatggggggacacatgaagcgctctgagaccacactctag

SEQ ID NO: 7509 - DNA, 420 bp, Glycine max
  Peptide Sequence Number=SeqID_99194
atgtctctcaacccatgggggaaacacatgaagttccccaagaccacactttggctaagttcagggtctatccaggatataccactgaagggtaggcatttctggcatccctatgtcaaacgctcccgaatatctcaatgtcgcccgttatcacaacccttgcattttgtgagggagaggggccttccacagtacttgaaaaggaagggattaagcatatggaggataggctacgtgccattaaaggatgaggaaattatgcctttgctggcatggcagagttgtgcttggtacccgacatggaagatgagggcgtatgcgaaagatgaaaagttattgatgcatttcttccaggagagtcttgttggggaaactattacctggtatactaacccggaactttcccaggtccattcctag

SEQ ID NO: 7510 - DNA, 378 bp, Glycine max
  Peptide Sequence Number=SeqID_99195
atgcaaattttcatagaggctatagatttaaatatctgggaaaccatagaaattggtccttacatccctactatggtagcaggaaatacaactatggaaaaacctaggaaacaatgggatgaagaagaaaggaaaatggtacaatataacttaaaagccaagaatataattacatatgcattaggcatggatgaatactttagagtatcaaactgcaagaatgcaaaagaaatgtgggataccttacaacttcaggaacatgaaatggaactcatgagactaaatcaacatgaggaaaatgacaagaaaaagaaaggaatcgtacttaaagcttcatcttcaattcaagaaggaagtgataaagaagatttgaattaa

SEQ ID NO: 7511 - DNA, 549 bp, Glycine max
  Peptide Sequence Number=SeqID_99196
atggtcaactctattccgccaagttataccgggggcaatattgataactggcgcatcggcaaaggcgccaccctctactaccctgtgtcggtggccggggcattattttctgtgggcgacccacatgcgtcacaaggcgactctgaattatgcgggacagcgattgagtgctccctcacaggaaccttccagctcattttgcacaaaaaggccagcctcccaggcactgcactggaaagcctgaaacatccgttgctggaaacacaggacgaatggttactgcacggcttcagctacccaaattacctggcagagctggggccggatgctcaaaacagtatttttaccaaatcctcagtagatttagccttgcgtgacgcttaccggaaaatgcgcgactttttaatggggacacaaggattaagtgaagacgaagccatttcactcatgtcaattgcagtcgactttggtattacccaggtcgtggatggaaactggggcgtacacgccgtcgtgaagaaaagtatctttccgccgcgcaagacttaa

SEQ ID NO: 7512 - DNA, 648 bp, Glycine max
  Peptide Sequence Number=SeqID_99197
atgtgtggcaacagacatggcaatggatggcagatgatatcatattcaatcatagaaaagaagctgcagtttactttctctatggatatggtggaactggcaaaacatttgtttggacaaccttatcatctgttgcttcaagtggagttgcttcattactattgccttggtcggaccacacattccaaatttgctataccagtccttgcaacagaaaattcaacatgcaatattcatcaaggcagtgagttagctgaattattaaaggttacaaaactaatagtctgggatgaagctccaatgtgtcacaaatttgcatttgaggcactagataaaagtcttaaagacatcatgcaaaacaatttgccttttggagggaaaattatggtttttggtggagatttccgacagatcttgccaattgttccaaaaggagatggaaaaattggacaatataatgacggattttcagaaatcactattccagacgagtttcttataaaaaattatgatgatcctatccatgctattgttgaagccacctatcccagcttgatagataactacagtgacacaaattacttgcaaaaaagagttgttcttgcctctaaaaaagaaattgttgacaaaataacgttttctacttaa

SEQ ID NO: 7513 - DNA, 303 bp, Glycine max
  Peptide Sequence Number=SeqID_99198
gtgaaaaagaggctaagttatgaagtgccaaaagtgacaattaagcttagctcaacagttgggctaagcgtgcatccaccgctaagcgtagcttcaacgtgcttagcacgaaggagaatctggcagggcatcagcatcaaggccggtataatgctcagggcacaaaattccacagacaccacaatgcctacctcgggaaaagagctctggaggcagcaagaggagcagcttttgcagagatacctaggttttttaggtgactttagcattgggaaatgtactgttgccttagaacttgattga

SEQ ID NO: 7514 - DNA, 1167 bp, Glycine max
  Peptide Sequence Number=SeqID_99199
atgagtgacggattttgcggtactcatttgcagatcatggttaggaccagaggattaggtcgtgccttaggtcaggtcacttgcagaggtgtgggcagaagagatcatgatgattctgatgatgctccacagcgtcgacgacctactgcatccgcacggaggcagcgagtcgctgtgactgcggatcacgtcgatgagccagtcatccctgacccagatgttcaggatgacccgatggaggcactagctactgtggaggacattcctgcggacgcaggcgcagaggcggctgaggatcagcctcagggatttccgggtggtccgagcgacccatctgtgctgacagcgtatgcggatcacgttgcttgcagcgtatggacgggagatgagcgtcctgaattgaagttatcctcacatgggaggaaggtccatagtttaggcaggcctgtccctgccattgagggacttatcgctggtacaggactaagtcctctgatcgcgtgttcgtgggtgagctcacccatctcattggacgacgtctcctctcttctccatcttaccgttataggcgactttcacgcatttgagcccttgcacgtggatgatgcggttcagatgcgggtggacttgttgatagtgtctccagagtctgctagggctgagacagtccagtgtcgcggaccgtacgtacgcctgcaatgggtacgtgaagtatatcagcgccgatgccaggcatgtcattggacagatgcggctcgtgcatatcttcttcacctgctgggttgcactctatttgctaacaagagtgcaaccaatgtccatgttgtctacttggaggcccttcgtgacctcagtatgacagagaggtacgcttggggagtggctgctttggttcatatgtacgaccacctgaacgatgcatccatgagccacagtcaacagcttggcggttacatcacactgctgcagtgctggatttacgagcactttccctcagttgcggagtccaccgccgatcaggactacgacgaggcttctccacgtgcgtgcaggtggattgcgacaaagaagaccgtgaagagcattcgcacgccgtcgtatatggagctcctagaccgactccggattccggatgtctgttggatcccgtatggggagcatcgggag

SEQ ID NO: 7515 - DNA, 366 bp, Glycine max
  Peptide Sequence Number=SeqID_99200
atgggtgttcacgttttggttcgtacttccggaacctccttacccacttccattacctttaacatgaatggccttcccaatattacaggaatgtcattttcttcacagatatccattaccacaatgtctttcaggaagataaaatgttttactctgactagcacatcttcaattactccatatggtctagtaatggagcggtcatcaagttgtaaagtcatcctagtgggcatgatctacaactctcccaaccttatgcacatggagagtggcattaagttaatactggctcccagatcaataagagcctttcccgttgtgacttctccaattgaacaaggaatggttacactcccagggtcttaa

SEQ ID NO: 7516 - DNA, 906 bp, Glycine max
  Peptide Sequence Number=SeqID_99201
atggataaccgaccgcttaagttcgaagagtttgagcacattatgcgccaatgcgtatttgtctctgctacaccggctaattacgagaaagagcatcagcagcaagtagtggaaatgatcgcgcgtccgaccgggcttgtagatcctgaaatcaccgtcaaacctgctgatacgcaagtcgatgatttgcttggtgaaatcaagttgcgtgtagaggttggcgagcgtgtgctggcaacaacgctaaccaaacggatggcagaggacctgacggattacctgagcgaacacggcgtgaaagtgcgttatttgcacagtgacattgatacagtagagcgggtcgagattatccgtgatttacgccttggcgagtttgatgtgctggtgggaattaatttgttgcgcgaaggtctggatattccagaggtttcgctggtggccgtcctggatgcggacaaggaaggctttctgcgctccgagcgctccttgatccagacagctggccgggccgcacgtaacctcaacggtcgggtgattttttacgccaataccatcacacgcagtatgaagcttgcgatggacgaagcggagcgcagacgtaaaatccagatggcattcaatgcagaacatggcattacgcctaaaggggtgactaaacgcatcaaggatattattgagagcgtttatgataaagatgaagcccagcgcgagcgtaaagccgcacaggaacaggcgaattatgaaagcatgagcgagaaaaccctgaccaaggagctgaagcggattgagaaagccatgcatgacgccgccaagaaccttgagttcgagaaagctgcccaataccgtgaccagttgaagaaacttaagttacaagcctttggtgcagaagtagaagacttgaaatga

SEQ ID NO: 7517 - DNA, 594 bp, Glycine max
  Peptide Sequence Number=SeqID_99202
atggctgaagatcttttgaagcttccaaacaatgggaatgccttggaaattggttacaagtattttgatgatttagtttcaagatcattttttcaacgttcaaaaagtaatcgaacttggggcaattgttttgtaatgcatgacctcgtgcatgatctagcattataccttggtggagaattctatttcagatcggaagaacttggaaaagaaaccaagattggtatgaagactcgtcatttgtcagttacaaagttcagtgatccaatctcagatattgatgtttttaacaaactacaatctttgagaactttcctggcaattgattttaaagattcccggttcaacaatgaaaaagcaccaggtattgtaatgtcgaagcttaagtgtttgagagttttatcattttgtaactttaaaacgctggatgttttgcctgattcaatagaagagatgcctagaggaatgggaatgttaagtcatttgcagcatttggatttctttattgtgggcaagcataaagagaacggaatcaaagaactggggacactttcaaatcttcatggttcgctttctattaggaatttggagaat

SEQ ID NO: 7518 - DNA, 261 bp, Glycine max
  Peptide Sequence Number=SeqID_99203
atggaggatgcgtcatctgagactaccactccagagcccttggtcagaaggaagaaggcaaatcaaacacaagaagctgcaaccacttctgagccttcagaaccagtggcagatacagcttcacttcagcaggcagcagacccttacactcctgaggatcagactacgtcagtcctgtctccgaacacctctcctacagctacccctgtgcttcacttaacagacgaggaggatgttcagacacaggatactcaggactga

SEQ ID NO: 7519 - DNA, 792 bp, Glycine max
  Peptide Sequence Number=SeqID_99204
atgacacatcacaatgatttccaagattattttgatgatgccaaagaatcaagagttaagcaagttccaaagaatcaggcttcaggaatcaagtctcaaataatcaagattcaagaacaattaagtttcaagattcaagattcaagaacaatcaagatcaagattcaagaacaatcaaaatcaagattaaagactcaggattcaagagaaattgatttcaagattcaagagaggaaatcgagaagcaacaatcaagacttcacaagggaaatcagttcaagtgaagggtacatccacttggttttcaaagagaacaagggagggtacatcccttgtggatctttggcttgtaaaggattttacaaggttgaaagaaatctcaagaaccgctggccacttgatccaacaagtggtatcagagcaggtttcttgagaaaagtttcacaatttcaagattcatggcctcctcaaattctctgtttcctgaaggaaactccatccataggccacctgtctttaatggtgagggttaccactattggaaaacctgaatgcaaatctttattgaagtcagatttaaacatttgggaagcaatagaaataggaccttatgtacccaccatagtagatgcaagcacaagcacaacaacagaaaaacctagagataaatggtctgaagaagatagaagaagagtccaatatagtcttaaagccaaaaacattattacttctgctctaggaatagatgaatattttagagtttcaaactgtctaaatgcaaaggagatgtga

SEQ ID NO: 7520 - DNA, 296 bp, Glycine max
  Peptide Sequence Number=SeqID_99205
gccgcaaggtccaacatgaagaagctgctgctcatgttcaaaaaggtccggtggagattaatttatctcagcctaatttgtcacaagatagtgacatggagttcatggtccctacacctattgttgatgttccaccagtagcaaggtataagctaaacataagaagacccaaacaaaagaacatttcagacacttcaacagtagacgcacctgttgtggatggcccaccaacagcacccttacttttcatgccaacaccaaggttcactagaaggaaggctgctaataaagatcta

SEQ ID NO: 7521 - DNA, 951 bp, Glycine max
  Peptide Sequence Number=SeqID_99206
atgtccgtcctcatcaaagaagaagacttcatccagtcgatagccgatggcatccagttcatcagctattaccaccccgtcgactacatccgccacctggcccgcgcctacgagcgcgaggaaagcccggccgcgcgcgacgcgatggcgcagatcctgaccaactcgcgcatgtgcgccgagggcaagcgcccgctgtgccaggacaccggcatcgtcaacgtgttcctgaaggtcggcatgggcgtgcgcttcgacaccaagcgcaccctgcaggaactgtgcgacgaaggcgtgcgccgcggctacctgaacccggacaatcccctgcgcgcctcggtgctggacgatccgctgttcgcccgcaagaacacccgcgacaacacgccctgtatcctgcacgtcgagcttgtcccgggtgacaaggtcgacgtgcagctggcttcgaagggcggcggttcggaaaacaagtccaagttcgccatgctcaaccccagcgattcgctggtggactgggtgctcaagacggtcccgaccatgggcgccggctggtgcccgccgggcatgctgggcatcggcgtcggcggcaccgccgaaaaggccatgctgatggccaagcagtcgctgatggaagacatcgacatgtacgaactgctggcccgcggcccgcagaacaagctcgaagaactgcgcatcgagctgtacgaaaaggtcaacgcgctgggcatcggcgcccagggcctgggcggcctgaccaccgtgctggacgtcaagatcaacaccttcccgacgcacgcggcttccaagcccgtcgccatgatcccgaactgcgcggccacccgccatgcccacttcgagctggacggctcgggcccggcgcgcctggacccgccgtcgctgtcgaatggccggaagtgcactgggcgccggactacaacaaagtccaagcag

SEQ ID NO: 7522 - DNA, 331 bp, Glycine max
  Peptide Sequence Number=SeqID_99207
gatcgcgcccgcaagacacctagtggacccagagaagtccaacagggtcctagggtttccagctctgattacgggcctttgtcagttctacggagtgcccgttgccccccagcaaggtcatcaggcccctattaacagggctttcgtcgagaagtactgcgccgccaggcgggcgcagggcgaggcaccacagcagcttggggatggcctgcagcgagcaacagacgcactgccgccacctctagagcccctcagctcatctacaaaggttggagcgttgcatatgacccgtggccaaccagcaggcgaccaagtccaaagccaaaggtaa

SEQ ID NO: 7523 - DNA, 75 bp, Glycine max
  Peptide Sequence Number=SeqID_99208
gctcatgagaaccctagggccttctcttacatctctggcccaatctatttggagtctatccaatgcccttgtggg

SEQ ID NO: 7524 - DNA, 237 bp, Glycine max
  Peptide Sequence Number=SeqID_99209
atgagagctgagccgattcatgtgatagaggtgtcatcctctgaagaagatattgaagaggacccagaggagttacctcctgaacctgctgtggatgcccttgacttcccagaggataatgaggacccactccctgatgttgattctccagaggatgttatgtcagcatctgaggcagactctacagaggagagcggccctggagggacagcgaatagtgacgactcttcatcgtag

SEQ ID NO: 7525 - DNA, 345 bp, Glycine max
  Peptide Sequence Number=SeqID_99210
atgttagccatcgtcagcaagtacgaagaagaattaaatctagccacggcccatgagcacaaagtggcagacgagtatgcccaagtgtacgcagaaaaggaggctagaggaagggtgatcgactcgttacatcaagaggcaacaatgtggatggaccgatttgctcttaccttgaacgggagtcaagaacttccccgattgatagctaaggccaaagcgatggcggacacctattccgcccccaaggagatccacggacttctcggctattgtcagcatatgatagacttaatggcccatatgaaaccgctaggaagtttgtattgtcactcagatcttgactag

SEQ ID NO: 7526 - DNA, 399 bp, Glycine max
  Peptide Sequence Number=SeqID_99211
atgttatcaaagagaaaaactctagatgagggttcactgttatcaagcaagtcggagatccagcatgaccacagattcacctccactccttatgttcccatggacccagtccccagtggagttgccaactatcataacctaccctttggcgggagggcgacgcggggctcacggatgcatcttccaaaggaggaatgcgggcggagtcgccaccaacgtttattcggggaaaacgtcggaaaaaccgaaaagcgtggtcttcggactttaagtgtgaaaggttcgggaaatttttatacgcacggggaaggtattagcaccccacgcgtccgtcacaagggacggcaacctttgatcacgtgtggtgtttccctcgctcctgcgtatcctcaattatga

SEQ ID NO: 7527 - DNA, 402 bp, Glycine max
  Peptide Sequence Number=SeqID_99212
atggttctatctggaaatcgcgatgaacattctaagcgcgcctatgcacttagcctgttcatcgtagctgtcaaaatttgggatttccagatgaacgcgttaagcggaccatgtcacgctaagcgcgctaagtgcgccctgtgcgctaagcctgagtgtcattctgatgagcctgagctaagcgcgccatgctgcactaagctccaactctcttcaatggcatctaagaaaaggaaggcaccttctacacctacccaggccagatatgacagatccaggttcacatctcaagaagcttgggagagatatacagacattgtggtgcctagaaaactactaccagagaggaatgtggaattttatgcgaacctatatgaccccgaggataaatcacctaagcag

SEQ ID NO: 7528 - DNA, 330 bp, Glycine max
  Peptide Sequence Number=SeqID_99213
atggtagcaggaaatacaaccatagaaaaacctagggaagaatggagtgaggaagaaaagagattagttcaatacaatttaaaagccaaaaatataattgcatctgctttaggaatggatgagtacgttagggtatcaaattgtaaaagtgcaaaagatatgtgggataccctacaagtaacacatgaaggaaaaatctttccaaatgaagatcttataaataaagttttgagatgcttaagcagggaatggaaacccaaggtaacaaccattactgaatcacgagatctatctaacatgtctcttgccactttgtttggaaagttatag

SEQ ID NO: 7529 - DNA, 291 bp, Glycine max
  Peptide Sequence Number=SeqID_99214
atggaaaaacctattctaatatttacaaagaagagtggacctaaccttggcccatgggctcagaaatctaccctgaggttcatgagaaccctagggccttctttaacagctctagctcaatcctcttggaatcttctatccaatacccttaaaggtgataaatgtggtattggttgtagtggtggtagtagcgatggtggcggcaatgattgcggtgatggtggtggtggtagtaatgacaatgattttgatggcaatggtgattgcaatggcggtggtgatggtagctag

SEQ ID NO: 7530 - DNA, 110 bp, Glycine max
  Peptide Sequence Number=SeqID_99215
gctgtcgtccattgtgacggacgcgtggggtgctaataccttccccgtgcgtaaaaacagatgtgactcttcatgtttaaatttgaaaatcaaaacgtttagaaacactg

SEQ ID NO: 7531 - DNA, 417 bp, Glycine max
  Peptide Sequence Number=SeqID_99216
ggccctgggttttccggcattaatcacgggtctctgccagtcgttcgggttcctgtcacacctagtgaggtgattcgaccgccgatcactcgggctttcatagagaagtattgcatgcctagacaggcacagggtggtgacccacaggcccctgacgcaccgccgccacctcatcaggcagatccagctgggtcatttgacatagagcggtatctacgacatttgagccagggtctcgcttcttttccatgccctactccggatcagttcagggcagaggttgcatggcccagagattggcctgaggcccaggcaggggaggcacccgcagaggctcccgacaatgcagatgaggcccgcatggatgaggagatgacagatttacttgacttcttgggagggagcggagccacatga

SEQ ID NO: 7532 - DNA, 120 bp, Glycine max
  Peptide Sequence Number=SeqID_99217
atgaagaagaagcacatgcttttcgaggattccgatgatgcttctccagcgtggaagaaggcgctgaagcagggcgatatgctggagctcttgaagatggtgttactatttttaagttag

SEQ ID NO: 7533 - DNA, 228 bp, Glycine max
  Peptide Sequence Number=SeqID_99218
atggcacgtgttcttgataagattaagttgatagatggatcaaggaaaactcttaagctttttgcaaggatcactgatctttggttcattgggatccctgaaaagtctgaacaagtcgaaatggttattgttgattatgattttttgtcttacttgaatgaggttgaagatgaaaggcccatcgttattgttttgacacatgctaggatcaaggaaggccagggttag

SEQ ID NO: 7534 - DNA, 555 bp, Glycine max
  Peptide Sequence Number=SeqID_99219
tttttgtcttacttgaatgaggttgaagatgaaaggcccatcgttattgttttgacacatgctaggatcaaggaaggccagggatcatatctgccgtcagtcagtaattctttgaaggcgtctaaactcatgatcaacgagcttgtgttggaaattcaagaattcagagagagttatagagttgaagtgatggttaatcacaagggcgaacagaccaaacttttgctctgggaccatgaatgtgcagagttaattggtcaatcagtggatgaagtcaacaagctcaaaatagcagatgacaatgttgatttaaatgcctctcctcaagcactagataggctattgggttgtttccttgcattcaaagtcaagccatgttgcaagattgagagttcaatacttgactcgaccgaccctaaagagcttgaatctcaatctgtgtttgttaccgtcgatgatgaccgttcaatgcttgactcaactgaccctatagagcttgaatcttgttcgcttccggcaagtgcaccggatcgcacaagtagtataaaacggtaa

SEQ ID NO: 7535 - DNA, 462 bp, Glycine max
  Peptide Sequence Number=SeqID_99220
atgaagagcacatcttcaacaacatcaagtgaaatgaaaaatcccatgatcggcccaccgttgatcatccaatttatcgctgccttcaacaacgacaaacgacaaacttgtggtaggcagaggcattcatccagaaagcatatctggactgttcggtttactcaggaaatgctggatgctcttgaacccctgaaactcccgcgttgtacaaaagttcctcttaaagcttgtggtcaccacatgacagtcttaaggcgatttagtcctccattgcaatggaaagttgaaaccctgaatcctactattggtggaaaaggcgttgttcaaccatggtatgattttcttaaagaaatggactttgatgatggagatgaaatctctatttactatagatattatgaaaaaaattgggatattgtaattagaaggcaggatgattgggacgatagcgacaccgattaa

SEQ ID NO: 7536 - DNA, 555 bp, Glycine max
  Peptide Sequence Number=SeqID_99221
atgagtgaaatagaagaggtgcaagaacagatgaaggccgacatggaggccatgaaagaccaaatggccgccatgatggaggccatgttgagcatgaagaaaataatggaaagcaatgcgactacagttgccactacgagtgtcgcccatgaggtaaacccgactcacccatcaggcctcaatcaagtaaatcctctagtctcggatatggtaggtcagggaggagaagcattgggaagtacagacggtccccatgttttacaaggcaagaattctttcccaccatacggtttgcctcccaactatacaccacacgatgttgcacacactcctgataagaatgtcgataactctgctctcatacccattgggagccaacaaccccgatctgatcatgcacatgtctctcaacccatgggagagacacatgaagtaccccaccacaatctagctgacttcgagcctcacctcggatatgccactgaggggcgggcatttggtggcatacccctgccaaacactttggaaggccctcagtttcacccacaaccataa

SEQ ID NO: 7537 - DNA, 993 bp, Glycine max
  Peptide Sequence Number=SeqID_99222
atggtgatgcccaaactggggttgcgagactattttagtgacaggggaagactcttcatgtacaaggttatggtaggagaaaaggccttcaaggacaggtttaaccccaaggtgaagaaccatgttccttttggaatgttattcactcaaatcatgaggaatgctggagtaaatgtatcttatatggaatcatttgttgcaacttcacagcttaaaggagtaacctttgtcaagatagaaattgctgataatttcccaaaatatgctaagaagcatataaagaaaaaggtcaagaaagaacctaaggaagaacaacagtctgtggtaggtcaaatgatagacccagccaaaaagccaaagaaacaaccaccctcggaccctaaaccctcaaaccctaaaaccacccaaaagacgaaggctctagactctaagtctgaacctaaatctagaccaacaaccaaacggctaaccataaaaataaaacacccccaaactcagcctacacctccttcaccacccaaacctcaaccagcctcacctccaaagaaccaagaatctgatgatgtgattcttaaaatccctacacctcaaaccttccctagcccttccacctcgaacctctcaacctcaccaaaaccagcttcgcctcacttgagcaaaatagaagttccagcatttgttaaggaggccttcgagttggaagaaggaatgctcgcatatgtgaagacattatctaaggaggagcacaaaaagaaattaactgaagatgccaagcttgtttccttgagtgatgagaaggctaccatgatgaagatagatggagctcttgagcaagccatgcttcgatcacttattgaagtatttcttgtagaagtcggggatgatgttattgagataaatcctagaagtgctcctattcgtccaaggacaaagaatactggttgtaacaagcttggtgtagagctagagttaaagagtcagaagtgtcactga

SEQ ID NO: 7538 - DNA, 354 bp, Glycine max
  Peptide Sequence Number=SeqID_99223
atgtcaatttctcttcaatttcaggcaaaaaggagttattttaaagaattgctaaaagttgatgtctcgctaagcgagctcaatgcgcttagcgagtgtcatccgctaagcgaggcatcagcgcacctaacgaataggaggaatctggaagggaatctatcatgcaggcacgcgctcaacacgtcattagctcgctcagcaagccgtttgtcaccttctaggcttagcgcgagtttggcgctcaacgaaagttcacttactcgcgctaagcacgagaatggcgctaagcgtgacatcaaggagcttccttgctatggaaggctaaaccctcagttggggattcttgctgagtaa

SEQ ID NO: 7539 - DNA, 3342 bp, Glycine max
  Peptide Sequence Number=SeqID_99224
atgatgtgtgcattggagtgccacgtcatttgccacgtccattttgtgaaccttggacagtacataagcctcccaagctctgagccagcttgttggcgaaagaggttgtttagtgtcaagggtagtagccttgacaaggtggtaaccttgacgggtgcgagagttgcaagtctgtcaagcttgtcaagccccccagcctggactaatattgtctgggctgcctttgttaagttgtctagggttgacacatttttctttttacaggcaaagtcaagcgtgtcaggcgagtgcatcacacgcacattactcttgcatatgtgtcacatcaagagtgggcacatactggagatgtggtgtgtgggggctcaattcaaaaaccgctggcggattgagaggtcattccaattggcggttcctcttttaaggagacacgctatggagcttttggtagcgagtcctctttgtgtcgtgttggcagaggtgcttctcaccttcatcggatggggctaccttttgctactcctttggacggggaacccgcgtagccatagtgttgggtcgccttcgtcccctcccaccattgctagctatgagtgggtatggaatgatgttttgaaatatcgttcctccattacttctgcaacgagtgtcgctactctagagcatcaactgagggcggtgtcgggttgtccatccttctttctcatgtactattttctctttgaggtcttgggtttgattctccccttgaactcttttcaatgtgctctacttgagcatcagagtgtagccttttctcagcttcatcccaatatttgggctaggaagctttttaagttttacttgaacgtgttttgtcacttcaaagaccattttctcaaggttttggaaactgatgtcgtggctgataggttgccactaatgttcaaccgggataaggaaccctgtttcctattctactggcagttagaccctactaggttgaagtcttttgatgaggatctactgaccctagtggagaaagttgataaggccattttggagcagttgttggccttgttggatgctcgggccatcttgtctcttccttcagcagatgatgttctcgcttccttagatggaaaagtcaaacctactggtaggaccatgccaccttctactgccaattctcctggcccctttgctgctggttcattgggtccgcctttggtcgtgcaggttactgttgctgcttctgctcctccttctttgcctgctcaagaggtttctatttctcctcccactatggttactacaccagtttctttggtcgcttttatcattgctgctccttccaccattgttacacccttattgagcgctggtgtaacaaccacaaatgctctagaaatgccacctccttcttcttcagcttcatcgattccccccttagctattttggcatcggcgtcgccttcctcctcttctcaccctaatgtctccctagatcacgtctattctcgtgatattgattcaatgaggagcatgggatataggccagagcagagaactccgactagctttatgtcttcctttgacaagaacctcattcgatcaattggggttcaaaatgaaactgattctatgacggtcttccttcagagaagtctagtgactctggaggaaaatggacaaaggcaccaggaggcgctaagcaagatggcatccttagaggctgaggtcgccaagtggagggccactgctcggattgtacggagagtgaagtgtcccaaggtggccaatgccattgttgcttttgctgaggtcgtcaggtccaaccaccaattgtcatccaaggtttgtgatgcttttgccaagatgttgcgcataagaccggatggtgacaagttggttgggcgatgttggcacttgttgagggagaataatgaattggttggcaaggtggagagtgttgcagcagaaaaggacgagacttccaaggtagttgctgacctccaggctcggttgagggagaacaagtccaagctagaggagttcgagctgaaggcgtcaaaggagaggaaaaccaacaaggagctagaggaggagttgctggacgtgaaggatggtgaactgcttgatgaagaggaaatagtttctacggaggaggatgctggcgaggagcaagaccttggtggcgtaggatgtaagactgaccttggcggttttgtaggtaatggaggagtaggtgacataagatcatctcagtgtgatttccacttggttgaaggtcttgctgaccagtgtgctggtatttctctttgctttgtgaaacctcttatccaaggacagggctcaccaagggagaaccttgggtttaacgagttttggaccagggatgcgttcatcttgggttttgacgaggctcaccaagggcgaaccttggatttgtcgagcctttggagatgcgagactcaccaaggggcggaccatgggtttgacgatactttggagaagcgagactcaccaagggtgaaccttgggtttgacgagtctttggagaagcaagactcaccaaggatggaccttgggtttaacgagcctttggagaagcgagactcacttagggcgaaccttgggtttaataagtctttggagaagccagactcaccaaggtcaaaccttggttttgacgagcctttggagatgcgagactcaccaaggatagaccttgggtttgatgagcctttggggatgcgagactcaccaaggatagagattgggtttaacgagcctttggagaagtcagaccttgggtttaacgagcctttggagaagcgagactcaccaagagtagaccttgggtttggcgagcctttggagatgcgagactcaccaaggacggaccttaggtttgacgagcctttggagatgcgagactcactatgggcgaaccttgggtttgacgagcctttagagatacggcattcaccaagggtggaccttaggtttggcatgcctttggagatgcaaccaggaacgaaaaagaatacaacacctggtcttacagtagcttgctatgaccctgaccagttgggtccaagctttcctgctcggggatctttccttactcacttcggactcaccacactaggtcgtcaggttgaatggttcgagtatgctaggaagtttttcttttcacaaacccttggacttgttaagccttgtgcacaaggctttaaggatgactctgttggctgcctctacctaatcgttggtctggggatgtttgacaaaagtcacgaggaggccctatcagcatatgaggtgtttccaggtgaatttctctacctcgctggctaa

SEQ ID NO: 7540 - DNA, 339 bp, Glycine max
  Peptide Sequence Number=SeqID_99225
atggagtttactctcatcaaggtgaacactgaaacgactaaagaaaaattaaagagtaatctcaatgacgctcatgaagtcagttttcaaaaggctcatgaagtcggttttcagaagactcattgtcaggttaagtttttcctgaagaatgttgacctttccctttttgatgtcgacaaggatgtcaattgtcaaggggatttgataaatgaagccaacatgcttgaggatgaagtgcaactgcttctaccggtatcatggcatctggcccatatgagagacgaaaagaggtctcacttgttgttgattgcgacgagcaatgatgagcctaaaagatag

SEQ ID NO: 7541 - DNA, 441 bp, Glycine max
  Peptide Sequence Number=SeqID_99226
atggttaaagacaaagacgaagatacaaaatttttgctctgggaccgtgaatgtgcagagttgattggtcaatctgcggatgaaattaacaggctaaaaatggaaggtggtgatgttgatttagacgcttctcctcaggcccttgataggctgctaggttgtgttcttgcatttaaagggaaggttcagccaaagttcgacaatgatgttgttcttaaatattcaaatgagttagatttgatcaatgttgtgctggatatgctagctgatactaagcaatttgtgtcagtgacagcagaccatgacccacttctgagggttccattaacacccacaaagtgcctatcagctgatgaactggatgatgaagcaagaagttgtgagatttcacccgcgcaagtttcctctaacaaactagcaagaccttctgcaactgaatga

SEQ ID NO: 7542 - DNA, 382 bp, Glycine max
  Peptide Sequence Number=SeqID_99227
atggcacgtgctcctgataagattaagtcgattgatggatcaaaagaaactctgaaacttgctgtaaggatcactaatctttggttcattgggatccccagcaagtccgaacaggttgaaatggttattgttgattctgatggagatgaaatccatgttgtttgtaaacaagatcagctaaagtcttggaaggctaatttgaaggaaagttctacttatgtcatgcataattttaaagtgctaaagaatgatggtcaattcagagtctgtaatcatccatataaattagcttttactggagttactattgttaggcaatccgatttggattcccttccttttaggaaatttaaatttgatgatttttctaatgtcattgctg

SEQ ID NO: 7543 - DNA, 696 bp, Glycine max
  Peptide Sequence Number=SeqID_99228
atggagaggtggcataaggaaactaacagtttccatcttcctattggggagctgatgatcaccctagatgatgtggcatctctgcttcatcttccagttataggcgccttccatagcttcaagcctctgctcgtcgacgaagccgtgttgatgttggtggagttactggaagtctctggagaggaagctagagctgagacagcacagtgtcatgcgacatacatatttttatcgtggctacgagatatttatcaaagcagatacactttccgagacttgagtcaaagcgaaagctatgcatggggagctgcctccctagtgcatatgtatgatcatttgaatgatgcttgtaagagcggcggccgacatcttgctggttacatcactctattacagtggattgctacgaaggctacttcaaagtcattaccagcatcgacgtaccggaagcgtctggatgccttaaggtcagctacgatgggtcctgttgtggtcacacaccaaccagagagggtggtgtggcaattttcctggtcatcatttgaagatattgacgataggtggatgcattactctgactatcttgcagcagctgggcagatttgtcttgtgcctggacagtgtgcatctgactacatggacaggttcttcatgatttctcatccgttcatgacacccgcacaggctgctgattag

SEQ ID NO: 7544 - DNA, 333 bp, Glycine max
  Peptide Sequence Number=SeqID_99229
atgacttatctcttgcacttgattagtaatacgatatttactaacaagtccttagcttacatccatgttgcctaccttcagtaccttggcaacctagatgcttgtcatgagtacgcattgggagtagttgcactatgtacctctaggaccatctctcctatgcaagccagtagagcaataggcaatgtggaggtgtttgcacattttcccactattggctactcaaagagacaggagaattatgtggtggaggacccgatagccaccagatggaagccattgagaggttctgggcttctcctttcgatcagggatatatgggataacctatag

SEQ ID NO: 7545 - DNA, 384 bp, Glycine max
  Peptide Sequence Number=SeqID_99230
atgcttacggtgtgggtggaaatagctttgatggtcgcaacttggattgggcaaattcagaagataaggcttatggtggtcgaaatcaaccaccgtggcggcggagcagagagactgagggagcgaggtcgagcaaaggccccagagaaggaatgggaaaggcatatccctcttgcggtagcgacaacgaggacgatgatgcctaatatgtccatgaccatggtgggcttgcttaaatgcattataaggagcttgagatctataaggttgcatgttgacacagggagtgcagtgatgggaagtgcaacttatgtggagagcaagaccatgacatcatggtcgaatgtgcggaggttgatggcagggaaatggatagggttgtag

SEQ ID NO: 7546 - DNA, 633 bp, Glycine max
  Peptide Sequence Number=SeqID_99231
atgaagattgaggaattggatgatggagagtgtagtagggacgaggaagagaagtgtcagaggcagattgtgagcattgatgcaaagagagcgttggttggagcaggtgcttggatcttgttctaccccacactcttgtataatgtgcttcgtaaccagattgaagttgagtttaggtggtgggatcatattgacgagtttttgttactgggcactgttccattccccaaagatgttcctcacttgaataaggttggtgtgggtggtgtgattactctcaatgagccctacgaaaccttggtgcagttgtatcaggttgaatataagttcatgacacctgctgctgcactagaatataagttcattatttgtcttgcttttcaaaaagatattgttgccacttgccaccagcagaaactcattaggtggaagttgcattcctgtttattgaaacgctttctaacgttacccctttctaattatctcaactatgctagatggcataagagcaggctaaagctgtgttgcatgaagttattaggctggcaccaaaattgcatgagtcgtatcacacccttggacttgtctatacttcactctaggattatgaaagagctatggctttttacttga

SEQ ID NO: 7547 - DNA, 360 bp, Glycine max
  Peptide Sequence Number=SeqID_99232
atggatgtgcttgatacatacatgattgaggggcagattcaatgctctgatcaaagaagattactctatgaagaatctggagatgaattagacagaaagaaagcattagaacaaaggagcatcagtaatttcactgaaaatgatgctttgctcaaacaagagaggccaaccctcagtatgactgacattgtacatgaattggaaactattgtggtcaatgaggaacatacagtttatcatgtagtacccttcataagtctaagcataccgaatgactcaaagaaaaacgcatacggccaagacccaagaatgataactattattaacattattactagaatacccatggggcctttctag

SEQ ID NO: 7548 - DNA, 327 bp, Glycine max
  Peptide Sequence Number=SeqID_99233
atgtcttcatcaaacatccctcatgtggtgctacaatcctcctccaaccatcacagaatgcctgtgattggatttggcactgcttcaatgtcacccccgagtaccaccagagtggcagtgttagaggctatcaaacttggttatagacacttcgatactgcttcaatatatggttcagagcaaccacttggagaagccatagctgaagcacttcaacttggcctcataggctccagagatgaactcttcatcacttccaaactctggtgcacggataattttcctcatcttgttcttccagctctacagaaaacactccggttttaa

SEQ ID NO: 7549 - DNA, 657 bp, Glycine max
  Peptide Sequence Number=SeqID_99234
atggttagaactagagggttaagtcgtgccttaggtagggttataggcagagccctgggagagaggatcatgatgattcaaatgatgttccccagtggcgaaggcctacaggatctgcacgtaggcaacgttatcctcccatggcaggaaggttcagaaatttgggctccagaaattgaagggctagtcgctggcacaagattaagtcctttgatcgcatgttcagtagacactggcgatcagggacttatatccgcttttatggagaggtggcataaggaaactaacagtttccatcttcctattggggagctgatgatcaccctagatgatgtggcatctctgcttcatcttccagttataggcgccttccatagcttcaagcctctgctcgtcgacgaagccgtgttgatgttggtggagttactggaagtctctggagaggaagctagagctgagacagcacagtgtcatgcgacatacatatttttatcgtggctacgagatatttatcaaagcagatacactttccgagacttgagtcaaagcgaaagctatgcatggggagctgcctccctagtgcatatgtatgatcatttgaatgatgcttgtaagagcggcggccgacatcttgctggttacatcactctattacag

SEQ ID NO: 7550 - DNA, 229 bp, Glycine max
  Peptide Sequence Number=SeqID_99235
atgccacttcaaggagaagatgagtcaagaacaagctcaccaccatcagaagccatggataaaagcttaaagaacaattcaagagttcaagatataatcaagaagaattcaagactcaagaagaaagttaagattcaagaatcaagattcaaggttcaagatctcaagaatcaagatcaagattcaagactcaagattcaagaatcaagagaaggcttaatcaagataa

SEQ ID NO: 7551 - DNA, 558 bp, Glycine max
  Peptide Sequence Number=SeqID_99236
atgttgtactttacgctggggtgccagagaaaagaggtaaaggtcagtttccatgatgcggtcgacgaaggagtgtcgacgggttgttcgccctttaaggcggtgtatgtcggacagactaggatcatcttgggtgtttgtggtttgtcaggggtgttattccccctaagtgcactcatgcattttatgggcagagtgctcatcgccctaggggcgtctcacgcgagcctccaactagttgtggttagccttcaactttctaagcttcttctcgtgatgtcgctccatctccgcaatatgggtttggagttgttggagagtattggtggacgtggccgaaatgtgttccaggatctcacacattgggctgaaagttccctaaggataagaaggggaacctgcaaaacaaaggactatgatgctcaatttgggagccggctgctaaggctaatgcgtatgtgctcctgtaccaaggctgagttgacatatataatggggtacgacgtccactttgtagaccttggacaatacaggatccttaaacatatttttacctaa

SEQ ID NO: 7552 - DNA, 279 bp, Glycine max
  Peptide Sequence Number=SeqID_99237
gttaacttagtgggacaaacacttaacaccttccttgcttggccgacacatctcgtgaagcgtttatcagaacaggttatgtgggatgctaccgtgttcggggtgtttaatcaagacttccccttgtacataaagcacgaagatctgtctaaaatagcacatggtggtcaatgtctcagcatctctgttatacagttgtggattctgcatctgactgagacaagtatgcgagcggggaattccgatgtgtatggattcctcgagccacagtccatctag

SEQ ID NO: 7553 - DNA, 168 bp, Glycine max
  Peptide Sequence Number=SeqID_99238
atggcgagtttgctggccatctcccacgtggcaaggaaaacgccagtggtgatggcgagtaggggagttgcaactgccattggcaacttgagggcaagttgcaactcccaccagcaagttagggaagaagaattagccagtgctggtggcgatttaagggctatataa

SEQ ID NO: 7554 - DNA, 1227 bp, Glycine max
  Peptide Sequence Number=SeqID_99239
atgtctttcatctctgactttgccatgagcatgagaggtagtgactctgggggttcaattcagaaactcctgcctcctacttcttctctaaataggaaacttgttctagttaccattattctccctctttctgtttttgggggagcaagaaggagtggtggcgaggacgttaaggcttccccccttgtgcggcgtagccacagtactgggtcaccatcgtccccctttattgttgttggctataagtgggtgagggacgatgttttgaaatatcggtcctccattacctttgcagcgagcgtcgctgctcttgagtgccatgtgaaattggcccatatggaggattgctgcaaaatagccggccaaactcgcgggagtgacgatttcccttttctgagggcggcatcgggtagtccgcctttcctttttatgtatcattttctcttcatggtcttggttttggttctccccttgtcttccttccagtgtgctctacttgagcatctaaatatgaaattgacaggaaagataggttggatctccttgaacaacgtgtccaagaagctatatgagtttgattcgaatgtgtttcgccacttcaaggactatttcttcaaggtcctagttactgacgttgtggctgatggattgccactagtgttcaaccgggatgaggaaccttgcttcccattctaccagcagtcaaatcctaccgggttcaagtcttttgacgaggatttgttaacccttgtggaaaggttcgacaaggctatcttggagcaactgctggccttatcggatgcacgggccatcctgtctcttttttcgacagacgatcttatcgctgccatatatggtataatggggggtcaaccttctgctagggttttccccaatgatgaagttgttaaggtctcccccaacatgtctttctctgttttggctaagaggaagcgtgatgatagtgttggggctacagggttgatgcccggattgggttacctctctagtttgcagggtctgccttcggctctatcagtcgatgtttccggttctcctgttgttgtagtttccacattggtcacttcagtcagtcctatcgtggctccttcgttcaccattgcgatgcccttgttgagcgttgtcactagagccatgagcaagaggctccaagaggattgggctagagctgctgaagaaggccctagggttctcatgaacctcatg

SEQ ID NO: 7555 - DNA, 783 bp, Glycine max
  Peptide Sequence Number=SeqID_99240
atgttgtgcgccaaaccaaagatcttctgctctttgttgatcgtagccccaaaacccgcaaaagaaaacgtgaggagaaggttcattaagaagggtcaccatacaaaccaaggtcagatttcaacacacccaaacccttgggaaggttctagaggtagggttagttttgtaatctgcacaagccttttgaagcccctgagcgtagcgagggttgtaggaggaggaagtgttgttggagaggttggtgacgaactcgaagcaatgagagaattcgatggtgtgggccccactgagggcgacgaattcttcgacggtgaagccgcatttggcgaagagttgggtgatttgggagatgggcatggagggggtggagaggtgggaggatacggcgaaggcgagggaggtctggccgttgcaacgaccgaggaagacgaggaagaaggggccgccgagcatggtcaggaggtcgcaggtggcgtcgaagaggatgttagagcaagagatggtgttggggcaggagagctcgagggcggccttggcacggatgatgaggtcaaaggtgtcgcttgggagggaatggttgatgttggcgttgcgctcaaccttggagaaggcgatggaggagagaaggatggaggcatcgcagtcattggggagaaggcagtcgtggaggaagaggcggagggtggcaatgactgtggtggggctcatgatctgcttgcgggttactatgtccctaatgatctggctgaactgtggacacgtgtcattatagaggaatga

SEQ ID NO: 7556 - DNA, 375 bp, Glycine max
  Peptide Sequence Number=SeqID_99241
atggctcgcttagcgcgccctgctcgctcagcgcaattccctctctggttggaattgcacttagtgtgcccttctcacttagagagacataaaaagttgtgttggatctacgagcatttttcgtccattggttccaccctagctactaaggattatgatgagaggagatcgcgtgcatgccgatggacctctggcaaggcactgcccgtgtcgacgtattgcaggtgtctggacaaactaacccctgatgtagtgtgttggattccgtatggtgatcatcgttcatttagagaatttgaggtcatcacgttgtttttctgtcatctcagatggggtcccttgacagtcattcaccaaccggagagggttgtatga

SEQ ID NO: 7557 - DNA, 402 bp, Glycine max
  Peptide Sequence Number=SeqID_99242
atggttggcaagatagatgttatggtggtagaagtggtttcaaagagtcttttgtcaagggggttgaagagtttgattttggaggttagagttgtgaaggttcaccattacaaaaatgggttcaaggataattattggatttggattgttcatcatgaagacatgttgcatcgtgatttaaatgagggtaatagttacatggatgcttcaaccaatgcagaatatgtggctcaacataaacaatttatgttaatgcaagacaagtgtgtgatgctcttaggcaacctcaaacatttgaagctccaaactcaaataatacggaagaacctccaaatgaagacactcaaagattttacattttattggtggaggcgaatgaaccattgtatgaaggggcaatag

SEQ ID NO: 7558 - DNA, 855 bp, Glycine max
  Peptide Sequence Number=SeqID_99243
gaagcttgggaaagatacacagacattattgtgcctaggaaattgctacctgagagaaatgtggtggtctaccccacagaatttgatgaattcctagatgagctggaaagaagacacaagagggaggagttgactgactttctagatggcaacattgatgttgccattgtaaaagaattctatgcaaacctgtatgaccccgaggacaaatcacctaagcaggtgagggtgaaaggtcatctgattaagtttgatgaggatactcttaacatatttttgaagacccctgttgttgtggaagagggggaaacactttgtgcttactctagatttgcactcctgaggcctgatcctcaggagttagctgctaagctctgtatcccagggaagggatttgagcttaatgttgatggttatcttatgaagattctgaggaagaacatgaccactcatgctcagacttggagcatggacatgaatgtggggtacctcatctcccaccagatctccctcatagcacaacatgacacatctagattaggattccctgccttgatcacatctttgtgtaaggctaggggagccaggggtaagagatctgaggccccttccacttcagcaacatcagaggcaccaacacctttttcttctttagtacccctctcttcatcaactcatattccagttatgcccccagcacctctgcaaatgccactcccagctccattatttgcaggaccatcagactttttattcacaccacagatgctttactccatgatccagagcatccacaaagggtgtcttaatgcggtcctagttgagtttagtcttacaagaggaatctgtgaatga

SEQ ID NO: 7559 - DNA, 1348 bp, Glycine max
  Peptide Sequence Number=SeqID_99244
atgaaggacatgctttgtgtgcagcagcaacttctggaaaagctatatgctgaattggatgaggaaagagaagcttcagccactgcaacaagtgaagcactggacatgatactgcgtttgcagggagagatagccctggtgaagatggaggcaagtcactacaagagagtggcagaggagaagataggccatgctgaggtctctcttgaggcttttgaggaaataatgtatcagaaggaagtgcaaattgcgtcgctcgagtttcaagtgcatgcttatagacacaaacttatgagcttggggtgtgaactcgaagaggatcttttgttgttgaataggagtgatcaaagaaatggagaaaatgggggtcagagtagcactgttagaaggttacaatcaatgcccgcaattcagtttctgagttctttaagagctgctgcaaagaggggaagatcacctagtccagttcttgatgtgattcctaagataatggaggagagtactactgacaaagaagttgctcaacctggcagtggaactcttgattcatatttgaaccagataaaggagttgaatgaacaagtgagggtgatttctgattgtgctgaaggagaaaagagtgcaaatttgagaagtagaagagggaggtcttgttcaattttaccgcatgctagtgctaagatggcatgtgatcaaacacacagattgatctctactaacttagatgaagtgagtcaaggtgaaagtacacccaatagaggagtagctaatgattctcctcgcatccttaatgttcatgatgtgtatgaagtcccacaaactagtgaaaatcatgaagtcagtgaacatgggggaaaaaggtttgagaaatggaattctgatgcagagaatagattaacaaaaccagattctgtgtctgagggaatggttgaatctcctcttaaacatgatgcagaaaagaaaaagggtatgtttaaagtacatggtgaaatcaaaactccttgtcttagagatatgatgatgactatcattggccagaaagaggggatgggtgtggattgcaattctcaagctgagtttcaaaagctgaatcagagaattgagaggcttgagagggagagaattagtgcaaggcaagagattacccatgaagggaatggtgaagagcagttgaggctgttaaaggacatacaaagtcaactccaaatgatacaatcggagatgagatgcttggaaaccaaaaaaaccactcctaagaatgatgtgtatttggctcctctccaagagaatgaccatcttggacgaccgatcaactcactgcattacatgatgtacaattggacatacg

SEQ ID NO: 7560 - DNA, 495 bp, Glycine max
  Peptide Sequence Number=SeqID_99245
atgggggattcaaaagaaaataacaaaggaaagagtagagacaaagataattatgtatggaaagattacttaaagtcccacccaagtcatagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagtcaagcgctgttgggatcaacaatcaaggcaacgttctggaaaatctttctgttggcattgagactattgctgtga

SEQ ID NO: 7561 - DNA, 579 bp, Glycine max
  Peptide Sequence Number=SeqID_99246
atgttcccggtcgaatctctaaaggctcatcaaacccaaggtccacccttggtgaatctcaccaaagccagtacgaacgtgttcttggttgaatctccaaaggctcgccaaacccaagatctgcacctggtgaatccatcaaaacccaagacaaacatgtttctagtcgaatctccaaaggctcatcaagcccaaggtccacccttggtgagtctcacaaaacccagggcgaacatgttcttggtcgaatctccaaaggctcatcaaatcccaagtccacccttggtgagtcttgccaaaccaagtacgaatgtgttcctagtcaaatcttcaaaggctcatcaaacccaagcccatgggcccgaaatctaccctaaggctcaggagaatcctagggctttctcttacatctctggctcaatcttctttgagtcttctatccaatgcccatggggggtaggattgcatcagtcaccccttcccacaacttccagagggaaagagggccttatggtcgtgacagggaaaggttgttcttccaaaggagccgcgagggcttcaccctctcacagagcctga

SEQ ID NO: 7562 - DNA, 726 bp, Glycine max
  Peptide Sequence Number=SeqID_99247
atgagaaattcgcataaggagcttataaactttgcagataggagcatagatgtggcagtagtgaaggagttttatgcaaatctctatgaccccgaagtcaaatcgcccaagcaagtaagggttagggggtatctgattaaatttgatgctaatgccctcaacaccttctttcgtacaccagtggtcattgaggaaggggagagcctcctagcttactccagatttaccaggttaaggccagatccacaagagctggtagcccgcttatgtatcccacgaaagggatttgagttgaatgcagacgggctgcctcggaagatcttgaggaagaatttgactacgctggcccaaacctggagtgtactgtctttttctaacttagcccctacttcccacacttcagatattacattggacagggccaggttaatatatgggattattcagaagatggacatgaacgttgggtaccttatctcgagtcaaatatctcttatagctcaacatgaatcatcaaggctaggttttcctgccctcatcactgccttgtgcatggcccggggagtcacctctgattctttgactttcgagagcttgagcccagccattaatttggcatatgttaaaaagaaatgctggaacttggatgacccttcggttcaaacccgtaacccaaggaatgacaatttcgattgccaatacttcgacaacatttcacaaagatga

SEQ ID NO: 7563 - DNA, 1656 bp, Glycine max
  Peptide Sequence Number=SeqID_99248
atggatgaacctgctttgtgccctaactctgactcacaaccttcttccttcttctttggcgccattcattctcgagtggctgtgatcatgttcctaatctcttggtcattcaccgtggtgtctttgctccttgcaagcctcatatataagtacgtgagcattaaaggaaaggctggggactggggagatggtttcaaaagtgcatatttccaactagcacttcgtagccttcggtccctaggagcaagccaagtgcacccgaagaattggtatccaattccactggtattttgccgaccctggggcaaactgccagaaaatgttccctgtcatcccaaacttgcagattttgctaactgtatgaagaagaaaggtcggggaatgtccatatttgtctctatactagatggggattaccatgaatgtgctgaagatgccaagactgcttgcaaacaacttagcacctacatcgattacaaaaattgtgaaggtgtggctgagattgttgttgcccctaacatgtctgaaggcttccgtggcattattcagacaatgggccttggcaatctcaagccgaacattgtggtgatgcgttacccagaaatttggcggagggaaaacttgatagaaatccctgccacctttgttgggataattaatgattgcattgttgcaaacaaggctgtggttattgttaagggtcttgatgaatggccaaatgagtaccagaggcagtatggcacaattgatttgtattggattgtgagagatggtggtctcatgctgcttctctctcagctccttcttaccaaggagagctttgagaattgcaagattcaggtcttttgtattgcagaagaggatgcagacgcagaggggctgaaagctgatgtgaaaaaattcctttacgatcttcggatgcaagcagaagtctttgtcataacgatgaaatgggatgcacagatggatggtggtgggtctcctgcacaagatgagtcaatggatgcatttactagtgctcagcaaagaattgatgattacttaacccaaatgaaggcgacggcgaagagagaaggtactcctctaatggcagatggcaagcccgtggttgtgaacgagaagcaggtcgagaagtttctttacacgacacttaagctcaattcgacaattttgagatattcaagaatggctgctgttgtgttggtgagtctacctccacctccagtgagccacccagcatatttctatatggagtacatggatctgttgctggagaaaataccaaggattttgattgtaagaggatatcctctttctctcttccttcaatggcccccaagtttggctcagagttccttaaacttcgctgctggaagtggtttggtgaggaggtcttccaaccgatccttggtggacattactgggttggagctatggtatgtggctcccacattgtcacatagtaagtgtggtggctgtttcatggatcttgcccctgttctttacttcctagacaaccatgataccttgttccctccaaagagaatgacatgtgcagacgcagaggttctgtcatctaggttgccaccccaatctgcatctgcatctgcatcactgtatgagagtaaatggggtggtcgagactgttgctgttga

SEQ ID NO: 7564 - DNA, 183 bp, Glycine max
  Peptide Sequence Number=SeqID_99249
atgaaggacatctttgaggttgtattgactaccatgttgaaggacgaggcaaagaattggtggaaagacacgatggagaggatgatgaccttggagattcttgtcatttgggagaacttcaagatcacattcttggacaacctaatgagaagtggaagtccatccaattcgagcaagtcttga

SEQ ID NO: 7565 - DNA, 1620 bp, Glycine max
  Peptide Sequence Number=SeqID_99250
atgtataatgggtgtctgtggaagggtggaaggctgaggctggagaaggccaaagaagactatcttgtgcgtttgaagagagaatgggaacaaggcgctctagatgatgctactcaaaaaccacctgctgctgctattgaggaggaaattcccagcaccgcacactcttccgagtcaaataccaaacacctcaatattttctttcccagattgagaaaggtgaaatccataccattcagtggaactggcaagcacaaatacagttttcagaatattaaagttcctctactccctgtgcatttttgtgattgtgaggagcattgtagtccttttgtccctgaaagagaaaaactatctattgatagggcagctgatagtggtgcaatgaatgatgaagagattagcataatgaatgctgtgatgaacaagctattgggaaaacaaaaggtttccaatgccaagaaacttggagaggagaagggttcttttgaatcacctgatgctttacattctgatgaatgtgaagatagtgcaacagatgaagatgatctcattatcaacgtggagacaaagaaaaataaaacagctttaacaggggacgaggaacttcaaaggatcttggaaaaccaggaatcatggttgaataagacaaaaattgctaaggaagaacccaacaagagcatgcctccagtgcaaaaaaggagtaatagcaatcatgacaagaacaagaagagaaaatcacttcccaaattggaagtgtctactacccctggaagcaagagtaatatgcagatgcttccagatgaggtaggatctggtgcacagcctactgaactagaagatgattttggggaaaaagtttcatggtctcagaagtcttcatggagagaacttcttggtgacaaaggcaatacttctttcagtgcttctctcatattgccaaagttggactctggtgagagtcaacaaagatctgacgatcaatccacacccgtatctacaaacaaaaaaactgaaaacatggaatgggatgggcacctagggagcaaacctacgaatccacacgtgatagaggagcttgtggaagctcaacctaccaataaacaagtgattgaagatgttaccaataataagcataatgtggcagtggcacctaataagacaggtcgaggatcttcatggctgcaaaaacaatcctggacacaaatggttagtcagaataacaattcatttagtatttcaaatattttgcctggcattactttcccagagccaatggccacggagcccattgtggaacctgccatttccaatgattgtaagcataatggtgtagctaaggatactgttaatgaagttgtcagtgatgggtttagctcaagggagactataccagtaaagagtcagcatactggtgccgatgacattgcttctgcttcagtagttgaggaaaaagttgaaacaagtccaagagaaaaatcctctgaaaatgttgaaataggcgaaacttgctcatttatgagaagtgctgcatctttgaaggaatgggcaaaagctaaggctgctatgagtggatcactcaaaagaaaacgtggtcagaaggaagatcagaaggcttag

SEQ ID NO: 7566 - DNA, 87 bp, Glycine max
  Peptide Sequence Number=SeqID_99251
atggctaggagactccaagaagattggatcagagatgcaggagaaggccctaaggttctcatgagccttaggggctccatagtgtag

SEQ ID NO: 7567 - DNA, 251 bp, Glycine max
  Peptide Sequence Number=SeqID_99252
atggacaatgtttctcttggtttactatgtcctcttcaggttgcatgcttcttctacataatcgctaagggattttttatatttgaaatgaacatttgtgtcgcaacctacccttcggcgggagggcgacgcgtgactcgcgggatgcgtgttccacgaaaggaatacgcgcggagtcgccaccaacgtttatttgaggaaaacgtcggaaaaatcggaaaagacgcgatctacgaacttttaagtgaaag

SEQ ID NO: 7568 - DNA, 426 bp, Glycine max
  Peptide Sequence Number=SeqID_99253
atgtctgaacaagcggatatggattatgaaaataaagaagcatgtagtgcgaatgaaccacatgttgattgttctgatgcgttcaatacttttcaggtgtttgagtgccgagaggatgtttcgcggtgggctcgatccgttgctcatgaaaacagatttgtggcggtgattttgaggtcgaccacaaacacaggtagtagaggaaggactgcgtttgtgttaattggctgtgaaaggagtgacgagtataggtgtaggaaaaaagaatttatcagaagatacactaggactaggaaatgtgggtgtcccttcaagtttcgttgcaagccagtggttggaggagaagactggatggtgaagttgatttgtggagtgcataatcatgaattggccaagtcattagttggacatccatatgcagggtga

SEQ ID NO: 7569 - DNA, 300 bp, Glycine max
  Peptide Sequence Number=SeqID_99254
atgaagccacaattctattcaacaagtcctataacttgtttgaaatgcaacaaaagagaaggtcaagcagctggtgtctcgctaagcaaggcatatgcgcttagcgagttacatccgctaagcgaggcactcaacccaattaacgcgtggggaaaccctagaagaggatcagtcacagatgcccgcgtccagcgtgccacaagctcgccaagcgagtcgtttgtcccttctcgcgctcagcgcgcccagttcgctaagcaagaattaactaactcgcacttagcgagaaaatggtgctaa

SEQ ID NO: 7570 - DNA, 762 bp, Glycine max
  Peptide Sequence Number=SeqID_99255
atgcttccatttgcgcattctctccttttctctcttcggtacgcagtgtttccccgtattttgtttgttcccttgctatcggtttggttcgctgaacggttaggttccgtgaaggtgaaggtaccggtgttcggtgttgcggtgctcgtcggcgacatacgaggtacacagtgttgggtgtgttctggtgtatggcagatcgcgcggatcaagttgattcgtaagaagtttacggatcaacttgatccgcatgtagatttcattgcttcggatcaagttgatccatttattgttaagatggatgaagatcagtggatgcatgaaggtataatgcctaaagaagttgatatggatgaaaatgaagaagaatgtggtgtgaatgaaccacatgttgattgttcggatgcgttcaatacttctcaggtgtttgacaaccgagatgatgttttgcggttggctcgatccgttacttatgaaaatggatttgtgacggtgattttaaggtctgacacaaaaacaggtagtagaggaaggacttcgtttgtgttaattggttgtgaaaggagtggagtggcgagtatagcccgtagcaagaaagaatttgttagaagagacactgagactaggaaatgtgggtgtcttttcaagctttgtggcaagccaatggttggaggacaaggctggatggtgaagttgatttgtgggattcataatcatgaatggccaagtcattatttggacatccatatgtcaggcgattga

SEQ ID NO: 7571 - DNA, 375 bp, Glycine max
  Peptide Sequence Number=SeqID_99256
atgaataattttgcacttctattttctccagggaatggaattccgaaggttgtaaatcttgaagtgtatggggaactggtagaaggaagtatcattaggggttgtgctaaggttgcatggtgcggtggaactccaggaaaaggtgttgctagttggttacggaggaagtggaatagcagtcctgtggtcattgttggggcagaagatgaagaatatcagttaaccattgatgatgttgattcaagtttagttttcatgttcacgccagtaacagaagaaggtgctaaaggagaacctcaatacaaatatacagattttgtaaaagctggtctgtttagaatatgcttggtagcctttgccaaaatactaatctag

SEQ ID NO: 7572 - DNA, 765 bp, Glycine max
  Peptide Sequence Number=SeqID_99257
atgcctcatttggaagcagcctcaatattactagttgggcctactttgaaaaaattcaatgatagagatctctctcgtgaggaagtggcactagcaaagcgttatcctgcacatacagctttgtgcattagagatggttgggagtttaatcgccctgagcatgctgcagagtcaactttccgctttttagttgagaaatggaaggaccatattcctctggatttttttctcaaagaagcctccatagataaacctgtggaagaagatatgtgtcgttgtcatttcacaattattcatgatggtgcagctagtacagacccaccattagttttaaaatatcaatggttttgtggtgatatatcactttcaaattttatccctattccagaggctactgatgaggtttactggccaaagcatgatgacattggtaaagttctgaaagtggaatgctctctcactttaggagaaatggtgtatcctcctatatttgccatctcttctcgtatttcacgagatacactcaaagaaggggaaaatgtgcccgttagaaaccatgagagaaaaaggttgatcaagaacacaatttgtcaggctgttcacagaatctgtatgaagatagatccttggatactcatcttgaacagggatgcagtagactttgatgctcttttcaatgatattctctctgagagaacagatccagttccatatgtttcttccttgagtgaagatctgcattatatgagggggaaacaatgctaa

SEQ ID NO: 7573 - DNA, 1854 bp, Glycine max
  Peptide Sequence Number=SeqID_99258
atggcttctcataattcctctcgtttctctgtctttcaacagtttgtttcagcggatcctaagggaatggaacttgtaattcctgactgttgcgaggacagagagcttatgccatcgagaaaatattttggtggacatgaaggggttggagagtatatttggtatcagacaaagcataaacttgaaggatctgaactactagatatatctaatgcttttgatgttgtaatatgtgggacagagccaacatataaaccattacttaaagacgttggagcttatttggctctgtattgggtgcctactcgtgcagatggaaaatgtggggagccattgatttcaatttgcagtaccccagtttcccctgctcctccagtagtttctaatgtatgcgtgaaagagttgtcttcgggaatttattctggagaaggtgaatattttggtggacatgaaggcgaaagtctctttagctggtatagagaaaataatgaaggaaccattgaactgattaatcggccaaattctaaaatctatgaagttactgattcggattacaattatcgtttgttgtttggatatacacctattcgttcagattcagttgcgggggaacttgtcttatcggatccaactaacactgttctcccagagcttccatatgtggagatgcttgctctgactggaaaggcagttgaaggtgacgtacttacagctgttgaagtgattccaaatagtgagactcaacaacatgtttggagcaagtacaagaaagatataagataccaatggagaatgctagttattaactcaacagtgcttctaatcaatgctgattatatgtatcacattaacatcatttcaggttttgttcatcagaagtgggagacaatttttcatttgatccattacctaatcagagttcttgctcctataaggcggtatgcattgagacaaaacctgtattgccagttgggtcttcttgacctgtctacagcaacacagagtcagttgggtagaggagagtatgtgaatagctccttgaatgtcaaaccacaattccctgggcactgcccctttggaatgtccacatgcctggttttgaacatttttcgtatgttgtcaattgatggcatgatgatctcagactttgatagtgactatgctaggatccctagaatacataagctggagattgagggaagaggatttcataccaatctctatgctgttcatggcatttacagtggtgggaaggaaggcaaaagtagagttcaatggcttagatcaatggttggaagtcctgaccttatctctataccaggagaaactggcagaatgtatgaagcgaatgttgatgatgttggctataggctggtggccatctatactcctgtaagagaggatggagtagaaggacaatcaatttcagtatccacagagccaattgcagttgagcctgatgttcttaaagaagtgaagcagaaccttgaacttggatcagtgaagtttgaggtattgtgtgacaaagaccaaacctcaaaaaagatttcatcagtgggcacatatgagagacgtatcctcgaaattaacaggaaaagagtcaaggtggtaaagcctgccactaagacttcttttccagctacagaaattcgtggtagttatgcccctccctttcatgtggagcttttcaggaatgatcaacaccgtctgcgtatagtagtggacagcgagaatgaagcagatttgatggtacactcccgacacattcgggatgttattgttcttgtgattcgaggacttgctcagcgattcaatagtacttccctcaattcccttctcaagatagaggcataa

SEQ ID NO: 7574 - DNA, 237 bp, Glycine max
  Peptide Sequence Number=SeqID_99259
atggaaattaccgaagtgaaggtcgagaaattcggcgcaattgtaacggttgcgttgagttggagaaaagaggggagaatgggagattggagagtggtgagtgtgggtttgattttcgcagaaaacggtgggttttgtttagatgaatgccagagatgggtttgtgtgagtttttgggtctcgttctcgtttgtttgcaccactgttggtgtggaaaccaccatagcactcaagtga

SEQ ID NO: 7575 - DNA, 390 bp, Glycine max
  Peptide Sequence Number=SeqID_99260
atgagtgatggattttgcggtactcatttgcagatcatggttaggactagaggattaggtcgtgccttagctcaggtcactggcagaggtgtgggtagaggagatcgtgatgattccaatgatgctccgcagcgtcgacggcctactgcatccgcacggaggcagcgagtcgctgtgactgtggatcacgtcgatgagccaatcatccctgcgccagatgttcaggatgacccgatggaggcgccagctgctgtggaggacattcctacggacgcaggcgcagaggcggctgaggatcagcatcagggatttccgggactaagttctctgatcgcgtgttcggtagacaccggtgatcggggactttttgttctgcgttttgtggagcgg

SEQ ID NO: 7576 - DNA, 150 bp, Glycine max
  Peptide Sequence Number=SeqID_99261
atgggttctccaccagcctccactcctcctcctccacctccttctcatccttcggatgcatcggcttcgccgtctgccatgaagcggacatgcaaagcctcacgtctacgatcgttgtccactataccacctggtgctgagagaccagtg

SEQ ID NO: 7577 - DNA, 1389 bp, Glycine max
  Peptide Sequence Number=SeqID_99262
atggagggtagccaaaatgctaggggtaaagggaaacaaagaaaatctataggtgaaaccattaacaaggatttagaggctaaacttccctctgtcctgaggacttatcgagatacactgactgctgatatgaagagtgctattaagactgctgttgctgagttgcttccggttcttgcttctcgaggttcagagtcagaattcttttctggagacagagctgtggatgcagatggtggaggtgcatcacttgctagcaagttgcggagcctatcatctgactgttttgtgcatcttctgagtgctattttcttgatagtacagggggggatgttccttggtgaggttttggtgtgtcctcctactttgaaacagtttgtactgcagaggtttgaagtatttgtcaaaatgggaggaaacattgtgtggcaatgttcagttcctgcacatttagtgcgggctgctgaagtgaaaaaggccatcgaatggatcttaagcaaccgtgatggtcattatgctgctgattcagttgtggcggcaattgctcatggtgcagcagctgcagaaacatcccaagaaagcgagtctcatggtactacatttttgccatattcagcacaaagaagtgttgccaagggttcttcatttcagggaaaagcaattgattctatgagctcctcaaacatgtcaaaaaatttcagagctgatatattgcgagaaaacgcagaagctgtctttgcggcatgtgatgctgctcatggaagatgggcaaagcttcttggggtccgtgcaattcttcatcctaggttgaaattgctggagtttctaaccatatacaacattacccaggagttcattactgctacagaaaaaattggtgggaggttgggatacagcatccgtgggacactgcaatcacaggccaaggcttttgttgattttcagcatgaatctcggatgtcaaagattaaggcagtgcttgaccaggaaacctgggtggagattgatgttcctgatgaatttcaatccattatcagtttgctttttacatctgataatttgacttctgagaaccttaatgaaaccgaggatgatatttctaccagttacaattgtgtggtgactaacaatgatgttctgccgatggcagacagttcagagtcaactgctgaacagcaaattatgcagtctaattccattgaatcatcgatgaataatgaaacaccagatagatctaaatccccggttgattcaacggaaccaaataaagctcatggtaggatttcatcagcacatagtaacaatactgagaaagaccataaaaaatctacatctcaggctctttattacaaaggtgttggttatcacatgtgttctctgtctctctga

SEQ ID NO: 7578 - DNA, 123 bp, Glycine max
  Peptide Sequence Number=SeqID_99263
atggcgacttggcctcaagtggaactcgccacctctactggcgagtcagccagtggtttcggaaaccgctggtttgactggcgactcgcaggtgcaggagaggcaggcctacggtgcaggtga

SEQ ID NO: 7579 - DNA, 447 bp, Glycine max
  Peptide Sequence Number=SeqID_99264
atggtgactgacagtagaaaatgtggatgtcccttgaagctgcaagcgaaacgagtgttgggaggtgaagggtggatggtgatgttaatatgtgagactcataatcatgcattggataagttattcattggacatccatatgttggtcgactaactgaggatgagaatattattatttgttatatgataaagttaatggtcaaaccaaaaaatattcttctcactttgaaggagtacaattccaaatattgtacaacaatgaagcaagtattttttctgagatgtgatgcaatccctcaagttattgatagagattcagcattgatgaatgtagtgaaaactgtcttccctgagacaactaacttgttctgtcaatttcacattgataaaaatgtgaagggttttgggttagggtttagtgttgatgggtcttgtgttagggtttag

SEQ ID NO: 7580 - DNA, 270 bp, Glycine max
  Peptide Sequence Number=SeqID_99265
atggtcatcattgtcaatgcagaagcttgtggttacgtgagcatgaactactaccaatatatagatgttgtttacacaaatgagcacatcttaaaagcttactccgcacaatggtggcctctagggaatgaagcggctattcctccttctgatgacgcatggacacttatccctgacccaactacaattcgtgcgaaaggtcggccaaaatcaacaaggataaggaatgagatggattgggtcgaaccatctgagcaccgacaaaaatga

SEQ ID NO: 7581 - DNA, 531 bp, Glycine max
  Peptide Sequence Number=SeqID_99266
atgaagaaggagatcatctgctcagtcggagggtcatggacatcataccataccgcatgtggatcatcctcgggtggggaaatagtaggctgccaccctcggcaagaggctaggaacttcaaactgcgcaatagttctctttcctcgggttcagctggttcttattacatgtatcttggcattctgaaccagctgttaatccaatcatcttatgtatctacagtacctctggctgccaccagaatcttagctcgtcaacttgttaggttacgtcaacagataaccaatttgcagggaagtcgtgctcagatcaggggtgtagcaactcacacacaggcattatatgcaagcacttcaatctctacgggaatgaagggtgcaactaaagcaatggtggcaatgaataagcaaatggcaccggcaaaacaggttaaagtgatcaaagaattccaaaagcaatcagcacaattggacatgacgacattgtttgaggggaccaccattggtgtctattggttggcattgcaatag

SEQ ID NO: 7582 - DNA, 420 bp, Glycine max
  Peptide Sequence Number=SeqID_99267
atgaaagtgaacattgaatggcttatcttgagactggaagagatacttgaggcaaggaaacttcttaatcaatttgccatgctaaaaggagaaaagtatgtcagcaaaaagatcattgaaagtgtcaagagagaattggaacaatgtgaagcagaaaagaaggcattggaaaaaaaggagactgcttgcaagaaatcactggccagagcacaagataagtctaccaagatatatgaaactatcacaaatgctaaatctaaagtgagacactttgataatttctctctggcggatgagcgtggtgttcccgtgtcctctagcatgaggttcttcatagtcatccacctattcatctgctcccccgaacacaaagttcaaggtcatcacaggatccaaacacaaatagcaaaccaggagtga

SEQ ID NO: 7583 - DNA, 285 bp, Glycine max
  Peptide Sequence Number=SeqID_99268
atgtatccttatggagcttcctcagtaaaatgtgcaatttgtcgctatattactaatgtcagtatgacgaatggaaggcttccaattcctgtacagagaccaaatggaacagccaactctggaacagtatcttctacttcatcgtcaatgcctcattctcagagccaaactgtcgtagtagaaaatcccatgtctgttgattcgagtgggaaattgcaaagcaagattttctcactgctgctggtgctcaaagatattgttcgtatatgtgactttgcagcatag

SEQ ID NO: 7584 - DNA, 837 bp, Glycine max
  Peptide Sequence Number=SeqID_99269
atgggcgtaggaatgagtgaatgtctattagtggcgcggaggcagaaccggagctgtggtagtagtggtggcggacagtgcggaacacctccggcaaagcccttggcgctgcgacgtgattcgttaccagagggggcaacaaggatgagaccttcggcgctgatacgggtcgcggcaacaaccatattgcttgtgccgcggcgtgtggtatcgacagagggggcacctccgacgacaactccggcatacccagcgggacaagttccttcgtgcgtcggagacagagttggcttgagtggcgaaggcaacggcggatggggcggtggagttagcggcggtgacgtcggaaatggcggaggtggcagcggaggccgcgacagaggtccgggtcgtcgaggcagtcagaggagaagggcatccagttgggcgtcgaggcggcgtgtaacgacatcaagtttggccaaagccacctcaaggcggtcttcggtggctgacgacgaggctgacgacgagttgtgtgggtggtggtggtcgtgggagctccgtacggcgagtagaagccatggacggcagccatggaagcttggtatggtggttgcggaaatgaaggaggggttctctcgggatcgaacaagctcagcaaccgttggcgggtgtggggagatgggtatggcagccatggaaggcgaccatgggaggtcaatgaaagcaccaatgttaggggagaaagaacacaatgctgacttcgagggcagcaacctccagaaagagagagagaaaggagaattcttaacttttgaagcttcttattactgttcctatcctctaaaggcatga

SEQ ID NO: 7585 - DNA, 63 bp, Glycine max
  Peptide Sequence Number=SeqID_99270
atggcagctacacgtaggttcgtaagtgaaggaattttgaaaagttgcggtgcacagcagtaa

SEQ ID NO: 7586 - DNA, 636 bp, Glycine max
  Peptide Sequence Number=SeqID_99271
atggggccccttcgttttctctctcacaccttttttttaggagatgacgcatcctggcttgatctcggagctcctaccggaggagcgagagggccaagcaatgtcagcaacggtgctggtgcagtgtgcttcttactcttcttcgtcttcttcttcgacttgggagcagaaacctcagtgttgggtgctaccacgggtgtcggagttgtcggtgtcagtgcagggggagagctcaccggaactagcgctggcggcgagctcacaggtgtcacagcaggaggtgtagccgcaggaggagtggtcgcgggaggtgtggtcaccggaggagtggttgctagagctggagcagcagctttagacagaggagatgctaccatgggagatgaaacaagagggtttgcgattgcagcattgggggatgaagctggtggagatgaagtgggagaagcaacaggcgcagttgattttggtttagaaggggttgtggttcgcaacccacgtcttcacgctttgatcattgggattttcaaaataacacttttgaacatctcgcttagccagacaagcatactaagcacaattccaacccaaggagataactcactcaacgagatcaagcgcaattctagccaatag

SEQ ID NO: 7587 - DNA, 456 bp, Glycine max
  Peptide Sequence Number=SeqID_99272
atgactttatccactacacagaaagagtacatggctctgacaaggatcaagtctatcatgaaaggactaagcacattgacatcagatagtacttcatccgttttaagaaaaggaagtgctaaagttgatgtcttgctaagtgagctcaatgcgcttagcaagtgtcatccgctaagcgaggcatcatcgcgcttagcggataggaggaatctggaagggaatctgtcacgcaggcacatgctcagcgcgtcatcaacttgctcagcgagtcatttgtcaccttccaggcttagtgcgagtttggcactgagcaaaaattcacttactcacactaagcgcgagaatggcgctaaacgcgacgtcgaggggctttttagcattgaaagatgtattgtctccttagaacttgatagagtaggattaggttcccgtatgtctggacacggaatgcggtaa

SEQ ID NO: 7588 - DNA, 255 bp, Glycine max
  Peptide Sequence Number=SeqID_99273
atgtatgaaactattcctaatttgtttgctttgggtaacttaatgatcaagttcaatgggctccactatgttgagtggtctgaaatgatccagtttcaactaggtgtaacacactttgacttgacattgataatggatgaaggtccaccaatcattatagagaccaatgttgatgctgacaagtctcttaaagaggcttggaagcggtctatgttagactattggaaagcatacctatgttgtcacaggttatag

SEQ ID NO: 7589 - DNA, 321 bp, Glycine max
  Peptide Sequence Number=SeqID_99274
atggccaagatcatgctgaaggtcacggttccactagatactattttaaacaccgttaacgtgaaggaccagatttacggtgaagttagtaggtcatttgttgtgaggtggaaagacgtgtatcccactccgcacaaagttacctgcaatagcctagacgttccaaacaccatgtattattttcttaaagacaaaggctggactcatttgcatttggaggacgttgtagaatgtcggcttgtgttcaatcacttgagaaagatagttaaaattggagctggatggaaatacttttgtgaaagtccttcaaagctggcatag

SEQ ID NO: 7590 - DNA, 384 bp, Glycine max
  Peptide Sequence Number=SeqID_99275
atgcagtcaacttgcatcactttgggaacacgtgcatcagcgttgggaaacgaatgcacaggagaaatggttcagtatggaacctccttagtggagatgcataagatgtcttctcccttggaaattagtgaactaataacttccactcatacaaatgataatgaggtgaatgtacaagttcctgcagattcaactcaagtagaagctaacaatcaagaaaatgaacatcaagaatcagttgtcgagagaaagaggaaaaaaactttagttgtttggaatgattttgatgaaatggaaatctcccctagggtgaagaaagctgtttgcagatactgcaaaagtaaatttgccactggtggaactggtcaagtactacccatttga

SEQ ID NO: 7591 - DNA, 873 bp, Glycine max
  Peptide Sequence Number=SeqID_99276
atgagatgtgaggcgcggcggtggattgtagcagctcgtgcttatttgctgcacctggtcagttgcactctttttgctaacaagagtgcaacatatgttcatgtggtgcacctaaaggcttttcgtgacctaggtcagagtggtggttatgcctggggagttgccgcgctggttcatatgtatgaccagttagatgaagcttctaggaccactacacgacagattgcggggtacctgactttactacagtgctggatctatgagcactttcctagtgtgcatcagtgcgtcacaaatgatgcataccaggagacgtccccacgtgcttcccggtggctaacgttgaaggcgcatatgaagggaattacaggagcaccgtaccgggaacgttgtgatgctttgacagtcacagatgtgtgttggttgccttacactgagcatcgaggggttaggggctttgagctgatttcatcattccaaggtcaactgagatggggtcctatggtgagcatccctccgccgcctgttagcgcttcattgtcatatgatgatatagatgactggtggatgcatttcgcggaccacgtactagttgtgggtgagctttgtgtagtgcctgggcaggtatctgcagattacatggagtggtttttccggatatctcacccattcatgataccaacccaagcacgtgaccagcccaaacatgcacctgccgcagaccttgaggagtacatgcagtcgtccatcccacaggttccagtggcatttgacccccctccacatgcagtggattgtctcacgatcaccagagggggtgccagtgcagatggaagtgtcagggctcgacagagacgacgcacagagcattga

SEQ ID NO: 7592 - DNA, 264 bp, Glycine max
  Peptide Sequence Number=SeqID_99277
atggcggcttgtggtggtcacccatggtcgtgggtgatgaagaaggagtttctagggttgtttggacggagttttgagagagagcgaaaatccactttttgcactgagcgcaacatttctcttgggttaggatttgcactgagcgctacatttagcactaagcacaattcctctcagatttgggttatgaacctacattccaaatttgaagatgatccaatggttaaggagtgcaggatcgtggttttaccaaaacaggtttag

SEQ ID NO: 7593 - DNA, 594 bp, Glycine max
  Peptide Sequence Number=SeqID_99278
atggatatgatttctgggtttaagtattctacttgctcttgtggtagttgtggggggactgatcaagccaaggtgggagataacaatgttttgacttcggttactgagccaccacatcccttcccaacaccactagtgacaaagatgacaaagaaatttggggagacaattaatgtgaatttcaataatggaggacataatattaatggggatcaaactgttacatatcctgatcttaatactattattgagcaacaaccgttacaaggtcgttacatagcaagggacagttgtaatcatcaacaatttccactaacagacttgtcggcaaaatatcctaacaaaatcgttaatgctataacagaatggcaaaatgctgcagcaaggctggacaggaaatctgtatctcttgggtctattgggctcaagattgctatcatcacctccatttgggagaaagaccttgtcctcaaggtcataggaggtagaaaaatcccatttccaatccactatggacagtgcctggatgacggggtcatttcccacggtaagtggcgcagtgatcctggaagagttggtgtagggccacattga

SEQ ID NO: 7594 - DNA, 882 bp, Glycine max
  Peptide Sequence Number=SeqID_99279
atggttcgaatggttcaaaggaacctaggggaaatgttaggttgtgacaacccgaataagggtcttattcctgcgccatgtcctgtaccgacatatgacatgtcctcccaattgtcatccatatgttgcataagaccatcaaggcctaggaggcttagtggcagtgttgggcccaagatagacataatgttcgtgtttgtggtttcgaaagggatggattactcacccgttacaccaacattttcaggttcagatgatgaacatcaagacaaatcttcgctcatggagttcagcctactctttactgaccttgaagaaggtttagcaatagggaccaaggccataggtagtcttgacaaaagtgtcaaagatggaagagttgaagagatttttcatgttctttgtaacatctcggatgaatcacattggaatgagagggatccaaaggatgtacaggtatgggattgtacatttgaggatgacctaaaggaattaattggtattacctataccaataagatgcatctactttttggtagcccatcacttaagaactccatagttaaaggtgtttggcttagagcaattataggggtaactttctgggaagtttcccaaaaaccatggatacctacggaggtttctgatcggtggaggattctgatcaatgaagagttgagtgaagtgccatctgtgaagtgttgtaaagtcaattatgggatgggtgaccttctaggaagtttccaagaaagtgtgaaagtgagaacaaagcacgctgaaaagtctcataaagggttatctacggaaggttctgaccagtggagggttctgactaacgagaagttgagtgaagtgtcacccgtgaattatcgtagagtatga

SEQ ID NO: 7595 - DNA, 264 bp, Glycine max
  Peptide Sequence Number=SeqID_99280
atgtcaggatttacacgtgattctcctcaaatttcagccagcccgcatcaattagacctcgcaccttacacttcagggcccaacaatgctcaatggaacgccccggggcttctccatgacaagcacacgttgcgttcgagtcgtattctcagagaaatggaggttgatgaaccttggctggggttatggctaccattgaattatcaatttgtgctaaaggtggtgttcgtcattggaagtgcggtagacaggctttgtggttga

SEQ ID NO: 7596 - DNA, 153 bp, Glycine max
  Peptide Sequence Number=SeqID_99281
atggggaccaccaaggattgtgtaacaatgcttccttttgatctctggcatgtcacggaacttcacgtattgtgcaacaaagggtgccaagtacctcgaagcggtcatacaaaggttacatgccatgaaacaatggttcccggacgaaattag

SEQ ID NO: 7597 - DNA, 510 bp, Glycine max
  Peptide Sequence Number=SeqID_99282
atgcttcttgtaacacccttgattattgacttctcgatgcctctcacactaggacactacactcaacatccttgttggtcagaatcttccatcggtctgaacccttcgcaagtaacccattctaagacctttacaaccagctctgacaccgctcaactactctcaagatcattgactgtccccacataccagcacgatacttttcagcgtgctttgtccttactcacacactttttgggaaacttcccagaaggtcacctatcccgtaactactccaagtcaagcaagcttaactgtgaaattcttaagtgtgtgattcgcttgggctcttacatgcccaccaacttccgcctggttcgtcctcgaaccacactatattgggaaagaaggtctgctacgataccatttgcaacacccctaattgtcaacacttcaatggctctcacactacaacacttcactcaacatccttgttggttagaatcgtccaccagtcagaaccctccgtag

SEQ ID NO: 7598 - DNA, 105 bp, Glycine max
  Peptide Sequence Number=SeqID_99283
atgctctggaatcagccaccggcttggcctcctcacagagtgcacagtctattgatgaatggacacaacacgaaattctcggtcgatgcaacccccttgacatag

SEQ ID NO: 7599 - DNA, 726 bp, Glycine max
  Peptide Sequence Number=SeqID_99284
atggaagggaatctatactctactgtcaatggtgcagagaaggttattgacgttgtagtttggaaagtagttgtagggatagacatgggtggtgtccgcaaatttgaagaatcaatggatggctacaacaaagtgcagacttatagaggaatgctttttgacctagtaaggattttgagaaacagactaggagttggtggtctgacagctaaggacaaaatgttggtatatatcattacatacattctggcaccaagatctagcaatcatgctcaagttactgacgatgacttgcggatcatatataggctgaaattaggtattcaaatgaattgggtacttctgattaaagatattatgttgaagagccgccaactagtggattatgaatttccatatgttgtcttagcttctagattcatcgattatttcaatatcaatgtttctaatgaaatagtagactttaccaaagcctctaatgagataatcgaaaggcatctcaagaagcttgacatgacatatgttgatcatgaatggatcatggccagagagccactagtaatagcaaacgacaatcagatggaagaagaagttgaagaagaagctcaacaagagccagctcaacaatggaacccttttgagtctctcatgattcagaagttggatgttatccttcagctaatcatctccatcaaaagcacctatccaaagttcaaagctccttag

SEQ ID NO: 7600 - DNA, 234 bp, Glycine max
  Peptide Sequence Number=SeqID_99285
atgtcatgttggcctgctaagcatagcctatggcagttacctttacacaaaacttttgcttcttttgttgtgcctaccttctgtgtgtgtgcattttgctgctatgcctcaagtactttcttcatcttccttgcttcttcttgcattccatcacaatccaagctaagcgcgccctgtgtgctaagcctaagggtcattctggctaagcgcgagtctgctgcgcttagcccatga

SEQ ID NO: 7601 - DNA, 135 bp, Glycine max
  Peptide Sequence Number=SeqID_99286
gctaagcgcgccctgtgtgctaagcctaagggtcattctggtgaggctgagctaagcgcgccatgctacactaagcttagaccctcttctgttttgaaaatggctaagcgcgagtctgctgcgcttagcccatga

SEQ ID NO: 7602 - DNA, 246 bp, Glycine max
  Peptide Sequence Number=SeqID_99287
atgagtttagagaaggagtgtttgagtttgtacaatttgttactagtcaagacatgtttcaaatgcaaggagaacaaacaaggtgtccctacaagaaatgaaaatgtaaagttttcagaacaagagggtgtaattgagacagaatacatggaggaaaatcctaatcatgaagctcaaaagttctttgatatgcttgcaactgcacaagcaccattgtgggaaggatgcgagcatcattcaaaatag

SEQ ID NO: 7603 - DNA, 231 bp, Glycine max
  Peptide Sequence Number=SeqID_99288
atgcagatggcagacagaggtagaggtggtggtcgtagaacatttaatcgtggtagaagacatggtcttactttgggagcttcaattaccaccaacccttccacctcattcattcacatatcaacctcaaagtcgatgattcatgtcgttgcaccgactccaaacacacttcctacaactcaagaccaaccaaatcctacctttgtaaagaagtcgattcccactacccct

SEQ ID NO: 7604 - DNA, 219 bp, Glycine max
  Peptide Sequence Number=SeqID_99289
atgggagctagggcagtggatggatcaagtccaactactacgaccagtcgctcagatgctttgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 7605 - DNA, 237 bp, Glycine max
  Peptide Sequence Number=SeqID_99290
atggcaccaaagaagctcctatctaagagggcacggaaagatgccgctggagaaggatccagtgcagccccacaagtggatttggagtttgacggacatcgggatcacgtctcccagacacacagtggacccagaaaagtccaacagagcattaggatttctggccttgatcataggtctctatcagttctatggggtgtcgattactcccacaaagcttatctggcctcccattaa

SEQ ID NO: 7606 - DNA, 240 bp, Glycine max
  Peptide Sequence Number=SeqID_99291
atggagctagtcaatgaccaatatcttttacttcgtcccaacaacatgttaaagtatgagcaagatgcatcagctaaaagcggtgattcgcaaggcgtccctgacgcggaggacgatgatgcagatccagacacgacaagaggaagagggatttgggagtggcagagggaaaatgtggtggaaatggcattaaaggtcaccaacaatgttttcttgatgtgcatatcagtattgtcttaa

SEQ ID NO: 7607 - DNA, 210 bp, Glycine max
  Peptide Sequence Number=SeqID_99292
ggtggtggtgacaaggactacaaggaggtacccccacctcctttgtttaaacctgcagggggacacatcaaccaagctgtgaccttcaacagaacttattacaaggagacaaccgtcgtagaacaagattatgtctacgacggtgttgtccccatggtcgtcgtagtcttttgttacttctacgacgaggctgtccggcagtcgtgttag

SEQ ID NO: 7608 - DNA, 693 bp, Glycine max
  Peptide Sequence Number=SeqID_99293
atgataacttcaattcacttgcttaatgaatatatagatgcaaagaataaaataattggtgccaagtattataaaactgatggattcaaaatcaaagatctcaaatctccaagagacatagacgatcatgggactcacatagcatcaacagcagctgggaatcgagttagcatggcaagcatgttaggccttggacaaggcacatcaagaggtggtgccacgttgacatgcattgctgtctacaaagcgtgttggaatgatcactgtgatgatgcagacattcttgctgcatttgatgatgcaattgcagatggggttgatatattgtcagtgtcacttggaggatccaatgatcaaaactattttggagatgcatcttccattggagcatttcatgccatgaaaaatggaatagtgacactatttgcagcagggaactctagtccatctcctgcattcatagacaatttatatccttggtcaatttcagtcgttgctagtactttagacaagatttgttggtctcccgagcaggctattggtgtcatgtcttgtaggattttgggtgtcatccccttcctatcacttttgtatgtgttgccaggattaccagcagttgtccaggatatttactatctacagacaacaacattaaaaagctcagttcttaatccttctagaaaagcttggtag

SEQ ID NO: 7609 - DNA, 1629 bp, Glycine max
  Peptide Sequence Number=SeqID_99294
atggatcatctagtagtaaggattcttgctggtgccttgtgtgacatcattgctgtttacaaggcattatacaagagctttggtggatttgctgcagatgttgttgcagctattgaccaggcagctcaggatggggttgacataataagcttgtcaattactcctaatagacgtcctcctggtgttgcaactttcttcaacccaatagacatggctttgatgtcagctgtgaagcaaggtatttttgtagtacaagcagcaggaaatactggaccatcaccaacaagcatgttctccttcagtccatggatctatactgttggtgctgcctctcatgatcgggtttatagcaacgccatatttcttggaaataatgtgaccatacctggagttggtcttgcatctggcacagatgaaagcaaactttataaactgattcatgcacatcattctttgagcaatgacacaacagttgctgatgatatgtatgttggtgagtgccaagatgcaactattcaattcgatttgtgctgggactctccaccatcaaacaggcctcagaaactgccaaaaaccttagtgcagctgcttaaccccgttccaatgaaaatgcctggcataataattgcttccacaaatgattccaaggttttaatgcaatactacaattcttcattggaaatagatgctgtttcaaataaaattgtgaaatttggggctgttgccagtatctgtggtggactaaaagcaaactacagtaatgttgccccaaaggttatgtattactctgccagaggaccagatccagaggacagtcttcctcatgaagctgacattttgaaacctaacttgttagctcctggaaattttatatgggctgcttggagttctgttggcactgaatcagttgaattcctaggtgaaaattttgcattgatgtctggcacaagcatggctgcaccacatgttgctggtcttgctgcactaattaggcaaaagttccccaatttcagtcctgcagccattggatctgctctttctagtacagcttctctgtatgacaagagtggtggaccaataatggctcagcgatcatatgcctctccagatctaaatcagtctccggcaactccttttgacatgggaagtggttttgtgaatgcaagtggagcactgaacccgggtttagtttttgattctggttatgatgattacatgtcatttctatgtggtattaatggctcagctcctgtggtgctaaactacaccggtcaaaattgcgggctttataattcgactgtctatggtcctgatctgaacttgccctccatcactatatcaaagctgaaccaatctagaatagtgcagaggacagtccaaaacgttgctcaaaatgaatcttacagtgttggttggactgctccttatggggtttcagtgaaagtttctccaactcacttctgtattcccagtggtgagagccaggtcttgtctgtgctcttgaatgcaacccttaacagctctgtggccagctttgggagaattgggctgtttgggaatcaaggtcatgtggtcaacattccactttcagtcatggttaaaatctcatataacactactactagctag

SEQ ID NO: 7610 - DNA, 372 bp, Glycine max
  Peptide Sequence Number=SeqID_99295
atggcagcgcagttgatccatgatcgcgtcgtgatggagtgcctagagggtgtttgggagaccctcgaaggcaatgagaggtgccgattccatggcacacctgtggagtggatactacctacgcctaccccatatcgactagttgagcctgttcaattgatagaggtgtcatcctttgaagaggatcttgaagaggacccagaagagttatctcctgaacctgctatggatgcccctgacttaccagaggatgatgaggacccgctccctgatgttgattctccagaggatattatgccagcatctgaggcagactctacagaggagagtggccctagagggacagcgaatagtgacgactcttcatcatag

SEQ ID NO: 7611 - DNA, 507 bp, Glycine max
  Peptide Sequence Number=SeqID_99296
atggagaatgtgtgtcgattacgccaatctgaatatgcattgtccaaaggactcatactcgtgtggaagcaaagctttccaagtttatttgatgatgccaaagactcaagtcaagaatcaagaatcaaacaagtttcaggaatcaaagagttgttcaatcaagaatcaagattcaaagcgtacatctacttgggttgtaatactgagaataagagagggtacatctcttgtggatcagttcaagtggagggtacatccacttggttgttcaaagagaacaaaggagggtatatcccttgtggatctttacttgtaaaggattttacaaggttattggaaatctcaagaaccagtggttgcttggggactggatgtaggtcagtagctggtgtctcgctaagtgaggcttatgcacttagcgagaatcatccgctaagcgagacactcagcctgcttagcgagttgggaaaaacttctatggattttctaatttttgaattgggctga

SEQ ID NO: 7612 - DNA, 288 bp, Glycine max
  Peptide Sequence Number=SeqID_99297
atggaagatgaggtgagtggagaggttgacacttatgccttctacttccaaagtgctaagtccataaaggaacttgaagatagggtagatttgaccgacttaaaccatcccaattggataataatcaaacactgtctttctactaagagggtttttcttagtgttggttcttgtcagtccaattttgcttatgtctatgaggatcttttcaaagatttagatataactttacctttcactaacttcgagtgtgagatacttattgagatgaatgtagagcctacctaa

SEQ ID NO: 7613 - DNA, 820 bp, Glycine max
  Peptide Sequence Number=SeqID_99298
atggtcttatgtttgttgatcaccttgatcagcattgctgctccacaagccgaggcagcacgagcatttttcgtgttcggtgattcacttgtggacaatgggaacaacaacttcctagccaccacggcgcgtgctgattcatatccttatggcattgattctgcatctcgtagagcctctggtcgtttctccaatggcctcaacattcctgaccttatcagtgagaaaattggctcagaacccacattaccatatttgagtccacagctcaatggtgaaaggctgcttgttggtgcaaactttgcttctgctgggataggaattctcaacgacactggaattcagtttagcaattcatacttcaaacagtatcagcagagggtgagtgcactaattggagaagagcagactcgaaatttagtgaacaaagcattggtgctcataaccttaggtggcaatgattttgtcaacaactattatttggttcctttctctgccagatcccgcgaatatgctcttccagactacgttgtgttcctcatttcagagtatcgtaaaattcttgcgaaactatatgaacttggggcacgaagggttctagtgacaggcacgggaccactaggttgcgtgccagcagaattggctatgcatagccaaaacggagaatgtgcgacagagctgcaacgagcggttaacttgttcaatcctcaactcgttcaactactgcacgacctcaacactgaaattggctccgatgtcttcatttctgcaaacgccttcgcaatgcatttggatttcgttagtaacccacaagcctatg

SEQ ID NO: 7614 - DNA, 147 bp, Glycine max
  Peptide Sequence Number=SeqID_99299
atggcgagccaggcgctagaagagacagatgactcgctgggcgagctggttacacgctgggcgcatgcttgcatggcagattcccttcaagattcctcttactcgctatgcgggctgatgtctcgcttagcggatgatactcgctaa

SEQ ID NO: 7615 - DNA, 138 bp, Glycine max
  Peptide Sequence Number=SeqID_99300
agtggacagatttccatagaacacttagggacaaactccatgatagcagatcctcttaataagggacttccacccaaggtctttcatgagcatgttgctcacatgggtgttttacagtttgaggaatctttgatttag

SEQ ID NO: 7616 - DNA, 564 bp, Glycine max
  Peptide Sequence Number=SeqID_99301
atgagagaaagaagtgaggatcctcttttcgactctgactctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcagcatctactataccaggaatatcaatgaaccctattattgaaattgctcaggatacccttttttag

SEQ ID NO: 7617 - DNA, 498 bp, Glycine max
  Peptide Sequence Number=SeqID_99302
atgtttaagcagggaatgacaaccaaagaaaatgacaagaaaaagaaaggaatcgcacttaaagcttcatcttcaatccaagaagaaagtgataaagaggacttgaatgaaatagaagaagatgatgattttaatttcttcgtgaagagattcaataaattcctaagaaacaaaggaaatcaaagaagatcaaacttcaaaccaaagaaaagaggagaagattcatcttctgttccaaagtgttatgaatgttatcaactaggacatctgagagtttattgccctagtttcaagaaaagaatggaaaaatctgagaggaaaaccttcaatgataaaaaatcaaagaaatcttacatcacttgggaagataacgatatggattcattcgaagactcagaaaatgaagtcgtgaatctaagtctcatggccaaaaattatgaaagcgaagaggtaacatcttctaacaataacttatctatttcctttgatgaactttaa

SEQ ID NO: 7618 - DNA, 279 bp, Glycine max
  Peptide Sequence Number=SeqID_99303
atgcgctgcgctacccagcgcgtaaccttgtctcccctactcctcttctggttatgccattaccaatcgcgggctttccaactagccattgtacctgagattgcgataagtccttcttcttctttggagcttgttcttggtcccaagggaaacggggtgacaaagagcagcttgcttctccaattggatcattgctcgactcgatgggtaacttctagtggtttgccggggaagctcttgtttttctttcaggagttggttggtggcatggacacctag

SEQ ID NO: 7619 - DNA, 733 bp, Glycine max
  Peptide Sequence Number=SeqID_99304
ggtggacccttgggtactagtaccctcaccttccgaggactacacgtcctcgcgttcagaggactacacgtcctcgccatcagaggactacacgtcctcgccatcagaggactacacgtcctcgccatcagagggctacacgccttcgcctttagagggctatgcatcctcacctttagagggctacatgcacaccctcagaggactacagggctgcacgccctcaccttcagaaaactacatgtcgtcgccatcagagggctgcgcaccctcaccttcagagggtcttgtgcccttaaatgcttaaccgagacttgcactccaggttatggggctagtagtttccttttatcagttcctggaccaccccctgatattggagcgagaccaactgtgcgagcagaaccagagagggaggctatcacgcaagatttcacccgtgccgctgcaaagagacgagtgcgggtcatgcgcaccaacatgaccactcttacacagatatggatgatgttgctacttagcaacattccacccgacgaccacaatgccgatctccctcctacggaagtatcagttggtctgtgccatcgtgacatagggatcgcgcccacaaggcacccagtgaacccggagaagtccaacagagccctggggtttccagctctggttacgggcctctgtcattcctacagggtgcccgtccccccaacaaggtcatgccatcatgacatag

SEQ ID NO: 7620 - DNA, 393 bp, Glycine max
  Peptide Sequence Number=SeqID_99305
atgcctagtctctatgaccgaaccacgaagctggaagaaactctagctcaattcatgcaagtgttaatgtctaatcagaagagcacagagtctgctatcaagaatctggaagctgtgaggactaaaagcagaatggaaatacaagctgaggaaggaagagttgatcaaaaggtggagggatttaaacaacagttggttgctcaaccgacatcaatatcaaggtcgcgtgctaagcacgagatcagtgcgctaagcgcaacagttgtcctcagcaggctcaacgcacgattggcgctaagctcaaatccacttacttgcgcaaaggcgtgggtggcgctaagcgcaacgtcacagattcagagtctatttaaagcctgttttgtgcagaattag

SEQ ID NO: 7621 - DNA, 504 bp, Glycine max
  Peptide Sequence Number=SeqID_99306
atggcatcgttcagccagatgttgtcccagattcagtcccagggacttgcactgcctcccgagcctctggttggtccctcaggttctcgagtaatcacaaaggggagttgtgttgatccctcaggaaacgatcctgagacgggtgacttagataggtgcggcttgtacatcgaagcagatcctaactgcctggttgccctggggagagtttatgagggatccactattgttcataacactcctttgttgcctggccaagtaaaggtgggtgtggaggaggttacagatgcagatgctccagttcctgtatccactgatgaggtttccttagtggggcaggcaattcacaccttccttgcttggccgatacttctggtcaagtctttatcacagcaagcagttatgtctccggcaaaaccacctcaaaatcccgatccggaggtcgatgatctgctttatctgatgacattgaccatcccaaagcttttcttgaggccttaccag

SEQ ID NO: 7622 - DNA, 546 bp, Glycine max
  Peptide Sequence Number=SeqID_99307
atgtccttggagttacttctcttagttgaaagctactgggcacttttaacctatcaacttttgaaatttgtttctgcggaaaggggattcggaaattcagatgttgtgaagaaagtctccctttggtggagagatttggcaaagggagttgtagggatgctaaattccgacttgattcccttaacccgtggattgaaaattagtgttgagaattctagagcttttgcttcccggagattgtctgggaacatcagaaaggatatttcagatattactcaaattggtttcacaaacaatttgggaaaatgtttgggattcaaaatgttccaaggaaggccgagaagagacgattatttggagatcattgataaggtggactcgccattgcaaactcagttttctccttgcccatggaatgcacattgttggaatactagatcaattctctatgacagacaggttattgattctagcacttgtttgggttgcattaatgctacagaggaaaccaaaatgcccgtgatgcttggagaaatattaagctga

SEQ ID NO: 7623 - DNA, 156 bp, Glycine max
  Peptide Sequence Number=SeqID_99308
atggtcctctacgggtcagcgttcgcttactcgaacccacccaaggatactaggctgccttgcagcggcattttccgcttgtccagagcagggaagggacgacgatctgtcgatcgtgaccctagcctctatttgcgttcgtccctaagtacctga

SEQ ID NO: 7624 - DNA, 757 bp, Glycine max
  Peptide Sequence Number=SeqID_99309
aggactacacgtcctcccccttcagaggactacacgtcctcgccttcagaggactacacgtcctcaccttcagaggattacacgtcctcgccttcagaggactacacatcctccccttcagaggatacaagtcctcaagttcagagggctacacacgctcgccttcaaaagactacaggtcctcgccttcagaggactacacgtcctcaccttcagagggctacatgcccttgcctttagaggactacacgtcctcccctttaaaggactacatgtcctcgcaattagagggctacacgtgctcgcctttagagggctacatgtcctgaccttcagaggactacatggcctcacctttagaggactacacatcctcgctttcagagagctacacatcctcaccttcagaggactacacgtccttcccttaagaggactacacgacctccccttcagaggactacacgtcctccccttcacagggctacacgccctcgcctttagaggactacacgccctcgccatcagaggacaacacctcctcgcctttagagagctacgcgtcctcaccttcagaggactacacgtcctccccttcagagggctacacgccctcgccatcgtagggctacccaccgtccccttcaaaggactacatcctcgcacctcgcctataaaggactacacgccctcgccttcagagggctacacgccctcgccttcagaggactacacgtcctcgccttcagagagctga

SEQ ID NO: 7625 - DNA, 471 bp, Glycine max
  Peptide Sequence Number=SeqID_99310
atggaagaatcgtcaaagaagagaaagggatcatcctccaccgccgctgctgctgcccatcgccgccacagaccatccaaagcacccacaacacctatacatccttccttgtcatctccaagatcatccactttgatttcttccgatgatcagcgtctacggtacctctctcaattttcttctaggatcattttagaccctaagtacctagacatagatttcttcgatgatgagacatttgattattatcaagtgtttcaaaattatggcttggttgatttcatgtctttaaaattgccttattatcctgaacttgtcaaagtcttttactctaatttaaaaattcaggatggcattctttcttctgaggtgcatggtattcccatgatcattgatcaatcattgttcttttctttgactaaattacccagtcaaggtgcaccttttgagggcaccattgttgatgactag

SEQ ID NO: 7626 - DNA, 211 bp, Glycine max
  Peptide Sequence Number=SeqID_99311
aacttgtaaagggtttttacaagatagtgaaactctcaagcgggttgcttgggggctagacgtaggcataaggcttgtaggcctaggatcttcttcatcaatggattcctttgctcctttgaagatgaatggcagcggaatggagaaggaagagagagaggagatgccacttcaaggagaagatgagtctagaagaagctcaccaccatag

SEQ ID NO: 7627 - DNA, 324 bp, Glycine max
  Peptide Sequence Number=SeqID_99312
atggagagtggcatcaagtttatactggcccccaaatcaatgagagattttccaacagacacaaaaccaatagagcagggaattgtgaaacacctaggatccttatgtcaaggaaccgagctaattgtcgctgtcgcaactttcccttctgcgggtgagcgaggcggggctcacgggaaaccggtcatgaagaatattccagattcgggagttgtatttatgtttgaggaaggtattagcacctctcacgtcgacaaaagcggggctcttgctcctacgtacactccatcgaagaggaaatctgacctacgcagttctttctaa

SEQ ID NO: 7628 - DNA, 258 bp, Glycine max
  Peptide Sequence Number=SeqID_99313
gtggccaaccaccgggcgcatgtacagacccatgattatctttaccagttaagcctcagcctacagagccagggttttacttcttttctgtgccctactccggaccagttcagggaagaggtcgcatggcttagagattggcctgaggcccgggcaggagaggcgccagcagaggctcccgacgaggcagatgaggcccgcgagaacgaggagatgaccgatttacttgatttcttaggagggagcggggccacatga

SEQ ID NO: 7629 - DNA, 327 bp, Glycine max
  Peptide Sequence Number=SeqID_99314
atgtgggtcatcatggaccaatacaaagagaagctaagtctagctacaatccctaaacaaaggctagaagacgagtatgcaaaggtatcggtcttgcaagcagaatgggaagcaagagatagagtgattgattcattacacagagaagcaatgatgtggatggataggtttgctttcaccttgaatgggagtcaagagcttccaagactactagccaaatcgaaggcaatggcggacgtgtacttggctcccgaggaagttcatgggctccccaattattgtcagcacacgatcaatttgatgacccacataattaggaaccgctaa

SEQ ID NO: 7630 - DNA, 835 bp, Glycine max
  Peptide Sequence Number=SeqID_99315
atgttctgtccggccagcggcgccacgccaaaattccacaccgagcgctgcacttcaccaaaggcgctgagatcctgctgggcttcgttgttgatggtgttaaacagccactgcagatcgcgcagcacgtggcggcgcagcgtgctgtgggaaatcagcgtggtattgctggcttcgctctgcttgtccggcgcgttccgtcgttgtgcgagctgttatcacggctcatcgctgccgcctggctggaacgtcagctgctgcagcgtcagcagcggatactcgccgctgtcgctcagccacagcttctggccgtggccggtaaactggctgtcatcgtggcccagcggctgccattccgtgacgctggcgcgcagataacagctcatccgcccccggcagcaacggatagcgcaccgggatctggcaaatctgctcgctgccatccaccagctgcacccgctaatagcggccgttggcgatggcttcgcacaccggcccgaagcggctgtcgccgtccatcagccacgcgaagtctgccgtctgttcctgctgttgcagctgacccggattggcttcggcctgcgccagcgcggcggcacgttgctccgcacccagcgcgaagtcaccgcggatgtcggcgctcagcgcagccagcagggtttcacaccacgcccacgcgctgcccggcagctgcggctgcgccgcgccgcgcagtaccgcttcacgctgctgctcaccggcaatggcctgctgcagtaagttgcccgccaggcacagcagctgcacaaacgccgcgcgcaggtcggcattggccgggctggcctgaatctggcgg

SEQ ID NO: 7631 - DNA, 515 bp, Glycine max
  Peptide Sequence Number=SeqID_99316
gtacacgcccttaccttcagagggctacacaccctcaccttcagaggactacacctcctcgccatcaaagggctgcacgccctcgtcttcaaaggactacacgtcctcaccatcaaagggctgcacgccctcgtcttcagaggactacacatcctcaccctcagaggactacacgtcctcaccttcagagggttgcacgtcctcgcctacagagagctgcatgccctcaccttcagagggttgcacgtcctcgccttcagagagctgcatgccctcaccttcagaggatttgccctcccggttatggggccagtagtttccttttatcagttcctgggccaccccctgatattgaagggcgaccaactgtgcaagcacaaccagagagggaggctatcacgcaactactatgcatatcggggcaagatttcacccgtgccgctgcaaagagacgagtgcggggatcgcgcccgcaagacacccagtggacccgaagaagtccaacagggtcctag

SEQ ID NO: 7632 - DNA, 324 bp, Glycine max
  Peptide Sequence Number=SeqID_99317
atgggatcgagtcaaataccttggcttaaaaaaaggttctatcaggtcaagatcaagagcctaggaatctctagtctgaaagagttaggacagttgatgggtcaactccaacgacaagccttccgcaaaacctatggaattggaccggggaaagcaagtcgaaaatggggtggttggagtaccaaggaaatgtttggaagcaaaggcgagagtcttggcaagtcaagacgaatgggccccgttcatggacatcctggcactcttgatcttcgggttggtcctctttccaaatgtggatgggttggtggaccggacagcgattaa

SEQ ID NO: 7633 - DNA, 351 bp, Glycine max
  Peptide Sequence Number=SeqID_99318
atggccacaccttttaaaacaaaggatgtcaatgaagacattacctcaaaagacatcagaagcctaatggaacaagctaattacaccaaaaaatacctccaagtgttagtagaatccattagtagagaaaaggtatctcctaaacacaaaatccatgaagaatctacatcaaatatccagatagaaaaacccttattcaaaccattcaaggttagtgaaaaggcaaaacaaaaaattagggaatttaggaagcacaaatcccttacagaagggataggtgataacaatagtgaattattaagtaagattgatagtttacttaaattcatccctaaaacaccccaaccatag

SEQ ID NO: 7634 - DNA, 519 bp, Glycine max
  Peptide Sequence Number=SeqID_99319
atgacattaacctataaaaataggcgtatcacgaggccctttcgtctcgcgcgtttcggtgatgacggtgaaacctctgacacatgcagctcccggagacggtcacagcttgtctgtaagcggatgccgggagcaagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatttcttgattgtttggatgtgggattttcatattga

SEQ ID NO: 7635 - DNA, 573 bp, Glycine max
  Peptide Sequence Number=SeqID_99320
atggggaatcagcagaggcaagggtacactcaaggagggttttcaggcttccagcaaggtccttataatcagcaaggacagtggaggacacaccctggcaaccagttcaataaagaccaaggtggatcctcaaacaggccaattcaacaagggcctaacatctttcagaggacaactaagttggaagagaccttgactcagtttatgcaagtaacgatgtcgaatcataagagtaccgagttagcactaaagaaccttgaagtacaaatgggacaactggccaagcagatagctgacaagtcatcaaatagctttggagcaaatacggaaaataatcctaaggaggaatgcaaggctatgatgaccaggagtaaaaaatttgtggaagctgaggatgaagaaaatgtggtagacaaggaacaactgagtgaaaagacaggtgttgagaggaaagtagaagtggaaaggccgtggaagaaagtgtggaagtatcatatcctgtggtgccttccaagaaagaaaaagatcgtcatatggcaaggtttttggatatttttaggaaactggaaataa

SEQ ID NO: 7636 - DNA, 830 bp, Glycine max
  Peptide Sequence Number=SeqID_99321
aagaccaagggcaaggcccagctgagactccttctacatcaacagctcctcatccagcttctacatcagcaactcctcttctagctcgtttgacagcagctccttctaccctacctcctatagattttcaacatttcaaagccatgcttcaaagcatacatcaggggaaaattattttgctccaaagtctccagctgccccctcctcacagggacgacgaggatcccgccgctcaagtacgacatcagccagcggatgagtcatcagagtcttccactcctgagcccttgatctggaagaggagggtagttgtaactcaggaagtcgcagccactcctgaaaagtctcctgaggccactctagagcctccggcaccagtggcagataccacttcttcacagcaggcagcagatccttcaacgcttgaagatcaaaccaccccagtcctatctccaaacacctctcctgtagctactcctcgagaattcgctaagcgtaaccttcagtggctaagcgcgaggaagaatccaaaagaagatgagctgtcaagtttgctaagcgcaccgctccaagtcaacaagcacatcgcttcagctcatccgctaagcgaaataagcgcgctaagcgatccagatctgcggcacgagcatgaacaaggccacctatttaagcctgaaatcagatttgcaaaaggagtttggacatttcttgagaagctctgcatgcacgaaggttctagagagagaaaggtccaagttccaaagagttctgagagattttgctgtgtgaagatctacagagatgcgagttcgaagcgaaagccgttctga

SEQ ID NO: 7637 - DNA, 540 bp, Glycine max
  Peptide Sequence Number=SeqID_99322
atgtttgtcgacaaagactactttagtctccttttcaccatccagagacaatcgagcccgatggcacgtggggacaaattggggtcatcctccacctttgctatccaaagacaatcaagtccgatagcacacagagatgaatatggtcatctgccctctttggtcgaagactcaatgtctttcggccgagactattacagtctaccctttgctatccagagacaatcaagtctggtggcatgcagagaccgtaatggtcactcgcttttgttgttccgagactatcaaattccccttatcatccaagacaagcaagtccgatgttcccttttgctattcgaagacgataaagttcgatggcatgcagagaaaaacatagtggcctgcttcccttgtcgagagactcaatgtctggtgaccaaggctaccggagtctcccttgctatcccgagacaagcgagtctgatagcatgtggagaccgtcatggttatccatttttatcgctttcaaggcaccaaggcttttgcttatgcacctga

SEQ ID NO: 7638 - DNA, 144 bp, Glycine max
  Peptide Sequence Number=SeqID_99323
atggtggatgatgcaatcctcccaaggaggggactcatcaccagagccatggctaggagactccaagaagattgggctagggatgcaggagaaggccctagggttcccatgagccttagggtagattttgggcccataggctaa

SEQ ID NO: 7639 - DNA, 714 bp, Glycine max
  Peptide Sequence Number=SeqID_99324
atgtgccaaagttttttttttaaagattatcaaggggaaccagagtcacaattctactatcaaaatgaagcaaaaaggagtttcaatctggacattttgttaatgcaattcaaggatacaattggatctattcaacgagcatttaaaagtgcaaaaattcaggttggtaagttggtagaagaagtgactcaagctatgaacagaagagaacaagagattgtcgaggttgacactcaggaggagagccctgtgaataagcatgatttagaagaagaagatgaggagaaagcgcaacaatgggaacaatgcttacaaacacacactcaacaagaagataatttccaagttaacacatgttcgcatcaattgtctatcaaagaagaaaggcatgaagaacatgaaggttcaatcattctaggacaaccctgtctaccatttactagttgtgttttcgacatgggtaaagaatgtctagtcaatgaagatggaggaagaatgctagcttgtattgaagagctgggggatccagatgatgaatctattggtcatgtgatgtttgaagaattggaaaacaataggccaaaagaaaagcccaaagtagaattaaagacccttccagtgcatttaaagtatgtattcttggaggacaatgagaccaaacctgttataattagcagctccttgcagaagaaagaagaggatcaactggtatag

SEQ ID NO: 7640 - DNA, 861 bp, Glycine max
  Peptide Sequence Number=SeqID_99325
atgggcagagctaggttggtttatggcttagtcacagggatggacatgaacattggcggcttgatctctggacagataaccattatggctcagtccaactcttctcgcctaggcttcccagctttaatcacagccttgtgcaggtcaaggggagttggatctgatgctcttacttcttacaggagcctgaggccgaacttgcaagaattggcccaccagaggccaatcatgattgttgagaagttcattgagcagcaaaagccagagctagaagacgaccaatcctctgaagccattgttcctggagcttttgatgttgcaaaagtaccagtaccagctgatccaccatctccagtggtggatccatcttctcctacgccaaaagcagctctcccatctacacctattattatatttgatgaccctacagaaatttcaatgggggtttaccgaaaagtgcactgggttgtcaagtatttaaaattaaaacggatgaatccgagtatcgagcatagggaactaatgcctaaattactaaaccctcgatccctcgtcaggctgaatatccaagctttgtccgtagatccctcatttaagactacacctgatttagacagtcctcttaggaagggaccagtcactagagccatgagcaagaggctcaaagaggattgggctagagctgctgaagaaggctctagggttctcatgagtctcaggactcatcttctccttaaagtggcgtctcctctctcttccttctccattccgctgccattcatcttccaagaagcaaaggaatccattgatgaagaagatcctaggcctacaagctccaatggcttagacaagggagtatga

SEQ ID NO: 7641 - DNA, 213 bp, Glycine max
  Peptide Sequence Number=SeqID_99326
atgtcagtgaaaaatctcgtcgggcgcctaggagtacatgacaagacaaaccacacactagcaagtcagtcagggtcacggtgttttgcgagaatgctccaaccatatgggatcaacataagcttaaaggagcactcaaaccgagtgaccctcaaggcctacactctgaagagtctatcagggcctctccctcccgattcaggtccaacctag

SEQ ID NO: 7642 - DNA, 126 bp, Glycine max
  Peptide Sequence Number=SeqID_99327
atgaggcaggaagggcagaagtggaacaagttaaccaaggtgcagcagattttcttaaaagctgtttctatatctgtgtgtctagttctttgttggaagaaagctaggatgttcaagtcacagtaa

SEQ ID NO: 7643 - DNA, 549 bp, Glycine max
  Peptide Sequence Number=SeqID_99328
ggctacccgccctcgccttgggtactagttaccctcaccttcagagaactacacgtcctcaccatcagagggctgcacgccctcaccatcagaggactgcacgtcctcgccttcgtagggctacatgccctcacctttagaggactacatgtcctcgccatcatagggctacatgccctcaccttcagaggactacacatcctcaccatcagagggctacacgccctcgccatcaaaggactacatgtcctcgccatcatagggctacatgccctcaccttcagaggactacacgtcctcaccatcatagggctacacgccctcgccatcaaaggactgcacgtcctcaccctcagaggactacgctttccttttaacggttcctgggccacccctgatattggaggagggccaactgtgcgagcacaaccagagagggaggctatcacacagctactatgcatactggggcaagatttcacccgtgccgctgcaaagagacgagtgcggatcatgcgcaccaacatgaccactcttacacagatatag

SEQ ID NO: 7644 - DNA, 408 bp, Glycine max
  Peptide Sequence Number=SeqID_99329
atgcacttcctcgccttcagaggactgcacgtcctcgtcttcagagggctacatgtcctcaccttcagaggactacacgtcctcaccttcagagggctgcactccctcgccttcagaggaatatacgtcctcgccttcagaggactatacgtcctcaccttcagagggctacacgtactaaccttcagagggctgcactcccttgccttcagaggactgcacgtcctcatcttcagaggactacacgtcctcatcattagaggactacatgtcctcgccttcagagggctacatgtcttcaccttcagagggctgcacgtcctcgccttcggagggctgcacactccctcgcctttagagggctgcacgtcctcgccttcggagggatgcacactccctcgcctttag

SEQ ID NO: 7645 - DNA, 405 bp, Glycine max
  Peptide Sequence Number=SeqID_99330
atgactacaccacccagctcccctcctcctcctcctcttcctcctactgattcaacatcacattcgccttctaccaaaagcaactcaactcagatcattgcctacttgactatcgatggtccccacagaaagaagttaagaacatatttggggatcgtcgctttcaataaggtagatgtgacatatgagaattggaaacaagtccctgctacccagaaggatttgatatggaaggatattcaggttgaatttgatatcgctgaagcatgtgatttgaggacgaaaaagaaaatacttcaaaccgtgggggagcggtggagacaattcaagtttgatttaacgttgagatggacacttgcatccgacaaggacagtgtcgactgtttgcaaaaagtacgacattag

SEQ ID NO: 7646 - DNA, 426 bp, Glycine max
  Peptide Sequence Number=SeqID_99331
atgttggtagaattactcaaggtcagtgttgcagaggcgagagctgagacgattcagtgtcatggctcttatgttcgactatcatggctacgagacgtgtatcatatgaagatcgaggcatgtcacaggattgtagcagtgcaagcgtatttgttgcatctttttggatgcacactctttgctaaaaagagtgtcacacacatgcaagtggtattcttggatgcactacgtgacttgacgcagagtgggacttacgcttgggccgctgctgcagtacttgtgcacatccatctcaaatggggtcccttgacggtcactcaccgaccggagaaggttgtacgacagtttggatacatccaaactattctgccacatcctactatgtcttcggtctctgttgaagaaatggatgatagatggatgtag

SEQ ID NO: 7647 - DNA, 135 bp, Glycine max
  Peptide Sequence Number=SeqID_99332
atggcatcttcaggcacttctactatcttcaccgtgttgcaaatgttgatgtatgtggccagctggatcaaggaatatggatatgagaagttggtcgtctgcacctctggtctagctatgctggtgaagtactga

SEQ ID NO: 7648 - DNA, 539 bp, Glycine max
  Peptide Sequence Number=SeqID_99333
cttcagcacctactctagcatctacttctgtagctccttcagtcccagctcatgttgacactcagcgctttgaagccatgcttcaaactattcatcagggacgaattcttttgctgcatagtctacaggtggtagctcctccacgatccatcctatcaatggcgcagttcttagagagggaaggtgaaggttccacagcccaggtaccccaacaagtacaggatgcttcatctgagaccaccattccagagccattcactcttcatcatgaggcaggtgaagaacaggtgagactagagactgctgctactcctgagagatcacttgagggcacatcacagcctcctactcttgtggcagacctctcctcaccacagcctacagctgacccttccactcatttacttgacataccagaggacccgaccacaccagtcctagcattgaacacctctcctccagctactccagtacttcacttgacagatgaggaggatgctcagactcaggatacacaggatcgatctcaggaattttaa

SEQ ID NO: 7649 - DNA, 345 bp, Glycine max
  Peptide Sequence Number=SeqID_99334
atggctcccatcaccgtcactccaaaaaaatgtaccctcgtctttagagggctgctcgtcctcgccttcagagggctacaagccctcgcctttagagggctacacaccctcgcctttagagggctacacaccctcgccttcgtagggctacacgccctcaccttccgaggactacatgtcctcaccttcaaaggactacacgtcctcgacttcaaaggacaacacgtcctcgccttcgccttcagttcatgggccacacgccttcatcttcagaggaccaaacatcctcatcctcagaggactacacgtcctcatcttcagagggctgcacgccctcacctttag

SEQ ID NO: 7650 - DNA, 702 bp, Glycine max
  Peptide Sequence Number=SeqID_99335
atgaagttatacattatagaatttgatgaattcaagagagaaattgagaggaggaattggcataagaagctcactaacttctttgaagggagcattgatgtggcattagtgatggaattctatgccaacctttatgaccttgaagataaatcaccaaagcaggtgagagtgcgagggcatctaattaaatttgatgatgatgccctcaacacctttttaaagacaccagtggtcatcgaggaaggggagagcttgccctcttactctaggttctgcaggttgaggccagatcctcaagagcttgcagcccgtctatgtatccctgggaggggatttgagctgaatgcatatgggttgcctctgaagattttgaggaagaatcttactactctgggccaaacctggagtgttttatccttttctaacttatccccgacatctcatacttcagatattactttggataaggctaagttaatctatggacttgtaatacagatgaatatgaacttgggatccctcatctcaggaacccggaaatctagggccagaggatctgaggcaccatctacttcaactccccctacctcagctccttctacatcaactccttctacctttcctctccctccaacaccagcaactctagttcttctggatccttcttctcagagcttcaagccattcttctcaatgctgtag

SEQ ID NO: 7651 - DNA, 450 bp, Glycine max
  Peptide Sequence Number=SeqID_99336
atgttttggcggaggctaagtttttcagaccaagggttatctgagccccaagtgaccataacggaagagatgaaaaccataaccaagcgatttgaggagcttgatgtttgtggcaaagtatctctaaagagtaaactccgggaaattgcataccctgatcaaaactctatgtgtccttctttagaaaaggtcaacactaaaggtgcacagaacaaaccgatgaccagaaagcaaagatcaacaaagcaatatctgtcttactgggagtatgttgatgctttacattctgtgcaaaatagtaattctttagtgaagtatagtgcatcatcttttgaccaggccattccaagaaggaccatgccgatgttggatcaatttcatccgttcattcacaatttcattgaaaacattgtggatgtcaaagctgacggtatgggtgaagattcatga

SEQ ID NO: 7652 - DNA, 231 bp, Glycine max
  Peptide Sequence Number=SeqID_99337
atggcagaatcatcgaagaagagaaagggatcatcctccaccaccgctgctgctggccatcgccgccacggaccattcgaagcaccgatctatcctcccttatcatctccaagatcatccactctgttttcttccgatgatcaacgtctacgatcgactgggctcacttggttcagtaccgaatgcataaggcattacgggccaatgcacctcttccttaccctcaattag

SEQ ID NO: 7653 - DNA, 672 bp, Glycine max
  Peptide Sequence Number=SeqID_99338
gtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccagatttccccctgtacataaagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcagtttgaatctaaaagttacataaagagttggatgcagagttcacaacgcgatatgtatcttggagcctacctaaatgggccaaacaactaccttaaggggattattaatagcctaaatcaaaaggctcctgctaggtggattgtcgtcaagtgtaatagacaaaaaggaactactgagtgcggctactatgtcatgcactggatgtccaccatcattttaggaagttttagaaataattgggaagcgtattttaacgaccgtagaccattggagcccgagagattaaaagcattgcggattcagtgggcacagttttatctccgagttagagatcaggcctag

SEQ ID NO: 7654 - DNA, 315 bp, Glycine max
  Peptide Sequence Number=SeqID_99339
gggaggagcttgccacccagctcgcccaagcgagctcagctcgcccaggtgagcaaggttgcttcctcgagaaccaacagccttctggaggaagaatctggaagccccaagtgggccagattgctattaagttacgaaaactcacggattgcgaaaaacacctcctttcgatttccgccacattacggaatttcacggattgcgcaagcccgcttccttttgatttcggacacgtctcgggacttcatttattgtgcaacaaaggacgccaagtatctcaaagcggctaaccaaaggttgcatgtcattaagtaa

SEQ ID NO: 7655 - DNA, 375 bp, Glycine max
  Peptide Sequence Number=SeqID_99340
atggatgaccaagaggaagtacaggaacagataaaagccgacatgtcggctttgaaagagctaatggcttccatgatggatgccatgctaggaatgaggcaactaatggagaataatgcggccaccgctgccgctgttagttcggctgctgaagcagacccaactctcccagctatcgcgcaccatcctatcccaagcgtggtaggacgagaaagaagcacactggggcacatcagcaacccccatccgggatacaaccgagtggcttacccctatggattaccacctaattacatgccaccagtcatacatgatgacgcgggtcatgcccctccccccatccttgagagggggcctcctcgacagtcggacgag

SEQ ID NO: 7656 - DNA, 869 bp, Glycine max
  Peptide Sequence Number=SeqID_99341
atgggatcaagtcaggcgcctccgcttaaaaagaggttctatcaagtcaagatcaagagcctaggggtcaccggtctaaaagagttgggacagttgatggatcaactccatcgacaagcctttcgcaaagcttatggtaagatctgggacctaaccatggtagaggtctccacggaggccatcgcctcccttgcccagtattatgaccagcctttgaggtgtttcacctttggagacttccagttaatacccacggtggaagagcttgaagaaatcctaggatgccctctgggaggaaggaaaccatacctcttctcgggattctatccctctttagctagaatttctaagatagtcaaaatctcgacacaggaattagaccgcggaaagcaaatcgaaaataaggtggtttgggtaccgaggaaatgtttggaagtaaaagtaagactcttggcaggtcaaggagaatgggccccgttcatggacatcctgacacttttgatcttcggggtggtcctctttccaaatgtggatgggttggtggaccgggcagcgattgatgcttttctctcctttcacgattgcaaggaaaacgcatttgtcgctatcttagccaatctatatgacaccttcgaacgaagatgtgagaagaacagtgcaaggatcgtttgctgtacaccggccctctacgtatggttggtttcacaccttttccgccaagaggtgagacatgcttgcccgctagaaggccaccgctcatgcacagagaaaaaagaggcaaattgggaccaactattagcaaacaaagaaggagcgtctgtcaattggttcccccgatggaaagaaggaagaaccgagattcttatttc

SEQ ID NO: 7657 - DNA, 324 bp, Glycine max
  Peptide Sequence Number=SeqID_99342
atggctccgaaaaagctttccgcgaagagatctacgagggatgtcgtggttgaagggaccagtgccgccctcgggtttgatagccaccgtttcaggagcaccgagcaccaacagcgcttcaaggccatcaaaggatggtcgttccacagagagagacacgtccagctcagggacgatgagtacacatattttcaggaggagatagctcgccgacattggacgtcgctggtgactcccatggctaagtttgaccctgatatagtcctggatttttatgctaatgcttggcccacagaagagggagtgcaacacatgcggtcatgg

SEQ ID NO: 7658 - DNA, 303 bp, Glycine max
  Peptide Sequence Number=SeqID_99343
atgcacggagtcgccaccaacgtttattcgaagaaaacgtcagaaaaaccagaaagggtggtctacgaacttttaatagtgaaaggttcgggagttgtatttacgcacggggaagggtgttttcctcgctcctacatatcctcgattgcgatgaggaaatcagatctacgtagttctttgagaactgaacgttggagaaaagagggaggtggttgccgcccagctcgcccaggcgagctaggttgcttccaccataaggcactgccttctgttggaactccctcaaagggtgggatcctctag

SEQ ID NO: 7659 - DNA, 459 bp, Glycine max
  Peptide Sequence Number=SeqID_99344
atgtgtttgacaatgatatttgataggatcaatatcaacagggaatacatgaatggaataataggaaaacatctggaaatgtgtctagatcataaatatattaattttggtttcctagtggattttcgggatcatatagggctgcaattgtttgctattatggggaaagatgtatgggaccagttgaaagtatggggaaaagatgggttgggtagctatgaaagatggagccctggctgtcatgggctgacccagcctccccaattcgaccacagtgcttgtaaagcgaacgatattactccattaatggagacaacgatggaaaagggcattgtttgtggattccagaaaaacagcacaatttgtaagttaaatccagcaacagtggaagcatggtataacatgttaaccaagctgccaccatcaaaaccactaaggatgatgatgaaaggaaagtga

SEQ ID NO: 7660 - DNA, 588 bp, Glycine max
  Peptide Sequence Number=SeqID_99345
atgggaaagagaaaagagaatgattcatcaaagattgatattaaccatcatttggtcactgcattagttgaacgttggaggcccaaaacacacacatttcatttttcacatggggagacaatcataactttagaagatgtggttaatattgaaggaccgcctataactggatccagtactggtgataaaaattttcaagaacttcctattgatgttgtgattccacaacatgctagagctcatattatgatgctcataggacactcacaaaggtttgctaccactttcaacattccgccatttgcatacaacctaccaccatcgagctcttgttaccgtctgtcattacctactcagatgcatgacatgggtcatgaagatgaggagaaagatgatgataacaataataacaacaataatgatgattgtgatgatgatgatgaccatggtggtgatgatgttgctcaacaacaacaaatagttacacatgatcatcctagaacaagaagaggaagatgtcgtagaaaaaaaggacaacaaccaccaacaaatcaagtgcaacaagtattgaagttattagccttgtaa

SEQ ID NO: 7661 - DNA, 315 bp, Glycine max
  Peptide Sequence Number=SeqID_99346
atgcaccgcaggccgctgacgcaaacaccaccacctcatcaggctgatccagctgggtcattcggcatggagcggtatttccagcacttggttcgccagcaggcggccaaccacagggggcaggtgcagatccataagtgtctctaccagctcagcctcaatcagtttagggctgaggtcgcatggcccggagattggcccgaggaccagacagaggaggcacctgcaggagttccggacggtgcagaggacgcccgcatggatgaggagatgacagatttactcggtttcttgggaagaagcggagccacgtga

SEQ ID NO: 7662 - DNA, 311 bp, Glycine max
  Peptide Sequence Number=SeqID_99347
ggatcgcgcccgcaagacacccagtggactcggagaagtccaacagggtcctggggttttcagctctgattacgggcctctgtcagttctatggagtgcacgtcgcccccaccaaggtcatcaggccccctactaaccaagctttcatcaagaagtactgcgcccccaggcaggcgcagggtgggacaccacaacagcctggggatggtcgacaacgagcaatagacgcatcgccaccacctccaaaagctggagcgttgcctacaacccgtggtcgaccagcaggcgaccaattccaaagccaaaggtaa

SEQ ID NO: 7663 - DNA, 792 bp, Glycine max
  Peptide Sequence Number=SeqID_99348
ggggttcgagacatacactcgtgggtgaggagtcactggatccccttcgatgcagatgccctaacccagttcttgggcgacccactgattttggaggagaatcagcagtgtgaattcagccagaggaggaaccagacagacggtttcaatgaggaagccatggcccagctgctgtgcatatcgaagcaagattttgcccggaccgctgcggggaagcgggtgcggatcatgcgcaccagcatgactaccctgacccaaatatggatgacactactgctcagcaatgtcttgcctagcaaccacaactctgacctccctctgcctaagtgtcagttggtgtatgccatcctgacacggatgagcgttcacttggcccaggtgattgttgatgccatttatttgtttgcaggtatggcgcctactaggcaccctttggacccggagaagtccaatagggccctggggtttccgactttgatcacgggcctctgccagttctatggagtgcatggtgatgcacctcaagccgtgggcgcaccgccaccacctcggcaggccgattcggctggaccactgagcatggagcacctcagccagcaggggcagggttccgccccttttgtatgccctaccccggagcagtttggggctgaggtcgcatggcctagagactggcccgatgcccagacaggggaggagcctgcagaattccccggtgaggtggatgaatcacatatggacgaggatgtgactgaccagctcggtttcttgggagggagcggagccacatga

SEQ ID NO: 7664 - DNA, 108 bp, Glycine max
  Peptide Sequence Number=SeqID_99349
atggggtcacatcttttttctggcacaaaggacgggattcctgacagtcactgcaatctcaacctctcattttctggcgcagaggacaagtctctacaggattcctga

SEQ ID NO: 7665 - DNA, 304 bp, Glycine max
  Peptide Sequence Number=SeqID_99350
atcggacaatgactcctatgaaggtaatgataccgaggacccagacgttgattttaagcaactgataaaccacgctgtggatgaggaagatgaggattgggggcttcccccagagctaaaaagaatggtcaaacaggaagatagggaagtaaagccacaccaagaagaaacggagatcataaacttaggtgttggcgaagaaagaaaagaggtcaagctacggaggatgaaacccgagatgtccttaaagataaaggaagaggtgaaaaagcagtttgatgctggcttcttggctatggcatga

SEQ ID NO: 7666 - DNA, 444 bp, Glycine max
  Peptide Sequence Number=SeqID_99351
atgtccggagaacaggaagcctggctgagcaattttacagataatcccatcgaatggttttcggcattcaacgtaaaattctctaaaggatattataagcatattccccatatgatcagctacctgcagaaggaaatcgagaagaatcctaatcagaaagaaagattggagagacttatagctgaactgaaggaagatcagttccgcaaggatgttgaagagaaaaagcttcctttggtttcatggctggttgctccggaacacttttcggaccatccgggatcaccttggtatggggcatggtatatttctgaagttctaaatatcttgatatactcaaaacaaaccattgtcataatcacagttatcgataattatgattatgatcagtttttggaccaggtttctccgccactgaaatttaaagggtcagaaaccgggtag

SEQ ID NO: 7667 - DNA, 212 bp, Glycine max
  Peptide Sequence Number=SeqID_99352
gccaccatctaaagaaattcttcaacactcataaccggtcgctggtggaccacatgatgcaagctccattggagcttgtaggcctaggatcttcttcatcaatggattcctttgcttcttggaagatgaatggcagcggaatggagaaggaagagggagaggagacaccacttcaaggagaagatgagtctagaagaagctcaccaccatag

SEQ ID NO: 7668 - DNA, 153 bp, Glycine max
  Peptide Sequence Number=SeqID_99353
atggataagagcttgaaggtaggagaagtgaatggagggagagggagagaaggagcacgaaattttgtgcctcaaaagagcccactaatccaagatcaagtccaagattctccgctaagtatgcttaggtggcatgaggcatgtaaagcatga

SEQ ID NO: 7669 - DNA, 963 bp, Glycine max
  Peptide Sequence Number=SeqID_99354
atgcagcagccgctgccgaccaacgccagccgctttatccacgccagccagctgtggttttatgcctactactggatcatgggcggcgcctttgcgctggtgtggcgcatcatcgacaaccatccgtggcagcgctggtcggtatggggatcgttactgattatctttgtcacctggtttggcgtgcaggttggcgtcggcgttaacgcctggtatggtccgttttacgacatgattcagcaggcgctgaccaaagctggctcggtgagcatcaatcagttctatgtgcaggtgctggcgtttctcggcattgcgctgattgcggtagtgatcggcgtgatgaactcgtttttcgtcagccactgggtgttccgctggcgtaccgcgatgaacaactactacatgcataactggcagcgcctgcgtctggtagaaggtgccgcacagcgtgtgcaggaagacaccatgcgcttcgccagtacgctgcaggactggggcatcagctttattcaggccatcatgacgctggtggcgtttctgccggtgctggtgacgctatcgcatcacgtgaaagaagtgccgatcctcggcaatatcccttatgcgctggtgatcgccgcgctgctgtggtcgctgtttggtaccgcgctgctggcgctggtggggattaaactgccggggctggagttccgcaatcagcgggtggaagccgcgtaccgtaaagaactggtgtacggcgaggacgatccgcagcgcgccgcgccgcctacggtgcaggagctgttcagccgcgtgcgtcacaactatttccgcctctatttccactatctctatttcaacatcacgcgcattctctacctgcaggtggacaatgtgttcgggctgttcgtgctgttcccctcgattgttgcgggcaccatcacgctggggctgcttaaccagatcaccaacgtgttcgaccag

SEQ ID NO: 7670 - DNA, 711 bp, Glycine max
  Peptide Sequence Number=SeqID_99355
atggcgattgccgactgggtaaaaagcaagatgacggttatcgcctctgcccagaccgttgcgctgagtgacgacccggttccggtgtttaaacagcttgcgcaggcgggtggattcaccaacgtttatgtcggctacgccagcaaaacggcgaaattctctgagcccgcgggcgtacctgcggattatgacccgaccattcgcccgtggtatcagcaggtggtcagcgcggacggcccggtcgtcaccgcgccttacgttgatgccggtaccggtaaactggtggtgaccttcgccgtgccggtgaaagagaatggcgccctgaaagcggtggtggcgggcgatgtggccatggacagcgtggtggcgaacgtgcgcgggatccatccaactccgtccagcagcggcttgcttctgaacagtgacggcagcgtgattgcggctaacgatccggctctgacgcttaaaccgtttgcagagaccatcaaaggcatcgattttgctgcgctgaaaagcggtaaccttgtcgacggtacgctgaacgacgtcgaaaaaaccttcgtggcaaccgccgtgccgggcacaaactggctgctggtcgtcgccctcgacaacggtgatgccacctccggcatgcgttccctgcttaaagcctcggcgatttcgctggtgatcctggcgctgctgagcgcggccattgtcacctcctga

SEQ ID NO: 7671 - DNA, 947 bp, Glycine max
  Peptide Sequence Number=SeqID_99356
atggccaagtttgatccagaaatagtccttgaattttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaagattttgcccggactggtgcagggaggcgagtgcgaatcatgcgcaccaatatgaccaccctgacccagatatggatgacgttgctcctcagcaacatcctgcccaccgatcataattccgatctccccatgcctaagtgccagctggtgtacgccatcctgacacggatgagcatccatgtggctcagttgatcgctgatgccatatatatttttgcaggtatggcgcccactaggcaccctttggacccagataagtccaacagggccctgggattccccgcactgatcaccggactctgccagtcgttcggagtccccgtcgcacctaccaagggtgatgctccacaggccgcaggcgcgcccccaccacctcatcaggcgggccaggctggggcattcgacatggagcagtatttacgacatttggttcgccagcaggcagccaaccaccgagcacatgtacagacccatgattgtctgtaccagatgagccttagcatgcagagccagggcttcgctcctttttcatgccctactccagaccagttcagggcagaggttgcatggcccggagattggcccgaggcccaagcaggagggacacccccagaagctcccggcgatggagaagaagcccacgaggatgaggagatggctgatttgcttgacttcttgggagggagtggagacac

SEQ ID NO: 7672 - DNA, 1320 bp, Glycine max
  Peptide Sequence Number=SeqID_99357
ttgaccatctgccagaacgcgtccagataccgcgcgcgatcgttctggtagtcggtgtagtaagcgtgctcccagacgtcgcagcacagcagcggggtgctttcaccggtcaatggcgtgcctgcattgcgggtggcctgcaggcccagctgcccgcccggatgctgcaccagccagacccagccggagccgaacaggcccagcgcggtgcggttgaattcctcgcgcaggcgctgcacgtcgccgtactggcgcttgaccagttcgcccagtcgcccctgcggctcaccgccgccgcgcgggcgcaggcactgccagtagaaggcatggttccaggcttgggcggcggcatcgaacagcgtgccctgggcgtggcggacgatctcctccagcgacgcttcctcccactcggtgccgagaatgccgacgttgacggcttccacataggcgcgatggtggcggccgtgatgcagttccacgggagccgggaagatagggcaggccgggcaattcgacaggcatggacaggttcgtggccagggggcggcggcagccggttccatccgcttacaatggcggctaccgtgggcagtctagccgaccatcacggtcggtttgtccggcgaagcaaggagtgtggttgtggcggtaatgaagcaaatccaggccgaggtcgatcgttacccgctcgtgctgttcatgaagggcaccccgcaatacccgatgtgcggcttctccagccgcgccgtacaggcgttgatggcggccggcgcagtcaccctgcgcaccgtcaacgtgctggaagagcccgagatccgcgccaacctgccgcgcttttccaacctgccgactttcccgcagctgttcatcaacgccggcgagctcaagcgcatcgtcgaagaggcgacccagggatgagtgcctggccatcgacgtcaccgaccgacggggcgctcgatggccgcccgttgcaggatcgcgtggtgctggtcgccggtgccggtggcggattgggtagtgcggcggcagtggctgctgcggccgccggggccaccgtggttctgctgggccgcaagcctcgccgcctggaccgcggtcggcccggagccgctgctgtatccgctggacctggaaggcgcgggccccgacgactatgccgagctggcccaggccctgcagcgcgagctggggcgcctggatggcctgctgctggcagacccggccagttttgcccgcgcggtgcacgtcaccctgactgcgcccgcctggctggcccaggcctgcctgccgctgctgcggcagcgcgaagatgcggcgctg

SEQ ID NO: 7673 - DNA, 228 bp, Glycine max
  Peptide Sequence Number=SeqID_99358
atgtcattgcctagcgttgttcatgtgtcctccaccttcgagtctggagccccgcgaatgtcattgcctagcgcttctggagccccgcgaatgtcattgcatagcgctgttcatgtgtcctccaccttcgagtttggagctatgcttcatgattgcctaagtgtggaccctctagtgcaatcctccattctccacttttttcggagccccatgaatgtcattgcctag

SEQ ID NO: 7674 - DNA, 1176 bp, Glycine max
  Peptide Sequence Number=SeqID_99359
atgatgcacccactgtcgcgaccacaccactttgccggtattcacatccagcgcagtcgtagaggtgccgagcggaattggatcgacgcggttgccgccccagtagtttggcgaagcccagtctttgcccgcccacccaacgatcaggtgatcacccaccaccgtcggcggctggagcagggacagcgggaatttagcgttaaccgtattccactggttgacgttgagcacgcccttatctgcaaagttttcgcacggcttgccggaatcggcatccagtgcgtacagcttgccgtcaacggtgcccatataaacgatcttctggcaggcctgacccgcctgcggatttttcgcctgccagtaagagacgccacgatttttcagtaccggctgggtcagcgcctgacgtggcgatttagtatcgtagtgccacttctccttgccggtgcccggatccagcgcaatcagccgatcaaatggcgtaccgatgtacagcgtatcgttggcaaaaattggcgtggcggaccagacggtcgctggcgtgtcgcccttgccatccgaaacgtcaccggtgtgaaactcccagatttttttcagcttgctgacgttgtcagcggtgatttgtttcagcgggctgtatttctgcgcgttgagctggccgtgaaaactgtcccacgtcgccgtggagggcaccagcggcgtggccggctggctggcggaggccactttctcgccgtcgcgcttgccgctggagacatcatcggtggcgtgcgtggtgccgggcgcctgctgatcggccgcatccactggcgtggcgaacgcgatgcgccgggttgcgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaactgcttcatgtggcacgagaaaaaaggctgcaccggtgcgtcaacagaatatgtgatacaggatatattcagcttcctcactcacggaatcgctgcgctcggtcgttcgactgcggcgagcggaaatggcttaccaacgggacagagatttcctggaagaagccaggaagatacttaacagggaagtga

SEQ ID NO: 7675 - DNA, 552 bp, Glycine max
  Peptide Sequence Number=SeqID_99360
atgtcgatctccccctgcagaagtatcagttgggatcgcgcccacaagacacctagtggacccggaggagtccaacagggccctggaatttccagctctggttacgggcctctgtcagtcctacagggtgcccgttccctccagcaagggatcgcgtccgcaagacactcagtggacctagagaagtccaacagggtcctaggaattccaactctaattacaagcctttgtcagttctacgaagtgcccgtcgcccccaacaaggtcattacgccccctattaaccgggctttcctcaagaagtactgcgcccccaaggcaggcacagggcgagacaccacaacagcctggggatggctggcagcgggcaatagacacaccgccaccacctccagagcccctcaactcatctacaaaggctggagtgtgtcctatgacctgtggccgaccagcaggcgaccaagtccaaagccaaaggtaagcaaaagtactaggtccgtgaccaacaagtcatcacgcgtccagctcaagacgttaaagaagcgctactag

SEQ ID NO: 7676 - DNA, 222 bp, Glycine max
  Peptide Sequence Number=SeqID_99361
atggagaacaacagccttcgatgtatacagtgcaatggagaagagagcgcgaaagggttcacagaaaagaagaaagcgagagaggctagggtaaacggagaagaagggagtgcgagcgaaataggtcgtttcaaatgtacatttcacctgaggtacaatctcgtcggcattgtcgctgttgtgttcgaggtagtgttgcttggaaagctgtgtatccattag

SEQ ID NO: 7677 - DNA, 456 bp, Glycine max
  Peptide Sequence Number=SeqID_99362
tcgttcggggttcccgtcacacctagtaaggtgattcgaccgccgatcacctgggctttcatagagaagtattgcacgcctagacaggcacagggtggcgcaccgcaggccccagacgcactgccgccacctcatcaggctgatccagctgggtcatttgacacggagcggtatttacggcatttggttcgccagcaggcggccaaccacagggtgcacgtgcagacccatgactgtctctaccagctcagcctcagtctgcagagccagggtttcgctccttttccgtgccctactccagatcagttcagggcagaggtcgcatggccaggagattggcctgaggcccaggcaggggaggcgcccgcaaaggctcccggcgatacagatgaggcccgcatggacgaggagatgacaaatttactcgatttcttgggagggagcgaagccacatga

SEQ ID NO: 7678 - DNA, 427 bp, Glycine max
  Peptide Sequence Number=SeqID_99363
atggacaacataagattcaccgcacccttcagagttcaaaagaaccttctgcaagttcctttctcttatcacaggcaatggctccggaattaccccaaatatgttttattccactacgatggcgagatacatttcattcgggtaagaacacatggtactaaatgcttttttgttgatggcttaaatgattttagaaaggcacacaacctcaacgaaagcgtcattctacgtttggttgccggtgacaaaaataccactttcacggttcatattgacgaacctacacaccaccactccaacctaaagcccattatatatagaagaagatacattttcacggctgatatcacacatgatatgctacagcaaaacatgcttttgatacttcctgcagcagcttccaaatttgtctatggctcaaaaaaaa

SEQ ID NO: 7679 - DNA, 99 bp, Glycine max
  Peptide Sequence Number=SeqID_99364
atggcaggctgggggcagtattcaggtgttgaacccgctgatatacctgctcaccagtcagcggtatcggcgcaatatcatgctcttgacttccattaa

SEQ ID NO: 7680 - DNA, 168 bp, Glycine max
  Peptide Sequence Number=SeqID_99365
atgggtgtgcaaatagcaatcaggcccacttgggccttccaggatgttccaacagaaggtggtgccttctggtggaagcaacccagggcgagttgggcggcaaccacctccctctttttccctataaataggggaaggagagcagaacaaattggttcaaccctcctg

SEQ ID NO: 7681 - DNA, 246 bp, Glycine max
  Peptide Sequence Number=SeqID_99366
atggagagaagtgtcattatggagaaagtacatgttcccaattcattgaattctcatgtatcattcgtgccaatttttaatgggcttaacttctcttattggaatgagcaagtccgatgtcacctcggtgtaatggatcttgatcttgctatattggaagagaagtctactactattattgatgctactagcatgaagagaaagttcattataaagcatgggaaagatctaacagactcaacctaa

SEQ ID NO: 7682 - DNA, 720 bp, Glycine max
  Peptide Sequence Number=SeqID_99367
atggtactaacgtcaccgctttggtcaaagttttttgatgtatatgatgagataatagatttcaccaaagcgtctagtgagatcaccgaaaggcatctcaagaagcttgggatgaggtttgttaaccatgagtggattatggctagagagccagcagcaataggaaacgtggatcagatggaagaagaagctaaagctgaagctttggagcaacatgagcaacatgaagacttagccttgaagcttgaagaagagcttgaagaagtgaaatcccttgccaaagttcccccatcaggagacttgaatatcgtaatatgcttccccttgagaatgtccttcgtgggtaatggggacaacgtcaaagagcatgcaaaggagggcagcatcattgaggttggtgtcaacgacaaagatgctggcacaatcgaggaggcattggcggttgtcgaggtcgaggacatcatcgccataatgcttgagggagagggagacataggggtcgacaaagccagtggcactggtgatgaggacgaagaggccagagggggaaatttgggtgatgaaggcaggggacaacgcgtcattgggcgacaacgacggggtgttgaggtttgggttaggcacgagaagaagatgacggaacgagaagagatgagtaggtcaggcttagagacattacacaacattgattttcataaaaccgatgttaacaagcattaa

SEQ ID NO: 7683 - DNA, 138 bp, Glycine max
  Peptide Sequence Number=SeqID_99368
atgagcaagaggctccaagaggattgggctagagctgctgaagaaggccctagggttctcatgaacctcagggtagatttctgggcccatgggccaaggttgggtccaattatctttgaacatggctccataatgtag

SEQ ID NO: 7684 - DNA, 405 bp, Glycine max
  Peptide Sequence Number=SeqID_99369
ggctcaggaggagtgagctcatcctcctcctctgctactgctgctggctcctctggttcaggctcctgggctgcggaggccccacctgagcataaaggagctggaagtaggaatggagatggagcaggaagtgtcgaaatagaaggtgctggagctgtggaagaagaaggagctgctgtctctagtggtgctgaagtagtggggacctctgatctcttacccctggccttccttggccctctaaatgtcactgttggatcatctagattccaacaattcttcttaatatatgccaagttaatggcagggctcaggctctccagggatctagaatctcattggactcctctggccttgcatagagttgtgatcaagccagggaatccaagtctggatgtatcatga

SEQ ID NO: 7685 - DNA, 372 bp, Glycine max
  Peptide Sequence Number=SeqID_99370
atggctctgaggaagctttcctcgaagagatctaggaaggaagccacggccgcagggactagtgccgctcctgagtttgatagccatcgtttcaggagcgctgagcaccagcagcatttcgaagccatcaagggatggtccttccaccgagagagacgcgtccagctcagggacgacgaatatagttctcgagttttacgccaatgcttggcctacagaggagggcgtatgggacctccagtcatgggtaaaaggctagtggattcctttcgatgcagacgccctcaatcagttcctgggatacccgctagtattggaggagggccaggagtgcgaatatggtcagaggaggaaccgggccgatggatttga

SEQ ID NO: 7686 - DNA, 195 bp, Glycine max
  Peptide Sequence Number=SeqID_99371
atgagaggtgaagaagaagaagaggtagaagatagcaccatgctagaggaaaagatgaaagcacaagccaacctttcaacccaagaagagggccagcaagtttcaatcattctaggaagatccttcatgagaaccgctcatgtaaccgccgatgttcgtaaaggagtctacacacttagagagggcaagaaataa

SEQ ID NO: 7687 - DNA, 429 bp, Glycine max
  Peptide Sequence Number=SeqID_99372
ggcaaaacaattggtgttaatgtagaagatgatgattcatacatggacacctatgttagtcctttgaccgctcaaatcactcctaacgttgtcggagaagaagaagctgacgacagacagaggtcaccaaagcaagttgcactagaaggatcagcaccaatctgtgcttcttcctcgtctaccagtgtagtttacaaaagcaaaggtgaaacgaaagatattgagctggtaaaggaggaacaggcacggattggtgctgattcttctagtgagacctccaataaatctgagaattataaggaggaagcacagaatgcaacaaagaagcataaaccaaagagggtagagagtgtcaatgctgatgcagaagcctttggtgatgactggaaagttcagattgccctatgcattctgaagttgaagcactag

SEQ ID NO: 7688 - DNA, 453 bp, Glycine max
  Peptide Sequence Number=SeqID_99373
atgccctcaccttctgagggctgcacaccctcaccttcagaaggctgcatgccctccccttcaaaggtactacacgtcctctcctttagaggactacacgtcctcaccttcagaagacttcacgtgctcgccttcagagggctacatgccctcgccttccgaggactacacgtctcgctacctagaggactacacatcctccccttcagaggactacacgtcctctcctttagagggatgctacacgccctcgcctttagaggactacacgtactccccttcagaggacacacgtcctccccttcaaaggactacatgtcctcacctttagaggactacacgtcctcgaccttcagagggactactgtcctcgcctcgatggctgcagccctccccttcagagggctgcaatgccctctccttaatagaggactacacgtcctcccttcttga

SEQ ID NO: 7689 - DNA, 573 bp, Glycine max
  Peptide Sequence Number=SeqID_99374
atggaagtatcagttggtctgtgccatcgtgacatagggatcacgcccacaagacacccagtggacccagagaagtacaacagggccctggggtttccagctctggttatgggcctctgtcagtcctgccaggtgcccgtccccccagcaaggtcacgccatcatgacatagggatcgcgcccgcaagacacccagaggacccgaagaagtccaacagggtcttggggtttccagctctgattatgggcctctttcagttctacggagtgcctgtcgcccccgacaaggtcatcaagccccctattaaccggactttcatcgagaagtactgcgccccaggcaggtgccgggcaaggcatcacagtactcaagacgttaaagaagcgctactaggaggaaacctagaattgactgcaaagaagctccccgcgaagaggtccaggaaaggcaccattgaagaggattccagatggtcattccttagacagagacagggacaactaagggatgatgaatttccgcacttccttggaggaggcggagccatacaaccgggatcgccaaacttgtga

SEQ ID NO: 7690 - DNA, 546 bp, Glycine max
  Peptide Sequence Number=SeqID_99375
atgtgtctgttagtattttatatgcatagatctcccacaggcaatttagttcctctggacttagaaattgaagctacattgagaaggaagagggccgagaggagaaggaaacttctgcaagatagaacagttgcatccattcttgaggaagaaactcatttttcttattcattatcacctgattcaccatcatcaagggaatccgctactcaattgcctgaagccgctataatggcagatgagcaacaccagaggatcacccttgaggattattcaagcagctcaatatcgcaattctttactagcattgcacgtcctgaagtgcaagctcacaacatcaactacctgcattctttaattcatttaatacaagggaatttgttccaaggattacctaacgaagatcctgtcgcaacgtgcccttctcaggcgagcgagggcgaggctcacgggtgcgctttccaaaggaggaaagatgcgcggagtcgccaccaacatttatttgtggaaaatgtcgaaaaaaccaaaggaaaccggtcaaaatga

SEQ ID NO: 7691 - DNA, 273 bp, Glycine max
  Peptide Sequence Number=SeqID_99376
gattctcttgaaattagtgagaaaaattgtttctgtgaagaaaatccatgccgaagcgcttccgtaacgcttccaagacgtttccgtgagcgatttcgtgaagattcttcaccgttcttcatcgttcttcgttcgttcttcggtcttcaaccgtttttccgacgttttcctcgaataaacgttggtggcgactccgtgcattttcctcccttggaagacgcacccgtgagcccttgcatcgccctcccatcgaagggtaggttgcaacagtga

SEQ ID NO: 7692 - DNA, 336 bp, Glycine max
  Peptide Sequence Number=SeqID_99377
atggctaagtttgacccagatatagtcctggagttttatgccaatgcttggcccacagaagagggagtgcgggacatgcgatcatgggtgaggggtcagtggattcccttcgacgcagatgccctcagccagttcctgggtgacccgttggtgttagaggaaggccaggagtgcaagtttagtcagagaaggaacaaagctgatgggtttgacgaggaggccattgcccaactattatgcataccgggtcaggattttgcccggaccgctgccggaaggcgggtgtggatcatgcacaccagcatgaccatattgacccagatgtggatgacgtga

SEQ ID NO: 7693 - DNA, 672 bp, Glycine max
  Peptide Sequence Number=SeqID_99378
atggctcatggtcgtcaaacgcttaccttcgataaagttgagttggccgtaagcgggtttgagcccactctgattcttctaggcccgattccgctagtatcttctgggaagggacctctacctcaaatgggagtaccacttccatcccataaaccaaggagtacggtgttgccccacctccacagccccgttcatcttcgcccgatagggggtggagttatgatgctggatcttgaaatccacgcacatttcctgcatcattttgttattcagattggtgccattgtcagtaatgattttcctagggagtccgtatcgaaaaatcagttccctctttatgaatctgaccaccatgctcctcgtgacattggtataggaagctgcctcgacccatttggtgaaataatctatcgccacgagaatgaagcgatgaccgtgcgaagccttgggtttgatggcccctatgacatctatcccccacatggaaaaaggccaaggggcagacatgacattcagaggatgtggtggaacattgacattgtctgcgtacgcttgtcatttatggcatttccttacatggatgcagcaatcgctttccatcgtcaaccagtaataacctgctctaaggatctttctggccatagcatgcccattggcatgtgtcccaaatga

SEQ ID NO: 7694 - DNA, 567 bp, Glycine max
  Peptide Sequence Number=SeqID_99379
atggtcattgaccagtcccttttccatgacttaaccaaattacccagtgacggtgtaccatttgaaggtacactgaatgacgactggaaatttgatttctctgcccatgatgcccgccaattggtttgcaccaacaatgcggatatgaccggacgtcttcttgccgggtcattggcttttgaaagccgcatccttcactatttaattgtgcgtattttgcttctacggtcttccaaccttgcccagagatcctttttaattggtgctgctgtgattgcttcttttggttaccgcaaagagcatgatgactcttgggtcaaaaagggtgctccacccgctgatgatgaaggcaaccaactagttgaagataattcctctcttcttcgaaagcttttggaaaagttcgatggtcttcaaacttttgttggtgacaagtttgataatatggaattgcaagtcgacatgcggtttgatgccatggaatcaaggatcaccaaagttgaagaagatgtctccttcatccgtacttgctttgatccaccaccaccgcctccatcatcctcttag

SEQ ID NO: 7695 - DNA, 141 bp, Glycine max
  Peptide Sequence Number=SeqID_99380
atgataggagaaggagatgaagatgcacaaaacaataaagaggacccctatgtgatggaatcctaccctacaagggcattggatagaaaactccaagaagttgggctagacatgcaagagaaggccataggggctccataa

SEQ ID NO: 7696 - DNA, 527 bp, Glycine max
  Peptide Sequence Number=SeqID_99381
atgggatcaaatcaaatacctctgctcaagaaaaggttctatcaagtcaaaatcaagagcttagaggtcaccagtttacgagaattggggcaattgatgggtcaacttcaacgacaagcctttcgcaaagcctatggtaagatttgggacctagctacggacttccagctagttctgactgttgaagagtttgaagaaatcctgggatgcccactagaagaaaggaagccatatcttttctctgggttctatcccttcatggcaagagttgccaacgtagtgaaaatctcagcacaacagttggaccgggtaaagcaaaacaggaatggggtagttagagtaccaaggaagtgtttggaggaaaaggcaaaggccttggcaaatcaagttgtcctcttcccaaatgtggaagggttagtggacctagcaacgagtgacactttcctcgcctttcaccatagcaaggaaagcctggtcgtggctgtcgcaacctacccttttgcgggcgagcaaggcgaggctcacag

SEQ ID NO: 7697 - DNA, 892 bp, Glycine max
  Peptide Sequence Number=SeqID_99382
atgggtcaacttcaacggcaagccttccgcaaaacctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtcggagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaagagcggcgcaagaattgattctatcttcatgcgaaggatgtcccatgagaggagtgccatcagacgaaagcatcacgcctttcatcgcacaaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 7698 - DNA, 186 bp, Glycine max
  Peptide Sequence Number=SeqID_99383
acggtcatatacaagctgcatgttctgaagcgcgatgtcgtgacatcctatacgaaaaatgaggttacattaagcaaaaatggcaacagaaatgaagagaaagaaggaattctgaagcaggcccagcccaacagtggcgctaagcgcgagtcaggcgctaagcgagcaaccaaatgcaggcgctaa

SEQ ID NO: 7699 - DNA, 447 bp, Glycine max
  Peptide Sequence Number=SeqID_99384
atggagtccatgaaagagcatatggccacaatgatggaggccatgataagcgtgaagaagataatggaagctaatgcggttgcaactgccgctaccagcactgttgctaaggtgaacccgatgcccccatcgggcctcaaccaaatgaatcatccaacctcagctatggtaggcaaagatttgggaagtacgggcggcccccattatgcgcaaagtcaaaacaagcacgccttcccgccacatggctttcctcccaactgtacaccacccaatgtagcgtacactcccagtgagaatgtcaataactccactcccatactcattgagagccgacaaccccaaactgatcatgcacatatctctcaacccatgggtgagacacatgaaatgccccaccataatctagccgacttccagccttgcctcggatatgccactgaagggtag

SEQ ID NO: 7700 - DNA, 1224 bp, Glycine max
  Peptide Sequence Number=SeqID_99385
atggcacagaagaagagcactcaaatcactcctaccacatccagatggagcaaagttgcaatcccctccaagaagaggaaagaaatttcctcatctgattctgattatgatgtcgaactagatgttcccgacatcaagcgggccaagaaatcagggaaaaaggtgcctgaaaatgtccctgatgcaccattggacaacatctcattccactccattggcaatgttgaaaggtggaaatttgtgtatcaacgcagacttgccttggaaagagaactgggaagagatgccttggattgcaaggagatcatggacctcatcaaggctgctggactgctgaaaacagtcaccaagttgggagattgctatgaaagtctagtcagggaattcattgtcaacattccctctgacataactaacagaaagagtgatgaattctcccctgctgtaatcaacaagtacctgggcagaccaactgaaggagtggtggatattgctatttctgagcatcgaattgccaaggaaatcactgccaagcaagtccagcattggccaaagaaagggaagctttctacagggaagctaagtgtgaagtatgcaatcctgcataggattggcactgccaactgggtacccaccaatcatacttccactgttgccacaggtttgggtaaatttctgtatgctgttggaaccaagtccaaatttaattttggaaactatatttttgatcaaactgttaagcattcagaatcttttgctgtcaaattacccattgccttcccaactgtattgtgtggcattatgttgagtcaacatcccaatattttaaacaacattgactctgtgaagaagagagaatctgctctatccctgcattacaaactgtttgaggggacacatgtcccagacattgtctcgacatcagggaaagctgctgcttcaggtgctgtgtccaaggatgctttgattgctgaactcaaggacacatgcaaggtgctagaggcaaccatcaaagccaccactgagaagaaaatggagctggaacgcctaatcaaaagactctcagacagtggcattgatgatggagaagcagctgaggaagaagaagaagcagctgaggaagaagaagaagcagctgaggaagaagaagaagcagctgaggaagaagaagatgcagcagaggatacagaatcagatgatgatgattctgatgccaccccatga

SEQ ID NO: 7701 - DNA, 138 bp, Glycine max
  Peptide Sequence Number=SeqID_99386
atggctccgagaaagctttccgcaaagagatctaggaaggatgccgcggccgaagggactagtgccgctcccgagttcgacagccattgtttcagaagcactgagcaccaagcagcgtctcgaggtcatcaagggatg

SEQ ID NO: 7702 - DNA, 96 bp, Glycine max
  Peptide Sequence Number=SeqID_99387
atggagcttcataaagggctacatcatgagaatggagttcttgctcatagtaatgccaccaaaaataagaatccaaggaatgcaatggtgcagtga

SEQ ID NO: 7703 - DNA, 466 bp, Glycine max
  Peptide Sequence Number=SeqID_99388
gggtagcgcccacaagacacccagtggacccggaggagcccaacagggccctggggtttccaactctagttacgggcctctgtcagtcctacagggcgcccgtccccccagaaagtcatgccatcgtgacatagggatcacgcccgcaagacacttagtggacccggagaagtccaacagggtcctggggtttctagctctgattatgggcctctgtcagttctacggagtgcctatcactcccagcaaggtcatcaagccccctactaaccgagctttcatcaagaagtactgcgctcccaggcaggcgcagggcgagacaccacagcagcctggggatggccggcagcaggcaacagacgcaccgccgccacctccaaagcccctcagctcatctataaaagctggagcattgcctacgacctgtggtcgactagcaggcgaccaagtccaaagccaaagataa

SEQ ID NO: 7704 - DNA, 780 bp, Glycine max
  Peptide Sequence Number=SeqID_99389
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttttgccggacacggttgggctgttggacatgcgcaattggatccatctgggtgcgaacacgtgcagagctcctcgctgccgcacgcaaagcacgccgtcactgcgctcagacctctgtcgctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7705 - DNA, 360 bp, Glycine max
  Peptide Sequence Number=SeqID_99390
atggcggaagagcccgaaaacaatccaccgccgccggaacctccaatcctctctgcactggatgccacggaggaaactgatgctccggctcctctggcgctagctccgaagcggcagcgccgtccgagtgttcgcctggggaagatcggtgaccaacgcgcctccgcgcacgaccatgactcgcatacgcgccacccgagcatgctgccatggagctggtggactccgaaggaatcttctagaaccttgaaggcgcgctccgtcatacaacttcagggtgatcaaagaaagaatgtttctactttccttatgcaggctggcatagtaaagaaggaatacatcaagcttcatggtttctaa

SEQ ID NO: 7706 - DNA, 54 bp, Glycine max
  Peptide Sequence Number=SeqID_99391
atggccgaccagcaggtgaccaagtccaaagccaaaggtagaaagataccttag

SEQ ID NO: 7707 - DNA, 897 bp, Glycine max
  Peptide Sequence Number=SeqID_99392
gaaggcaaggaaggagttcttttctcgtgtggggactatcctaatgttccactgatagggactaggggttgtattaattataatcccgcactcgccataagacagctaggatatcccatgaggggagcaccgaccgaagaaagtctctcgcctttccttatgagagatctaggcgcgcaaggtctcaaggttatacaaagaatccacaaggcgtggaggagtccgttgaggaaagacaaggagcttagaggcatccgaaacggcgtcatcggaggttatcatggatggctaagaattcacacgcggggcttagattggctctccaaattgaaagttatcaatgaggagaacttcgaagctccggaggaagatgaagaagtccgagctctaaagttagagctagggaaagcgagactcgccaaggagaagttcaaatcagctgctacacacatccggaagagtgcaccgagttacaagaggaaaacgcagccactgcaaaatcccttgaacaagaaaccaaaagggcccgcaaggaggaatatggccgagagaaattccgaggagcattgtggggtagcaacaatgagctcaagctccgaagagaggagagagatcggtcgcgggtccaaaaggagtttggctcaacacttggaagccacggagcaaagcatgctagctatcatagggcaatacaagcaagaattgaaccagtccatggcccatgaacaaaagttagtcgaggatttcgctcaagtgtatgccgaaaaagaagcaagagggagggtgattgatgcgctgcatcaagaagcgactatgtggatagataggttcgccttgaccttgaatggaagtcaagacctcccgcgtctgttagccaaagcaaaagccatggccgaa

SEQ ID NO: 7708 - DNA, 768 bp, Glycine max
  Peptide Sequence Number=SeqID_99393
atggctggaacaaattccgaggggctctgtggggcagtaacagcgagcttaagctccgaagagaaggaaagggaccaatcgcgagtagacggtttgatcctgaaggatgaattgagggtttgcctaaggtccaaaaggagcttgtctcagcggttatgcgaggccgaaaccaacatgttagccatcatcagcaagtatcaagaagaattagatctagccactgcccatgagcacaaggtagcggacgaatacgcccgagtgtacgcggatggaccggtttgctcttacattgaatgggagtcaagagcttccctgattgttggcaaaggccaaagctatggcagacacctactccgcccccgaggagatccacgggctcctcctctattgaaagacgccataactaagcgcaccccaaggcatccctatcgcaccagatccaaatctaggacgatgggtgacctagaggaagtacaggaacaaatgaaagccgacatgtcggctttgaaagaacaaatggcttccatgatggatgccatgctgggaatgaaacaacttatggagagtaacgcggccaccgccaccgctaaaagcacactggggtacgccaacaacccccatttggggtacaatcgaggagcttacccctactgtttaccacctaattacacaccaccagtcatacgtgactacgcgagtcatgttcctcccctcctacttgaaggggagcctcctcgacatctggacgtggtccacgaggatcattga

SEQ ID NO: 7709 - DNA, 486 bp, Glycine max
  Peptide Sequence Number=SeqID_99394
atgtggatgatgttgctgctcagcaacatcctgcccagcgatcataactccgacctccctctgccgaagtgtcagctggtgtatgccatcctgacacagatgagcgtccatgtggctcagttgatcgctgatgccatttatttatttgcaggtatgccacctaccaggcaccctctagacctagataagtctaacagggccttgggttttccagcattgatcacgggtctctgccagtcattcggggttcccgtcacacctagtaaggtgattcgatcgtcgatcacccgagcctttattgagaagtattgcatgcctagacaggcgcagggtgatgcaccggctgaggttgcatggcccggagattggcctgaggcccaggcaggggaggcgctcgcagaggctcccggcgatgcagaggaggcccgcatggatgagaagatgatagatttactcggtttcttaggagggagtggagccacatga

SEQ ID NO: 7710 - DNA, 294 bp, Glycine max
  Peptide Sequence Number=SeqID_99395
ggtgacctcgacatttactgcctagttttcctaagtgagaatgttgtgtggacacgcttaggctatttccttggggatggtaccacattgcatatgagagttgagagtcgtcgcctggtggattatgaatttctttatgttgtacttgcctcaagattcattgactacttcaatgttgatgtctctaatgagattatggacttcaccaaagcgtctattgagattaccaaaaggtgtctcaagaagtttggaacgaggtttgttgatcatgaatggataatggatggagagtcg

SEQ ID NO: 7711 - DNA, 564 bp, Glycine max
  Peptide Sequence Number=SeqID_99396
atggataatgaagagggcgtgcaggaacagatgaaggtcaatctatcggccttaaaagatcaaatggcttccatctcggaggtcatgttaaaactccagaaaactatagaggataaagccacgacaaccgcttccagtacagttagggaagcggagccggtgctgcagcccgccttaaatccgggtcgagacagaaacacggcagtgtttggccgaaggtatagtccacaagcttacccctatggcttgcctccggacttcactccccgtgccaccccggaagatttaagccaagcccctactttcgaggggcaactcccaccttatgacgactatcccgggcaagacgatgaggaaggagatacccatcttggccccctgctccacctcaaagattcatccctccatgaactaccccaaccgaacatagtccgccatataccgacttcacccacacccgtaaaagaatctgttcccttcgcggaagataagggaaagattgaggcacttgaagagaggttaagagcagtcgagggccttggaaattacccattctcggattag

SEQ ID NO: 7712 - DNA, 411 bp, Glycine max
  Peptide Sequence Number=SeqID_99397
atggaagggttagtggacctagcagcgattgacgctttcctcgcctttcatcatggcaaggaaagcccggtcgtcgccattttggccatgtatgacacgttcgaccggggatgtgaaaagagcagcgcacgaattgtttgttgtgcactggctctctatgtgtggctgactgtgagagacgatgaggttaaagcttcggaagaaagtgatgaggtacaagccctaaaggcagagcttgagagagcccgagtagtcgaagagaagttcaagtccatagccatcaaagtctatgatgaactaagggacgtcaatatggccacagctgaagccttggaacgaggaaccaagaaggcccgaaaggaagaacatgaccaaagcaaagttttgaggggctttatagggcagcaatag

SEQ ID NO: 7713 - DNA, 432 bp, Glycine max
  Peptide Sequence Number=SeqID_99398
atgacggaggccatgttaggaatgaggcagctcatggagaaaaacgtggccaccgctgccgctgtcagttcggctgccgaagcagacccaactctcttggcaactgcgtaccatcctctctcaaacatagtaggacggggaagggacacactggggcacgatggcaaccctcatctgggatacaaccgagcggcttacccttatggattgccgcccaactactcaccaccccccgacgaggtccacaaagaccctcaagactatgctcgaagggatgtcgagttctatcccccgatccccgaagggccggcacccagcacgttgcctcagcccaacatcacgacacaaccaatagttttgtccacggaaggaccgcccccggcaactgaagaaaggaggaagctcgatctcctcgaggagagattgagagcc

SEQ ID NO: 7714 - DNA, 129 bp, Glycine max
  Peptide Sequence Number=SeqID_99399
atggcaataactgaagctacagggctccaaatgaggctaaaggcccaagtggagaagaacgaaggcccaagtggagaaggacaaagcccccgagtggagaaggatgaaggcccaagtggagaaggatga

SEQ ID NO: 7715 - DNA, 226 bp, Glycine max
  Peptide Sequence Number=SeqID_99400
atgtgggcatctcttgtcaatgtcggtatttacacgcgattctccctcaaatttcagccagccccgcatcaattagaccttgcaccttacgcttcaggcccctacaatgctcaatggaatgccccggggcttctccatgacaaacacacgttgcgttcgagtcgtattctcaaagaaaaaggagggatggcctttgtggataactgggcggtggataaaggagaag

SEQ ID NO: 7716 - DNA, 219 bp, Glycine max
  Peptide Sequence Number=SeqID_99401
atgggggtgcaaatagcaaccaggcccacttgggccttccagaatattcctccaaaaggtggttgcttctcgaggaagcaacctagcttgcctgggcgagctggaaaatccaagctgaggcgcttccataacgtttctgtgggtgatttcgcaaagattttcaaccttcttcgacattcttcattcgttcttcgtcgttcttcggtcttcaaccggtaa

SEQ ID NO: 7717 - DNA, 528 bp, Glycine max
  Peptide Sequence Number=SeqID_99402
cgtgactcaaatgtcagtatgacagatcttgtgagcgcggaagatgacacagcaaaaaagaatgtttatacggataaccactcgggtatttccgcccgtcagcgtgactcaaatggcgcagaagacgacattaatctctgcgtgctatcaggcttttcgtcttacagacagcaaaaaagaatgtttatacggataaccactcgggtatttccgccccgtcagcgtgactcaaatgtcagtatgacagatcttgtgagcgcggaagatgacggcgcagacgatgacgttagtctctgtgtgctatcaaggctattcatcgtacagacagcaaaaaagaatgtttatacggataaccactcgggtatttccgcccgtcagcgtgactcaaatgtcagtatgacagatcttgtgagcgcggaagatgacacagcaaaaaagaatatttgtacggataaccactcgggtatttccgcccgtcagcgtgactcaaatgtcagtatgacagatcttgtgagcgcggaagatgac

SEQ ID NO: 7718 - DNA, 1191 bp, Glycine max
  Peptide Sequence Number=SeqID_99403
atggggacaaatcaaactggcaaaaggttttatcaagtcaagattaagggcctagatatcaccagcattaaggaattggggcggttgatgggacctctccaaatgcaagctttccgtaaggcatacggaaagatcttagatttgaccatagcagagatattcacagaagccattgcatcactcgcccaatactatgaccagcccttgagatgcttcacgtttggagacttccaattagtaccgaccgttgaagaatttgaggagattctaggatgtcctcttgggggaaggaaactgtatcttttcttcgggttccttccctccttgagcaaaattgcaattgtgatcagggattcggcgagaggattggaccgtgtgaagcaaactcgaaacggcatagtgggcctagcacgaaagtacttagaaggcaaggcgagggatatggcgaatcaagatgagtgggtcccgttcatggatgtattagcattgaatccatgttcgctccgaagccatcgctcgtgtgtcgagaaaagaagagtagattgggaccaacacttggctgggataggaggtagaatagtcaactggtttccacgatggaaagaaggaaaggagggagttctcttctcatgtgggggctacccaaacatcccgctgataggaacgaggggttgcattaactacaatcccgcacttgctataagacagttagggtacctcatgaggggagcaccgacggaagaaagcctgtctcctttccttgtgagagattttggcgcgcaaaatttcaaggttatacaaagagtccataaggcgtgggaaagcccgttaaggaaagataaagaacttaggggcattcgtaatggcatcattgggggttatcatgaatggctgaaagtttgtacacggggtttagattggctcttcaagttaaagattatcaacaaagagaacttcgaagctccggaggaggatgaagaagtccgagctctgaaaaccgaactaggaaaagcgagacttgccaaagaaaaattcaagttggtcgctacagacgtccggaaagagtgtgccgggttacgagaagaaaatgcagctaccgcaaaagcccttgaaaaagaaaccaagagggctcgcaaggaagagcatggtcgtgacaaatttcgtggagcattgtgggggcagcaacagtga

SEQ ID NO: 7719 - DNA, 559 bp, Glycine max
  Peptide Sequence Number=SeqID_99404
agcttcggtaatcaatttcgagcgtctggatatattacgggacacaatcggacattcgagtaaaaagttattgtcgtttgaatttactcagagcttcggtaaggatccaatttcgaagcgtctcgatatattacgggactcaatcggacattcgagtaataagttattgtcgtttgaatttgtctcagagcttcagcattcaatttcgagcgtctcgatatattacgggactcaatcggacatccgacgtctcgatatattacgggacacaatcggacattcgagtaaaaagttattgtcgtttgaatttgctcagagcttctattcaatttcgagcgtctcgatatattacgggacacaatcagacatccgagtaaaaagttattgtcgtttgaatttgctcagagcttcggtaatcaatttcgagcgtctcgatatattacgggacacaatcggacattcgagtaaaaagttattgtcgtttgaatttgctcagagcttcggtaattcaatttcgaacgtctcgatatattacgtggctcaatcgaacttcgagtaa

SEQ ID NO: 7720 - DNA, 183 bp, Glycine max
  Peptide Sequence Number=SeqID_99405
atgcggaaattgattaaggaaaggatggaaaataaggtggataatttcgtgggtcttaataaggtggttcttggcataaaatggatgaatgggatgaacaaggttgaagatgaaaggaaggaaagaatcactctttctggcgaaggcaacacactgttagacaaatggcctcagttatcttaa

SEQ ID NO: 7721 - DNA, 348 bp, Glycine max
  Peptide Sequence Number=SeqID_99406
atggctgcaaaattcatagaggaaacaggactgatatcagttcagcaacaaggagcagattcttggatttggaagcaacattcaagcggtatctatttgaccaatactgcttacaagtttctgatggaggaaataaggggggatccaatggatgggagctttgtgtttctgtggaagcttaagataccaccaaaggcaaagatttttacctggagactcatcaaagaccgcttaccagctaagttcaaaatatatatgtactcacagtacctctggaccagtttgaattttgaaacaacaatgaccacagaatcaacaatggctaaaatcgctcccaatggaatctga

SEQ ID NO: 7722 - DNA, 430 bp, Glycine max
  Peptide Sequence Number=SeqID_99407
gatgatgctgactgtctctagaggaccaatctcatctgaagatatcagaacagttgctggtgttgaatatcctacatatagagaagcatgttttgctatgggttttttacaggatgatagagaattcattgccgcaatcaacgaagcaaaagactggggctcaacaccttatccaaggaatctttttgtattattacttttgaaaggtaccattgataaggacacaactaaggataaggaccatgaagcacttgaagggcccatgaccagaggcaaacttaaacaggcccaacactgtgatgaggacacaacaaagggcaaggaccatgaagcacttgaagggcccatgaccagaggcagacttaaacaggcccaatacgtcatagagacaatgctagtcatttgtatagctgccattgatgatgattga

SEQ ID NO: 7723 - DNA, 201 bp, Glycine max
  Peptide Sequence Number=SeqID_99408
atgggttatcaaactggcgatcagaaaatacaaatgatggaaagtcaggctatagggaatccaaataggggagaagctggtggagctattgagtaccgtgggttagacctcttccaacaaaacaaccctccttcttttaatggaggatacaaccttgatggtgctcataactggataagggaaattgagaaaattttttga

SEQ ID NO: 7724 - DNA, 438 bp, Glycine max
  Peptide Sequence Number=SeqID_99409
atgacgaccgttaacggatgtcagctcaatctgaaggaaattatgcggaagctttacagaattattatgaggctatgcgactggaaattgatccctatgatcgaagccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaa

SEQ ID NO: 7725 - DNA, 204 bp, Glycine max
  Peptide Sequence Number=SeqID_99410
atggacgaatacgcaagcatatttcatgcttgtttggggatatcgaaaattcgagtggctgaagctgaagcagctactttcgaagtaacagaaagaaaagcaacgactggagtgggagagtcagagtcgaaaagaggattcctcacttctttctctcattcaaaaccgtgcatgagactttcatctcgcacggctcctaagtga

SEQ ID NO: 7726 - DNA, 561 bp, Glycine max
  Peptide Sequence Number=SeqID_99411
atggccccgaggaagcttgcctcaaagaggtccaggaaggataaggcggccgaaggaactagttccgctcttgagtatgacagtcaccgctttaggagcgctatacaccagcagcgcttcgaggccatcaaaggatggtcatttctccgggagcgacgcgtccagctcagggacgacgagtatacggatttccaggaggagataggtcgccggcggtgggcatcactagttacccccatggccaagttcgatccagaaatatggatcccgtttgatgccgatgctatcggccagctcctgggatatccgttagtgctggaagagggccaggagtgcgagtatggccagaggaggaaccggtctgatgggttcgatgaggaggccatcgcccagttgctatgtataccgaggcaggattttgcccggactgctgctggaagacgggtgcggatcatgcgcaccaacatgaccaccctgactcagatatggatgactttgctgctcagcaacatccagcccaccgaccataattccgacctccccctgccgaagtgtcagctg

SEQ ID NO: 7727 - DNA, 804 bp, Glycine max
  Peptide Sequence Number=SeqID_99412
atggctccaaaaaagcttctatctaagagggcaagaaaggacaacacaggagaaggatctagtgcggctctacaagcaaatatagaatttgacggacaccgtttccgaagtgaggaacatcaacgtcgctttgaagcgatcaagggttggcctttcctcaaagaaagacgggtccaaaagagagagggggaatacacggagttccaggaggcagtttccaggaggcaatggactcaactcacagggcccatggctaagtatgacctggaaatagtcatggaattctacgtgaatgtgtggcccactgaggacgaaatgccatcaaccagttcttggggcatccgttggtcctggaagaggggcaacattgtgaactttgcacgaagcgtgacaggaaggcgggtgaggatcatgaacactagcatgaacaccttgacaaagatctggatgacactgctcctcagcaacatccttcctagtgatcataattttgatcttcccctgccaaaatgtcagctggtctacgctatcttgacccaggtcagtattcatgtggcccaactaatctcagattccatttaccaatttgtacggatcacgcctccaaaacacctaatggaccctgaaaagtccaacagagcactgggatttttgaccttgatcacaggcacggaagccgaggaaggaacagcagcaacagctagccgcagatgcaccaccaccacctctccagcaaccatcatctctagagtccatctcagctcacatgcagaggatggaactctatatgcagcatttggatga

SEQ ID NO: 7728 - DNA, 531 bp, Glycine max
  Peptide Sequence Number=SeqID_99413
atggtgattttccaccatggagatgcagtggaagacaaaggagaagagcccaagtctcttggagtcttctatccaatacccttgaggggtaggattgcatcaggtcgtgagtggttccctgagagtagactacgcatgcgatgtggtggcaagattcaagaagactggacagagagtaaaagaaccagtggttttattttcttctatgagaagagaggttcgaagaacctagggaaattagcgagtggtgactaccttgcatttggtgcattcatttggcatagttcttcgagcacgatgccaatgggaggcctactaagtgattcttgtactcgttcaatcatagccattgaagttcacgaggatatgggagatttcaatgatgatgagaatctcataccgtctgagatcaccttctaccaggatatcatcggtgacgagatatttgagggagacatggtttcgtttgagaaggaatgggattcctcggaagacaaaagtgacccttcaaaagatatgacttggccttag

SEQ ID NO: 7729 - DNA, 354 bp, Glycine max
  Peptide Sequence Number=SeqID_99414
atgatcaagtcaaggtcggtgttgaggatgattgagatgctgatgcctgtgttccggtacccactcaagaggataaacagggagcttagggaccgatgtcgtacaggatgtcacgacatcgcgcttcagaacatgcagcttgtatatgaccgtatgaacagattgaacaacatcaaggtggctcacaaaacactcaagtcccaaaactcacaaaataactcttcaatctcggacttggtagaaaactcgtgcagccttcatgtttatatagcagtgtgcgtatctgggctgcaacaacttgcgctggatgagatctatcattctcctgaaaaatctggcaccttaaagaactaa

SEQ ID NO: 7730 - DNA, 141 bp, Glycine max
  Peptide Sequence Number=SeqID_99415
atggaaaaggtcgaaggtctgcatattttgaaaatgagggttcgggagttgtttactcacggggaaggttgtttccctcgctcctacatattcctcaattgcgatgaggaaatcagacctacgcagttcttttataactga

SEQ ID NO: 7731 - DNA, 1269 bp, Glycine max
  Peptide Sequence Number=SeqID_99416
tctcagttgatagacattgagtcttcgacaaagggtgtagacgactatgttggtctctgcgtgtcatcagactggattgtgcttgcttgcatcgggttgacgaagaggagactaatgtcgtctcggttgatagacattgagtctttgacaaagggtgcagaccaccatggtgcaggcgaccatgttggtctctacatgtcaatgggctcgcttgcccctgtcctaaaaagggcaaaagtgaggactttgagtcgtatgaaagcgaggactttgagtcctgcgaggactttgagtcctatgaaggcgaggactttgagtcctctaaaggagaggacctttagtcctctaaagggtaggacattgagtcatctaaaggcgaggaccttgagtccaacgaaggctaggacattgagtcttctaatggtgaggactttgagtcctaagaaggcgaggacttggagtcctctaaaggaaaggacattgagccctctaaaggcgaggactttgagtcctatgtgggcgaaaaccttgagccctctgaaggagaggactttgagccctctaaaggcatggaatttgagtcttctcatgacaaggactttgagttctctaaaggcgaggaccttgagtcctccgaagactaggactttgagtcctctaaaagcaaggaccttgagtcctctgaatgctaggactttgagtcctttaaaggggaggaccttgagtcctctgaaggtgaggactttaattcctctaaaggctaggtctttgagtcctttaaaggcaaggaccttgagtcctctgaaggtgaggaccttgagtcctctgaaggcaaggacttggagtactctaaaggcaaggactttgagtcctctaaaggcttggactttgtgtcctataatggcgaggactttaagtcctctaaaggctaggactttgagtactctgaaggcgaggactttgagtcctctgaagggaaggactttgagtcctatgaaggcaaggactttgagccctctaaaggcgaggactttgagttctatgaaggtgagaaatttgagtcctctaaaggcaaggactttgagccctctaaaggtgaggactttgagtcctataagggcaaggacttttgagtcctctgaaggtgagaaccttgagtcctctaaaggcgaggactttgggccttctaaaggcgaggaccttgagtcttctgaaagcgaggacttggagtcctctaaaggtgaggactttgagttctctaaaggctag

SEQ ID NO: 7732 - DNA, 192 bp, Glycine max
  Peptide Sequence Number=SeqID_99417
atgtccaccgaccgagactactttagtctccccttcgtcaaccagaggcaagtgagcactttgacacccggaaaccaacatggtcgtctgcagcctttctcgaagactcaatgtgtatcgactgagatttctttagcctccccttcgtcaaccaaaggcaagcaagcttgttcacacacagagaccaacatg

SEQ ID NO: 7733 - DNA, 497 bp, Glycine max
  Peptide Sequence Number=SeqID_99418
atggcatgtcccactatagaagttgagtatattgcaactaaaagttgttgtgctcaaagtctttggatgaagcaacaacttgaagactatggagtagaccttgataacattcctctatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 7734 - DNA, 447 bp, Glycine max
  Peptide Sequence Number=SeqID_99419
atgtattctcttgatttcaagattgtcatcatcaaaaagggggagattgtggaagcaaagctttccaagtttattttgatgatgctaaagactaaattcaagaatcaagagtcaagcaagtttcaagaatcaaagaatcgttcaatcaaagcaagtttcaagaatcaaagagtcattcaatcaagaatcaagattcagaaaaatcttttaccaagagttatactctctggtaatcgattaccagaaggcagtaatcaattaccagtagccaacattcttttcaaactgatttacaaagctgtaatcgattaccataatcatgtaatcgattaccaatgttttaaaacattagatttcaaatttcaagagtcacaacgtgagataaaacagtttcaaacttgtgtagtcgattacacaatacttgtaatcgattactggtgtttctaa

SEQ ID NO: 7735 - DNA, 222 bp, Glycine max
  Peptide Sequence Number=SeqID_99420
ttgagcctcagcctgcagagccagggttttacttcttttccgtgctctactccggatcagttcagggcagaggtcgcatggcccagagattggcatgaggcccgagcgggagaggcaccagtagaggcgccagtagaggctcccgacgaggcagatgaggcccgcgaggacgaggagatgaccgatttacttgatttcttaggagggagcggagccacatga

SEQ ID NO: 7736 - DNA, 523 bp, Glycine max
  Peptide Sequence Number=SeqID_99421
atggaggtagaggtggtggtcgtagaacatttaatcgtggtagaagacgtggtcttagttttaggagctccaattaccaccaacccttccacctcatccattcatatatcaacctcagagtcgatgattcatgccgtttcaccgactccaaacacacttcctacagctcaagaccaaccaaatcctacctttataagggagtcaatttccactacccctgttagagatgcttcaccttcagcaccagatgattctcttacacttgagtacccatcaaatccaaattgtgaacatattgttgatcagaggcctttcgtttgtgcatataaaggagagtttcaaccaacatataggtgttctaatatcatatcaaatatcattagggcaaaatttgatgaaccagctgcaagttggttgaaggtgtcagttgaccttcgcgataggtggtttggagagtttaagaaagagtataggtggcaccacaagaagagcataccattagagctgtttttgagacaaagag

SEQ ID NO: 7737 - DNA, 231 bp, Glycine max
  Peptide Sequence Number=SeqID_99422
atgtcgtttaggacttgtgggaaagcttgggctgagcaaatgaggaaaatgagtgaccaaagtgaaagcagagccatttctaggcttggaggggttgatagggacccggtgctgagaggaacgaggataagggctacgtgggagtacgtgagctcagttgaaggtgggcaactggggatgagtggtgcctggagatatgtcgcgggggtcaggagaccttggggacgtcag

SEQ ID NO: 7738 - DNA, 138 bp, Glycine max
  Peptide Sequence Number=SeqID_99423
atgggtttgtcaggcttaaaggagcactcaaacccggtgacccccaagacctacactccgaagagtccgtcagggcctctccctcctgattcaagtccaacccctaaaatcattttagcacacagacactgctcgtga

SEQ ID NO: 7739 - DNA, 375 bp, Glycine max
  Peptide Sequence Number=SeqID_99424
atgtcttgcctagcgatcataactccgatctcccctgccgaagtgtcagttggtgtatgccatcctgacacggatgagcgtccacatggcccaagtatgccacccaccaggcaccctctagacccagataagtctaatagggccctggggtttctggcattgatcacgggcctctgccagtcattcggggttcccgtcacccctagtaaggtgatccgactgctgatcacccgggccttcatcgagaagtattgcacgcctaggcaggcgcagggtggtgcacctcaggccgcaaacgcaccgccaccacctcatcaggccgatcccactggatcactaggcatggagcgttatctacaacacttgattcgctag

SEQ ID NO: 7740 - DNA, 113 bp, Glycine max
  Peptide Sequence Number=SeqID_99425
gttctacgagttataaagttgttgctgaatgtgctaatgtaatgaatgaaatggttttagatgatgaaggtgaaatgatgggtgttgctggtgtcactaatttggaggaatga

SEQ ID NO: 7741 - DNA, 474 bp, Glycine max
  Peptide Sequence Number=SeqID_99426
atggaaaccatatcgaaatgctttgagcaacttgatgtttgtggcaaagcacatttgaatacaaagctgcgagaaattgcttatcctgatatgaactccatgtgtcctcctccagaaaaggattctattgaaagcattattgatgtcaaagtggatggtaactgtggttatcagagaatagttgccttattaggtatgggtgaagaatcatggtcattggtgtgcaaccatctgcataaagaactgacaagctggtcggaagagtatatcaaccccgttggttgcatagacaaatttgaggaattaaaacgttccttacttgttgacggattatctatggttactatggacaagtggatgaatattatggatatgggatatgtcattgcttcacgatacaacgtgatcattgtttcttctatgcatcacgtaatatgcattggtcatacgtatggaaatcattttttgtacagg

SEQ ID NO: 7742 - DNA, 150 bp, Glycine max
  Peptide Sequence Number=SeqID_99427
atgtgtttaaactatacttgtacctatagtacctctggagcaggaaaattccacggtggtgcggaagaggtttctaaaggaacaacaagaggaaaagacaaaatagctgttatatataagctggaagcaagtcctagttatatcatctaa

SEQ ID NO: 7743 - DNA, 108 bp, Glycine max
  Peptide Sequence Number=SeqID_99428
atgagcgaaacaacaaataaaggaaacgagtttgaagctaaaccacaaaacgaaaggaaaaggccatttggtgcaggggaagctagcccaggcgaggtggttgcttaa

SEQ ID NO: 7744 - DNA, 291 bp, Glycine max
  Peptide Sequence Number=SeqID_99429
atgaagaacgtcgaagaacggtcaaaaccttggcgaaattcctcacggaaaacgttacggaagcgcctcggcttagattttcttcacggaaacaatttttccaagcaaattcgaaagagagagaacaaaataggggagatggttgccgcccagctcgcccaggcgagccaggttgcttcctccagaagcaacagccttctggaggaatcttctggagggcccaagtgggcctggttgctatttgcaccccccattttcactaagtacaccccctctgcttttttttggtga

SEQ ID NO: 7745 - DNA, 135 bp, Glycine max
  Peptide Sequence Number=SeqID_99430
atggatgcagaattaacaaagagatgtgtacctaggagcctacttgaatggaatacaagccacaacatcaagatgatcactagtacattaggaaggaaattcctaattgatatagcaaaaggtttggccaagtaa

SEQ ID NO: 7746 - DNA, 258 bp, Glycine max
  Peptide Sequence Number=SeqID_99431
atgctgacatgtccggaaaggggacagatgaccacactggtctctacttgtcaatcagacttggggtcttcgaatgatgaggtgcggataactgtaaggtgtctccgcatgctaccagactcttgggtcatgatagctaaaggtagggtggtcgacaaaagcggggcttttgctcttacgtatcctcaatttgtgatgaggaagtcagacctacatagttcttgcttgcgagacaaaaatggcctcgccgttctttaa

SEQ ID NO: 7747 - DNA, 384 bp, Glycine max
  Peptide Sequence Number=SeqID_99432
atggggtcagatcaaatacctctgctcaagaaaaggttctaccaagtcaaaatcaagagcttagaggtcaccagtttacgagagctagtgcctactgtagaagaatttgaagaaatccttgggtgcccgctgggaggaaggaagccatatcttttctctgggttctatccttccatggcaagaattgccaaggtagtgaaaatctcggcacaagagttggactgggtgaagcaaaacagaaatggagtagtcggagtaccaaggaggtgtttggaagaaaaggcaaaggccttggaaagtcaaggcgaatgggctcctttcattgacatcttggcgcttttgatctttggagttgtcctctttccgaacgtggaatggacctag

SEQ ID NO: 7748 - DNA, 559 bp, Glycine max
  Peptide Sequence Number=SeqID_99433
atggaggtttcctttggtttttctaacgttttcctttcaataaacgttggtggcgactccgcgtattttcctcctatagaagacgcacccgtgagcctcgcctcgctcgcccgcaaaagggaaaacaaagaggtgaggcatgcttgcccgctagaaagccaccgttcatgcacagagaaaggaggggcgaattgtgaccgactcttagcaaacaaagaaggagcgtcggtcaactggttccctcgatggaaagaaggaagaaccagggttcttatttcgtgcagaggatttccgaatgttcccttgatggggacaaggggttgcatcagttacaatcccgttcttgctataaggcaacttggctaccctatgagaggggcaccgctagaggaagagctcacgcctgtcatttcacgaggtttcaataagaccaacgtggagacacttcagaaggtccgcaaggcatgggaggtggtgcaaaagaaggacaaagaactcaggggcagcaacaatgggcccatcggtggctaccgaaggtggttgaaagcccatgtgcaag

SEQ ID NO: 7749 - DNA, 360 bp, Glycine max
  Peptide Sequence Number=SeqID_99434
atgaacaacatgatgacacttcaacacgcccaaattaaaacatcttttgagacaagtatacacgtggttgggcatgcgtttaaagttaccttgtacaaaaaactacttggaatgctatcaaggcttactttttcagatcaagggttatgtgaggctgaggtgaccataattgaggagatggaaaccatattgaaacaatttgagcatctcaatgtttatggcaaagattctattgaaaacgatattgatgtcaaagcggatggtaaccgtggttatcatgcaatagtttccttgttgggtatgagtgaagaatcatggtcattggtgcgcaaccatctgcataaagaactcacaagctag

SEQ ID NO: 7750 - DNA, 273 bp, Glycine max
  Peptide Sequence Number=SeqID_99435
atggtcgtcattttgcctaaggaaaatgttgtcatctggttttgtttgttgcataataggtcagacaactgcctcaaaggaataattaacagtgctttgaaaggatttgacgatactccacaaagtaaatccaaggttgttgctgctaggtggattgttgttaaatgtaatagacaaaaaggaagcactgagtgtgggtattacgtcatgcactggatgtcaactataatcttaggaagtttcaagaataattgggaaacggtaattgtttaa

SEQ ID NO: 7751 - DNA, 270 bp, Glycine max
  Peptide Sequence Number=SeqID_99436
atgtggctacatagattagcaacatctctctatctctcttggtggtgtttgcatgttcactactttgtcaagcttcagcttttgtgtcctatgaccataaggctatcatcatcaatggacagagaaggatacttctttctggctccattcattaccccacaagcacccctgagtgataactggattaatgaagacttgaggcttactaatatccaggtccagtttcaaaattggactgtgagtcaatttactgacattgatggtacctag

SEQ ID NO: 7752 - DNA, 492 bp, Glycine max
  Peptide Sequence Number=SeqID_99437
atggcgcttcaagctaaacaacttttattacttgtgcagccttacacttcttatttcatccacataagactcattgttcaatctctcatcaacaacacccacaatatatcaatggaggtaccatgccccagaatgctatcaaacaagcaacaccctttagtcttaggacataaagtcacaaacactaacactagacagtatagtagcatgcagggtgccctagccgaaggtcttgcaaggggttgtttgtttggtcactatatagagtcttgtctcttccttaccctaccctacatgtcgctaacttcaaaagcccaacaaaaaaaaagtgagaatgaaccaatgaagtttacctcgacaccaataacgacaatggcaacaacctggctgcaagtgggagtgagaaagaagagccgtggcgtggagaggaacacctacgcgggcaacaccagagctacgatagagacgaagatgcgctacagatgtgactga

SEQ ID NO: 7753 - DNA, 335 bp, Glycine max
  Peptide Sequence Number=SeqID_99438
caccactcattgagttggtgaggatcaatgttccctcatgggaagatgtccatgaaaggggtgtcgagggaaagggcccagaatatgaagaacctcgggatttgaggtcaaatcctttccaaggtggaggggatgatacaatcctacccccaagcgtattggatagaagactccaagaggattggactcaacatcatcttcaagcttcttatccaaagcacatcgttggtggtgaagctccttcttccatagcttattttctagtggatggtgcctcctctcacctcttctcctttgtcttccgctgcatctccatggtggaaaatcaccattga

SEQ ID NO: 7754 - DNA, 276 bp, Glycine max
  Peptide Sequence Number=SeqID_99439
atgcggatttttgctggtcacgttgagctgcttaaagccaattgtcgcacaatctccctaaacccatctagccccattaagaagcttcaacatgaagcaaccagctcgcctgggcaagcatgggaaggggttcagcacccttggtcacttgcagcagacaaggaaagtgtcgttgacactgtatgcaaaaagtacgacattagcaatgagaagtgggctcaattttgtcagacccgcagagacccttcgtgggaggatatgcgaaaaaaggcatag

SEQ ID NO: 7755 - DNA, 321 bp, Glycine max
  Peptide Sequence Number=SeqID_99440
atgctccccgcgaagaggtccaggaaggacaccactagagaaggttccaatgcagccccgcaagctgacatggacttcgacagacaccggttttggagtgcagaacaccaacagcatttcgagaccatcaagggatggtcgttcctcagagagagacaggtccagctgagggacaatgagtttcctgacttccagggagagatagctcgcaggcgttgggcactacttgtgacacccatggctaaattcaattcggagatagtcatggagttctatgttaatgcctggcctactgatcgaggtcatacccaaatcaaataa

SEQ ID NO: 7756 - DNA, 429 bp, Glycine max
  Peptide Sequence Number=SeqID_99441
atgtcttcagtcatttacatttcaaatacttcaatgtcttcagtcagttacgctttcaaagactacaatatcttcatttacatttcaaagacttcaatgtcttcagccatttacacttttcaaaagacaacaatgtctttatttacatttcaaagacttcaatgtcttcggtcatttacgctttcaaaagactacaagtcttcatttacatttcaaagacttcaatgtcttcattcatttacgctttcaaagactacaatatcttcatttacatttcaaagacttcaatgtcttcagccatttactgatgcaatcctccctaggaagggaccagtcactagaaccatgagcaagaggctccaagaagattgggctagagttgctgaagaaggccctagggttctcatgaaccttagggtagatttctga

SEQ ID NO: 7757 - DNA, 435 bp, Glycine max
  Peptide Sequence Number=SeqID_99442
atggccaatgagcaccagcactatgtgcccggtgaaacgcgcaaggtgttccactggcgcggctggcgtattctgccgcagatttgctacgacctgcgcttcccggtgttttcgcgcaaccagaatgattacgatctggcgctgtacgtcgccaactggccggcaccgcgcgcgctgcactggcaggcgctgctgctggcgcgcgccattgagaatcaggcctatgtagccggttgtaaccgcgtcggcagtgacggcaatcagcatcaatacagcggcgacagccggattatctcgccgcagggtgagatcctcgcggccgctgaacccttcgcccgcgcgcgcctcgatgccgagctgtcactggaggcgctgcgtgactatcgcgaacgcttcccggcctggcgcgacgcggatgaatataaattaaattag

SEQ ID NO: 7758 - DNA, 537 bp, Glycine max
  Peptide Sequence Number=SeqID_99443
atggggaaaaatcaaaacggaaaaagattttatcaagtcaaggttaagggtctagatgtcaccagcctcaaggaattgggacgattgatgagacctctcaaaaggcaagccttctgcaaagtgtacggaaagattctagatttgaccgcagtggaggtatttacggaagctgttgtatccctcgcccaatactatgaccagccgttgagatgcttcacgtttggggacttccaaatggtaccgactgttgaagagtttaaggagatattaggatgccctcttgggggaagaaaaccgtaccttttcttcggttttcttccctccttgagtaagattgcagttgtggtcggggattcggaaaaagagttggatcgcatgaagcaaactcggaacggcatcctgccgcggaaatacttggaaggcaaagcaagggatatggcaagccaagagaagtgggtcccgtttgcggatatgctagctttgctgatttttggggttgtccttcttttccgaacgtggacggcttggtggatttag

SEQ ID NO: 7759 - DNA, 81 bp, Glycine max
  Peptide Sequence Number=SeqID_99444
atggagaaaaatgaagaaacaacaatggaagagaagcttgcttggggcttctatggaggctggatctttgagcttcaatga

SEQ ID NO: 7760 - DNA, 249 bp, Glycine max
  Peptide Sequence Number=SeqID_99445
atgagccttagcatgcagagccagggcttcgcttcttttcatgccctactccagaccagttcagggcagaggttgcatggcccggagattggcccgaggcccaagcaggagaggcacccccagaagctcccggcgacggagaagaggcccacgaggatgaggagatggccgatttgcttgacttcttgggagggagtggagatacgtgactgggagatccccagattcatcgcatacgtttttgtttag

SEQ ID NO: 7761 - DNA, 453 bp, Glycine max
  Peptide Sequence Number=SeqID_99446
atgcagcagaagcgacatggtcatgctcagtcatcttcacaaccaacagttaactgcacttcagaatataatatgattgcgtctgattcattaaaaagtgaagattctgaatccacacaagtcattttcaacatgcagaactatcaacatgcaaagagatgtgattctgcaaaagcgaggatcaaccaaaaacgtattatgcagcagaagcgacatgcttatgctcagtcatcttcacaaccaacagttaattgcacttcagaatataatatgattgtttctgattcatcaaaaagtgaaaattctgaatccacacaaggttcatgctctaattttatgactcccttcaaggattgtcaatctccaactaatcaacctataatcaacactgaaggtaatgactataattctgatttccagtttcagatgctactgtacatgctcttaaattaa

SEQ ID NO: 7762 - DNA, 316 bp, Glycine max
  Peptide Sequence Number=SeqID_99447
atggagataagatttttagtttcaggaaaatatgttgccttgcaaaattgtgatgacgaagatgttgaaactatgatcgaaagttttcaacaacaacaacaaatgtcagttctagaattgtacgtagaaaaggatgttgccggtggttccatgtttcattttgcaaattctgttatgtcatgtggacataatctatctcttcatgagtcggaactgccaagaaatataagcaatgtacatgatgatgaagatgatgatgatgatgattatcttgcgtctaactcatactttgaagagtctttggatgaagatgata

SEQ ID NO: 7763 - DNA, 523 bp, Glycine max
  Peptide Sequence Number=SeqID_99448
gaaacgtaagagcattggggcaaggccaactgctcaatatgatactagatggttccattcgcttgatgcttggaaccgttatacaaataatgtcttggggaggagtattttgcctgagaggaaggttgagatataccacacagagttcgatgacttcaagacagagttggagaggcgtaatcttcacaaatgcctcaccaacttggttgatgggactattgatgttgctttggtgaaggaattttatgctaatctctacagctctgaagacccttcaccaaagcaagccagagttagaggccacttggtgaagatagatgctgacagcctcaacacatttctagagactcctgtagttctagaggagggggagacattacccacctattctaggtactgcagtttacccacagatcacagagagattgaggctgctctatgcataccagggagagggttcattttgaatgttgagggccatccggggaggattctcaggaaggatctgactaccttggcctag

SEQ ID NO: 7764 - DNA, 327 bp, Glycine max
  Peptide Sequence Number=SeqID_99449
atggctatcactgctgcgttggcttcaagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 7765 - DNA, 390 bp, Glycine max
  Peptide Sequence Number=SeqID_99450
atgcatagtgggatttacgcttggggcgctgttgcactcgtgcacatgtatgataatttaaatgaggcatcaaagagtacggcgaggcagcttgcaggatatatcactctgttacagtgttggatctacgagcattttttgtcctttggttccaccctagctaccgaggattataatgagaggagaccgcatgcatgtcgatggacctctagcaaggcactgcccgtgtcgacgtatcgcatgcgtctggacagaatgaccccagacgtagtgtgctggattctgtatggtgaccatcgttcatttagagaatttgaggtcatcacattttttgaccatctcagacggggtcccttgatggtcattcaccgactggagagggttgtatga

SEQ ID NO: 7766 - DNA, 537 bp, Glycine max
  Peptide Sequence Number=SeqID_99451
atggaggaattgttgcaacgaatgatagatcaaggccgactggaagtcggtgatgaggggagggaagagcagcatatatgtatgcagtctatggatgagagaagttttggaaggcctaagcctttggtgatatatttcaccaaggacgcagcttcacaaaagccccgatacccctcggcaggtaaacctgttcctttcccataccaaaacagccacgtagtcccgtggaggtatacacctccgagtgaaaggaaagaagaggccatcgacatcagctcgttgtcggccaaggtaaccaatatcacggggctgagtggtgtgacccgcagcggtcacgagtttgtacctcccgacctgccgacacaacctgcaaacattaaggggaaggcgaaggtggtggaagaacaaaatgacaagacgacccttactctgaacgaggatattccagtgaaaggtcttccagagaaaagggatggttgtggcaagaaggaagtgtcgctagaggaagcaagcgagtttctccgtattattcagtag

SEQ ID NO: 7767 - DNA, 176 bp, Glycine max
  Peptide Sequence Number=SeqID_99452
atggagcctccggtaaggggaaaatacgggctaagacggacaaaatcagtgttttatctttactttcctcctatcaccgataaaaggtacttggcacccattgttgcacaatacgtgaagttccgtaacatgccggaaatgaaaaggaagcatcgttacacaatccgtgagattcc

SEQ ID NO: 7768 - DNA, 174 bp, Glycine max
  Peptide Sequence Number=SeqID_99453
atgcataatgcgatcaagaaacaagccagaggactaccaatgaaaatgcctcaccaaaagaggaaaactctaggtgaagcttcattattatcaagcgagtcagagacccagcatgactacaaatcaacctccactacctatggctcagacccgggtatagggcccaacatctaa

SEQ ID NO: 7769 - DNA, 546 bp, Glycine max
  Peptide Sequence Number=SeqID_99454
atggctcagttgatcgctgaaggccatttatctatttgcatgtatggcgcccgaccaggccccctatggaccccagataagtccaacccggacctgggatttcccgcactgatcacagaactctgccagtcgttcggagtccccgtggcacctaccaaggtgattcggccaccaatcacccgaacttttattgagaagtactgcacccagagacaggctcagggtgatgctccacaggccacaggcgcaccaccaccacctcatcgggctggcccggctgggtcatttgacatggaacagtatttacggcatttagttcgccagcaggcggccaaccaccgagcacatcatgcagagccagccttcgcttctttttcatgccctactccagaccagttcagggcaggggtcgcatggcccggggattggcccgaggcccaagcaggagaggcacccccagaggttcccgacgatggagaagaggcccacgaggacgaggagatggccgatttgcttgacttcttgggagggagtggagatacgtga

SEQ ID NO: 7770 - DNA, 135 bp, Glycine max
  Peptide Sequence Number=SeqID_99455
atgcagctgcccgcccgtttcccgactggaaagcgggcagtgagcgcaaacgcaattaatggaacaaaagctggtaccgggccccccctcgaggtcgacggtatcgataagcttgatactcggatgtctgattga

SEQ ID NO: 7771 - DNA, 312 bp, Glycine max
  Peptide Sequence Number=SeqID_99456
atgtgttttcatgaagaaaatccaagccgaggtgcttccgtacgcttccgtaagcgattctgtggaaattcttcattgttcttcaccgttcttcgttcgttcttcgtcgttcttcaatcttcaactgaaaaatcaatcgatcgtttttctttgaaagtttccttgaatgaattgactaataaccaaagtgatgcaatcctccctaggaaggggccagtcactagaaccatgagcaagaggctccaagaagattgggctagagctgctgaagaaggtcctagggttctcatgaacctcagggtagatttttga

SEQ ID NO: 7772 - DNA, 1599 bp, Glycine max
  Peptide Sequence Number=SeqID_99457
ggggtgacgtactcggacagcagggcggccccgatcatcagcgggatggtgacgatccagagcatgcgcagcaggcgcatgccgctgacgcccgagacgcgcaggatcaccagctcgttgcgctgggccaggccagccagggccaggatggcgccgatcagcaggccgatgggcagcaggtcgtaaagtcgggtcgggatggccagcgcctgcatgtacagcagggccatcatggagaacttgtcacccacattgtccaggtcgtccaccagtgcgaagaacgtgaaaagacccagcagggccataaggaccactgcgcaagagcgatagatctcgcgggccaggtagcgacgggcggtacgcatgtaagggacgaaggagcgcgtaaacgtgaaagcttaacaaatccggccgcccaaggggatgtcgaccatctgcatccgccgggtcagggtgtacacgcgcgagttcaggtagttggaattgcggtggctgtcatagaagcgcggattgggcagcatggccgccagacgggccgactggctggctcccaggttggccgccggcacgttgaaataatgcctggcggccgcctgggcgccgaacacgccggtgccccattccgccacattcaggtagctgcgggaactggacaggaacaggttcttggccaactgctgggtgatggtcgagccgccgcgcatcttgctgcgtccggccgcttcctgtttctggttgtattcccaggccttgcggatggcgtcccattcgacgccgtcgtgttccgtgaagttggaatcttcggacgccaccaccgcccgcttcaggttgcggttgatcttgtcatagggcacccactcgtacttcagctggaaatcggggttgccgtcgcgcaggcgcgccagttcctcgcgcatgatggcgctgctgccggggttctggtagttgtaccagaccaccagcccgaacagccagaactggtagagcagcaccgcgcacagcagcgccatcagcgtgccggtcccggccatgagcgcctcgcgcagcgccgtcagcaccggcgcgggatcgggccgcaccccgtgccagatgaagaaactctcggccgcctggccgaccagcataccgaggccgtcggccgtcagcgcggcgccatcctggcgcgcctggcgcatgaacgccgtcggctgggcgccgtacatcatgtcgtaggcggcggcgccttcggcgtacaggccggcgggcagctcgggggcggcgtcctgcagcccgctggcggtggcgttgacgaccaggttccagccgccgggcagggcggcgtcgggcaggccgccggcggtaacgcgggtctgcggctcggcgcccgtctcgcgccagctttcggccagctccagggcgcgggcagcggtgcggttgacgatatggatgcgggcgcaaccggattgcgccagcggttgcagcacgccgcgggcggccccgcccgcgcccaccagcagcaccgaggcgccgctcaggcgcacgcccaggcgcagcaggtcggaaaccaggccgacgccgtcggtgttgcagccgtgccaggcgccgtcgcgccaggacagg

SEQ ID NO: 7773 - DNA, 767 bp, Glycine max
  Peptide Sequence Number=SeqID_99458
atggattgggaccagctcttggccgggataggaagtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgagggggagcaccgacggaagaaaagcatgtctccttttccttgtgagggatttcggcgcacaaaaatttccaagactatacaaagaatccataaggcatgggaaacccccgttaaaggaaagatcaagagctttagaggcattcgtaatggcatcattgattggctcgcccaagttaaaagtcgtcagcaaagagagttttgaagcaccggaagaggacgaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcgtggttctgaaagaggagttgattgcttgttcaaggtccaaaagaagcttgtctcagcgtctatgcgagacagagaccaacatgttagctatcatcgccaa

SEQ ID NO: 7774 - DNA, 963 bp, Glycine max
  Peptide Sequence Number=SeqID_99459
atgaaacaaataaaaagagaaaaacatgttacctatagtagtcatgactcttgcaagagtttaaatgaagaacttagcgactattatggagggcaacatagatcacatactaaacatcactcgcaaagaaaagaaaaggatagaaggcctaaagaggttaacattagcctttcatatttccatgaaaaagataatgttggggtcttcctagattgggaaatgaaggttgaacaactctttgcttgccatcatattagtgaagagagaaaagttccattggctacccttagcttccaaggggaggaggaaagaacaagcattgctaggttcctaagtagtctaaatgtgaaagaccaagctccaagtgtgttagaagtaccaccttctaggccaaaggatgacaagggtaaaaacatagaggaaatcactacaaaggctagttcaccagatataaatagtaacatcaagtgcttcaaatgtattgggaaaggccacattgcttctcaatgccccacaaagaaaaccatgatcatgaggggtcaatacatctatagtagccaagaggaggctacttcttctccttcctcaagtggggcaacaacaacgagctcaagcttcgaagggccgagagagaccagtcaagagtcgaagttgagtaggatggaggcgaacatgtgggcaatcatcgaccaatataaagaaaagctaaatctagttgcaacccataagcaaaggctagaggacgagcatgcaaaggtattggtcttgcaagtgaaaagggaagcgagggagaaagtgatagattcattacacaaagaagctttgatgtggatagataggttcactttcactttgaatggaagtcaagagctcctaagattgttagccaaagccaaggcaatgacggacgtgtactcgaatcccgaggaagttcatgggcaaattgatgtcccacataattag

SEQ ID NO: 7775 - DNA, 171 bp, Glycine max
  Peptide Sequence Number=SeqID_99460
atgcagagtatccatgatctggctcaacatcaacccagaatgagcatgaaggcatttattgcccaagtggcctggccaggagtccagccttctactttggggggagagatcaccgaggatgaggatggcactgcagacacagattatgcagctgacatggcagcggcatag

SEQ ID NO: 7776 - DNA, 1428 bp, Glycine max
  Peptide Sequence Number=SeqID_99461
atggacccgagaaagcttccatcaaagaggtccaggaaggacaccgtcggagaaggctccagcgtcgcccagccagctgacacagattttgacagacaccgattccggagtgccaaacatcagcaatgcttcgagaccatcaagggatggtcattcctcagagagaggcaggaggaggtagctcgcaggcgttgggcaccacttgtgacccccatggctaaattctacccagagatagtcatggaattttatgccaatgcctggcctacagaggagggagctcgggatatgtgctcctggcgtgaatacaaccagaggaggagtcaggcctctggttttgacgaggaggccattgctcagcttttatgcatatcggggcaggatttcgctcggactgctgtagggagacgggtgaggatcatgcggaccagcatgaccaccttgacccagatttggatgacattgctgctcagcaacatcctacccagtgaccacaactttgatcttcctgtgccgaagtgtgagctggtgtatgccatcctaacacagatgagaatgacacctagaagacaccctgtggacctggagaagtccaatagggccctgggtttccccactctgatcacaggtctatgccagttttatggagtgcctatcgcccccaacaaggtcatccaaccccctatcactagagccttcatcgagaagtactacacctccaggaaggctcagggcgaggcaccacagcaacttggagacacccagccacaggcagctgatgcaccaccgtctcccctggagtccacctcagttcacttacgaagccaggatcccgatacttatgcgtggcctacccctgagcagttcggcgccatggctggagattggtctgatgctcagataggggcagggcccacaggcacctctggagatggatacggagctaaggaagatgatgacatggctgacgtgatggacttcttccttggaggaggcggagacaggcaagcaagcccattgacacgcaaagaccaatatgttcatctgcaccctttcatcgaagattcaacgtttattgacagagactacgttagtctcatctcgtcatccagagatagcaaggccgatgatacatggaggcaaactatagtcatatgccacctttgctatccagagacaatcgagtccgatagcatgcaaaggcaagcgagcctgttgaccgagactactttagtctcaccttcgtcatccagagacgataagtccgatggcacacggaaaccagtcatggtcatctaccacctttgtcaaccagaggactcaatttcgttcgacctagacggctatagtctacccttcgctatcaagagacagacgagtccgatagcatgcgggggccgtaatggtcactcactttcgttgttctga

SEQ ID NO: 7777 - DNA, 630 bp, Glycine max
  Peptide Sequence Number=SeqID_99462
atgccgagcttagcgagtttagcgagccatgctcgcttaggcattttgatgtgtcagctaagcgaatggcctctaggaagaggaaagctactgcctatagacctcgagagccctatgataccattagattcatatctgagggcgcctaggagagatatgcacagaacatttactctcgggacatccttctggagaggaacggagctcaagcagaggaactggcataaggccttgaccaggcagcctgatggtcacaatgatgtggccctggtcaaggaattctatgctaaattatatgatctagaggataagtccccgctacaagcttataaaggtgaggttagtctacggactggtcatgaagatggatatggacttgggctcgctcatttcaggccaaatctcacagatggcccaatccaactcctctcggctcgactttcatgcacttattacagccttggcgtagccagaggagtagtatccgactcccttaccttcgagtccctaagccttgccattaatttggtgtacatcaagaagaattgctggaacctagatgatcccatgatcacctttctggggacccataaagctagggcccggggaccatcaaacgcttccacttaa

SEQ ID NO: 7778 - DNA, 924 bp, Glycine max
  Peptide Sequence Number=SeqID_99463
atgccctatacggtaacccgcccacactcttttgctatccgtcagactcagagtctggtagaacgcagagacttacgttgtcttctgcaccttttgtcatcccgaggcgatgagcccgatgacatttgggggtaccgtatggttatccgcaccttttgtcatcccgaggcgatgagcccgatgacatgcgggggggcgaacgagcccgttgatgcgcagagactaacatcgtctcctgcacctttcgtcgcccaagggcaaacaagctcgttggcacgtagagacttatgtcatcttctgcaccttttgtcatcccaaggcaacgagttcgatgacatgcgggggtaccgtatggttatccgcacctttcgtcatcccgaggtggcaagaccgatgacatgcaggggggcgaacgagcttgttgacgcgcagagactaacgtcatctcctgcacctttcgtcaaccaggggcaaacaagcacgttgacgtgcagacacttacgtcatcttctgcaccttttgtcatcccgaggcaacgagcccgatgacaagcaggggtaccgtatggttatcggcaccttttgtcatcctgaggcgacgagcctgatgacatgcggaggggcgaacgagcccgttgatgcgcagagactagcatcgtctcctgcacctttcatcgccaaggggcaaacaagctcgttgacgcgcagagacttacgtcgtcttctacaccttttgtcatcccaaggctacgagctcgatgacatgcgggggtaccatatggttatccgcacctttcgtcatcccgaggcggcaagaccgatgacatgcgggggtggcaagcctgatgacatgcgggggtaccgtatggttatccacatcttttgtcaaccaggggcgaatgagcccgttgacgcgcaagactaa

SEQ ID NO: 7779 - DNA, 654 bp, Glycine max
  Peptide Sequence Number=SeqID_99464
atgggtgaagtagaggaggtgcaagagcagatgaaggccggcatggaggccatgaaagagcaaatggccacaatgatggaggccatcatgagcatgaagaagataatggaagccaatgcggttgcagttgtcgttaccagcgctgttgctaaggtgaacctgatgcccccatctagcctcaaccaaatgaatcatccaacctcatctatggtaggcaaagatttgggaagtacgagcggcccctattatgtgaaaattcaaaacaagcacgctttcccaccatatggcttgcctcccaactatacaccacccaatgtggtatacactcccaatgaggatgtcaataactctgctcccatactcattgaaagccgacaacctcaaactgatcatgcacatgtctctcaacccatgggggagacacatgaaatgccccaccacaatctagtggacttcgagccttgcctcggatatgccactgaagggcaagtaaaatccctcctattatggatggaatggaaaaagttggatcatctagaggaaaggctcagggccattgaaggaggtgaagattatgcctttgctaacctagaagagtttgttcctagtacccaatatcatcacccctcccaagttcaaggtgccggactttga

SEQ ID NO: 7780 - DNA, 555 bp, Glycine max
  Peptide Sequence Number=SeqID_99465
taccgtcaccttcagaggactacatgtcctcgccttagagggctagcacgccccgccatcagaggactacacgtcctcgccttcaaggggctacaccctacttcaagagggcctcacgtcctcgccttcagagggttgcacaccctcgccttcagagggctacacgccctcctatcagaggactacacgtcctcaccattcagagggctcacgcccagccttaagagggctacacaccctcgccttcagagggctgcacgccctcgccttcagagggctacacgccctcaccttacagagggctacacagggctcactcctcgccatcagaggactaacacgtcctcgccttcagagggctacacgccctcgcctttagagggctacatcctcaccttcagagggctgcacgccctccttaagaggctacacaccctcgccttcatagggctgcacgccctcaccttcagagggctacaggccctcaccttcagagggcatacatgtcctcactttcagagggctgcacgccctcgcttgcagagggctgactag

SEQ ID NO: 7781 - DNA, 198 bp, Glycine max
  Peptide Sequence Number=SeqID_99466
gtccgtgatcgacaagtcatcacgcgtccagctcaagacattaaagaagcactactaggaggcaacctagaattggctacgaagaagctccctgcgacgtggtccaagaagggcatcaatgaagaggattccagtgtggccccacaagccgacatagtctttgacaaacaccgattcttgagcgtggaacatcaatag

SEQ ID NO: 7782 - DNA, 429 bp, Glycine max
  Peptide Sequence Number=SeqID_99467
atgtctttcgtcattttcgcttttacagacttcaatgtcttcagtcatttacgatttcagagactacaatgtcttcagtcatttacgatttcagagactacaatgtctttagtcatttacgcttttagagactacaatgtctttagtcatttatgctttcaaagactagaatgtattcagtctttttcactttcaaagactacaatgtctttagtcatttacgctatcaaatactacaatgcctttagtcatttacgctttcagagactacaatgtcttcagtcatttacgctttcaaagactacaatgtcttcagtcatttacgcttttaaagactacaatgtcttcagtctttttacgctttcaaagacttcaatgtcttcagtcatttacgctttcaaagacaacaatgtctttagtcatttatga

SEQ ID NO: 7783 - DNA, 944 bp, Glycine max
  Peptide Sequence Number=SeqID_99468
cgcggcgtgttcagcagcaacgccgcaggcgaactggaggtcagcaccaccggccaccagggctcgcacgtcttcagctcctacagccagggcaactgtttcatcgtgctggagcgcgaacgcggttcggtggcggtaggcgaaacggtggagatcgagccattcaatgccctgctgaggagctgaacatgctgccggaattgaccgacgccgaagcgctgcgctacaaccgccagatcgtgctgcgcggctttgacttcgacggccaggagaagctgaaggccgcccgcgtgctgatcgccgggctgggcgggctgggctgcgccgccgcgccatatctggcagcggccggcgtcggccatctggtgctggtggatttcgacaccgtctcgctctccaacctgcagcgccagatcctgcaccgcgacgatcgcatcggccagagcaaggtcgcttcagccaagcgggaactgagcgccatcaacccgcatatccgcatcgacgcgatcgacggccgtttggaagatgacgcggtcgcggcagagatcgccgcctgcgatctggtgctggactgcaccgacaacgtggcggcgcgcgatgccctgaaccgcctgtgccacgcgcagcagaggccgctggtttccggcgcggcgatccgcatggaaggccagctcagcgtgttcacctatcagccgggcgagccctgctaccgctgcctgagccggctgttcggcgacagcgccctcacctgcgtcgaagcgggcgtaatggcgccgctggtcggcactatcggcaccctgcaggcgatggaggccatcaagctgctggccgactatggtcagccgctgcgcggcaagctgttgatgttcgatgcgatgagcatgcagttccgcgagatgaaactgccgaaggatccgcactgcgaggtgtgcggcggggaatga

SEQ ID NO: 7784 - DNA, 552 bp, Glycine max
  Peptide Sequence Number=SeqID_99469
atgacggcgccggcaatagggttaggcttcggcgttaaacgcgttgtggaaggcgacttccgcatacggcagcgtggcctggaaggcgatggcgcggaaggtgatcaccgcgcgttcgccgccttccggatcggccaccttcttgatatccagcttgaagttgatggcgctgatgatgccgtcgccgaactgctcgtgcaccagcgctttcagcgtggagccgtaaacctgcagcatttcatagaagcgataaagggtcggatcggtcggcacgccgccgggaatgctgccgcgcaacgggatggtttgcagcagctgtaccgcctcttcgtccagcccgagcttggccgccacggtgcgtgccgcttgttccggcaacgcatgctgccccagcagcgcggcggtgacgaacgccaggctgagtccggtgccctcagccagcgcgtcgaaagtcaggttatggcggatcttggcggccatgatggtgtcggtgagcgctgcgcgcgggacggcgttgtgcagagagtgtgtcatgttagctccttttgttga

SEQ ID NO: 7785 - DNA, 543 bp, Glycine max
  Peptide Sequence Number=SeqID_99470
atggcgatatctgaagtgcagtcgcccagggaaggcgcgaaaaccacgctgacggagcatccgctgatgctgtcggtgaacggcgaacagcttcatgcgcaggtgatggcggatacgccgctcttgctggtattgcgcaacgatctggcgctcaacggcccgaaatacggctgcggcctgggcgaatgcggcgcctgtaccgtgttgatcgacggcgtggcggcgcgctcctgcgtgatcccggcgctcggcgtgtccggccgggcgatcgtgaccctggaaggccttggcgatcgccagcgcctgcatccggtgcagcgtgcctttatcgaagagcaggcggcgcaatgcggctactgcctcaacggcatgatcatgaccaccaaagccctgttggatcgcaatcccgccccgagcgaggcggagatccgtcaggcgctgtccggcaacctgtgccgctgcggcacccatctcgaaatcctgcgtgcggttcagcgcgccatcattctctgccgcgatgagggcgcccacgcttatgactga

SEQ ID NO: 7786 - DNA, 318 bp, Glycine max
  Peptide Sequence Number=SeqID_99471
atgaagatgaaagcaaacaaaacaagaaatgaattgaaagtctcggattcgaacacttaccggttgaagaacgaagaacggatgaagaacggtgaagaacgcaggaaaatcttcacagatttactcacggaaatgtctcggaagcgttacggaagcactgctactcgattcttcttcacggaaatggaaaaagggaggtgcttgccacccagaggcttcttgagaaaaatttctaagcgcaccccaattactaagttcaccccctttcgtactttacgaaaaagttacggaagccttacggaagtttttcggatttga

SEQ ID NO: 7787 - DNA, 1455 bp, Glycine max
  Peptide Sequence Number=SeqID_99472
atgggatcgagtcaggcgtcttcgcttaaaaagaggttctatcaagtcaaggtcaagagcctaggagtcaccagtctgaaagagttagggcagtttatgggtcaactccagcgacaagcttttcgcaaagcttatggtaaaatctgggacctagccatggcagaggtctccacagaggccattgcctccctcgcccaatattatgaccagttgttgaggtgcttcacctttggggacttccagttatcacccatggtggaagagtttgaagagatcttgggatgccctctaggaggaaggaaaccatacatcttctcaggattttatccctctttagctagaatttctaagatagtccgaatctcgacgcgggaattagaccacagaaagcaagtcgaaaatggggtggttggagtaccgaggaaatgtttggaaacaaaagcaagaatcttggcaggtaaaggcgaatgggccccattcataaacatcctcgggcttttgatcttaggaggggtcctttttccaaatgtggatgggttggtggacctggcagcaatcgacgcttttctctcctttcatgaccgcaaggaaagcccggttgtcgctatcttagccgatctatatgacaccttcgaccgaagacgtgaaaagagcagtacagggattgtttgctataccccggccctctgcgtatggttggttttgcaccttttccgccaagagttcccccgatggaaagaaggaagaacctgggttcttatttcgtgcggaggatttccaaatgttcttatgagaagggcaccactagacgaagacctcacacctattattgcacgaggtttcaatagcgccaacgcggaggcacttcagaaggtctgcaaggcatgggagatggtgcaaaataaggacaaggaacttagaggcagtagcaacgggcccatcggtggctaccataggtggttgaaagcctacatgcaagttgaagttccggaggaggacgaagaggtgcaggccctcaagacagaaatcgagaaagcccaaatagtcaaagaaaagttcaaatcagcagctcttaagatccgaaaggagaatgccgaactgagagacgtaaatatagccaccaccaaggccttagaacaagagaccaaaagggcccgtagggaagaacatggccggaacaaattccgaggggctctgtggggcagtaacaacgagcttaagctccggagagaggaaagggaccaatcacgagtagacagtttgatcttgaaggatgaattgaggatttgcctaaggtccaagagaagcttgtctcagcggttatgcgagaccgagaccaacatgttagccatcatcagcaagtaccaagaagaattaaatctagccacagcccacgagcacaaagtggcagacgaatatgctcgagtgtacgtggaaaaggaggctagaggaagg

SEQ ID NO: 7788 - DNA, 288 bp, Glycine max
  Peptide Sequence Number=SeqID_99473
atggataaatttgatatctttgtccctcatcctctcacaaacgcatctttgcttattcagctttcaccgaaatatggatgcaagccattggtctatttgctcaagcgacctgcgttcttgagtttggacttccaagaccgttcaattagaaattactcatgctacacatttgaatcaatcgcttctttcattcttccttgctacaaggctgtggaaacaaaacaacaatggttacctcagagccctacactggggcaaggaaaggcaccatgcataaacctcaagtga

SEQ ID NO: 7789 - DNA, 249 bp, Glycine max
  Peptide Sequence Number=SeqID_99474
atgagggttcactgtaatcaagcaagtcggagacctagcatgaccacagattcacctccactccttatgttctcatggacccggtccccagtggagtcgccaactatcgcaacctacctttcggcggaagggcgacgcgaggctcacgggtgcatcttccaagaaaggaaaatgcgcggagtcgccaccaacgtttatttgaggaaaacgtcggagaaaccagaaaaaggcgtggtctacgaactttaa

SEQ ID NO: 7790 - DNA, 774 bp, Glycine max
  Peptide Sequence Number=SeqID_99475
atggccagaggaggaaccggtctgatgggttcgatgaggaggccatcacccagttgctatgtataccggggcaagattttgcccggactactgccggaagacggcaacatcctgcccaccgatcataattccgacctccccctgccgaagtgtcagctggtgtacgccatcctgacgcggatgagcatccatgtggctcagttaatcactgatgccatctatatttttgcaggtatggcgcctaccaggcaccctttggatccagataaggctaacagggccctgggatttcccttgctgatcacaggactctaccagtcgtttggagtccccgttgcagctaccaaggtgattcggccgcccatcacccgggcttttattgagaagtactgcacccagagacaggctcagggtgatgctccacaggccgcaggcgcgccaccaccacctcatcaggctgaccaggctgggtcgtttgacatggagcagtatttacggcatttggttcgccagcaggcggccaaccaccgggcacatgtgcagacccatgattgtctgtaccagatgagcctcagcatgcagagccagggcttcgcttctttttcatgccctactccagaccagttcagggcagaggttgcatggcccggggattggcccgaggcccaagcaggagaggcacccccggaagttcccggtgatggagaggaggcccacgaggaggaggagatggccgatttgcttgacttcttgggagggagtggagctacatga

SEQ ID NO: 7791 - DNA, 213 bp, Glycine max
  Peptide Sequence Number=SeqID_99476
atgggcagcctcagtcagcaggggcaggtttctgccccttttgtatgccctaccccagagcagtttggggctgaggtcgcatggcctggagactggcccgatgcccaggtaggggaggagcgtacaggatccctcgatgaggcggatgagtcccatatggatgaagatatgatggacctgctcggtttcttgggagggagcggagccacatga

SEQ ID NO: 7792 - DNA, 345 bp, Glycine max
  Peptide Sequence Number=SeqID_99477
atggcaatggaaaacaaatacacttttgacattttttttcacccccgatctacaccaccagagctgcgggaggccattcttgttctcaagagaagacttccaaattgtgccatgccacatgtaaatgcctgcggtcaacacatgaccatcctcagaagaattggacctccattacagtggaaagttgaggcccttgatggaatgaacagatatgttttacaaccatggtatgatttcctcagggctagtgatttgtcacacggtgatgagctctccttctattgcaggatctacgacaaaatatgggaaatggtgatccgccgcaaaattaattgggatcgttaa

SEQ ID NO: 7793 - DNA, 728 bp, Glycine max
  Peptide Sequence Number=SeqID_99478
atgaaacgtattgctattaccgagcgcccggactggcgtgaaaaagcgaccgagttcggtttccgtttccacaccatgtacggcgagccgtactggtgtgaagacgcctattaccagttcacgctggcgcagattgaagagatcgaaagcgccaccgccgagctgcaccagatgtgtctgcaggtggtggaaaaagtggtcggcagcgacgagctgatggccaagttctgcatcccgaaacacacttgggagttcgtgcgcagttcgtggcgcaccaatcagccgtcgctgtattcgcgtctcgatctggcctacgacggtgtcaacccgccgaagctgctggagaacaacgccgatacgccaacctcgctgtatgaggcggccttcttccagtggctgtggctggaagaccagatcaacgccggcaagttggatccggaatcggatcagtacaacagcctgcaggagaagctgatcgagcgtttcgccgagctgaaagcgcatcacggcttcggcctgttgcacctggcgtgctgccaggacagcgaagaagatcgcggcacggtgcaatatctgcaggactgcgcgcaggaagccggtctgccgaccgagttcctgttcatggaagagattggcctcggcgagaaaggccagtttaccgatctgcaggatcaggtgatcggcaacctgttcaagctctacccgtgggaattcatgctgcgcgagat

SEQ ID NO: 7794 - DNA, 348 bp, Glycine max
  Peptide Sequence Number=SeqID_99479
atgagggtgactgggtttggctccatcttaggaaggatagattccctactaaaaggaaatccaagcttagcccctagaggggatggaccttttcaggttttggagaggatcaataacaatgcctataggttggacctccctcccaaaagagtaaggagtggagctgatattgaggaggaggaactaatagatttgaggtcaaatcctcttcaaggggaaggggatgatgcaatcctccataggaagggaccagtcactagagccatgagcaagaggctccaagaggattgggctagagctgctgaagaaggccctagggttctcatgaacctcagggtatatttctga

SEQ ID NO: 7795 - DNA, 670 bp, Glycine max
  Peptide Sequence Number=SeqID_99480
atggctccgaaaaagctttccacgaagaggtctaggagagacgccgcggcagaagggtccagtgccgccctcgagtttgatagccaccgtttccggagcgccgagcaccagcagcgcttcgaggccatcaaaggatggtcgctccatagagagagacattggacgtcgctggtgactcccatggctaagtttgaccctgagtgcattccctttgatgcagatgccctcagccagttcctgggtgacccgctagtgttggaggaaggccagcagtgcgagttcagccagaggaggaacagggctgacgggatcgacgaggaggccattgcccagctattatgcacaccggggcaggattttgcctggaccgctacagggaggcaggtgcgaattatgtgcaccaacaagaccaccttgacccagacgtggatgacattgctactcaacaatgtcttgcctagcaatcataactctgatctccctctgccgaagtatgccacccaccaggcaccctctagaccagataagtctaacagggccctgggatttttggcattgatcacgggcctctgccagtcgttcggggttcccgtcacccccaacaaagtgatccgaccaccgatcacccgagccttcattgagaagtactgcacgcctaggcaagcacagg

SEQ ID NO: 7796 - DNA, 231 bp, Glycine max
  Peptide Sequence Number=SeqID_99481
gcctcgggcgcacgcatgtggcgtcaggcgcgccatatcaaagaaggcattgaagaccagatgatcctggaacaggcgaagggcagcgaagggcgcacgcgggcgcagctggaagagaaaatccatgtgccgcgtcacaccattttgctgcagatttttccgctgtatattctgccggtgatcatcgccgtggccggttacttcgtgttgaaactgctcggtatgctgtaa

SEQ ID NO: 7797 - DNA, 1302 bp, Glycine max
  Peptide Sequence Number=SeqID_99482
atgccccagctggctgagaccaattacgacgtcgtgaataagaaggtaagctggcaggaagcgcgtgacgtgtttgctgcgcgtggcgaaagctacaaaaccactattcttgacgaaaacatcagccatgacgatcgtcctggcctgtatcaccatgaagaatacatcgacatgtgccgcggtccacacgtgccgaatatgcgtttctgccatcattttaaactgcagaaaatctccggagcctactggcgcggcaatagcgataacaagatgctgcagcgtatttacggtacggcctgggcggacaagaaacagctggcggcgtatctgcagcgtctggaagaggccgcgaagcgcgatcaccgtaaaatcggtaagcagctcgatctctaccacatgcaggaagaagcaccgggtatggtattctggcacaatgacggctggaccatcttccgcgagctggaagtgtttgtacgcaccaagctgaaagagtacgactaccaggaagtgaaaggtccgttcatgatggaccgcgtgctgtgggaaaaaaccgggcactgggacaactacaaagaagcgatgttcaccacctcttcagagaaccgtgaatactgcatcaaaccgatgaactgtccgggtcacgtgcagatctttaaccagggtctgaaatcgtaccgcgacctgccgctgcgtatggcggagttcggtagctgtcaccgtaacgaaccgtcaggtgcgctgcacggtctgatgcgcgtgcgcggctttacccaggatgacgcccacatcttctgtactgaagatcaggtgcgtgatgaagtgaacagctgcatccgcatggtctatgacatgtacagcaccttcggttttgaaaaaatcgtggtgaaactgtcgacgcgccctgagaagcgcattggcagcgatgagatgtgggatcgtgccgaagtggacctcgccgaagcgctgaaagagaacaacattccgttcgaatatcagccgggtgaaggcgccttctacggcccgaaaattgagtttacgctgcacgattgtctcgaccgcgcctggcagtgcggcaccgttcagctagacttctccctgccgaaacgtctggacgccacctacgtgggcgaaaccaacgatcgtcagacgccagtgatgattcaccgtgcgattctgggttcgatggagcgcttcatcgggattctgaccgaagaattcgccggtttcttcccgagctggctggcgccggtacaggcagtggtgatgaatatcaccgacggccaggcaagaatatgtcagtga

SEQ ID NO: 7798 - DNA, 1326 bp, Glycine max
  Peptide Sequence Number=SeqID_99483
atgcgcccagtgggcctccagcgccttgccttgctcaatcgcttcctgttcaaccacctggcggcagatgatcagatcgccgagcagcggcagctcgatgcccggcggggcctcgaacgggaaagagagcacgttggttcagctcgtggctttctgcttcgtcaaccagacgcacggtcacctcggcctcttcctgaaattgcggcagcacgccttccagccagcgctggaaggtggcctcatccggcaggccgtcgccgctttcacaggcaatctgcagatccaaaatcacctggctcatggtgtctcctgctcggaggcggcgagcgcctcgcgcttacgttgttcggcaatcgcgtctttgcgtttctgttcggccgcttcccaggcctcataggcgatgaccacgcgggccaccaccgggtggcgcaccacgtcttcgctgtggaagaagttgaagctcagttcttccacgtccgacagcacttccaccgcgtggcgcaggccggatttctggttgcgcggcaggtcgatctgggtgacgtcgccggtgatgaccgccttcgagttgaagccgatgcgcgtcaggaacatcttcatctgttcgatggtggtgttctggctctcatccagaatgataaaggcgtcgttcagcgtgcggccgcgcatataggccagcggcgcgacttcgatcacgttgcgctcgatgagcttctccacgcgctcgaagcccaacatttcgaacagggcgtcgtacagcgggcgcagatagggatcgaccttctggctcagatcacccggcaggaagcccagcttttcgccggcttcgaccgcggggcgggtcagcagaatgcggcgaatttcctggcgctccagcgcatctaccgcggcggcgaccgccaggtaggtcttgccggtgcccgccgggccgatgccgaaggtgatgtcgtgatcgagaatgttggcgatgtactgcgcctggttgggcgtgcgcggtttcaccatgccgcgcttggttttgatggtgaccgccttgccgtaatccggcacgctgtcggctacctgttccagcacccggctctctttgatggccaggtggatttgctccggatcgatatccgggatcacgccgcgaatcggcgcggtatccacgtacagatggcgcaggatatcggcggcggcggccacgcacaggtttttgccgaccagcttgaaacggttgtcgcggcgattgatttcgatgcccaatcggcgctcgagttgtttgatgttgtcatcaaacgggccgcacaggctgagcaaacgcttgttgtctgcgggctctaa

SEQ ID NO: 7799 - DNA, 483 bp, Glycine max
  Peptide Sequence Number=SeqID_99484
atgtgggctttcttcaccggttgtcagatcgactgggctcacttggttcggtaccgaatgcataaggcattacggaccaatgcacctcttccatatcctcaattggtcaccctctttctccatcattttcaaattcctcttgatgatgaaccttttgttcaagtcaagcgttcctttgctataggtgctggtgcagtcacttcatttggttactgtaaggatcgtaatggtcaatggctgaagaaagatgcccttcctccacaagatgagcgtactccttctcctcctcctcaacgagatgattcagcccttatgactgaagttctttcagagttacggggtcttcacacttatgttggtgaacgttttgattctttggataatcgctttgcaggaatggatatccgtctcacacaacttgaagaagatgtgggttatattcgtcagagctttaatcttccaccaccaccaccaccttcttag

SEQ ID NO: 7800 - DNA, 183 bp, Glycine max
  Peptide Sequence Number=SeqID_99485
atgactgcccatatgaacaatgccagattttcgatgatggtcattgtcaacaccataagggtcgtggtcaacatcacaagggtggaggtgagcttagctattagagagcttctcaaggaagatttctcaaagaagcttctcaaggaagttttctcaagaaagcttctcaaggaagctacctag

SEQ ID NO: 7801 - DNA, 519 bp, Glycine max
  Peptide Sequence Number=SeqID_99486
atgatgcctttttctttttcttcttcttcttcttcttcttcttcttcttctccttcttcttattctgtggcattcttccactccaagatctggtcacacttggccttctttcttaacttagccaagaacttattctttgcctttactaaggaaacaacttccttcttgctcatgggggagaagttgatttgggtgagggttgagaagtctaaggtggaagggccagagaggtgccaaatgcataatgcagtgcatgaagagcaccacgatcgtggtgaaatgggtgattacggttgtggtggctcagatggttcagacttagaatctggagccttcctctttggggttgttctagggtctaaaggtttgggcttagatgaaggttgtttcttgggtttcttggttgggtttgagggatcagggttagatgttagtggaggtcctttaatggtgattttccacaatggagatgcagcggaagacaaaggagaagaggtgagaggaggcaccatccactag

SEQ ID NO: 7802 - DNA, 379 bp, Glycine max
  Peptide Sequence Number=SeqID_99487
cgccatcgcagcatggacacagaggctccttgccgctacagtgcatgttgtcacgaagtgctttgatattgcactttccgcgactacttttgcagtggaaatagcatggatgggatttctggcaaaaagcatagcaaaaaaagaggagaatcctgcttctactcttgtctattctctctctgtgacacttgctccatgtctgtctccagttcttgtgtctgacatcgatattggatatgaggagatagttaacactctggttcttgctttcaatggtaaacctgtgaagaatctgaagagcttggacaacatggttgagagctgcgatgatgattatctaaattttgatctggaataccaacaggttttctctcattga

SEQ ID NO: 7803 - DNA, 777 bp, Glycine max
  Peptide Sequence Number=SeqID_99488
atgcgtttaggagtatcagctctatgcaggattatggcatgcactcttgacaagttcttagcgtacttgaatgggattggaaatgatggtccgatggttatcattttgacgaatgccaggatcaaagaagggcaggtgagtaatttgttcaaggcctcgaagttattgatcaatgaacctgtattggaaattcaagatttcagggagagactttcagatttaggccttgacgtcaggccagctttgacacctcgtggtcaaggaagttctcaactttcagggtcaagccagctatcatcaaaggatgcatttcttgcaagggctgaggcaaaaataatttttgagctagacgccatttccgaggatgttgtttgtgttacggtgggcacaattactagaatagtcatggatacttattcatggtactatccaacttgcattcaatgtcataggaaaactaatgtagaagcagtgccattcacatgtggatgtggtaaagagaatgatcaagttgttctgaggatcaaggttcaaccaaactttaggatttcggttgttcttagatgctcaaatgaattagatttgattaatgttgtcttggacatgctgcttgatactgaggcatgttccgaggtagataccccaaactttgactgcaatgatacttcgcaagttgaatctcaatctgtgtctgtgacagcagatcatgatccagttgcagtattgccattcacccaaagaaatgtgtatcatccaatgaaattgatgatgaagtag

SEQ ID NO: 7804 - DNA, 552 bp, Glycine max
  Peptide Sequence Number=SeqID_99489
atgaaagaaatcaaaagagaaaaacatgcctcctatagtagttgtaactcttgcaagagcctaagtgaaaaacttcgtgactattatgaaggaaggcataggtcacatcttagacctcactcccatagtagagaaaaggaaagaaagcctcaagaggctaacattaacctcccatacttccatgggaaggacaatgtagaggctaacttagattgggaaataagggtagagcaacaacttaaaaggaagtctacttcaaaatcttatggctcttactcttatccaaagaaagaccaaggtcaaggcatattagaggtgacaccttctaggcccaaagatgataaggggaagacaatagaaaagcaaccccttaaggctagtatgcaagagaagactagctccataaagtacttcaaatgtcttggaagagatgaggctactatttcaccttcctctagtgaaagtgaagaagcaaaaaaggaagaatctagtgaagaaatctacccccatgaagaaggacaacctttaatggttaaggaggagtgtaaggag

SEQ ID NO: 7805 - DNA, 384 bp, Glycine max
  Peptide Sequence Number=SeqID_99490
atgagaccaacgtggagacacttcggaaggtccacaaagcatgggaagcagtacaaaagaaggacaaagagctcagaggtagtaacaatgggcccatcggtggctactgaagttgaggcaccggaggaagatgaagaggtgcagacccttagggcagaactcgagcaagttcaaacagtcaaagaaaggttcaaatcgatagctcttaagatccgaaaggagaatgccgaactaagagatgtaaatatagctaccaccaaggccttggagcaagagacaaaaagggatcgtagggaagaacacggctgggacaaatttcgaggggctctgtggggcagtaacagtgagcttaggctctggagagaggagagggaccaatcatga

SEQ ID NO: 7806 - DNA, 357 bp, Glycine max
  Peptide Sequence Number=SeqID_99491
atgctctcctacaacctgagacaaggtagatggagattacaatttataggcttagggttcaagtcaatcaatcaaactttcagctcaacatgggtgcaagggataattcattcatgcacaagctccattggagcttgtaggcctaggatcttcttcatcaatggattccttttcttcttggaagatgaatggaagaagaatggagaaaggaagagagagaggagacgccacttcaaggagaagatgagtctagaagaagctcaccaccataggaggccatggataagagcttggaggaagaaggagatgaatgaagggagagggagagaagagcacaaaattttgtgctctaaatga

SEQ ID NO: 7807 - DNA, 546 bp, Glycine max
  Peptide Sequence Number=SeqID_99492
tccacggatgggagaagttttggaaggcctaaacctttggtgatatatttcaccaaggatgcagcttcacaaaagccccgatacccctcgatagctaaaattgttcctttcccataccaaaacagccacgtagtcccatggaggtatgcacctccgagtgaaaggaaagaagaggccaccaacatcagctcgttatcagccaaggtaaccaatatcacggggttgagcggcgtgacccgtagtggtcgcgtgtttgcaccccccgaccggccgacacaaccagcaaatgttaaagggaaggcaaagatggtggaggaacaaaatgacaaaacgacccccactccgaatgaggatattccagtgaaaggtcttctggagaaaagggaaggctgtggcaagaaggaagtgtcgctagaggaagcaaccaggctggggtttgactgcaccaacaatatggctgagtataaagcgtgtgccctagccgtccaggcagcaattgactctaatgtcaaactgctcaaagtgtacgggactcagcactggtga

SEQ ID NO: 7808 - DNA, 612 bp, Glycine max
  Peptide Sequence Number=SeqID_99493
aggtcatttggtgaagaatgatgctgacagtctcaacgcattcctggagacacctgtggtattagcagagggagagactctacccgcatactctagatactgtaggttgcctacagacttcagagagatagaggctacgtgtcgagtgttctcatactccaacttggcccccacatcacatacctctgatctgacagtgaacagagctaggctgatctttggcctagtctctcatttggatatgaacataagagcgctgatttcaagccagatgacttctatagcccagtctaacacctctaggcttgggtgccctgctataatcaccgcattatgcagagccagaggggttgtatctgacagccttaccttcgagcacatgagcccggtcattaacctagcctacatcaagaagaactgttggaaccccaaagatctaacagtctctatccgaggggctaggagggtgagggcaaggccaactgagcttccttctacttctgcagctcctactccagcatccacttcagtagccccttctgtcctagctcagataaattctcagcgctttgaagccatgctccaaagcattcatcagggacagattgtggc

SEQ ID NO: 7809 - DNA, 357 bp, Glycine max
  Peptide Sequence Number=SeqID_99494
atgacaacctcgatgacaagtgtcggcccttccacctcctctgttggctcaaccctgacactgtgcaccactgcctcttcctccgatggatgcctctacatcgacaaccagatctgtgagggtgtagggtggaggctttgcgggggtggacttgcaatttgtgagcctgaaatttgtccctattggaagcttcttgatgatgcgttgggtgactatgatggtgttgtcagtgattacattgaactttgccagcaacaccgttgttctagccaccaattgggccctcaatctgaatctcttgccttggacgtgtgtggtggttgttgtacagccacaaattgtgatttgattttttaa

SEQ ID NO: 7810 - DNA, 1004 bp, Glycine max
  Peptide Sequence Number=SeqID_99495
atggttctgaaagaggagttgatggcgtgttcaaggtccaaaagaagcttgtctcagcgtctatgcgagacagagaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcaggcacctactccgcccccgaagagattcatgggcttctcggctattggaaaaacgccataactaaacgcgccgcaagggatccctatcgcaccagatccaaatctagaacgatgggtgatcaagaggagacgcaggaacagatgaaagccgacatctcatggagaagaacgcaggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcctctcccgtccatgaaaaagaacctcctcagcagcccgacgaagtccataaagaccctcaagattatgctcggagggatgtcgagttttatcccccgatccccgaagggccggcaccaggcacgttgcctcaacccaacctcgcagcatcgccaatagttttgtctatggaaaggccgcccccggcaactgaagaaaggaggaagctcgatctccttgaggaaagattgagggctgtggaaggatttggggactatccatttgcagacatgacggatctttgcttagtacccgatgttgttattcccccgaa

SEQ ID NO: 7811 - DNA, 198 bp, Glycine max
  Peptide Sequence Number=SeqID_99496
atgagccatatagcaaagatatattggtgggtgtccaagaaaccaactcaatctgatgatatacctcaagcacttgcagcccttaccttagacaacacaattactgaaacagaatggacttctaacaccgaggcctctaatcacatgacaggaacgagaaacagggaaaccaattatcaccgggaggcacaagggtga

SEQ ID NO: 7812 - DNA, 501 bp, Glycine max
  Peptide Sequence Number=SeqID_99497
gtggacccttgggtactagtacctatcacctttagaggactatgtgtcctcgccatcagaggactgcacatcctcgcctgtagagggctgcacgcccttgcctttagagggctacgcgtcctcattttcattcctgggccaccccctgatattggagggcgaccaactgtgcgagcacattcagagagggaggctatcacacatctactatgcataccggggcaagatttcacccgtgctgctgcaaaaagacgagtgtggatcatgcgcaccaacatgaccactcttacatggatatggacgacggatcgcgcccacaagacgcccagtggacctgaagaagtccaacagggccctggggtttccagctctggttacgggcctctggatcgcgccaacaagacacctagtggacccgaagaagtgcaacagggccttgggatttccagctctggttacgggcctctgtcagtcttacagggtgcccgttcccccagcaag

SEQ ID NO: 7813 - DNA, 207 bp, Glycine max
  Peptide Sequence Number=SeqID_99498
atgactgctaagcgcgcatccactgctaagcgcagattcaatgctcttagcacaacagaaaaatctggcaggccatcagcatcaaggttgtgtgctaagcgcgagatcagtgcactaagcgcaatagttgtcttcagccaggctcagagcacaacaggcactaagcccgaatccacttactggtgctacgcacgagggtggcgctga

SEQ ID NO: 7814 - DNA, 504 bp, Glycine max
  Peptide Sequence Number=SeqID_99499
atgccaatctccccctacagatggatcgcgcccacaagacgcctagtggacccgaagaagtccaacagggccctggggtttccagctctggttacgagcctctgtcagtcctacagggtgcccgttcccccagcgaggtcatgccatcgtgacataggaattgcacccacaaagacacccagtggacccagagaagtccaacagggccctggggtttccagctctgggatcgcgcccacaagacacccagtggacccaaagaactccaatagggtcttggagttgccaagctctaattacgagcctctgtcagttctacggagtgcctgtcgcccccaggaaggtcatcagtcccctactaatcgagctttcatcaagaagtactgcatccccaggcaggcgcagggcgaaacaccacagcagcctggggatggccggcagcgggcaacaaacgcaccgccatcacctctagagttcacctcagctcatccacaaaaaggttag

SEQ ID NO: 7815 - DNA, 651 bp, Glycine max
  Peptide Sequence Number=SeqID_99500
gtcggtgggcgcaaacacgcgaccactgcgggtcacaccgctcagtcccgtgatattggttaccttgggcaacaacgagctgatgtcagtggcttcttctttcctttcgtccggaggtgtgtacctctacgggactgcgtggctgttttggccttccaaaacttctctcatccacggactgcatacatatatgctactcttccctcccctcatcaccgacttccagtcggccttgatctatcattcattgcaacaattcctctactgccaaacatgtttccacattatgtagctcgtcgggatgcaacaaacaagaatcctctttatgcccacccaccctacgcggcctatcttgactcaatggcattaaccggctcccccctccatgaattggcgggcagggccaagcattttttgatggaatgccccggggtattcccatgggacggcaagaggtcttcgtacatcattgggagtggggtgaattctggaattggcttcgggagaaagttcctcattgcgttggaattgccggccgggcaagtcgtggttggagccggaacttggggggcctccctctggatgggtgccttagactgcacgggtgctgaattggaggagttcccggcgcgagctgaaaagttcagatga

SEQ ID NO: 7816 - DNA, 707 bp, Glycine max
  Peptide Sequence Number=SeqID_99501
ttcatatacgaggtttagattggctcgccaagttaaaagtcgtcagcgaagagagttttgaagcaccggaagaggacgaggaagtccaagctctcaaaagcgagttaggaaaggcgaaacttgccaaagagaagttcaagttggccgctacacacatccggaaggagtgtgccagattacgggaagagaatgcaactaccgcgagagcccttgaacaagagaccaagagggctcgcaaggaagagtatggccgtaacaaatttcgcggagctctatggggtagcaacagtgaactcaagctgcgaagggaagagagggaccagccgcgagcacatagcatggtcttgaaagaggagttagttgcctgttcaaggtccaaaaggagcttgtctcagcgtttatgcgagacggagaccaacatgctagctatcatcgccaagtatcaagaagagttacgcctatccacggcccacgagcatagggtcgcagacgagtatgcccaagtatacgcggaaaaaaaggctagaggaagggtgatcgactcttacaccaagaggcaaccatgtggatggatcggtttgctcttacctgaacgggagtcaagaacttccccgattgttagccaaggccaaaggcgatggcggacacctactccgcccccgaagaaattcatgggcttcttcggctattgtccagcatatgattag

SEQ ID NO: 7817 - DNA, 420 bp, Glycine max
  Peptide Sequence Number=SeqID_99502
atggaaaattttttgaagaaatattttcctgagtccaagatagtcgagggaaaagctgcaatttcttcatttcatcaatttcttgatgaatatttaagtgaagctctagaatggttctatagcttactgtggaaaactccaactcatggattctctaagcctatacagttgaacatcttcattgatgggttaaggctgcagtcgaagcagttactagatgcttctgcaggaggttatgctatttgtggtggtgctcatgattcaggctgctgcatttccactgaggatcatgcacttgaagttaacttcatgggaaaccagcctagacaaaattttaatgcaggtggattctcaggatttcagcagagccaaaattataaccagcaatatggacagtggagagctcatcctggtagttaa

SEQ ID NO: 7818 - DNA, 432 bp, Glycine max
  Peptide Sequence Number=SeqID_99503
gatgagagaaattctctgtgtggaagatgacgtaaatctccgtgtgtcaacgggcttgttggccgcgattgacaatagggtgcagaagacgacgttagtctctgcgtgctatcatgcattcagtcttagagttagcaaaagaaagtttaaacggataaccactcgggttctccgcatgtcacgtgactccaatgtcagtatgacagaaattgtctacgcggaagatggcgtaaatctccgcgtgtcaatgggcttgttggccacgattgagaaaggtatgacagaaattgttagcgcggaagatgacgtaaatctctgtgtgtcaacgggtttgttggccgcgattgacaaagggatgagagaaattctctgtgtggaagatgacgtaaatctccgtgtgtcaacgggtttgttggccgcgattgacaaagg

SEQ ID NO: 7819 - DNA, 261 bp, Glycine max
  Peptide Sequence Number=SeqID_99504
atgggtgccaaataccacgaagtggtcaaacgagggtcgcatcccaacagcggatggtccccggacgaaattaggacgcagaatgaccataattcgtcttcgcgttttgttggacacgatcgagcctgggcggcgagacacagaatgaccataatttttctctgggtgccaccggacacgatcgcctctggatggcgaaaaggtgtgcagaatgaccataatttgtctccgcccacctctcgacttactgtccccgaatga

SEQ ID NO: 7820 - DNA, 233 bp, Glycine max
  Peptide Sequence Number=SeqID_99505
agcagtttagggctgaggtcacatggcccggagattggcacgaggcccagaaaggggaggctcctgcaggatccccgggcgatgcagaggaggcccgcatggatgaggagatgacggatttgctcggtttcttgggagggagcggagccacacgaccatgggatccccagattcatattctttttatgtttcatcctttatcatttacatgttattttatttcgatgacttga

SEQ ID NO: 7821 - DNA, 1011 bp, Glycine max
  Peptide Sequence Number=SeqID_99506
gaaggaaggcataggtcacatcttagaccttactcccataggagagaaaaggaaagaaagcctcaagaggctaacattaacctcccatacttccataggaaggacaatgtagaggctaacttagattgggaaataagggtagagcaacaacttaaaaagaagtctacgtcaaaatcttatggctctcactcttatccaaagaaagaccaaggtcaaggcatcttaggagtgacaccttctaagcccaaagatgataaggggaatacaatagaaaagcaagcccctaaggctagtatgcaagagaaaactagctctataaagtgctttaaatgtcttggaagacgacacattacttctcaatgcccccccacaaaaaccatgattatgaggggccaagacattcatagtagccaagataaggctactacttctccttcctctagtgaaagtgaagaagcaaaaggggaagaatctagtgaagaaatctaccctcaagaagaaagacaaccattagtggttaaagagaagtgtaaggaggtaagtgtctcctccaagaggttagctaagaaggaaactcattttacaataaagacaaacattaaagaaactttccctcttagacaacctccacattttcttttgtgtaaaaagacacttgttagcacagccacacctcttgggcttgagattattcctcaagtaaaggagctgttggatgagggtttggttcgcaagagcttaaatccttgtgctttgttggtgcctaaaataggtattattaggcaccaaatccctatcataggtggtatgatgaatgtgttgagtggtgcaacactcttttgtaaaatcactcatgcacccaacatcttcatgatttgtgtacataggaactcattaggtagtgatcaagggcttcccatggaccctaagagaataaaggtcattcctgagtggcctactccaccaagtgttgaggaaagaatccatgagcttcagaacctctggatttga

SEQ ID NO: 7822 - DNA, 423 bp, Glycine max
  Peptide Sequence Number=SeqID_99507
atgccgatctccccctgcggaagtatcagttggtctgtgccatcccgacataggggttgcacccacaagacacccagtggacccggagaagtccaacagggccctggggtttccagctctggttacgggcctctgtcagtcctacagggtgcccgttccccccagcaaggggtagcgcccacaagtcacccagtggacccggaggagcccaacaggaccctggggtttctagctctggttacgggcctctatcagtcctacagggcgcccgtccccccagcaagttcatgccgtcgtaacataggtaaagatcgtgcccgcaaaacacctagtggacccggagaagtccaacagggtcttggggtttccagctctgattacgggcttctgtcagttctacggagtgcctgtcaccctggcaag

SEQ ID NO: 7823 - DNA, 765 bp, Glycine max
  Peptide Sequence Number=SeqID_99508
atggatggcatcattgatgtggccattgtgaaggagttctatgctaacctctatgatcccgaggataaatcacctaagcaggtgagggtgagaggtcatttggtgaagtttgatgcatacactctgaacactttcttgaagacccttgtgataattgaggagggggaagagctgtctgtctactctaggtttgctttactgaggacagatcctcaggaattggcagcaaaactatgcatcccagcccctacctctcatacttccgacatcactcttgatagggccagggtgatatatggcatcatccagaagatggatatgaatgttggttacatcatctccagtcacatttcttttattgcacaacatgactcctctaggctgagtttccccgcccttatcactgctttatgcaaggccaggggagtcacttctgattcattgacaattaagagccttggtctagccattaatgtggcatatgtgaagataaactattggaacctcgatgatcccactgttactttcagagggcctcgcaaggccaaggggaagaggtcagaggttctcccatcttctgagattcccccttctgcagctccttcatcttctgatattcctcctataccagcttcaactcccactcccttaccagctcctcctacaggaccatcctccttcacatctaagacattattggccatgttgcagagccttcataaatgccaggttattatcatgcagagcttacagagcttctgttag

SEQ ID NO: 7824 - DNA, 183 bp, Glycine max
  Peptide Sequence Number=SeqID_99509
atggagatggaaagtaaaaggattgagagaattgagaaaggaaaagagaaagagaaagagagaacaatggagatggaaagtaaaaggattgagagaattgagaaaggaaaagagaaagagaaagagagtttagagattgggaaactgatattattgaacccagtcacaactcagattatgtag

SEQ ID NO: 7825 - DNA, 2135 bp, Glycine max
  Peptide Sequence Number=SeqID_99510
gtctgggtgagattgtgaaaccaaagaagcttggtcgacgaaagggttcaaataggataagtaatgtcacagttttagagtctgaaagatcattgttttctggtgaggaagataaagctgaggatgaagttgcaggcctgggtgagattgtgaggccaaagaagcgtgatcgaccaaagggttcaaataggatgagtattatcacagttttaaagtctgaaaggccattgctttctgttgaggaaggtagtgccgatgatgaaggtgcaggcctaggtgagattgtgaggccaaagaagcgtggtcgaccaaagggttccaggaataaaaagaatattttgcatgtaagacctaataagtgcggcaagacgaagggttcaaaaaataaaataaagaatgttgttgaggttggtaatgaagttgctggtgctggtgagattgcaggacctaagaaacatggtcgaccaagaggttccacaaagataaagaagaatgctttggaggttaataatgaagtttctggtgctggtgagatcacaggatttaagaaacgtggtcgaccaaaaggttcaacaaagaaacggtatactgttgtgtacgcttctagtaatgaagtggcatgtgaggttgcaagacaagatctggaaaacaaaatgctgagcaatctgtgtcaaaaagtttctgatgaacttgtaagcataaataataaatatggtccagcaatgagtacaagaagtaactcgaggagttttgtatttgagggtcagaagtttccagggatgtctaatgatattaatttagaaggtgatggtggaagcacaagtgtttggtcaagtggtttggaaaaagaaaaagggaggtctcctaaaccagtcaaagaaattgaaaacagtaagattacttggccaattgttaagcgtggtcgcccaaagggctcaaggaacaagaagataaaactaataggtcaggtcaggacaaagcatggacgaccaaagggatataaaagtaaggctgaagaagctggaaacaattttgacaagggagggaaaaagcgtggcaggccaaagggttctcatagaaaggaaaaggagtctgcttaccattttgattcactgattgagaggcatggtcttgtagctgagaaagaaggaggaacttctgctgaatctgcctccaaaaatgatactggtcaagagaaaaaaatttatagctgtcaaagaagttctagaattacaagacaagctattaagcaaagccaatcaaggggtctaaaagagaagacaccagctgctgttactatagcagatgagaatgagccaaatggtgttactgacagatccatgacaaatgctagaggacaatccttacaaaaacataaaagcactcgtttcagcaaagttttgagtaggattatgccacagaatgatttacaggaggaatgcattacactgctagaagatcaagtacatgaggtaaagaagtcacattttcttcttgaatgctcagagaatcccagaaatgaaaatacaaaaagaacaggattgacttgtgcaaccagcaatgatcagagaagatctagtgaaagactgaaagctttgctaattgatggcaagaattttcagggtgttggaagggaagaaactgtataccatggattggaatcttcagctttgatgtgtgataacggaaagaaaaaggaggcaaggactttaaggtgccaccagtgttggcaaaaaagtaggagtggtattgtcatttgcaccgagtgcaagagaaaacgatattgttatgagtgcattacaaaatggtatccagataaaactagagaggagatagaggtttcttgtcccttttgtcttggtaattgcaactgtcgattgtgcttgaaggaggaggatatatctgtgttgactgggactggtgaagcagatacagatgtcaaattacaaaagttgttttacttgcttgacaaagttctgcctttactccaaagtatccaattggagcagatatcggaattgaaagtagaagctaggatgcaaggttcacaactgctggaagaggaagttgtgcattcactaattgatgatgatgaccgtgtttattggtactacatcatgaacccttatggttga

SEQ ID NO: 7826 - DNA, 429 bp, Glycine max
  Peptide Sequence Number=SeqID_99511
atgaaggctgacatagaggccatgaaagggcaaatgaccacaaggatggaagccataatatgtatgagaaacgtgatggaggttaacagggctacagtcattgctacaagtaccaccactgaggtggacccgactcacccatctggcctcaaccaagtaaatcccccagcctcggatacagtaggtcagggaggcaaagcattgggaagtgcgggtgacccccattattgcaagtctagagcaagcattccttcccaacatatgtcttgcctcccaactatacaccacccaatgttgcacatgctcccaatgagaatgttgataactccgctctcatactcattaagagccaacaaccccaatctggtcaggcataggtctctcaacccatgggggagacacatgaagtaccccgagaccacactctag

SEQ ID NO: 7827 - DNA, 742 bp, Glycine max
  Peptide Sequence Number=SeqID_99512
tcggcttagtggaagtgtgaccacaaacttggcactagatcctcaagaaaccacaaatcagcgagcatactccaagtaccactatgttaggctatttgaaactttgaggattgactccttaacacactatacatcgaggttttatatttgtgtcactatcgggacctcgtcccccacactttgtggtgtgaaaaccgctaatcggccggccttgcaagctcatgcaactttcaagtacaatgccccacgtgacactcttcaacttgcatctcaatgctccactgcacattcatacaaaacttcttcaagctccaaagcttcttcatgttgctcccatatctctaacattgatggcactgatagtgcacctaagtatatggagtacttcatagacggttctctagagtatgtacttgggccatcgtatgatggggagaactctaagcacaccatgactgcttcattttctacgagacccacaccactattggagcgtgactacccagatgaggaggtggcatctctagtcattgacttatgggacaaggagaagatggaggaggatccaaagatggtggaggatgatcaaccagaggtagaggaagaggacaacatggcaccggtggcggcaactagcgaggaggttcaccaggaaggagtcaggtggcttattgatgacaacagtgaggtggatcctaataaggatatgcatgatgtatcctcacagggatcctattgttag

SEQ ID NO: 7828 - DNA, 228 bp, Glycine max
  Peptide Sequence Number=SeqID_99513
atgagattttggatgtttagcattttacttctaaatgaccatttagaggaaacaccaggttcaacaaaaatagaagaaaatcactcaaagtgtatcaatctcacacagagcaaggatggacattctcaccctgggtcaaggtttatggtaagttgggattttggctcaaggcttgtagaacggctggacatgataaatgtcagggcgtgggtttggccagcggtttag

SEQ ID NO: 7829 - DNA, 204 bp, Glycine max
  Peptide Sequence Number=SeqID_99514
atgatggcacatcacccgctaagtgagaaaggcgcactaagcgcaattccaactgaggggaattgcgctgagcggcccaaagctgcgctaagcctatttccaaccgagaggaacatgaaaaacacgattttcactctctcttctcccaaaacgtctccaaccctaaaccttattttcgtcacccagatcaccggtggcgcgtga

SEQ ID NO: 7830 - DNA, 386 bp, Glycine max
  Peptide Sequence Number=SeqID_99515
ctggtatatacctagtttccttggtctttatagtcttctcaagaggaggctataaacagaaggatgtcttggctacagaagtttcctctcttagaggagagttgctacaagtaagagatgagcgagaccggcaattatctcaagtacaaactttaagttctgaattagagaaagttaaagaatctaggaaacactcctccactaaattggatagcttgaccttaaaagctaatgatctggaggaaaaatgttctttgaaagataatcagataaaggcattggaagagcaactagcaactgcagagaagaaactgcaggtgtctaatatatctgcatacgagacaaggacagagtacaaaggacaacaaaaatttgtgaatgagtaa

SEQ ID NO: 7831 - DNA, 297 bp, Glycine max
  Peptide Sequence Number=SeqID_99516
atggttgctcacatcccagatccaagggttgatccttctcaatatcgtgatttactacattattggtgttctaagaaaggacaaaaaataagcaacattaacaaaaggaaccgctcaaaatatcaggacttgcattgcatgggaaccaagaatcttccaagacggattcatgagatgacaacaaaggctaagggagtgcaaccttctcgggtagaaatttatattgacactcgaactcgaaaagatggaagcattgttattgaaaaggctgctactgtaattaaggttatggtgtaa

SEQ ID NO: 7832 - DNA, 104 bp, Glycine max
  Peptide Sequence Number=SeqID_99517
atgacctaggatcacttcctagatactgcatttttaatgtttatttgattcgggtatggcctcaatcaaatttggcgccgttgccggggagtagtggtccaaag

SEQ ID NO: 7833 - DNA, 330 bp, Glycine max
  Peptide Sequence Number=SeqID_99518
atgacagatcttgtgagcgcggaagatgacgtaaatctccgcgtgtcaacgggcttgtcggccgcgattgacaaagggcagcagaagacgacgttagtctctgcgtgctatcaggcttttcgtcttacagacagcaaaaagtttatacggataaccactcgggtatttccgcccgtcagcgtgactcaaaaacagcaaaaagtttatacggataaccactcgggtatttctgcccgtcagcgtgactcaaaagtcagtatgacagatcttgtgagcgcggaaagatttcgtaaatctccgcgtgtcaacgggtttgtcagccgcgattga

SEQ ID NO: 7834 - DNA, 228 bp, Glycine max
  Peptide Sequence Number=SeqID_99519
atgcatatgacacagatgcaatttacgaatacgggagcccgagaaactgtctccttcttagatacaacgtctaggggtagcaaagtgccccaacaggggatcaagacagaacccatgtgcgatgcatatgcgaaaggcagtgtgaatataagtaaaagggtatatgacacttatgcatggcagtgtgaaaaatggcacgcagcgtgtttgctccgtgcccctatttaa

SEQ ID NO: 7835 - DNA, 183 bp, Glycine max
  Peptide Sequence Number=SeqID_99520
atgcataagaaagaactacgtaggtctgatttcctctccaaaggagggctgttgtcctttgagacaaacgtgagacaaacgttggtggcgactccgcacatctttcctcctttggaaagtgcacccgtgagcctcgccctcgctcgcccgcgaagggcacgttgcgacaggagggttttgtga

SEQ ID NO: 7836 - DNA, 195 bp, Glycine max
  Peptide Sequence Number=SeqID_99521
atgtcgttcaccaaaggaaagatgtgtgtaaatgaaatggctccaaagaaactctccacgaagaggtctagaagggacgccacaggagaaggatccagtgctgccttagagtttgatagtcaccatttccggagtgccaagcaccagcagcgcttcgacgccaacaggggatggtcattccgtgggatcctctag

SEQ ID NO: 7837 - DNA, 846 bp, Glycine max
  Peptide Sequence Number=SeqID_99522
atggaaaaatgcctcatcttctttacgttcaaggaatcatttatgtcacgcattttagtgttaactgcccaccgcacccccgacgagtcgcgcatcaaccaggcgctgatcgaggccgtgcgcccgctgcctaacgtgaccgtgcacgaactgatccgcgcttacccggattaccgcatcgacgtggcgcgcgaacaggagctgctggaaagccacgatgcggtggtgatgatgttcccgtttttctggtacagctcgccggcgatcctgcgcgaatggcaggacgcggtattaacctatggtttcgcctacggcagcgagggcaccaaactgcacggcaagccgctgcagttggtggtgagcaccggcggcaacgcgcaggcctacacgccggcaggctacaaccgctatccggtgcaggatctgctgctgccgttccacgcgctggctaacctgaccggcatggattatctgccgccgcacctggtgcagggcgtgagcgacatgagcgatgagcagttggcgcaagcggccgccgggggcgcagcgctcgccgcgccctgcggggtcagtcttcgagcagccaccacaccgcttcgaacggccgcagcgtcagcgcttgcggctgatccgccgagtcgctgtagttgctcatcagcggacgccactgcgcggaggcttccacgccctccgccgcccaggccagcggttcgcggctcaggttggccaccaccagcaggcgctggccgttccagctgcgctgatagcaccacagcgccgggtgatccggcgccagatcctgatagtcgccgtgggttagcagcggatactgcttgcgcaggatga

SEQ ID NO: 7838 - DNA, 117 bp, Glycine max
  Peptide Sequence Number=SeqID_99523
atggaggaggcacgaggagaagctttggctgcacaacaacactggtttcgtaggagtaataagccttctggtaatcgattacaggatgttgtaatcgattaccagagcataaactag

SEQ ID NO: 7839 - DNA, 210 bp, Glycine max
  Peptide Sequence Number=SeqID_99524
atggccaccatcatcgtggccatttgctctttcatggcctccatgtcggccttcatcttctcttgtacctcctctacttcacccattactctagctctggcacaggttcgaaatgggtttatgatcccaacatggttggctcatgaggaaaacacaaggatcatgtatgatgatgcaatgactcatgcaaaatgtgaggctggaatgtga

SEQ ID NO: 7840 - DNA, 132 bp, Glycine max
  Peptide Sequence Number=SeqID_99525
atggaaatcgaaaggagattcttcctccagaaggctgttgcttctggaggaagcaaccttgctcgcttaggcgagctgagctcgcctgggcgagctgggtggcaagctcctcctctattttgctataaatag

SEQ ID NO: 7841 - DNA, 181 bp, Glycine max
  Peptide Sequence Number=SeqID_99526
gaagcaacccagcttgcctgggcgagctgggcggcaacctcctccccctttttcctataaataggctgaaaggggctgttctaaggatcccggatgcccctggtgaggtttccgtaagcaaatccgtgaaggttttcctccgttattcatcgttcttcatccgttcttcgttcttcaacga

SEQ ID NO: 7842 - DNA, 207 bp, Glycine max
  Peptide Sequence Number=SeqID_99527
atgccggaaatgtcgtggtatcactccagagcgagaaacgtttcagttgtcaggaaacgggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 7843 - DNA, 779 bp, Glycine max
  Peptide Sequence Number=SeqID_99528
atgaagttactacagaccgtgggggagagatggaggcagtttaaatcagatctcacgaggaaatgggcccttgcagccgatcaggacggtgtcgaggacactgtctgtgacaaatacggcatcagcaaggaaaagtgggcccagttttgccagactcgcagagacccttcttgggagaagctcctggctgagaagaccaagaagaagatgcaggaagctgcacaatcaggaagcgttgatggcgtcatcgaccctccatccccggtcagacgccacgtgaagtggaagatggccctcacgaagaagacaggggagatgacgactgaggccgcaaaggaaatcgctgagaagattgattcgtttgaggagcaggccacacagggatcgttcgtccctcatggacgtcaggatgttctggccgctgctattggacgtccagagcaccctggacgtgtccgtgctgctggagccggtgtcaccatcaagcaatactttggattggctccacggacgtcccgcagcgcttcctccctgcctcctgacgaattacagcagctgacccagcagatcagggaccagctagaggagtccatcacagagaaagtgacgaggcaggtcatggcatccttcagccaccttcagtcgcagatgcaatctcagggagttgtagtgcctcctgagcctgtggttggtcttggtccctccggtcctcgagtgagcacaaaggggagttgtgttgatccctcaggaaacgatcctgagaccggtgactctgacag

SEQ ID NO: 7844 - DNA, 357 bp, Glycine max
  Peptide Sequence Number=SeqID_99529
atggcacgcagagacagattatgttcattctgcacccttttgttatccagaggcggcgagcccgatgacatgcggagacaaattatggtcattccgtacaccttttcgccattcggacacaatcgtgttcgatggcacacagagacaaattatggtcattctgcacccttttgtcatccagaggcggtgagcccgatgacatgcgaagacaaattatggtcattccacacctttcgccattcggggacaatcgtgtccgatggcacgcagagacaaattagggtcattcggcgcctttcgtcaatcgagagtaacgaattcggaagtatcaggatgatgttggtcgttcggcgctga

SEQ ID NO: 7845 - DNA, 540 bp, Glycine max
  Peptide Sequence Number=SeqID_99530
atgggtgaagtagaggaggtgcaagagcaaatgaaggacgacatggaggccatgaaagagcaaatggccacaatgatggaggccatgatgagcatgaaaaagataatggaaaccaatgcggttgcagttgccgctatcagcattgttgctaaggtgaactcgatgcccccatctggcctcaaccaaatgaatcatccaacctcagctatggtaggcaaagatttgggaagtacgagcggcccctattatgtgaaaattcaaaacaagcacgccttcccgccatatagcttgcctcccaactatacaccacccaatgtggtgtacactcttgatgaggatgtcaataacttcgctcccatactcattgagagccgacaacctcatcatgcacatgtctctcaacccatgggggagacacacgaaattccccaccacactctagtcgacttcgagccttgcctcgaatatgccactgaagggcaagtagttggtgatatacctctgcaaaacactttggagggccctcagtatcagccataa

SEQ ID NO: 7846 - DNA, 4299 bp, Glycine max
  Peptide Sequence Number=SeqID_99531
atggcttctccgccttcatccaccttctgttgctgcttgcggtttcgctgtcatgggtttggaacaaaatcacagcaggtgccagggatgagtccaaggagaagccaagccacaccctcttcaaaacgacgtggctggtcagaagaaaagcttgtgacccttttggatttggcgctaaaaacacttgcttggggcgttgtttgcgtttgcttgcaaaatgggttcttcagttccggtgaaagaaggttctcgttcttcttcagagcctggtgcactttctaccttgttgtttcttgctattgcttcgtggtggacattgttgttgtatcggagagacgtgttgctctgccaactcggtacttagtctctgatgtggtctccacttgtgttggtttgttcttctgttacgtggggtattttgtgaaaaacgaggttcatgttgataacggtattcaggaacctcttttgaatagcgatgccttggagtcaaaggagagcaagggcggggacactgtgacccctttctcatatgctgggtttttgagcattcttaccttctcttgggtgggtcctcttatagctgttggtaataagaagaccctggaccttgaggatgttcctcaactagacggcagagatagtgtaattggtgcttttccaagtttcagagagaaacttgaggctgattgtgggggaattaacagagtcaccacactgaagttggcgaagtcgttaataatgtcagcatggaaggagattcttatcacagcttttcttgcattgttaaacactttggcttcttatgttggtccatatcttattgacggttttgttcagtacctggatggacaacggctatatgaaaaccagggctattttttggtttctgcatttttctttgcaaagcttgtagagtgcctgacccaaaggcattggatctttaagttgcagcaagttggactccgaatccgagcactgcttgtcacgatgatctataacaaggctcttaccctttcttgccaatcaaagcagggccacacttctggggaaataatcaatttcatgactgttgatgcggaaagagtaggtgtcttcagttggtatatgcatgatttgtggatggtggctctgcaagttacgttagccttgttgattttgtataaaaacctcggtctggcttcaattgctgctttagttgcaactgttgttattatgttagcaaatgttcccttgggatcgttgcaagagaagtttcaaaagaagttgatggagtcaaaagatacaagaatgaaggccacatctgagattctaaggaacatgaggatcctcaaactacaaggatgggaaatcaagtttctatcaaaaataaccgagctcaggaaaaatgagcaaggttggctaaaaaaatatgtttatactgcagcggtgaccacgtttgtgttttggggttcccctacatttgtatctgtggttacttttggtacttgtatgcttatagggatcccccttgaatcagggaagatcttgtctgcacttgcaacgttccggattcttcaagagcccatttaccgtcttccagatacaatttcaatgatagcacaaactaaagtttctcttgataggattgtgtcattccttcgtcttgatgacttacggtctgatgttgtagagaagcttccttggggcagttctgatacagcaattgaagtagttgatggaaacttctcttgggatttatcctcccctaatccaacattgcaaaatataaatcttaaagtttttcatgggatgagggttgctgtttgtggtacagttggatcaggcaagtctactttactttcttgtgtattgggagaagtaccaaagatatcaggcatccttaaggtttgcggaacaaaggcctatgttgctcaatctccatggatacaaagtggcaagatagaggataatatattgtttggtgaacgcatggatagggaaaggtatgagaaggtacttgaagcctgttccttgaagaaggatctggagattttgtcatttggtgatcagacaattataggagaacgtggaataaatttgagtggtggacagaaacaaagaatacaaattgcacgtgcactttaccaagatgctgatatatatctatttgatgatccttttagtgcggtggatgctcacacaggatctcacctctttaaggaatgcttgctgggccttttaagttcaaagacagtggtttatgtcactcatcaagtggagttcttacctgctgctgaccttatattggtcatgaaagatgggaaaattactcaatgtggaaagtatactgatctgcttaatagtggtgctgattttatggaacttgttggtgcacacaaaaaggctttgtctacactagattccttggatggagcaacggtatctaatgaaataaacgccttggaacaagatgtaaatgtctctggcacgtatggttttaaagaaaaagaggctagaaaggatgagcaaaatggtaaaacagacaagaaaagcgaaccacaaggccagcttgttcaggaagaagaaagagagaaaggtaaagttgggttttcagtttattggaaatgtatcacaacagcatatggaggagctcttgtaccattcatattattggctcagattctttttcaagctcttcaaattggaagtaattattggatggcctgggcgactcccatctcatcagatgtggagccacctgttgaaggaacgactcttatagcagtctatgttggtttggccattggaagttctttctgcatccttgccagagcaatgcttcttgtcacagctggttataaaacagctactatactctttaataaaatgcacttctgcattttccgtgccccaatgtcatttttcgattccactccaagtggacgaatccttaacagggcttcaactgatcaaagtgcattggatacagacattccttatcaaattgcatcatttgcgttcatcatgatccagcttttgggaattattgcagtgatgtctcaggctgcatggcagcaatattatattccatcagcccgagaactagcacgtttagttggagtctgcaaagccccaatcattcaacacttttctgaaacaatttctggtacttcaactattagaagctttgatcagcagtcaagatttcaggaaacaaatatgaaactgactgatggatattctcggccaaagttcaatattgccggtgccatggaatggttgtgcttccgcttggatatgctgtcttctatcacatttgccttttccttagtattcttaatatctattccacagggattcatagatccaggccttgctggtttagctgttacatatggacttaatttgaacatgatacaagcttggatgatatggaatctctgcaatatggagaacaaaattatatcagtagaaagaatacttcagtatacttgtatttctagtgagcctccccttgttgtggacgaaaatcggccagatccttcctggccgtcatatggcgaagttggtatacaagatttgcaggttcgttatgctccacatctcccacttgtgttgcgtggtcttacatgcaaatttcgtggaggactgaaaactggcattgttgggagaacaggaagtggtaaatccactctcatacaaacacttttccgaattgttcagcctacttccggccaaattatgattgacagcatcaacatctcttcaattggacttcatgatttgaggtctagactaagcattattcctcaggatccaacaatgtttgaagggactgtgagaaataatctggaccccctggaagaatacagtgatgaacaaatttgggaggccttggataagtgtcaacttggagatgaagttagaaagaaagaaggaaagctcgactccaaagttaccgagaatggtgagaattggagtatgggtcagaggcagttggtctgccttggcagggtgctgcttaagaaaagcaaggttttggtgcttgatgaagccactgcatcagttgatacagctacggataatttgattcagcaaactcttaggcaacaattctctggctctacagtaattactattgcacatcgaataacttctgttctacacagtgatatggttctgcttctcagtcaaggactcattgaggagtatgacaccccaacaaggttgatagagaataagtcatcatcttttgctcaacttgttgctgagtataccatgaggtccaactccagttttgagaaatctgatgatcattga

SEQ ID NO: 7847 - DNA, 1652 bp, Glycine max
  Peptide Sequence Number=SeqID_99532
atggccttccaactcaaacccgaacctgggtctccgcctatgtccacttccaccacccagaaaaactacaaagaaatgagcatttctcagcttgtctcggttttgcgtgtttcgtttcaaacggaggattttgataaagttgaggaagaattggcgaacagggacgccaaacttaaggcggagattgagccactccgggagaagatcgaggtggagaggctcaagaggattgaagccgaagaaaaacttaaaaatagagatgagcaatgcgaaaaggggaaaagagcacagcaaaactatgagcagttgttgaaggaagtgaagaaaaacggtttggttgaaaaaaacacgattgaggagttaaggcaaatgagcctcgctttacaacgtgaaaattgtgagctgaagggcttaaagaaaaaatggctagatgatggcaaatctgtgggtgaacttaggagcaggatcagtgtgttggaggaggagaagagtgctcttgatgcccttagcaccaagaacagtgaattgaaggaagcaatcaagattaaattgaccgccatagagggtttgaggaccgaaaactgtaaattggcagatgagaagcgcagacttgagacattgatggagaatttagagaggaaatttgcggaaatcggtgtcaagattgtgaagttggaagatgcaacacagtctttgttagatggcttaaaagctgaaggaattactgtcaatgttgaagaggttggtgactacaagcttgaaaatgacactgggggccatgttcccttccaaaggaatgaagatactcgtcactcaattgatgctcagtctcttagcaaagggaataaggatgctctaggtgcatcagggttcaaattggaattggaaaatgagatcataaacctagatgatgatgatgatgatgatgatgatgatgatgatgatgatgatgggtgtacatcaaaaggattgcatggaaagaaagtcatttctcaaattattgcagaaaatgaacatccaagttcatcggatgcaatccagcacaaaagcatttttacagaagcacaaaggtttgaagcaatcaaaagaaaatgtttatctgacacgcagagttctacttccacatcttctgatgacgatgattcatttgagtttgacgaaggtaatccccccaagagaagaaaaactgcaccagacagttctggagtaaactctttgccaaggtctcttccttcaaaattcaaattcaaattccaaggtttcactttttctctgttttctatccctcaacaccaaaaggtcgacaatggtgtcgccacgtcggagaaaacgatgtcggcagcggaaaattccaaggaattgggcaccttggagcctcctgctgatcctggagaatacgccgtttttggaggcgcagaactggatgacctttctcttaactctctcgccttctctctctctctctttctctctctctggcaaccaatgaagattagacttggccgctgtttgaatttgaacaaggaaaagattgcagacctgggtctcgaggactcaacccttctatcttatatggttgaagtggcgagattaccatcctggaaaatcatcttggattgcgctatgagtgcccaagcaattctaagatacag

SEQ ID NO: 7848 - DNA, 231 bp, Glycine max
  Peptide Sequence Number=SeqID_99533
atggagaccaccaacaccccatgtctgactgttgtcaaagcaatgttagacattttcagtgctggaagcgacacttcatcaacaattatgatttgggtaatgtcagaactagtgaagaacccgagggtgatggagaaagtgcaaattgaggttagaagggtctttgatagaaaaggatatgtggatgaaacaagtattcaagaagtgaaatacttgagatcagttatctaa

SEQ ID NO: 7849 - DNA, 603 bp, Glycine max
  Peptide Sequence Number=SeqID_99534
atgtttcacacatccttgattgcaggtctggtagtttctgttgtggatcctcaacctggtgaaactattattgattgttgtgctgctcctggcggaaagacccactacatggcctctcatttaagtggccaagtggttgagaattcttataaagagacagcaaagttgcaccaagtggatggtatcattattgccatccatgctgatcttcgtacattacctgatagcggacagcttaagagtaacaaagttttgttggacgctccatgctctggacttggtgttctttccaaaagagtggacttgcgttggaacaggaatctggaggatatggaacaactgaaggaatttcaggatgagctcctggatgcagcatccaaattggtaaaacctgggggagtattagtttacagttcatgctccatagatcctgaagagaatgatgacagggtatttcttgtaacacatccggatttccacattgatcctgtagacagatatgttcctcctgattttgtgacaagcagtggtttctttttctccaacccagttaaacattcagtagatggctcctttgcagctcatttagtacgagatttatag

SEQ ID NO: 7850 - DNA, 1005 bp, Glycine max
  Peptide Sequence Number=SeqID_99535
atggatgaagagaaaggccaagaaattgcttttgtgcagtttcctcaaaattttgagaacctcggtaagaatgatttgtatgggaatgctatatcagcaactgtggaggtggagctccatggtgcggatggttatggtggccctttgtttattggaacttgttgctttcatagaagagacgctttatgtgggaagaagttcaattgtcaatacaaaaatgagtggaatgatgagaatgagaaagaggtggttaaagcaaacttgcatgaactagaagtggaatcgaaggcactagcaagctgctcctatgaggaaaatactctatggggaaaagaggacgtgataacagggttgtggatacattcgcaaggatggaaatcaatatactacaacccaccaaggaaggctttttttggtattgctccaactaacttgcttcacacactagttcaacaaaagaggtggggtgaaggtgacttccaaattttgttcactgagtacagtcctacatggtatggtgaaggaaagatcaatttaggcctactaatgggatattggcgctttaactattcggcaaccacttgtttgccaatactatattactccttcatcccttcactttatctccttaaagccattcccttgtttccaaagatgtctagcccatggttcatacctttcgcatatgtaatactcggggagagttcttctactttgattgagggtttgatttctggaggcacaatcaaggacattgtctggaaattctttggacgttcatattcatcctttgctgtcacaactaagattgtagaagatgatgatgtttcccaacgttacaagaacgaggtcatggagtttggaacctcttctccatttttcactgtactagcaacacttgcattactccatttgttttgcttactagccactataaaagagttagtcctttgcaaagttgctttgactggacaagggcagattgccaagctctcatactattaa

SEQ ID NO: 7851 - DNA, 1242 bp, Glycine max
  Peptide Sequence Number=SeqID_99536
atgagaaaatcagttaaggtggtttggcatgtacaaagaaggccacaagagattcctgcagagataagcaaatcaaatggaaacaatttacttgtcgatgataaatccaaatacaaatcaatgtggatccgtgcatactcatctctgtggatgctagcgagtgtctcactaatcatatacttgggtcatctttacatctgggccatggttgtggttatccaaatatttatggccagtgagctcttcaatctacttagaagagcatctcaagataaacgtctccctaagtttaagctcttgaactggcattatttcttcacagcaatgctattcgtatatggccgtattctcagtcaacaacttgtgaatactgtgacttcagataaactcttgtatagatttgtgagcaacctgatcaagtatcagatggttatatgctactttttatatattgcaggttttgtatggtttattctttcattgaagaagagatattacaagtatcagtttggccagtatgcatggacacatatgatacttattgttgtgtttacccagtctgcgttcactgtagccaacatatttgtagggatattctggtttcttttccctgcaatcctcattgctatgaatgatgttggtgcatatttcttcggtttctattttgggagaacacctctgatcaagctttctccaaagaaaacatgggaaggtttcattggagcgtctgttgccactatgattgctgcatttacgtttgcaaacttcttgggtcgcttccagtggctaacatgtccaaggaaggatttatcaactggttggcttcagtgtgaccctgacccaatttttaagccagattacattccattgccaggattgatttctcattggcttccttggaaagagatagcagttttgccagtacagtggcatgccttgtggatgggactatttgcgtcaataatagcaccatttggaggtttttttgctagtggcttcaaaagagcttttaaaatcaaagactttggtgatagtatacctggacatggtggatttacagacagaatggactgccagatggtaatggctgttttcgtctacatttaccatcaatcatttgttgtaggccaagactattcagttgagatgctattggaccagataatgaggaaccttggttcagaggagcagctatctctctacacaaaactcgggaagatattgcaagaaaggcatttatga

SEQ ID NO: 7852 - DNA, 1371 bp, Glycine max
  Peptide Sequence Number=SeqID_99537
atgtccttgttaacatgtatcatattcatgaatgacatgctctcatttaccacaaaagtgaaaattgtttctatggagagacaacttcacttagcccagaaagacctgaaaaaattaaaggaacaactaaagaatgcagaaactaccaaggctcaagtcctggtggagcttgaaaaggctaaaagagtggttgaggatctctcacaaaagcttaaagttctcggtgaatccagagaatcagctattcaggcaacagaagcttcaaaaaatcaagcaaaacagcttaaagaagaaaaatgtggtgatcctggtggaaccaatggtgcttggaaagaagagttagaaactgccgttaataattatgcttctgtcattacagaacttgatgttgcaaagaaagaactgagtaaaattcgtcaggggtatgatttatcctcggaagcaagagtttctgctctcaagcaagcagcagaagctgaagatgcaatgaaggcaaacaccaaaagagcatgtgagctatctaaagaaattttggctgtacaggaatcagttgagaaaacgaatgctgaatttgtccaagcacatcaactgcaagaagagacattagccaagcaaaaagttctaagacaatcatatgaagccatccttgaagaatcaaaaaagaagatggagctggagaatgtaaaaagagagcactctgaattgaaggagaaagaatctaaaactgaatctgttgttgagaatcagagggtagagctccggaaaagcaagtctgaactcgaagctagagttgcatcagaggaaatgatcttgacattaaaacagttgttgtctgaaactgaaaatgcaaaaagggaaacagaagatatgaagagtgaggcagcagaattgaagatggaagatgcagtcactaaacttgtgttagaagatgcagaaacaaagcttaaaggagtgttggaagaagtggaagctgctaaagcagcagaggcaagtgctcttgatcagattaaggttttatctatgaggactagtccttctcattcatcaacttctgaacctggtgcaagaattacaatctcacgagaggagtttgaaaccttagttaaaaaggttgaggagtctgataaattagcagacataaaagtggctgctgccacagcacaggttgaagttgcaaaggctagtgaaaatgaatttctaaaaagggctgaagcagcaaagaggacggtggagggtgagctcagaaagtggcgcgaacaagagcagaagaaagcagcagaagctgcatctcgaatattggctgaaacactgatgtccccagaactatctcctcagcactataggattcaaatgcagacaaggtggagatga

SEQ ID NO: 7853 - DNA, 3528 bp, Glycine max
  Peptide Sequence Number=SeqID_99538
atgccacaggaaaccttaccaaactctaatttcatatctcctcttaagagaggattgaatttgaaaggttcggcggcttcagcatgtaacaacaatgagactttacacagtgtgacggaggagaccatcaacgatcatgaattggctcagagaaaagcagaggaagcagcttcaaggaggtacgtagcagcagaatggcttcggcaaatggacaatggcgcgtcttcatcactctccaaagaaccctccgaagaggaattctgcctcgcactccgcaacggtctcattctctgcaacgtcctcaacagagtcaaccccggcgctgtcgtcaaggttgtcgacaatgcggtggtcgataacgtcgccgttcagtcttcggaggggcccgcccagtctgcaattcagtatttcgagaacatgcgaaactttctcgaagctgtcaatgacatgaagcttttgaccttcgaagcttccgatttggaaaaggggggttcgtcgagcaaagttgtggactgcattctctgtttgaaagggtattatgaatggaagctatcgggtgggattggagtgtggaggtatggtggaactgtcaggattacttccttccctaaatggtcttcttccaacatactgggcactgaaagtgttgttgatgagactgagtcatcgcagtttcttcatctgtctggagaggtttcagttgaagaaaccaaagctgttaatgctttggcttctgtttttgatcagtttggactcaaacttttcctggcttacctcagagaggctgatggggttgatgatctgcctttgaatgcaatggtaattgatactttgctcaggaaggttgtcaatgatttttctgcattgcttgattctcaaggcactcagcttggacatttcctcaagaaaatattgaaaggcaatactggttgcctctccaagagagaattcatagaagctatcacattatatctaaatcaaagacgtagtttggcatcaaatgaattctctaaactatgcacttgcggtggaaaacgcgatagtaatcagcacaatgccagttattctgccaagcatgctgaaataagtgatgcccagcaaaaagagctcgagaaactgaagtacttctatgaagagataaaattggaggtcaaacaaattcaatccaagtgggaccaagaattgagaaggcttggtaatgatccaaagacttgtttttccatgaaaaatattcttcatttgagttctatgtacttcttagagagtcatataaagagccttgaagaggcctcctcttcctaccataaagtcttggaggagaaccgctctctttacaatcaagtacaagatctgaaaggtacactagaatccgagatgctttgtcaaggatctacttacattatttatcaaggaaaagatgctagaagggtattttcattcaataaggtgtttgcaacaagtaccacccaagagcaaatatatgctgacactcaaccattggttaggtccgccttagatggctataatgtatgcatctttgcatatggacagactgggtcaggaaagacctacacaatgagtggccctgatctgatgactgaagagacatggggtgtaaactatagggctttgcgtgacttatttcatatttcaaaggaaagagcagatgccataaaatatgaagttggtgtccagatgattgaaatatacaatgaacaagtgagagatttattagtcagcgatggctctaacagaagatatccttcaaatatacgaaacaactctcaattgaatggtcttaatgtgcctgatgcatctttagtcccagttaattgtactcaagatgttcttgatttaatgaaaattggtcagaagaatcgtgctgttggtgctacagctctaaatgagcgaagcagccgttctcatagtgtgttgacagttcatgtcagagggagggacttagtgtctaactccattcttaagggttgtctccatcttgtggatttggctggaagtgagagagtggacaaatctgaggctgttggcgagagactaaaggaggcccagcatataaataaatctctttctgcacttggggatgttatctctgctttggcacaaaagagtccacatattccttatagaaatagcaagctcacacaagttctacaagattcattaggtggccatgcaaaaactttgatgtttgttcatataaatcctgaagtcaatgctcttggagaaacaattagcacacttaagtttgcagagagggttgcaaccattgaacttggtgctgctcaatctaataaagaaactggagaaattcgggagctaaaggaagagatatcaaatatcaaatcagcattggagaggaaggaaactgaactacaacaatggaaagctgggaatgcacgaaatgccatagaatctcagaacgcagcaccaagagctgtttcacctttccgtttgcccaaaaatggtaccagtgacaacatgaagcctgaaaattgtcaaagacccatggatgatagaagctctgaggctaaaacttgttcttcgggtaagcaaagaagatcaagatttccctcaacatttatagagaaggactccatgccaaaaatgtctcttctagctgaagaaaaattagtgagctcagggaaaggtagatcaccatcacctccagtcaggaggagatcaatatccactgatagagggtctgtcattaaaagcaaggtcaaaagtgacacatcagacaaccaaccaatcttaaagcatccatttccaactagagtactagtaaataaattgcttgtcacaatgccaatggcctcatctacaggcaataactcaagggtgaatctgcattcacaggagccagtgaagcaggataacactaatgaaactctcttcaaccaccagaaggtcaactccaggaaagttcatcaagaacacgaagaggaacaaatcaagcaagctcctggttcagtaagacaaggtggtactaggaaaaacaaggctgaaagtaaggccaaggttaagcattttcagcacttgccctttaggattcaaaaggctgatatgatacctggttctgacatggaaattggccgagaaatgaccatggaggcacctcggaaaagcgattattttgagtcagaaaatgatatacgcctcatggagtctgcagtcaatggtgttgtaaatattaaaaagatacatcagaacatctctaggaattctcagaacattggatcaagaggaataatgcaagcagctgagcctttattgtccagcaaagttgaaaacaaaattttactacatggtacaggtcgcaatcttaaggagggcaccaatactacattgcctgaatttagaaggagccgatctacgccactgacaactattgatgttcatgttggagtgccggctcacataattttgttgactgaggtctcgagaggaaatggtcaaagaataaccaggaattggaggcaacaagatgatgatttccaatatgataattga

SEQ ID NO: 7854 - DNA, 330 bp, Glycine max
  Peptide Sequence Number=SeqID_99539
atggacaaggccaatattgaacctcaccttaaatgttccccttgcattgtaattgaccctgttattctccacttgcctttgaagttttacaccaacatcttgcgctcaatgttcaaggactcaaacctcagcccaattctcctgttaggattggaaaaatttgcaaggagagtgaattcaccattgaggtactgtggtgagtcaaagtacaccacattgaggcttgcattgggaatgtcaaacgtggggtttcgtggtttcatggaaagtcgaggttgcccgaaaattgctctagtgttggcaagggaatttggtgcttctgattgctga

SEQ ID NO: 7855 - DNA, 1582 bp, Glycine max
  Peptide Sequence Number=SeqID_99540
gactgttgagaaacacttacagacctttgcacatcgcgagcgaaagaagatgccagatatgttgaactggtttggatggtgtacatgggatgctttctacactaatgtcacttcagagaatgtgaagcaaggattgcagaggtggtacttccttccatggacaatggacatagttatgagattttgttataatgatgatggatgcaatctggatattgggggaccccatggggttgatggagcactgaagtcaaagatggccttccctatttctcctggaaaagtttttcatttttacgatgaactccactcatatttggcatctgctggtattgatggtgtcaaagttgatgttcagaatatccttgaaactcttggagcaggacatggtgggagggtgaaacttgcaaggaaataccaccaggcattggaggcatcaatcgctaggaacttccctgacaatggaatcatttgttgcatgagtcacaacactgatggattatacagcgcaaagcgttcagctgttattagggcatcagatgatttctggccaagagaccctgcatcccacacgattcacattgcatcagtggcttacaatactattttccttggtgaatttatgcagccagactgggatatgtttcatagcctacatccgatggctgaatatcatggtgcagcacgagctgtagggggatgtccaatttatgtcagtgacaagcccggacaccatgactttgatcttttgaagaagcttgcactacctgatggttctatattaagggctaaacttccaggacgaccaacaaaggattgcttatttactgatcctgccagagatggaaagagtcttctgaagatttggaacatgaatgatttttctggagttgttgcggtattcaattgccaaggagctgggtggtgcaaagttggcaagaagaaccttatccacgatgataatccaggcgttgtcacaggtgtcattagggctaaagatgttgactatttatccagggtagcagatgataaatggacaggagatgccattatttattcccatcttggtggagaagtggtttaccttccaaaggatgcatccatcccagttaccttgaaaaccagagaatatgaagttttcacaatagttcccgtgaaggaattgagcaatggtgtcgaatttgctcctattggtttaataaagatgttcaattcaggaggggctgtcaaagagtttaattggggatctaatgaaagtacaaatgtagccatgaaagtccgtggttgtggccaatttggtgcttattcatcagctcagcctaagttgataacagttgactcagaagaggtagaattcaagtatgaggaagaatctggattggtgactattgatttgagagtacctgagaaagaacttgatgtatccatagttcgcaacaatatgatgagcgtatgtagaccaatggcaggaaatgttagaggttcccttatgcaactcctttctgatatgctctcattgaaagcagttactgagaaatccacattgagagcaagtccttgttgggttggtctaggactctga

SEQ ID NO: 7856 - DNA, 2124 bp, Glycine max
  Peptide Sequence Number=SeqID_99541
atggaagcaaacaaggaggaagcacttaaagcgatagagattgctgaaaagcgctttgctctgagagactttgccggtgcaaaaaactatgctgtaaaggctaaaacgctctgtccaggattggagggtatatctcaaatggtggccacatttgaagtttacattgcttctgaggtcaaacataatggtgagctagattactattcgattcttggattaaaaccttttgcagataaggaggctgtaaagaaacagtacaagaagttggcggtgttgcttcacccagataagaacaaatgtgtgggagctgatgaggcatttaagcttatttctgaggcttggacttggctatcagatagtgctatgcgcagttcttatgatctcaagagaaatgtgcagttgggtgggactaaccagacgaatttgtctcctgcccatgctacaggggccgcaggttataacaagtgttccaatttgtcaaccccttgtggtgggcttgacaccttttggacaatctgcacctcttgtaaggttcagtatgagtatctgcgcaagtatgtgaataaaagactctcttgtaagaactgtcgtggcacttttgttgctgttgaaactggggcggccccagcaaatggttcgtttccatattgtccttggtcatatgtagcaggaaatgggtatggaagtcattcatttgatggagttgcatatgttccaactagtgccccctatttcaatgggaatggggtcacaggataccattctggacatggatatgagtacgttccaaacgtttcatttcagtggggctctgctggagttgtcaaccaaaatggatcagctaccttacctgctgattctgttcatcaggccaatggaaatgtgaagaggggaagaccaaaagtcaagtcaggagctgataagagacatcacatggtagagactatggtcaatacaaattcagacgtaccattctcctgtagtgaaccacaggaagataaactaagtagacctgacaagaaacagaaagttgttgtgggagccagtttcagaaatggctatgatgaaaagggttcaaaacgtgcttcagagtcgatagtggctaacggaaatgatagcatgggacatggccaaaagccttcctgcacagtcgaagttcaaaccaaacagtgttccatggcaccggcctttgacgcaagaaaattgttgattgagaaagccaggaaagaaatcaggaagaaactggaggagatgaggttgtcgtctgaagcagcagcaacagcagctgcagctctgaatgagaaagaaaaatcacaagctgaagttggtcaagtaaaaagagagacatgtagaaaagcagctccgattgtttctggtctacagttagagaatgggaaaactggtccaatctcaattactgttccagattctgactttcatgactttgacaaagataggtcagaggaatgcttcaggccaaagcaaatatgggccttgtatgatgaggaagatggaatgccacggttgtattgtatgatccgtgaggttgtgtctgtcaatccatttaagattcacatcagttacttgagttccaaaactgatagtgagtttggctcagtaaactggcttgattcaggttttaccaaatcttgtggaaatttcagggcttttaattcagatgctgttgatcaagttaacatattttctcatgttctaagtaaggagaaggctggtcgaggtggttgcgttcgaatatatcccagaagtggagatatttgggctgtgtatcgaaattggtcgccggattggaacagatctactccagatgaagtgaggcatcagtatgaaatggttgaggtgctggatgattactctgaggaacttggtgtttgtgttagtcctcttattaagttggctggatttaaaactgtatatcagagtaatacagacaagagtgccataaaatggatacccagaagagagatgttgtgcttttcacatcaagtgccttcttggttgctgaagggggaggctagcaatttgcctgaaaggtgttgggaccttgatccggctgcaactccagatgagcttcttcatgctgctacagaacctaatgctttgtag

SEQ ID NO: 7857 - DNA, 468 bp, Glycine max
  Peptide Sequence Number=SeqID_99542
atgatggtatatccgttaattagacatattagcgatacacgcatgaagtcacatcagacgttcaaacacatgagctacatcgtcgacgtccaaacacgtgaactccacatgcaccgtcctccctccccacctcctcccccctcttttcctcccgccccacctcctccctcctctttggttgcattttttaaaactaaaggtatgaagagagtcattgcttcttcacatttgcggtttgccatatcattctctagcagatgccgttgtgatgttcaatcttttccgttgacgagaatacaagacacagaacaagagatagaaggagacaatctacgtcgatgtatttgcgtttgttgccgtgaagaggaaaaatcttgtgggatgccacacctaaccatgaacagtcttgatgtcatcgacaacaaaaaagacgaagagaaaaggacaaagggagaaagaaaaaaataa

SEQ ID NO: 7858 - DNA, 1179 bp, Glycine max
  Peptide Sequence Number=SeqID_99543
atgtcagtgcaagattacctggacaagcacatgctttcccggaaactcgaagatgccgtcaatgccgccgttagggccaaaacctccgatcccgttctcttcatctcgaatcacatgagaaaagctgtgcaatcggtcataacgaaaatcaaggcgagacagatcctcgatagcagaggaattccaaccgtcgaagtcgacttgcatactaacaaaggcgtgttccgcgcttcagttcccagcggcaactccaccagcatgtatgaagctgttgagttacgcgacggtgacaaaggagtgtatctcggaaatggcgtggctaaagctgttaaaaatatcaatgacaaaatatctgaggcgttgatcggtatggatcctacgcttcagtcgcagattgatcaggccatgattgacctcgacaaaactgagaagaagggggaacttggagccaatgctatattagctgtgtccattgctgcttgtaaagctgacaaaaatatacaggttccactttacaagcacattgctgacctgtctggaaaaaccagcccaacacttcctgttcctgcctttactgtcataagtggtggaaaacatgctgggagtaacctggccattcaggaggccattagcagaactggttataatgagaaaataaagatagctcttgatgttgctgctacaaatttttgcataggtaaaagatatgatctggacttccaatctcctcaaaagtctggacagaattttaagtcagcagaggatatgatagagttgttcaaggaactatgctctgaataccctattgtgtcaatagaagatccatttgacagggaagattgggaacatatcaagcatatctcaagtcttgggatttgtcaggtagttggggatgatctcttgatgtcaaatgcaaaacgcattgagagagcaataactgagtctgcttgtaatgcccttcttcttaaggtcaaccaagtaggaactgttacagaagtcattgaagtggtgaagctggcaaaggaagcacattggggggtggtaacatctcatagatgtggagaaactatagactctttcattgctgatttatctgttggccttgcttctggtgtaattaaagcaggtgctccttgcagaggagaacggctagaaaagtacaaccaggtctctatctga

SEQ ID NO: 7859 - DNA, 1806 bp, Glycine max
  Peptide Sequence Number=SeqID_99544
atggattacggccatttgcattgtcttatagcagatgtcttctactttcttgatcttcgtagaagagaagaaatgtttctctgtgcgctaggtgtcgctgggacttcaatggcagtgaccgaagctcagaatcctcttcttggagaaaacacatgtggttccttgttaaaaaagtttcaggaaatatgggatgaggttggtgagagcgacgagcaacgagacaagatgcttcttcagttagagcaggagtgcttggatgtgtacaagagaaaggttgagcaggcagccaagtcaagggtgcagctacttcaagctctgtctgatgctaagcttgagctttccactcttctatcagcacttggagaaaagagctttgctggaattcctgagaatacttatggaactatcaaagaacagcttccagctatagcaccagtacttgaacagttatggcaacaaaaggaagaaagaattaaggagttctcggatgtacagtcacagatccaacaaatatgtggagagatagccggaaacttgaaccttaatgatgtttcacctgcagttgatgagtctgacctgtccctgaagaagttagatgaatatcaatctgagctccaagaacttcaaaaggaaaagttttgttgcattgccttgtttggcagagcgagaggttgcacaaggttctttcttgaatttgtgagtactgtgcatgatgtatgtgctgtccttggtatggacttcttcagtactgcaactgagctccaagaattagcttctcagttgattgatctttgtaatctaatggatactcatcccgaggaaaggagactatttgaccatgttacctgtaatatgtcagcttctgttgatgaagtcactgttcctggtgcccttgctctggatctgattgagcaggctgaagtggaagttgagagacttgatcagctgaaagccagcaggatgaaggaaattgctttcaagaagcaagcagagctcgaagagatatttgcccgtgctcatatagaagtagatccagatgctgcccgggagaagattatggcattgattgattcaggaaacattgaactaactgaattactggctaacatggacaatcagatagcaaaagcaaaagaagaagctgtaagccaaaaagatatattggacaaggttgagaaatggatgtcagcatgtgatgaagagagttggcttgaagactataaccgggatgagaacaggtataatgcaagcagaggtgcacacataaacctcaaacgtgcagagaaagcacggatattggtcaacaaaattccagctttggttgatacattggttgctaaaactcgtgcatgggaagaagatgatggtatgtcatgtacatatgatggcgttgctcttcttgccatgttagatgaatatgccatgctcagacatgagcgggaagaggaaaaacggaggatgagggatcagaaaaagcaccacgagcagcgaaacacggaacaagaaaccatctttggttcaagacccagccctgctaggccagttagttccagtaagtcaggaggtcctcgtgctaacggaggagccaatgctactcctaaccgacggctatcgcttaatgctcatcaaaatggaaacaggtccacatcaaaagatggaaaaagggaaaacagactatctgctcccgtgaattatgtggccatatcaaaagaagatgctgcttctcatgtttctggtactgaacccatcccggcatcaccctataattgtcctgcttttactttcttttgcatcataaagaattaa

SEQ ID NO: 7860 - DNA, 4242 bp, Glycine max
  Peptide Sequence Number=SeqID_99545
atggaatgcctttacggttttgcatcttctatttcaagagatttagtgtgcggagcaataaatcaattacgttatccttgttattttaacaatttgattgaagagcttgagaaagaagagggcaatttgattgtaacgagaaatgatgtccaaaaatttgttgcacatgccaataaccaaacgagaacgactgctgaagttgttaaccactggctacaggatgctgagaatgacatagacaatgtgaatcagttgctgaaagaggcaagaacaaaaaaaagttgttgttttgggcactctccaaattggatttggcgatactgtgtaggaaagaagttagcaaataaaactagggaccttgaaaagcgcattcaaagaggtagaccatatattcaaattgaacgcaatactacacttccttctagcacacttgatattctctcggaaaaatgtatgaattttgacagtagagaatcttcttatgagaaactaatggaagcactgaaagataatgaggttgccatgattggtttgtatgggatggggggttgtggtaaaaccacgttaggaatggaagtaacgaagatagcaaaagcagaggatctttttgacaaagtgctttttgtgcctgtgtctagtacagtagatgttccaaggatccaagaaaaaattgctagttcgatggggtatgggtttccagaaaatgaaaagggagaaagggagagagcccagcgcttatgcatgagattaacccaagaaaataagctactagtgattttggatgatgtgtgggagaagcttgattttggtgccatagggattcccttctttgaacaccataaaggttgcaaggttctcattaccactagatcagaagcagtttgtacttcaatggattgccaaagaatgattcacttgccaatcttaactagtgaagaagcgtgggctcttttccaagagaaagcacttataacagaaggcacccctgataccgtaaaacatttggcaagattaatttcaaatgaatgtaaaggactgccagttgccattgcagctgttgctagcactttgaaaggcaaggctgaagtggaatggagggttgcattgggtagattaaaaagttctaagccgatgaatattgaaaaaggtttgcaagatccctacaaatgcttgcaattgagctacgataatttggatagtgaagaagccaaatcacttttcttgttgtgttctgtattccctgaagattatgaaattccaactgaacttttaacaagatgcgcaatagggttaggcgtagttggagaagttcgctcatatgaagaggcaaggagtgaagtgattgcagccaaaattaagctcatgagttcttgtttattgttgaatgcatttcatgaacgtgtcaaaatgcacgattttcatcgcaatgtagcccacttgatagcaaagaatgaggataaggtcattaagtgcgaattggagaaggatgcgactttggagcaaatttcagtaagatatctatggtgtgtgaaatttccaaatgatttggactgttccagtcttgagtttctttgcataaaaacaaaattggaaatatcagatcaaattttcagaagaatggaaaatcttagagttatgtatcttgacaatggagggtggcacaaactaccattgtcaacaatgacatttaaaacattgaaaaatcttcgttgtctaatccttagcaattgggtattaagtgacatctcatttataagtgatatgaagaaacttgagtgccttgcattgtctgattgttatttgccttcattccttgaattacaaaatgatggtgtagttgcacaactaaccaacttgaaatcgttaatgttatataaatgtgacatggagacgaataattttgatgtggtcagaagaatcccacggctagaagaattgtgcatcattaatagacagcaagaatgggatgtttacaatgaaaacaccattaaattctctaacacgtttagtgtcccccaagaactgcaatggtatacaataaaattaggaagcctacgccaagatgatgaagatgatgatgcaaattttatctcccataaaagaactctattgcttagctgttttcacatatcaaataaggcgattaaggatttggcaaaaaaagcaaaggttctatccatagcaaatactcagggaggtgcaaaaaatataatccctgatatatttcaattggaaaaaggagatattcatgagttgaataagctcgagatatgtaattctaaggagatagagtgtttggttgacactagcaatcatttgagtgaggtgggaattctcttctccgagttgcttaagctgaaaatatgcaagatggatcaattaagagttttatggcatggttgtatacctcctagtggcccttttgagaaattagagaagctacatttaagtaattgtgcacagttgacatctttcttcacgcatgctattgtccaaagtcatgtgcaatccacaatcttccaaaatcttcaagaagtgattataagtggatgtagagaattaaagtatgtcttctcagccaatactgttcgaggcctacctcaactgaaagtgttgaagataaaagattgcaatcaactagatcaaatagttgaggatattgtcccatcaacacctgatatgaattatccacttgcacaccaggatcaaaaacaagaattagatgaaatcattcaagatgagcaacatcaacagtttttgaatcctcattttgaacctaatcaattggaaattttcccagaaagtactgcaattccaggatcgtttactctatccagccttacaacccttgaactaagatcatgtccgacattgggctcattgtttacggcatccacggctaaaaccttgacttcattggaagaattaattatagaagattgtgatggtttgaagcatatcctaactcgtgaaagaggtcataaaaatcaaaaggaaaacctcgttgaggatgatcgtgaatttcagagtgatatttcaatgttcttaggtttgaaacggctatccatcgaagggtgtgatttacaacatatattatctgtctcttttgttggataccaggcgaaattagaagatataagaaataaagagactcataataattttgaacatcttcagcgaaaaaacattcagattggacaagtgcgtttgaagttaaaaaagttggagttgtacgacctacctcaaatgacttatatttgggtggcttccaagagttcacttttcctccaatatcttaaaacattagacatagaggaatgtgcaaaattggaagtaatctttccatcgtgtgttttacgatgcctaccaaaattgaagcatctagagataagagaatgcacagaattaaagcagatcatcgaagaggacgtgactgataaaaaattgtcagatcattctacacagccatgcttcccaaagctagtagatttggttgtcaaagaatgccacaagttgaaacgtttcttctctgcgtcttcatctagtgatcttctcaacctggaggttcttatcatagatggagccactgaactagaagagattattggatttgaacaaggattttccaggaattcttttgccttccgaaatcttggaacattaaatataacgagatgtgcaaaattggaagtaatatttcctctgagtgttttaagatgcctatcagagttgaagcgtctagagataagacaatgcaaagaattaaagcagatcatcgaagaagataaaaaaatgtcaaatcttgtttctctagaaccatgtttcccaaaactagaagtggtggttgttgaacaatgccacaagttgaaacgtttcttctctgcatatgcatctaacgaccttcccaacctagagcttctgatcatagatggagccgctgaactagaagaacttattggatttaaacgtggaaaaggtggtgagatagaaaaggccaaagttgaacttccaaaactgaaactttttatatttatgcaactcccaacccttcaccaagggactgaattgctgactgtaaagcatcgcattgtccacaattgtccaaaactctctttgacttcaacgactactcttcgggagctctgtgcaaatattccttattcagtgcatatgctattgccatggtttgatgtgggcctttcctcaattggcatacaatttgcttttcctcattccacctaa

SEQ ID NO: 7861 - DNA, 333 bp, Glycine max
  Peptide Sequence Number=SeqID_99546
atgcttgaagaagggaaaaatgcacggatggaagaatgtcattactggcagaatctgaatgagaaccggacattatggaaattagggacattgccgccaggtctaatcacatattactcaacaacaaagccactggataagtcatggcatgttctgggacttggctacaacccaagcatcagcatggatgagattaggaatgcagcagtggtgcacttcaacggcaacatgaaaccatggcttgacattgcaatgactcaattcaagccacttcggtcaaagtatgttgactatgaattagatttcgttcaggcctgcaattttggtttctaa

SEQ ID NO: 7862 - DNA, 300 bp, Glycine max
  Peptide Sequence Number=SeqID_99547
atgcaagcaacaaatctctcaatcacttggggtacaacaaagtttaggagctggaaactacctgggtctaccatcaattgtgggacggaggaagaaagaagtatttggttttctaaaggacagaatatggaaaaggatcaatcactggacaagcaagaaattgtcaaaggcgagcaaagtgtgataaaagagggtgtcaaatgtagaattggaaatggaaactcaattgctatttggaaacagccatggcttcgaagaaatgatcatccatatgtctctacagctccacccggggattag

SEQ ID NO: 7863 - DNA, 3057 bp, Glycine max
  Peptide Sequence Number=SeqID_99548
atgtcccaagcaacctcgtcttcagctggtgggggtgatggtggtgccaacattgaacttggtgcaaccttactcctcaccaccaccggcaacagcaagtacaccagaatatggcgtagaagtttgtacataagattcctcatctctgtcaagaagccaacaacttccatcgacaaccatgagtcgccaccgtcactactttcttcagtaccgtacacttcattgcctcctgctagaacctcctcttccgttgcaattgatattaaagaagaagaaacagaagagcacattaggagagatattgctcgaattgtaaaggagaaggacttgagatctctcggtctgcttggtggcgttgactctgtttccgctgtcctatgtcgtcaacatcaacactcaaagggcaacaccactataccattaccagttcttggaacaaacttgtccaagtttttattcaacagctgcaaggtctaccgttgcacaattctggtgatgttaatctccgctgggttgtcattcgccataggattcaagcaggagggacctaaacatggttggcatgatggtgttgctatagtttttgctgttttactactggttgcagtaacttcagtagcaaactttcggcgtgagaggaaaatgttgaaattggcaaagacaaaggtcgagttgcaattcagggttaagagaggtgaagagaccctaatggttcccagatctaatattgtggttggtgacagagtatgcctgtggccaggtgatgagattccagcagacggtttgcttgtaagtgatggcatccttttgctggctgagcctgaggcaacaaaaagcaaacatgatcctaaggggaacccgtttcttatatctggttcaaaggtgattgggggccagggaaggatggtggtaacatcagttggaaccaacaccaatttggctgaaaggaggggcttgttggagcgactaatcgagaggccaatttcttacattgacatagctgctctttttatctcactactggttttacttgtgatcttcattcgcctaatttctgaaaaagatgggaacaatagtgggctgcctgaaatgaaggggaaggtctcaattggcttgttgatgaaggcacttcagagagctttcttgaaaccacaaggaacggtttccactttaacacgtcttgtcactgttgcaatactatgcgtgcagcatggaatgccacttgtggtcacaatttctctcaagtaccagatggataagatagttccaaaggaagatgctgttcttaatgatttatcagctagtacgacaatggggttggtaactgtcatctgcattgatgtatcaggtgagctcatatctaaaccaatggaggttagcaaagtattgatcgggcagaaagatgtcagcatggttgagggatcagaaatagatacaactgcgcttgacatgcttaaacaaggagttggtttatcaatccttgcaccagagatttctctttcctctttgtctaattcacttgtttcttgggcagaaaaaacattggaagtgaacttgagatctttcacagaagagaaatttgacattcttaagcacagcaatctgaattctggcaaagaaggcagcggagttttggtaagaaaaattggggacaatgaacaagttctgtacatgcactggagtggagctgcatccacaatattggatatgtgttcacagtactatgatagtacaggggaattccatgcaatcaaaaaccagaagatcaaatttgggcaggtgattgaagagatgaaggatggtggccttgagccaattgcttttgcttatagagaaacagatggaaaagaacttgagaaaggactgatcttgttaggactgataggtctcaaatgcactactagtctagaatccataaaatcaggtttggaaaatctgaaaaaaaatgatgcaaatatacagatcaaactggtctcggaggatggcatcatggaagtgaaaggcatagcttgtggactaggactagaatatgataatgtgcttgaaggaaaagagcttcgggatttgaatggggaagctagattagacaaagtggatcaagcccatgtaatgggaagcttccatcctaaagacaaacttctcatgatacagtgcttgcaagagaaaggtaaggtggttgcattcattggaacaaggttgatgactaatcattcttcagttctgaaggtagctgatgtggggatagtttttgatcctctgagaacaatagtggatatagatagttgtgacataacaatcaaatttttcagtgtattggaaccaattgtgatggctggcagaagtcaataccgcaatattcagaagttcattcaacttcagctgacatgcaccatatcagggttagtcataaccttgattacaacatgtactggagattccccccttgcagcatcccagttaatttgggtgaatgtcttgatgtgcattctgggtggcctaatgatggtattgaagctaaccggcgaggaggaacagattgctaaacaaccatctgatcataggaaccaacatattgtaaccaaagaaatctggaaaaacgttgttattcaggttttatatcagacttctgtgtcaatgatacttgagttcggtggagatgttactgacaaggaaaaaaaggttagggaaaccatgatcttcaacacattcctattttgccaactctgcaattttctcaactaccaggttttgaagatggttgttcagagcttctatttcttggtggccttaggtggttgttttcttatgcaagtgctggtgattgagtatgctaaaggcctagcagattgcatgcggctgaatgctgcgagatggggtatctgtgtcttgattggtgctcttgcatgcgtatttgaatggacgttgaagaatattcttccagttattctcaatcctagcaccaacattgcttcagaatcaattacttcaccttcgttctatctttctccaataagcttcattgattccccatcacttccctgcagtgaattaatgtga

SEQ ID NO: 7864 - DNA, 2382 bp, Glycine max
  Peptide Sequence Number=SeqID_99549
atgatgcagagactctcttctgccactactactactactactcgctctgccttgctgcgctacggtggcggcgcacttcgccgggacgtgcttgctcccatttcctcttctcacttagcagctaagtcacaggcgggtgaaaatgacaccaaagcagctagatggttttctattatgagctctgatagatccacatttgattcctcaaacttgaaaagggatttgttctttggcaaacgatatgaatcaactgctgcagaatcttcttcctcagcagccgccgagagatatgagtaccaagctgaggttagtcgcctcatggacctcattgttaacagtttatatagtaacaaggaagtgtttcttagggagcttatcagcaatgcaagtgatgctttggataagctgcggtttctgagtgtaacagagcctggactgttgaaggaggcagttgattttgatatccgaattcaagctgataaggataatgggatcatcagtattactgatacaggcattggtatgactaggcaagaactagttgattgtcttggaactatcgctcaaagtggaactgcaaagtttttgaaggctctaaaggatagcaaggatgctggtggtgacaacaacttaattggtcaatttggtgtgggattttattctgcttttctggtttctgatcgggtggttgtctcaacaaagagtccaaaatccgataagcaatatgtttgggaaggggaggcaaatgctagctcatatacaatatctgaggagacagatcccgagaagctgattccaagaggaactcgccttacactggacgacaaaggttttgctcatccagagcggattgagaagcttgtgaaaaactattcacaatttgtttcattcccaatatacacatggcaggaaaagggatacaccaaagaagtggaagttgatgaagatacagctgaagacaaaaaggatgatcaagatgataagactgagaaaaagaagaaaactaaaactgttgttgagcggtactgggattgggagctgacaaatgacacccaaccaatctggcttcgtaatcctaaagaagtcactaaggaggagtacaatgaattctacaagaagacttttaatgaatacctggagccattagcatcatcacactttaccacagagggtgaggtagaatttagatctatactttatgttcctgccttcgctccctctggaaaggatgacataatcaatcccaagaccaagaatataagactttttgtgaagagagtgttcatttcagatgattttgatggagaactgttcccccgatacttaagctttgtcaaaggtgttgttgactcaaatgaccttccactcaatgtgtcacgtgaaattcttcaagagagccgcatagttcggattatgaggaaacgtctagttcggaaagcttttgacatgattctgggaatatccatgagtgagaacaaagaggactacgagaagttctgggagaacttcggcaaacacttgaaattgggttgcattgaagaccgtgagaatcacaaacgtattgctcccttgcttcgttttttctcgtcccaaagtgatgaagaactgatcagcttggatgaatatgttgagaacatgaaacctgatcaaaaggatatttattacattgctgctgacagtgtgactagtgcaaagaacacaccgttcttggagaaaattgcagagaaggatcttgaagttctgtttttggtggatccaatagatgaagttgctattcaaaatcttaaatcatacaaggaaaagaattttgttgacattagcaaggaagacttggatctaggtgataagaatgaggaaaaggaaaaggaaatgaagcaggaatttggccaaacgtgtgactggatcaagaaaagattgggagataaagttgcaagtgtgcaaatttcaaaccggcttagctcttcaccttgtgtcctggtgtctggaaaatttggttggtctgcaaacatggaaaggctgatgaaggcacaatctatgggtgatgcatccagtttggaattcatgaggagcagaagggtgtttgagatcaaccctgaccattctattatcaggaacttggatgatgcatttaaaacaaatcccgatgatgaagatgccctaagagctattgatcttttgtatgatgctgctttggtttccagtggttttacgcctgataatccagcacaacttggagggaagatatatgagatgatgggtatggctctcactggtaaatggtccacacctggtcagttccagtccacagtaacccagccccataccccagaaactttagaagctgaggtggttgaaccaactgaggctggtggtcagaagtga

SEQ ID NO: 7865 - DNA, 3603 bp, Glycine max
  Peptide Sequence Number=SeqID_99550
atgtctgtgaatcgaaggcttcctgcttcaaatggtagattgctatcaaatatgaagtcttggaagctgaatgagcctctgaatgggtctaattctcccaggacatggagtgtttggttcatcttgagtttcaatagtaagtatttggtgagcaaggagaatgaagcaatttgtgaagagagagagagagccttgctacaacgttacaatgttagtaggaaacagattcatgctttggcttccttgttctctggatcagatcagaaaacagtggttgttgcagagatgaatatgaatagtaacaaagtggtgctctttgtcctatgtcttactaagtttataatgcagattttatccaactgtattgatgaaagaagacttcaaatgctgttaagcagcggcatggtcagtacaccacagttaatatgtccggagaatcaggagttacaaaaggtgcatacatgtgttgcagacactgtagaacctatagaacaatgcccagttctcaatgattgtgtccagacaaggcttgaattatcattcccattgaaaagttatgtatcattggcctcgcactctgcacttccaactgatttggttagttatttgcaccgtggaaagaacattgtgcaatcatgggaactgagggtatctgcaattcggtatcatgcgagttcatctaatttaattaaaggatgctggtgggtcctcattggaattacaatgtcctacttctgtttactatggaggaatcaaaagcagaagctagttcaggggcatccagctgcacaacaaaagtgtttgaaacattttccaaggggtccttcaaggggtgctgggagagaagaaactctagcaaatatgtgtgatgagagagcccgtatgctgcaagatcagtttaatgtgagcatgaaccatgttcatgctctggctatccttgtatctacctttcaccatggtaaacatccttctgcaattgaccagaaaatttttggagaatatacagagagtacagcatttgaaagaccacttactagtggtgttgcttatgctttgaaagttctccactctgataggatgcattttgagaagcagcatgggtggacaattaagaaaatggaaactgagaatgaggcattagtacaagattgtattccagaaaatttggatccagcacccattcaagatgaatatgcaccagtgatatttgctcaagaaacagtttcccatattgtatctattgacatgatgtcagggaaggaggaccgtgagaatattttgagagcaagggcgtctggaaagggggttctgacatccccttttaaactactaaagtccaatcatctgggtgttgtacttacatttgctgtctataacactaatcttcctttagatgctacactagagcagcgtattgaagctactgtagggtatctgggtgcgtcttatgatgttccatcactggtggacaagcttctacaccaacttgccagtaaacaaaccattgttgtaaatgtttatgacacaactaatgcatctgcaccaatcacaatgtatggtactgatgttgctgacactggcctactatacataagcagcctagattttggggatccgctacgaaaacatgagatgcactgcagcttcaagcagaggcctccattaccttggacagcaatcaatgcatcagtgggggtgtttgttattactttgcttctgggtcatattttttatgcagcaataaatagaatagcaaaagttgaggatgactatcgtcaaatgagagagctgaaagttcgtgctgaagctgcagatgtggcaaaatctcagtttcttgcgacagtttcacacgagatcaggactccaatgaacggtgttttaggtatgctgcaaatgttgatggatactgagcttgatgaaaaccagatggactgtgcccaaaccgctcacaagagtggtaaagatcttatctcagtcataagcgaggttcttgatcaagctaagattgaggctggaaagcttgaacttgaagctgtagcctttgatcctcgagctattctggatgaaattttatcacttttctctgaaaaatctaatgaaaaaggaatagagctggctgtttatgcatccaatcaagtacccaaagttgtcattggcgatcctaaacggttccgacaaataattactaatcttgtcggcaattcacttaagttcactcatgataaagggcatgtatttgtctctgttcatctggcaaatgaagtgaagaacccacttcatattatggatgcagtgctgagagaaggcttaaacttgaaccaggacatatcaaacagaacatatgatacgttaagtgggtttcctgtatgcaacagatggaaaagttgggcaaattttaagcagttaagtggcataaatgagcctgaaattattcaacttctagtaatagttgaggacacaggtataggaattcctacagatgcacaaagccgcatattcacaccttttatgcaggctgacagttccacctcccgaacatatggtggaactggaataggactgagtattagcaaatgtctagttgacctcatgggaggagaaattggatttgtaagtgagcctggaattggaagcactttttcctttaccggaaccttcagaaaaggagaaagcacgtctctggatgcaatgcagcagaataatcattttggttcagagttccaaggattgagaacattagtggtagatagcagaaaaatccgagctgaggtcacaagatatcatctgcagagattgggaatgtccgtggatgtaacttacagtctgaattctgcatgctcttgtttatctaatgtgtgtaacaagagtatgtcgacccaattggccatgattcttatagacaaggatgcttgggataaagaatgtcatatcttatacacaatcaagaaacgtagacagaatggcatcaaaggggatccaatgaatttaccaaagatttttctcctggccacccaccttagctccaatgaacaggatgggctcaagtcagttggtataatagatgatatactgatgaagcctctttggcttagttctttgattcagtgctacagagtatcccttggcactgaaaacaagagagtaaataggaaaaaagtgtccaaactcgggaatttattaattgacaaacaaattttggttgttgatgataatgcagtcaacagaagagttgcaaaaggtgttctacagaaatatggggctaaagttactgctgtggagagtggcagggctgctctgaagatgcttaaactgccacataattttgatgcttgtttcatggatctccaaatgccagaaatggatgggcaaatccgttgtctcgagagtgaggtaaatgagaaaattgcgtgtgggcaagcatctgcagagatgtttggtagcatctcttattggcacattccaatactggcaatgacagcagattcaactcagtcttccaatgaagagtgcataaagtgtggaatggatgactatgtgtcaaagccatttgaagaagagaagctctacatggcaatggcgcgtttcttcaagtcagatacatag

SEQ ID NO: 7866 - DNA, 270 bp, Glycine max
  Peptide Sequence Number=SeqID_99551
atgttttacctgaatcaggttattgataagtcattcggttttgacactgttgttgaagaggcacaacgaaccataaactctgctcatgtggaagcagaaagcactaagaatggtatcggtattgtcaagttaatgggtcgttacagcgagttgaagaacgctcaagaattgacgcagcttagtggtatcttaacacattttgctagtggtgagaatttgggtagtttgcatcaggcaataggttcagacttcattggcactgatgcttaa

SEQ ID NO: 7867 - DNA, 1179 bp, Glycine max
  Peptide Sequence Number=SeqID_99552
atggacatgaagttgaatattccagcaattaatgttttattcttattgctagctatttctagtacaactcaatcggttgacattaatataaaaaaatttggcggaggtgcagatataacacaggctttgacaaaagcttgggaagaggcatgcgcagcaacaagtgcaagcaaaattgtgattcctggtgggtcatacaagatggaagcagttgatttaaaaggtccttgcatggctcccattgaaattcagtttgatggcacacttcaagcaccggctgacccgaatgcactcgacggggctgatgaatggctcaaagtacaacatgttaacttttttaccttatcaggtaaaggtgtttttgatggtcaaggtgcaactgcttggaaacaaaatgattgtggaactaacaagaattgcaagaaacgttccaagaattttggtttcaatttcctgaacaattctatggttcgggacataacttctaaggatagcaaaaactttcatgtaaatgttttagggtgcaataacttcacatttgatggtttccacgtcagtgctccaaataccagtatcaacactgacgggattcacattggaagatcaactgatgtgaaaattcttaacaccaacattgccactggagatgactgcgtctcattgggagatggtagcaaaaaaataactgtccagaatgtgaattgtggacctggtcatggcattagtgttggaagtcttggcaagtacccagaagaagagccggtagaacaacttttagtcaagaattgcactttgacaaatacagataatggtgtgaggatcaagacttggcctagttctccaggagcttctcctattactgatatgcattttgaagatattaccatggttgatgtcatgaacccagtgatcatagaccaagagtattgtccttggaatcagtgctcaaaacaggctccatcaaaaataaagataagcaaggttaccttcaagaatattcagggcacttcaaaaaccaaggaaggagtgactcttatatgtagcaagggtgtaccatgtgaggatgtggaactaaataacgttgctcttacattcaatggagctccaatagttgctaaatgtgctaatgtcaagcccatagttacaggaaaagctcctgcttgcacatgtacagcttaa

SEQ ID NO: 7868 - DNA, 225 bp, Glycine max
  Peptide Sequence Number=SeqID_99553
atgaagaagaagaagaagaaccctcccttcagcggtgtggaattcatgggccttggcccaatacagcccaacctgtctttatatcagggggaattctatttagagaagaccggtagactctgtagtgaggagagtagaccagatggaaagaagacaaacaattcgaggcagaggaaggcccaaaaagactataagagaggttatcaaaaagtatctcgaacttaa

SEQ ID NO: 7869 - DNA, 1053 bp, Glycine max
  Peptide Sequence Number=SeqID_99554
atggaggtagtatctgatgaagaagccttcttgtttggcatggaactagcgggtgcctctgctgtctctatggttctcaagtcagctttggagcttggcatcttagaaactatagccaaggctggtcctggagcttacctttccccttctcacatagctacaacatacttacatactccctccatcaactgcctcatggtaaggctgaaaggcactatggtcttcacccaaaagccaaataccttgtcaacaatgaaggtggtgtctctgtggctgcttactttctcatggaacatgacaaagtccttaaagacatgtgattcagttaaggagggtgggcatccattcagcaatgcttatggaatgactgcctttgaattccatgacacaaatcctagattcaacaagcttttcaataagggattgtctgatatctctagcatcacaatgaagaaaattcttgagacctataatggctttgagggtgttggatctgtggttgatgttggcggtgggactggagctattattaatatggttgcctctaagtatcccaccacaaagtgtgttaattttgacttaccccacgtcatcaaagaagctccagcttatacagtccggaggccaattaagggtgcaggaagcaacgaccttgaacccatcgttttaaaaattggaaaaggtgtggaacatattagtggagacatgtttgtgagtgttccaaaaggtgacgtcatttttatgaagtgggtatgccatgactggaatgatgagcaatgcttgaaattgttgaagaattgttatgattcccttcctgacgacactggaaaagtgattttggctgaaggcattagtccagaaaccccagattctaacttagctgcaaggtgtgagtttcaaatggatgttatcatgttgtgtcatagcccaaatggaaaagagagaacagagaaagagtacaaggccttggctaaaggagctggattccatggtttccgaatagcatcttgtgttctcaacacacatgttatggaatttcttaaaaaggcttaa

SEQ ID NO: 7870 - DNA, 49 bp, Glycine max
  Peptide Sequence Number=SeqID_99555
atggttgttgtggaggatgcggcggtgaaggacgaagaagaggaaaatg

SEQ ID NO: 7871 - DNA, 2091 bp, Glycine max
  Peptide Sequence Number=SeqID_99556
atggcaatgcagggttgttattgtcactatacgaagttggcaactcaaagaagaacactggaaaatctcagtttttcaggctcaatttcggttaacaaattgtcaaagaatgaaaggaccagaacatgtgatccattatcagcagggaacaatcaatttcataggttactggtgaaaatgcggcagacagaaatgcctgcctcgaagtatggaacaaatggtaaagctgttagaatggtagggacaaatgagttagtgaaaagaaagagaatgttagagaataaggtgttgaatggttcagcaacttcaaaggtagtgagaaaaaatggtatcacaggcttgaacaagacagtgaaatctagaaggtcattggaagagctaaaggttttagccacagatgaaggtttcagttgggccaatgaaaattacagttcctggcagaggtctattgatgtttggtcttttgtggcttctttacgcattcggattatgttggacaatgcaaaatggacatatttcggaggtttcacagaggcaaagcagaaaagcagaaggcggaaaactgcctcgtggttaaggaagtgtgtattgcagcttggtccaactttcattaaacttggtcagttatcatcaacaaggtcagatctatttccacgtgaatttgtggatgagctcgcaaaattacaggacatggttcctgccttctctcctaagaaagcaagaaaattcatcgagagtgaattgggagctcccattaacatattatttgaggagtttgaagatcggccaattgctgctgctagtctcggtcaggttcatcgtgctattctgcataatggggaaaaagtagtcatcaaagttcaaaggcctggtctgaagaagcttttcgacattgatttgaaaaacttaaagttgattgcagagtattttcagagaagtgaaacttttggtggtccacttagagattggattggaatatatgaagaatgtaaaactattttgtatcaagaaattgattatataaatgaaggaaagaatgctgacagattccgccgagattttagaaacataaagtgggttcggatacctctggtatattgggattatactgctttaaaggtgttgaccatggagtatgtaccaggcatcaaaatagaccaggtggatacattaacttcgcgtggttatgatcgattgcgtatctcatcacgtgctacggaggcgtacctgattcagatattgaaaacaggtttctttcatgccgatcctcatcctggaaatcttgctattgatgtggacgaagcaattatttattatgactttggcatgatgggacagatcaaatcttttacccgggagagactgcttgaacttttctatgccatatatgaaaaggattccaaaaaggttatgcaacgccttatagatctcggagccctccaacctactggggacttgtcatcagtgaggagatctgtgcagtttttcctggaccatttgctaagccaggcaccagatcaggagcagaccctttctgcaattggggaggatttatttgcaatagcacaagaccaaccattccgttttccatccacctttgcctttgttctcagggcgttttcaacacttgaaggcataggttacacactgaatccaaatttctccttttctaagattgctgcaccctacgcacaggagcttttagagataaggcaaaagcagcgcactgcaccacagcttgtggaggagataagaaagcaagcagatgatgctacaacctataccatgtcaatgccatacagagttcaaagaatagaagagtttacaaagcaacttgaggcaggggatctaaaacttcgggtccgagtgcttgagtctgaaagagctgctcggaaagcaacgggtttacaaatggcaactatgtataccgtattaggaggaactctgctaaatcttggtatcactatgagcagccaaggcaacataactattgcgaatggatctttcattggtgcaggtatttttatgacactatttgtcagatccatgcaaagggtaaaaatgcttgataagtttgagaaaatgatataa

SEQ ID NO: 7872 - DNA, 648 bp, Glycine max
  Peptide Sequence Number=SeqID_99557
atggtgggtttatctcttggagaaaaacatttcattcaaggtggcattggtcaagatcttcgttgtgatggtagaaagagatttacatataaaccaatctctgttgaaactgaagttattccccagacaaatggttcggcaagagtcagaatgggtgctacagatgtaattgccagtgctaagggtagagggggtgatgagttggctgcagaactgtcaaatgctcttcaacgttgtctcttgggtggtaaaagtggagcaggtgctagaattggcctctcctcgcttattgtcgttgaaggaaaaatttgttgggatctttacattgatgggcttcttgctgctttgagcaatacgggtattccaagagtccaagttgctgctggaacatcaaatgatgagcaaccagaagttgacgtaagcaacgaggagtttctgcagtttgacacatctggagtccctgtcatagttacactggctaaggcactatattgtggatgcaacatcagaggaggaatcacaaataagctctgctgtttctctgttaataggcaagggcacatatgtggtataaccaaacgaggaggtgtagggctggatccaagcaccattcttcaattattttgtaactcggctaaactatggtaa

SEQ ID NO: 7873 - DNA, 3549 bp, Glycine max
  Peptide Sequence Number=SeqID_99558
atgttcaccgaaggactcgacgagagcgcaatccaatggatcaagcagggatcaaaagcaccacctgatgttgatgtccaagagcctcctcttcctcaggtacgctctcctctggccgagaaaatcagctgcagcagcaatcgattcccacgatctcctctcttgagcagtgccaacactctcaattctcccgttctccctccgttgaagttccattcggctttattacaaccgcgcaacctcgcctttgccgatcacgatgacagttacgaaagcacggaggatgccaatttctccgatgacgaaatctctgctcccaacaaccttgatttctcggactcgccaataccacacaattatgacgaggaacaattgtttggatgcaaaggccgcagaggaattctcaagactggtttggccaatcaaaacctaaccattcaggttcccaacactgtcagaaggttcacagatggagaaatgggtttcaataaatgtcttcaaaggaacctcactccagctgccgctgctcctgttcagcttcaaaagcaagttcaccttcgcaatgtgaattgccctgatgatgacaccgttggattgggtactccaagtgcccctcccatcattgattctgattttccactggagagggattcagaatgctccctaaggaacgaaccaactgaccctcctggatcttggccttcaagggaatctctggattatgatggcacaaaaagtgagacttccattgaacaaaaacccaagcccgagacggttgctaaacccactgtcgctgagcttgctcaaagactggacaagacttttacagaagacagagaaagacagacccctcatttacaatattacaacactagcagttgcaatagtcaatacgcctggcaaacccttatcacttatgatgcctgcatacgtttatgcctacaagcatgggcaaaaggctgcactgaggccccagagtttttaaaagatgagtgcctagctctccgaagtgcttttggattgcatgagttcttgttgcaacctcgaggtgtcaagccaactgaaggcagaaataccaggaatttggaacaaacagttcccctgaagattaagaaagttgtagggaaaataagagtggaagtgaagaaacttcgcattataccaagacaaaaacttaacatcacaaagtcacagcgaggatcaatctacatgcaaactggggtggagtacgtccggcatgtttcatctctcgtgaaaaatggcattaattctatgaaggcggcctccttctcattggcatctgaagagccactacattgttcgatccaacttaagagtacgatggaagaaaatgaatcagagccatgttctgcaattcttttgcgccctggaagtggagattaccatgattttttcccattgagccaaggggacgctttaattgtagaagtccaagattcaaaaaaggtagtccatggtgaaaccaggattccaatttcatccctcggtgataatcctagtgacagaattcggtggtggccagtatatcatgatgaacgtgaatgtgttggcaagatccagctctctattggcagtacaatgacaagcgatgagaacaatcacataaagagtgcggctgttgtggaaactcaagcttatgatttattattggagggtgccatgcgtgcacaacatttccactcccgaaacttgcggttaaatgggccttggaaatggttgttagatgcatttgcggactactatggagtttctaattcatatgccaagctgagatatctattacatgtgatgaatgtggcaactccaaccaaggactgcctagagcttgggagagagttgctagaacccctcataaaggccagaagtgagaggagtctgaccaggcaggagagaagtatactttcagactgtgaaactcaaattgaaagtcttctagcgacagttttcgagaattacaaatcgctagatgaaaactcaccaacaggtttaacagatcattttggtccagcatttgatgctgctgcaccagctttggatcctgctgttcgagtcttcacaagtcttcatgatattctatctctagatgctcaaactattctaagaaactatcttcagactgcagcaagaaaaaggtgtagaaaacacatgatggagactgatgaatttgtgtcaagcacctctgaaggttacctaatggataccattaccatctcaacagcatacctgaagatgaagaatctttgtgtttcaataagaaatgaaattcaagcagacataaagatccacaaccagcatacgatccatggtcagcatatatttccaagttcaattgacctgacaaacatcacagcagcagtttacagcacagagctgtgtaagagactgagagctttcctttctgcattgccaccatcgagtccacaggcacatgtaaatgagcttctagttgcagcggcagattttgaacgggatttggaatcatggaatataagtcttgtgcagggaggcgtagactccagaaatttgttccacaattatatcatggtgtggatacaggatatgcaacttagtttgcttgatttatgtaaagcagaaaaggtgccatgggctggagtaaccacaaaccactccacctccccatttgctgaggaaatgtacgagaaaatcaaagacaaccttacccagtatgaagttgtaatcaacagatggcctcaatactcactttatttggaaaatgctgttgcaaacattgaaagggcaattgtgaaatccctcgaaaaacaatacagcgacatactaactcctttgaaagatagcatacaaaagagacttcacttgcaagttcaaaagatagcaagaagacaatcagctactgttcatttggttcctaatcaattgggaatattcttgaataccctcaagaggattcttgatgtccttcattgtagagtggaagacatcctaaattcatgggcatcctgcctacctgtcattggagataagaagacactgtttggggagcaaatgaatggaatcactgttctcttgagaaccaaatacaaaacttatttgcaagcaataatagggaatcttgtcaacagtacaaaagctaatcggaacacaaggctgaaaaagatccttgaggaaacaacagaaacagatggagaagcagaagtgcgtgaaagaatgcagttgctgaattcacaacttactgacttcatctccaatctgcatgaggtctttaccagccagatttttatagcaatatgtcgtggattatgggataggatgggacagattattttgaaatttctcgaagggaggaaagaaaacaggatatggtacaacggctcttcatatgctctggggatattggatgatacctttgcttcccaaatgcaacgattacgaggaaatgcgttgcaagagaaggatattgagcctcctcgctcagtgattgaagctcgatctattctttgtaaagacacggcaaatgcaaccgatacatctaattacttctatatatga

SEQ ID NO: 7874 - DNA, 645 bp, Glycine max
  Peptide Sequence Number=SeqID_99559
atgggagctgggcgtggagtctccatctcacttgatggggtgagggacaagaaccttatgcagctcaaaaagctcaatctcgctcttttccccgttcgttacaatgacaaatactatgtcgatgcactcgcttccgcttactatagtgatatttgtgttggagcaattgcatgccggctggagaagaaggaaggtggggggcaagttcgggtttacatcatgacgttaggtgttttggcaccttaccgtggacttggtattggaacaaagttattgaatcatgttcttgatctttgctccaagcaaaacatttctgaggtttacttgcatgtgcagacaaacaatgaagatgccataaacttctacaagaaatttgggtttgaaattacagaaacaatccagaactattatacgaacattacaccgccagactgctatgttctcacgagggccctttctaggctttgcattgtaccgactgctgaggcatgtgccctcttcgcacaatttgggttgcataaaagacgaaggctaagcttcttacgcatagtgggaaaggatttcttagccgatcagatcatcagatttgaagaatcgcatcctaggagacctgtgaaggactttgtggtcgccgccgcactctaa

SEQ ID NO: 7875 - DNA, 87 bp, Glycine max
  Peptide Sequence Number=SeqID_99560
ggatgttaaaagcggtatttggtgggtcttgattctctccgtcccagttcctgtgttgatctttgatgtgcttctgtttggatacag

SEQ ID NO: 7876 - DNA, 144 bp, Glycine max
  Peptide Sequence Number=SeqID_99561
atgaagaatgaaagtgaagaagcggtgcaatcttgggtggaggatgtcctagatctaggtttcaaggtgaaaaatcacaattttggcattggactaaatccgggtggtgccgatggggcgattctactctacactaatgactga

SEQ ID NO: 7877 - DNA, 175 bp, Glycine max
  Peptide Sequence Number=SeqID_99562
atggtgatcatggatgagagaaagatggaaggtggagcggcaagcttggggaaggaagaactccaagacaaaatgaaaagaggaagagaaagtagtaagaggaatagcgacagcagcatgcaagtcaaagatggaggcgtggtgggagagaggatattcggcgttggagaaggcg

SEQ ID NO: 7878 - DNA, 351 bp, Glycine max
  Peptide Sequence Number=SeqID_99563
atgaaggacgttttggagaatttggagcgaattcaagctgccaatgagaaacctgtggagcctaaattccgttctactcatgccgccaaccgtcaagatttgtacggcatgatttctgatgccaatgccgttccagacgctaacactatttactaccgtgactcacccaacaacgaacgcaagaaactagcaccgacgagaaagtctgttgtggcgaccatccccttgaagaatcccttcttcttcaataatgttgatttgcttctacaacttggctgtggctgtagtccttcttggaggagcgcacagaaaaggagtggcgcgagtgcggtggagaagcaacggggctga

SEQ ID NO: 7879 - DNA, 3114 bp, Glycine max
  Peptide Sequence Number=SeqID_99564
atggcatcggcagcgcctaatgtcgatctcttcgatgcctattttcgccgtgcagatttggatcgagacggccgtatcagcggtgccgaagccgtctccttcttccagggctccggtttgcccaaacatgttcttgcgcagatttgggcatttgcaaaccaaagccagagtggtttccttgggcgggcagagttttacaatgcccttaagcttgttaccgtggcacagagtaagcgggaactaactcccgaaatggtaaaagcagcattgtatggcccggctgcatctaagattcctgctcctcagattaatttcagtgccacagtatctgcacctgcgcctgcacctgcacctgcacctgtaccacagattggtcctgttagtcctttatcccaccaaaatcttggaccaaggggggcagttccaaatttgagtggtaaccagcaaaccctcccttctcagggaaatcagtttgcgaggcctccagctactgttgccactcaaggaatggctcgccctgaaacccctggcatttccagttatggcaagatgggtggaactccagaagtaacttcctctccagtagcagttagaggaactagtcccccatcagcgcaggaggggtttgggtttggatcaaatgtggcacggccacctggccaatatcctgcctcccccataaagtcatcagatcaattggttaaggattctaaaccagtggatgcttctgttaacggtgattcttccgattcattttttggaggagatttattctcagctagctcatttcagcccaagcaagcttcttctccacaaggattttcttctggcacttcagcgctttcttcagctattgttcctgtatctggaggaaaccagcattctactaggactagtacccctgattctttgcagcgctcacttgcaacccagcctgttggtgcacagcttcagcaagcccagccggtggtaaaacaggaccagcatgcgtcagtccagacacataataagccgaattcatctggacttccagggagattacaggattctgcttccagtcaatcccaagctccatggccaaggatgactcaaactgatgttcagaaatatatgaaagtattcatggaagtagacacagatagagatgggaaaatcacgggggaacaagcgcggaacttgtttcttagttggagattaccaagagaggttttaaagcaggtttgggacttatcggatcaagataatgatagcatgctttctctcagggagttttgtattgcattgtacctaatggagcgacacagggaaggacgtgttcttccagcagtacttccaagtaacattgtgcttgatttaccaactactggtcaacctgctgctcactatagtagttggggaaatccatcagcttttcaacaacagccagggacaactggttctggtgctcgacaagtgaaccctgctgcaggtcggccgccaaggccggctgctgtctctcagtctgatgaaggacctcagaacaagccgcagaaatctagaattccagtcttggagaagcacctcattaatcagctgagttcagatgagcaaaattcaattaattcaaagtttcaagaagcgacagaagctgataagaaggtggaagaacttgagaaggaaattatggagtccagagagaaaatagaattttaccgtgcaaaaatgcaggaacttgttctgtacaaaagcagatgtgacaatcgtcttaatgaggtcatagaaaggatagctgctgataagcatgaggttgagattttagcaaagaaatatgaagataaatataagcaagtgggagatttatcatccaagttaactaccgaggaagccacgtttcgtgacatacaggagaaaaaaattgaattgtaccaagcaattgtcaagatggaacaggatggaaaaggtgatgcaactctgcaggctcatgttgatcgtattcaaacagaccttgatgagctggtgaaatctctgaatgagcggtgcaagaaatacggattacgtgctaagcccactacattattggagctaccctttggctggcaacctggtatccaagaaggagctgctgactgggatgaagattgggataagcttgaagataaagaatttgtttttgtcaaagaactcactctcgacgtgcaaaacattatagtgcctccaaagcaaaagttgccgtcagctgtgaacacgaaagctgtgaacgtggaagctgtgaacacggaagctgtgaacgtggaagctgtgaacacagaagctgtgaacaccgacagtcctacatttgttgcttctcccaagagtgatgataagtcggaaaagccccggactaccaatgaacagggagttggcaatggatctgtttataataaaagtgaagatgggtctgtaaaaagtgctcccaatagtccatttgcaagcagtgctatcggaagcccacatggggattttgattctgacattagaaagacagctggtgaagatagctcactccgtgatcaagataccatacaagaaacccaaagtgatcatggtggtgtcaagtctgtgttttctggagacaaaatttttgatgaaccaaattggggaacctttgacacaaatgatgatattgattcagtttggggattcaatgctagtagcttcactaaggaggagagagatcttgatagagctgggaacaactatttctttgattctggggaactgggcttaaaccccatcaaaacaggttcaccacaggctggtgatttcttccagaggagcagtggattcggttttgatgattctgttccaagcacaccactttacagctcaagtagctctccgcaaaggccaaaagagtggttggaaactgcttttgatttctcaagatttgattccttcagaacacatgatagtgtatctttgcctgctcgggagacgacagaacaatatgattcagtacgcaacagtgtggattttgaccatgcttatgggtttccagcttttgatgactcggatccctttggctctggcccgtttaggacttcatcggataatcaaactccaagacgaggatctgataattggagtgccttttag

SEQ ID NO: 7880 - DNA, 1320 bp, Glycine max
  Peptide Sequence Number=SeqID_99565
atggctaagagagatggggtctcggtcggagaccaaactccgaggaaggtcatgatgttgcaaattgtatcgagaaatagagtggccaccttgaatgcgttgggtaggcttgtgatgaaatcgagtgagagatcttcccaaatgcctgatggaagtaggagagttcttgatgaaggattgggcgttttgccagagatgctcccaggtgtccgccaaggggagtcaaatgaaacttcgttaggagggaattgcgaaaaggattatcgtcatcaagccaaatgctacccttgtgtaaaatcaactgatcatgcaattggtagtcagggtacacctctggaagttttcccaagtaatattgctgctccggcgtctaaattatttggttcatcaattccttcaagcttcgatgtagaggctcgttgcaactttggagtgaactgcttactgaagaaagcgataggtctgtcctgttgcatcaacactatgcctatggttgtgccggatgcgtcaatctcaatctcaaaagcttgtgagaaatcaggtgggatcaatactggtgcttgtgtcatagcggacttcaatgcgtcaaaggctagctgggattcaggggacaatttgaattgctcatggcacaggagagctgtgaaagggggagtcactgaagataaggatatcatcaaaaaacaccgtgacgaattgacgcaaaaatggttgaagcaccgagttcatggtagcttgaaagatcgaggtgagatatggtggacgatttggcgaggtggtggtagggaagacgggttgaggaagatagcgtcatatttggacgacgtggatccagtgtggatcaggcgtcaaagatgtttaggtgatgtaggtaacggcccaaccgggacatccgtgcgaagctcggccggtaagcccaaatggtggaacttcatagacaagggacaggtatttggccacccatggttggatgaagttgtgggtgctgccactgtcgatgaggacggtgaggcgattcgggccgatgaagccatatatacgaaaggtggctggtgccgagatacccgaagaggcatgcaagctgatcgtaggggtggggttgtcggggtcaggaggatcggtaaggtcagggtccgtgagccccttttcacggcgaagagccatttcttcgggggtgcgatggacgaagggttgtcggggattagtttggctagggcggtggcctacgggagggagatgggctgcaggtacgtcggcgccaattgtgtctccagtgcctgcaagaatcctgaccaggtggtgatgaagccatttcaatag

SEQ ID NO: 7881 - DNA, 2748 bp, Glycine max
  Peptide Sequence Number=SeqID_99566
atgaatcataggttctggatgaatttgctttgcgttgcattattaacattgatcctattacatggggcatcaagaggacatgatgatgtcgtcaaaatcggtgccatattcacattaaaaaccataaacggacgagtttccaaaattgccatccaagctgctgagaaagatgtgaattccgatcctcgcatccttgggggtcgtaaattgtccataaccatccatgattccaacttcagtggttttcttggctttattggggccctcaagttcttggtgaccgacacagtagctataattggtccacaaagttcagtaatggcccatgtgctttcgcatcttgcaaatgagctccatgttcccctactctcctccacggctctggaccccaccctaacacctctccagtatccttattttctacaaacagcaccctccgatcacttccacatgaatgccgttgccgacctcattagctatttcggttggagagaagtcatagcagtgttcagcgacgatgatcagagtcggaatgggataacggttttgggggataaacttgctgagagacgctgtaagttgtcttacaaagcagcactgcctcctgatccgaccgccactccatcccatgttactggtcagttagtgaagatcaagagtatggagtctcgagttatcgtcttaaacaccttcgcgcaaactggtctcttggtttttgaggtggctcaaaagctaggaatgatgtccaaagggtatgtctggatagctactgcttggttatcaactgttttagactcaactacttcactaccttcaaatacttgtaactcaattcaaggagttattacctttcgccctcacacccctcattccagaaaaaaacaggcatttatctcaaggtggaaacacatcagtaatggctcaattgggttaaatccatacggcctctatgcatatgattctgtttggatgattgctgaggcactcaaattgttttttgatcggaatggtaccatttccttctctaacaatacaaatttaagtggtacgagggaagagactctggatttcggtgctttgagcgtttttgatggagggaaggagttacttgataacatattgcgcattaacatgactggattgactggacctattcaatttggttcagatagatctcctctaaatccatcatatgacattcttaatgtaattgctactggttataggagagtcggctactggtctaattactctggcctctctgtaataacccctgagaaacttcacgcagagcctgccaatcgttcaatttcaagccagcatctaaaccgtgtcatatggcctggaaatacaacagaaaagcctcgtggatgggttttcccaaataatgggaggcaactgagaattggaattcccaacagagttagctatcaagacatggtctcccaaataaatggcaccaatgcagttcaaggatattgcatagatatattcctagctgccattaaattgcttccctatgcagttcaatacaagttcattctgtttggagatggacacaataacccaagctactacaatcttgtcaacatgattacttctgatgtttttgatgctgctgtaggtgacattgcgattgtcactgaccgaacaaagattgtggattttactcaaccatatatagagtcggggctagttgtggttgctccagtaaaaaaattgaagtcaaatgcttgggctttcttgcgaccatttactccacagatgtggggtgtcactgcattttttttcctttttgttggagcagtggtgtggattcttgaacatagaacaaacgatgagtttcgggggtcaccgagggaacagatagttacagttctttggtttagtttctcaaccatgttctttgcgcacagagaaaacacagttagtccacttggtcgagtggtgttgataatctggctttttgtggttctgataatcaattcaagctacactgcaagcttgacatcaattctcactgtgcaacagctgtcctcacccataacaggaattgatagcttgatatccagcagtgatcgtataggattccaagtaggctcatttgctgcaaactatctcactgagcaactcaacatccccaaacatagacttgttcctcttggctcaccagaagaatatgctgttgcccttgaaagcggaactgttgcagctgtggtggatgaacgaccctatgtagaactcttcctttcaaaccactgccaattctcaattaggggccaagagttcaccaaaagtggatggggatttgcattcccgagagactctcctcttgcaattgatatgtcaactgcgattctaaccctatctgagaatggtgaacttcaaaggatccatgaaaagtggctttcagaaaaggcttgtggttttcacagtactgaggatgaacagcttaaattaaatagcttccggggcctgtttctaatatgtggaataacatgtttcctggcgcttcttatctattttttatcgatggtacggcaattcaataaaaaatcccctcaaaaagttggtccttctaatcgttgcagctcacgttctgctcgcatccagacatttctacattttgttgacgaaaaagaagacgtctcacccaagttaaaaagaaaactcgactatatctcatcaaatcgtttgaggagcatatccaagagagtacaagaggacatttcccaagaggctccttga

SEQ ID NO: 7882 - DNA, 252 bp, Glycine max
  Peptide Sequence Number=SeqID_99567
atggtgcaaactagctgtgctcacactgaaggtagttttgctcatgaagatggtaagacccttccttgcaacactggtaaatcttttgggctaagagactatagagaagttgcttttcctcagacaactgcaaaagagacagtattaggacaaatgaaacataacagggagtgggcagtgtcctgttgtgtggtgggggtggcaagaggtgcacacacacctgaaatgcatggctactggttgcgtgcataa

SEQ ID NO: 7883 - DNA, 264 bp, Glycine max
  Peptide Sequence Number=SeqID_99568
atggcagacaaagctaagggaatggccagctcagcgcatcacacgaaatcctttaggagagagggccttggtcagaatatcagcaagttgatgtgctgcaggcacatgaaaaacatcaatctgtttggtgatgaccttcttcccaacaaagaaccgatcaagctccatatgtttagttcgagaatgaagaacagggttgtgagcaagagagacagtgctggtattatcacagagaatgagaggagtggtatgagcaacttataa

SEQ ID NO: 7884 - DNA, 1701 bp, Glycine max
  Peptide Sequence Number=SeqID_99569
atggtgtacttggagcactgtctgcttccaagagttaacgcttattcaaggattgtcaatggtcttctgaaaaccgctttgggaccacctacagggtcaaccactgctttgtctccagcacaggatattactttccgacatgaatctgtgaaatgcttggtcagcattattaagtctatgggagcatggatggaccagcagataaggataggagatttagatctagcaaagagccctgaaagcagtagtgcagcagagaatcatctaatactaaatgtagaagaaggaaatgcttctgatcatgagctacattctgatgtaaattctgaattttcagatgctgccacgttagagcaacatcgggcatataaaatcgaacttcagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgtatcatggagaagtttgctgagcgctattgtaaatgcaaccctagttcttttagcagtgcagatactgcctacgttcttgcttactctgtgataatgcttaatacagatgctcataataatatggtgaaagataagatgacaaaggctgattttgttcgaaacaaccgaggaatagatgatggaaaggatttaccagaggaatatcttggggcactttatgaccaaattgttaaaaatgaaattaaaatgaatgctgattcttctgcacctcagaataaacaagcaaatagcttcaatagattgctgggattagaaggtatactcaatcttgtgaactggaagcagagtgaggaaaaagcagtgggtgcaaatgggcttctcattcggcacattcaggagcaatttaaaactaattcacgaaaatcagaatctgcgtatcatgttgtcactgatgtggctatactgaggtttatggtggaagtttgttgggggcctatgctggctgctttcagtgtaacacttgatcagagtgatgacagggtagcaacttctcaatgcttacaaggatttcgacatgctgtgcatgttactgcagtgatgggtatgcagactcaaagggatgcttttgttacatctgttgccaaatttacttatctgcactgtgctggagatatgaaacagaaaaatgttgatgctgtcaaggcaataatatcaattgcgattgaagatggagatcatctgtatgaagcatgggaacacatattaacttgcctctcccgaattgagcatttgcaactgttaggtgagggtgccccaagtgatgcaaccttcttcacttcaactaatcttgaaatggaggagaaagcactgaaaacattaggtttctcttcttttaagaaaggaacactccagaatccagccatggtggctgttgttcgtggtagttcatatgacagtacaagtattgggattgggaactttgaactgaaccatgtgtttgctcatagtcaacggttgaatggagaagcaatagtagcatttgttaaagcactttgtaaagtttccatttcagagttacagtctccaacagacccccgtgtatttggcctcactaaaatagtagaaattgcgtaa

SEQ ID NO: 7885 - DNA, 873 bp, Glycine max
  Peptide Sequence Number=SeqID_99570
atgtcatcatcttcagacctggacaggcaaatagagcagttgaagaggtgtgagcctcttaaggagtctgaagtgaaggcgctttgcctcaaagccatggaaatccttgtcgaagagagcaacgttcaaagggtcgacgcccctgtcaccatatgtggtgatattcacggtcagttttatgacatgaaggagcttttcaaagtaggaggggattgccccaaaactaactatttgtttctgggggattttgttgatagagggttttactcggttgaaacgtttctgcttctgctcgctcttaagtgtcgtatgtcgataacgacaaactgcagcttgtccgctctaattgaaaacaagattttcagtgttcatggtggtctttctcctgccatttcaacactggatcagatacgaactattgatcggaagcaagaagtacctcatgatggtgccatgtgtgaccttctatggtcagatcctgaagatattgtggataactggggtcttagtccccgcggtgctggttacttatttggtggcagtgttgttacttcctttaaccactcaaataacattgactatatatgtcgtgcacatcagttggtaatggaaggatataaatggatgttcaataaccagatagttactgtctggtcagctccaaattattgctacagatgtggcaatgtagctgcaattctggagttggatggaaatcttaataagcagttccgggtgtttgaagctgctccacaggagatgatgatgtctgacttgggaggaatcagtgaaggacaaatcagttctggaggcaggagttctgcatcccatccgtctgcttcaaccatctttagtatcatagcagtattgtga

SEQ ID NO: 7886 - DNA, 2334 bp, Glycine max
  Peptide Sequence Number=SeqID_99571
atgtcgaactcacgcgctctctctgcgccactcgctctgcttcttcttcactcgctcctttttctcgtctctgctcagagatctacctggaacactctcggcggaggtgcgccgttggttgtagcacgtggtggattttcggggatacttcctgattccagtggtgctgcctataatttggcagtaatatcgactgggccagatgtctatatatggtgtgatgtgcaattaacaaaagatggagttgggatttgccagccagatataaatcttgcaaattctacttacattgcaaccatttacccaaataaaaccacaagttactcagttaatggtgtgcccaccagtggctattttcctctggattataccctgaaggacctatctagtgtcatcttaactcagggagtatactctcgatccaccctgtttgatggaaacaattttggaattcttactgttgatgatttagttaaattagatcaaaaaccaaaaggaatatggttgaatattcagcatgatgcattctacgcacaacacaatttgagtatgagaagctttgtgctttcagtttctagaagcgtagttttcagttatatctcatcacctgaggttggttttctgagaagtatagcatcacgtttcaacccaaaaacaacaaaattggtcttcaggtttatgagacagagtgacgtagatccatcaaccaatcagacttatggttcgcttttaaaaaatctaacatttatcaagacatttgcttctggaattcttgttccaaagggatacatatggcccgtagatgcaactctttatctacaatcacatacatctttggtctcagatgcacataaagcagggctggaagtttttgcatcagattttgtgaatgatgttccatctagcttcaattacagttatgatcctcttgccgagtacctccaatttgtagacaatggtgacttctctgttgatggtgtgctgtctgattttcccataactccatttgaagctatagcatttgtccctcggaatggagttgatgcagctccaatctctcaccacctcccgctttcaagcttccacggttgctttgctcacctaggcaccaatgctacgaaaaaagataaaactttggttatctcaaaatatggagcaagtggagattatcctgcttgtaccgacttagcatataataaggccatatctgatggtgtggatgttctagactgtcctgttcaaatgtctaaggacggaacaccattttgcttaaactccattgatcttatagagagtacaacagtcgcccaatcaagcttcagcaaatttgccatgactatccctgagatcaaatctggcagtggcatatttgcattcaacttgacatggaatgatataaaaatcttgaccccctcaatattgaacccttttgcaaaatacagattgttcaggaatccaagatctaagaatgctgggacattgttggcattatcagatttcttgtccttgacaaaaaatcagacttctctatcaggtgttgctatcattgttgagaatgcagcctatcttgcagacaagcaaggattaagtgtgattgatgctgtcattggtgctttaagcaaagcaggttatgataaaccaggatcccaaaaggtttatattcaatccactaatagttctgtactgctgaaattcaaggagaaaaccagttatgagctagtgtacaagattgacgagactgttggagatgcagctaatgcagctgttgaggatataaagagctttgctagttctgttgttgtcaacaaggactccgtaattcctaataataataaattcctgacggcctatacaaatattgtgccaaagctaaaaaatgctaacctctcagtttttgtagaaacattcagcaatgagtttgtgtctcaagcatgggatttcttctcagatccaactgttgagatcaactcgtatattgagggagcacaaattgatggtatcatcacagacttccctaaaactgctgacagatacagaaggaacaaatgcttaggtttgggtgacaacaaacctacttacatggaacctgttcaaccaggtggtctttttggactcattaccaaagaattcttgcctccagcagaggctccgcttccacccttgacagaatctgaagtggcagagtcacctttgcctcctgttgctaaaatagccccagcttccagcccgaatgccagaaccaaatttccacagggaaattcacagcctaaggtcactgtctgcttcttcttgtccactctggctgtgtttatagcttctcttcttctgctttga

SEQ ID NO: 7887 - DNA, 2133 bp, Glycine max
  Peptide Sequence Number=SeqID_99572
atgtcaaaatttgagggtgttattgtctccgatcaatggcttcaaagccagttcacgcaggttgagcttcgcagcctgaaatccaaatttgtctctttaaagaatcagaatggtaaagttacatttggagatttgccgcctttaatggtgaagctaaatgcattcagagacatgtacgctgaggatgagattagggggatcttgggtgaatcaggcactgattttaccaatgacattgattttgaagctttcttaaaggcatatttgaatttgcaaagccaagctaccacaaaacaaggtggtaggaggcactcctcatcgttcctcaaggaaactgtgaccacccttcttcacacgatcagtgaatcagaaaaggcctgctatgttgcccacataaacagctaccttggtgatgatccatttttgaaggaatatcttcctttggacccagctacaaatgatatatttgatcttgcaaaagatggtgttcttctgtgtaaacttatcaatgttgctgtgcctgggactatagatgagcgagccatcaattgcaaacggaatcctagtctttgggaggtaaatgagaaccatactctatgcctcaattccgccaaggctattggctgcacagtggttaacattggcgcacaggacttagttgaaggaagacctcatcttgttctagggttgatttcccaaatcataaagattcagctgctggctgatctcaaccttaagaagacacctcagcttgtggaattggttgatgacagcgaggagatcgaagagcttcttaatttgtctcctgaaaaggttctactaaaatggatgaattttcatctccagagagcaggttacgagaaaactgtcagaaatttttcttctgatgttaaggatggagaggcctatgcttatctgcttaatgtccttgctcctgaacattgcagtccggccaccttggataccaaggatgccagtgaaagggcaaatctggttcttgatcacgcagagagaatgggctgcaaaagatacttgaccccaagggatgttgcagagggtacttcaaatttgaatcttgcttttgttgcacaattgtttcatcataggagtggtctatctacagacactaaaaagatgtcctatgctgagatgatgactgatgatgtgcaaacatctagagaagagagatgcttccgactgtggatcaatagtcttggaatttctacacatgtaaataatctgtttgaggatgtcagaaatggatggatacttttagaagtgttagacaagatatttccaagatcagttaactggaaacatgcaacaagacctccaattagaatgccattcagaaaagtagagaactgcaatcaggtcataaaaattggtaaacaactgagattctcactagtcaatctagcgggtaatgacattgtgcaaggaaataagaagctcattcttgctttattgtggcagctcatgcgattcacaatgcttcaactgttgaaaaatttgagatctcattcccaaggaaaggagatcactgatgctgatatcctgaaatgggtgaacagaaaagtgaagagcactggcagaacttctcacatagagagcttcaaggataagagcctgtcatgtggactctttttccttgagcttctgagtgctgttgagcctaggattgtcaattggaaccttgtcaccaagggtgaaagcagtatgattctttatagggatattaaacagatcctttgtataacatatgatgagaagaggttgaatgccacttatataatcagtgttgcacggaagctcggttgttccatatttttgttacctgaggatattatggaggttaatcagaagatgattctcactcttgcagccagtataatgtattggagcctgcaacaacagactgaggacatggattcattcccttcacctgccggcactgctactaccaccacgcctgaagcatccccggcaccttcggtatgtggtgaagatgaaagttcctctattggcggcgaattctccaacttgagtgttgatgatgccacctctgacaccacagcaacttcttcgcaacccgagtctgacagtgtttctgcgggagatgagctgttatga

SEQ ID NO: 7888 - DNA, 1156 bp, Glycine max
  Peptide Sequence Number=SeqID_99573
atggagtcggatcttggcaagctcttcattgggggaatttcctgggacaccgatgacgaacgtctcaaagaatattttgggaaatatggagaggtgatagaggctgtgatcatgagagatacaatagctgatgtttcggttttgtatgtctttgatccatacccagaggccagaggttttggcttcatcacttatgattcagaagaagctgtggacagagttctttataagacatttcatgaactcaatgggaagatggttgaggtcaagagggcagttcctaaagagctttcccctggacctacccgaagcccattgataggatataactatggtttgaataggaccagtggcttcctaaatagttatgctcagggtttcaatatgaatccaattggaggttatggagtcaggatggatggaaggtttagtcctcttactagtgccagaagtgggtttagcccatttggctccagtggttatggaatgggagtgaatttggatttaggattgaacccaagctatggagggacttccagttatggtggcagtctgggatacgctcggatgagtcctttcaacaatggcaactctaacagatataccactcctattggcaatagcgggggcaatgggagaagcgattctcttatgaactcagcttcccggagtgtttggggaaatgggggccagaacaatgctgccaatagtccagtcagccctggcgcttacttgggatctggaagtggggcttttggtgtttcaattggaaatggtggcaccaattggggtccatcagttccaacccagggtggaggggctgccactgggtatagtacttggggtaactcttatgatggtggagataacaacatcagtttaggaggtggagggtatggaaggaacagcagcccaagtgtgcctcaatcctcaacatttactgcaccaactggtgattatgaaggatcctatgggaacttgtaccgcaatggttcagtttacagtgactcaacttggcggtctgctgcttctgagatagatgcttctggttcgtttggttacggtggacttggtggtatagcttcagatgatccagtaaagagttctgatggttttattggaaactacaatgtaataagtagacaaactaatagag

SEQ ID NO: 7889 - DNA, 942 bp, Glycine max
  Peptide Sequence Number=SeqID_99574
atggcttattccctaatggatggtgcctcctttctccctttctcctttatcttccactacatctccatggtggaaaatcaccatcgaaggaactcattgaagctcaaagatcgagcctccatagaagcttctcaagcaagcttccatcaagtggtatcagagcacaagagcttcaacctaagtgaagaacttcatcactattatgaaggaaggcataggtcacatcttagacctcactcccataggagagaaaaggaaagaaagcctcaagaggctaacattaacctcccatacttccatgggaaggacaatgtaaaggcttacttagattgggaaataagggtagagcaacaacttaaaaggaagtctacctcaaaatcttatggctcttactcttatccaaagaaagtccaaggtcaaggcatcttaggggtggcaccttctaagcccaaagatgataaggggaagacaatagaaaagcaacccctaaggctaaaaaccatgattatgaggggccaagacatttatagtagccaagatgaggctactacttcactgtccgccaatgaaagtgaagaagtaaaaggggaagaatctagtgaagaaatctacccccaagaagaaggacaacctttaatggactcattaggtaggtttgttcttattttgggtttcaatacaaacctaggtgctcctatgggacaccttagtgatcaaggggttcccatgaaccctaagagaataaaggtcattcctgagtggcccactccaccaacatcactccttgagttggtgagtaaccatgttccctcatgggaagatgcccaagaaacgggtgtcgagggaagaagcccagagtttcaagaatctctagatttgaggtcaaatccttttcaagagggaggggatgatgcaatcctacctcctaagggcattggatag

SEQ ID NO: 7890 - DNA, 531 bp, Glycine max
  Peptide Sequence Number=SeqID_99575
atggaattggatctcttctttgttagagaaaaagttttggagaagcaacttcaagtggttcatgttcctgccattgatcagaaggctgctattttgacaaaggctttgactccttccaactttaccacgtctgacttgagtaaagatcagatgatagtagatctttccagcaaaacaaaaatactgttttggggtggtattgctcttggttcaatgtcagttggggtccttggctatgcagttgtgaggaactggaataagtggaaacagtggaagcaacagaggcagctccagcaacaaaggcaagcggtgagtgatgttgaacctcagatggatgatgagattgaagatgttccagatggacaattatgtgttatatgtctgatgaggagaagacgttctgttttcattccctgtgggcatcttgtgtgttgccaagggtgtgccatatcagttgaacgcgaagtggcacccaaatgtcctgtttgtcgtcaggagattcgagattcagtgcggatttatgaatcttga

SEQ ID NO: 7891 - DNA, 240 bp, Glycine max
  Peptide Sequence Number=SeqID_99576
atggaagcggaatggagaaggaagagagagagagagaggagactccacttcaaggagaagatgagtctagaaaaagctcaccaccataggaggccatggataagagcttggaggaagaaggagatgaatgaagggagaggaagagaagagcacgaaactatggttcagcccactaatccaagatcaagtccaagattctccactaagtgtgttaggtgtcatgaggcatgtaaagcatga

SEQ ID NO: 7892 - DNA, 1032 bp, Glycine max
  Peptide Sequence Number=SeqID_99577
atgtgcagtgccaccgattataatactaaatcaatcggaggtatgtgcatcttactacaactgtgggcatgggagcgatgtccaaccttggctccaaagaggactccttcccaagtagaaaatacaccattgggacataggtggctgcgacgtggaaaccaacatatcggcaatgatgatgtgagagtttttcgtcgcaagctggatattatgaaacgtcatgagtttgtgtgggagccttacccatcaaccgttttatcattgttgcctcccgtttgtttagtcggaagtctcgcgtggcgaaagacaaagatgtttgttgacccagaaaatgcaaagacggctacattgggtgaagttgcggaggcattacaatacatggtgtctcctgaagggaggaatacatgcacatttgatgatctcgtgccttatgtggaaaaaattacaattttatccgaagagcaagagagagtcactgagccagtgtcacatggtcccgcatcagagcgtcaatttcccgcacaacagtttcacatgcttcagtcaagtattgaaactcaggggatagacagaagaagggacattgttgaagcggaagaatattcccaacaaatggcggagcgtggccatggaatgtattacacgccacaaacatttgctgagtatccgacccagatgtatcaatatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaccgggaccaatacctaatacgggtgacttattcggtgttgatttgcggcacgcattttctgcggaggctgacgaagaagaagcggggaggcatcggggcagaagaaatcctgatcgccaagcacgaagatgggatcgaccatgtggcacatcctcacgacatcacggacaccaaaatgaatga

SEQ ID NO: 7893 - DNA, 281 bp, Glycine max
  Peptide Sequence Number=SeqID_99578
ggcaagcagttggtggtatacccctacaaaaccctttggagggccctcagtatcacccacaactgcacctcttgcattccacagcggttaaaaacccttatgactatggcaggaatgggaaagttggatcatctagaggaaaggctcaagggccattgaaggaggtgtcggactttggcaagtacaaggggactactcgctccaagaaccatctaaagatgtactgtcggaagatgggggcatacgcaaaagatgagaaactgctgatacatttttcctga

SEQ ID NO: 7894 - DNA, 534 bp, Glycine max
  Peptide Sequence Number=SeqID_99579
atgcaagggataacttggctcccgaagctaaaaagtccatgtagggaagaaactgaagtccctaatgagagcgaagaagtgcaagccttgaaagtagagcttgaaagaacaagagtggttaaggaaaagctaaaaatggcagtcaccagggtcaggaaagaatgtgatgagctaagggatgtcaacatgaccacagccgaagcgttagagcgagaaacaaagagagctcgaaaagaggaatggggccaaaacaagttccgaagggctttatggggcaacaacaacaaactcaagcttcaaagggccaaaaaagatgagtcaagggtggaaagtatgatattagaggataagttgagggcttgccaaaggtcgaagagaagtttgaccgaacagctaagtagtacggaagagaatatgttgacaatcatcgaccagtataaagagaagctaaacctagctgctagccataggcagagacttaaggatgagcatgcaaaggtatcgactctgcaagtggaaagggaagcgagatag

SEQ ID NO: 7895 - DNA, 742 bp, Glycine max
  Peptide Sequence Number=SeqID_99580
atgatcttaaaaaaggagttagttgcttgtgcgaggtccaaaaggagtttggctcaacacttggaagccacggagcaaagcatgctagctatcatagggcaatacaaggaagagttgaaccagtctatggcccatgaacaagagctagtggaagattttgcacaagtgtacgccgagaaagaagcaagagggagggtgattgatgcgttgcatcaagaagtgactatgtggatggataggttcgccttgaccatgaatgcaagtcaagacctcctgcgtctattggccaaagcaaaagccatggctgaaaggataaagccatccgcaaccgcctccagtacagttagggaagcggagccggtgctgcagcctgccttgtatccgggcctagacagaaacacggtcgtgttcggtcgaaggtatagtccgcaagcttatccttatggcctacctccggacttcaccccccgtgccactccggaagatttaagccaagcccctacttttgaggggcaactcccaccttatgaagactatcccggacaagacgatggggaaggagatacccatcttggccccctgctccacctcaaagatccatccccgcatgaactaccccagccgaacatagtccgccatatcccggcctcacccacacccgtaaaagaatttgttccctttgcggaagataagggaaagattgaggcgcttgaagagaggttaagagcagtcgagggcctcg

SEQ ID NO: 7896 - DNA, 243 bp, Glycine max
  Peptide Sequence Number=SeqID_99581
atgactatgtggattgtcatcatcaaaaagggggagattgtggaagtaatgtcttccaaggttattttgatgatgccaaagaatcaagagttacgcaaagtttcaagcaaagattcaagaatcaagtttcaagattctagattcaagaatcaagtttcaagtttcaagattcaagaatcaagatcaagattcaagactcaagattcaagaatcaagagaagactcaatcaagataagtactaa

SEQ ID NO: 7897 - DNA, 252 bp, Glycine max
  Peptide Sequence Number=SeqID_99582
atgactaccaaccttgccgaatgtatgaattctgttttgaaaggagcccgagcattacctattactgccttagtcaatgaaacatttgatagaacaaatgattcatttgttactaatggcatcaaaatcatgaatatgataaaggcaggacataggtactctgaagatgtatatgtcatgatgcaagaaaatcaacacattgctacctcgcattatgttcgcatgtatgttcgagaaacaagggagtttgag

SEQ ID NO: 7898 - DNA, 87 bp, Glycine max
  Peptide Sequence Number=SeqID_99583
atggcgcgcccagcgcgcgatctgaacgcgctaagcgcgagcctagcctttctttcatccccagttgtaagccctcaatggccatga

SEQ ID NO: 7899 - DNA, 342 bp, Glycine max
  Peptide Sequence Number=SeqID_99584
ccattagaagagaatgagcatgtgattagaagtgtgactgaaaatgttagtcagtttgtcagattgattgtgaagaaatgcattaaccgtatcccggaaagcatcatccataggaagcgtggttcaaagcaaatttgtcccaaatttgggggagtaattatcaagtgcgctaagcgcgcatccaccgctaagcgcagcttcagcgcgacagaagaatctggcaggacatcatcatcaaggccgcgcgctaagagagagattagtgctctaagcgcaacagttgtcttcagccaggctcagcgcacgactggcgctaagctcaaatccacttactcgcgctaa

SEQ ID NO: 7900 - DNA, 156 bp, Glycine max
  Peptide Sequence Number=SeqID_99585
atgcccaagtctatggggcaattttggctttgtttcatgcttgattggtgcctatgttgcattctggagtactggggcatgccgcattgcccccattctcttgctattcatgccaaaacatgcgcccaccaagtgctcggtgaaatgcctcaatga

SEQ ID NO: 7901 - DNA, 47 bp, Glycine max
  Peptide Sequence Number=SeqID_99586
ggtgaatgctgtgaaaattttcccggacgcccaaaatggactcgaat

SEQ ID NO: 7902 - DNA, 612 bp, Glycine max
  Peptide Sequence Number=SeqID_99587
gtcctcaccttcaaaggactacacgccctcaccttcaaagggctacacgccctcacctttagaggactacaggtcttcgccttcagaggactacacatcctcgccttcataggattacaggtcctcgccttcagaggattacacgccctcgcctttagaggactacacgtcctcaccttcagaggactacacgccctcgcctttagaaggctgcacgtcctcacctttagagggctacacgccctcgccatcaggggactacatatcttcaccatcagaggactacacatcctcgcctttagagggctgcacgccctcgtcttcaaagggctgcacgccctcacctttagaggactacacgtcctctccttcaaagggttacacgcccttgccttcagggggctacacgtcctcaccttcaggggactacacgtcctcccctttagagggctacatgccctcgccttcgtagggctacacaccctcaccttcgatggactacacctcctcgccttcagagggctacacgccctcgccttcagaggactacacctcctcgccttcagaggctgcacctcctcgccttcatggggctccacatccgcaccttaa

SEQ ID NO: 7903 - DNA, 330 bp, Glycine max
  Peptide Sequence Number=SeqID_99588
atgaacgaaaacgcaattcatggggctccaaaaagattgagaatggagaaattcactaagcaatcactacgcatagttccaaactcgaaggagaattgcactaagcaatcactacgcataggctccaaactcgaaggtggaggacacatgaacgaaaacgcaattcatggggctccgaaaaaggggttgagaatggagaattgcactaagcaatcaactacgcatagctccaaactcgaaggtggaggacacatgaacgaaaacgcaattcatggggctccgaaaaaggttgagaatggagaattgcacataagcaatcactacgcatag

SEQ ID NO: 7904 - DNA, 186 bp, Glycine max
  Peptide Sequence Number=SeqID_99589
atggctcttagttatttcgtcaccatttttgcgacttaccattttcgtagtgtgtgccctcgtccacacgaccttttcaaagagaaaaagagaaaaaagaaagaagagagaggaaatgaacaaatgataaataacttaaaaaaggaaaaagaggaaaaggaaaagagagcaagtaagaaaagataa

SEQ ID NO: 7905 - DNA, 240 bp, Glycine max
  Peptide Sequence Number=SeqID_99590
atgaagaatggaagatggatagcgcaagagaagatcaagagtgaagagaagatcatccatggcgctatccctcctgagctttacagattcttccacactaaaaaacaagagcagcacaacacaacagcacacacacaaggtgcagaagctaataacccttttcttaaaaaaaagctggctatagctagctaccattatggaacattaaatgcttctgatacatggtggggagggacgtag

SEQ ID NO: 7906 - DNA, 351 bp, Glycine max
  Peptide Sequence Number=SeqID_99591
atgcagctggcgaagaagcgagccgacaaccgtattctgatcggcgagtccggagcggtggccgctctgattccgctgctctggtgcagtgattcgtggacgcaagaacacgcggtgacggcgttgctgaacctgtctcttttggaagagaacaaggcgtttataacgaatgcgggtgcagtgaagtcgctaatatacgtgctgaaaagagggacgaagacttggaagcagcacgcggtttttgcaaggaggagtgacaaaagcagaagagagaccacaaaagagggcttcattttgaaagaaaaatcttgggaagaaatgagcaagttaatccttaaacaaagagggtag

SEQ ID NO: 7907 - DNA, 118 bp, Glycine max
  Peptide Sequence Number=SeqID_99592
gctgacagaatacaacccccaaagaaaacggaaggtgggaagctatatgccccagctgctgttgatcgcttcaggacacttggtgagcaagaacagattgttcgggataatagcactg

SEQ ID NO: 7908 - DNA, 480 bp, Glycine max
  Peptide Sequence Number=SeqID_99593
atgactgcagcgtacgacgagccagtggtccttgcgccagatgttcaggatgaccctatggaggcaccagctgctgtagaggacattgtggcagacattcctgcggacacaggcacagaggctgctgaggatgagcatgagggattttcgggtggtccgagcgacccatccgtgttgacccagtatgcggatcacgttgcttgcagcgtatggacgggagaggagtgtcctgaactgaagatatcctttcatgggaggaaggtccatagtttaagcaggcatgtccctgccattgaaaaacttgttgctggtacaggactaagtcctctaatcgcgtgttcggtagacaccgacgatcggggacttttgtccgcgtttatggagcggtggcaccgggagacgtctagtttccatctctcggtgggagagctcaccatcatgctggacaacgtctcctcgcttctccatatcttcccgtga

SEQ ID NO: 7909 - DNA, 390 bp, Glycine max
  Peptide Sequence Number=SeqID_99594
atggctgctagtgaccatgcaattttgcatgataaagttcatatccctaccaagaagagtttattggagctttcatcacaagatgccttattggcccaaaataagttgttgtacaagcaacttgaagctttaattgaaacactaagttgcacactttgtggtggagctcatgggtcaggcttgtgtattcccactaaagaaatatctcatgaagttaattacatggaaaaccagcctagacaaaattttaatggaggtggattttctggatttcaacatgaccaaccttaccagcaacataatcaatggagaactcaccctggtaatcagtttaataaagaccagggtgggccacctaatatgccacaacaacaagggcatagcttataa

SEQ ID NO: 7910 - DNA, 240 bp, Glycine max
  Peptide Sequence Number=SeqID_99595
caaaagaatgtttatacggataaccactcgggtatttccgcgtatcatcgggcccgccgcctctggatgatacaagggtgcagaatgaccaaacttggtctctgcttgtcatcgggcccgccgcctctggatgacaaaaggggtcagtatgacaaagattatggggcggccgacaaaagcaaggcttttgctcctacgtatcctccaatgaggaactcagacctacgtagttctggataa

SEQ ID NO: 7911 - DNA, 342 bp, Glycine max
  Peptide Sequence Number=SeqID_99596
atggttaaggaggagtgtaaggaggtaagtgtctcctccaagaggttagctaagaaggaaagtcattttggaataaagacaaacattgaagaagcttcctctcttagacaatctccacatcttctcatttttaaaaagacacttgttagcactgtcacacctcttgggcttgtgattattcctcaactaaaggagttgttggatgatggtttggttcgtattatgaggcaccaaatccctatgaaaggtggtatgatgaatgtgttgagtggtgcaaccctcttttgtaaaatcacccatgcatccaacatcttcatgatcacatacattgggactcattag

SEQ ID NO: 7912 - DNA, 192 bp, Glycine max
  Peptide Sequence Number=SeqID_99597
atgacctctatggagacctctgccatggctaggtcccagatcttaccaaatgcgtatggcacagatgcattttacgaatatgggagccagggagattgtccccttcttaggtacaacattcaggtagcatggcgctcgatgtatgcatttaagaaggcgacacggaccctccgtcggttcatgacaaagtga

SEQ ID NO: 7913 - DNA, 190 bp, Glycine max
  Peptide Sequence Number=SeqID_99598
ccaccttgatgttagcctaacatcaagtgttggacctgagtgtgtagagttgatctctattgttcagagagcaatctctggttgcacgggtagtgaatggagaagaagagttgagaggagatgccacttcaaggagaagataagtcaagaagaagctcaccaccataggaagccatggataagagcttga

SEQ ID NO: 7914 - DNA, 222 bp, Glycine max
  Peptide Sequence Number=SeqID_99599
atgccaccaacgtttatttgtggaaaacgtcggaaaaaccgaaggaaacaggtcgacaaaagcggggctcttgctcctaagtaccctccatcgaagaggaaatcagacctacgtagttctttctttaagagtgaatcaagtgattctttttacttgaaaggcgatcattttaaggcgttggaccttttaaaaatgatccatttacatgataaggaaaactga

SEQ ID NO: 7915 - DNA, 252 bp, Glycine max
  Peptide Sequence Number=SeqID_99600
atgatccttgatgccttagttggaggcactatgatgtccaaaagcccgaaggaagctattgtaatcattgactccatagcagctagtgattatcaaagtcatcatgatagagctccgactcatagaaaagccactgttcaacgcctagtgatggacaacaagaagaggaggcccattatctgcagaaccaagccataccttaataaaactttcaaggaagctaccaaggatatagaggtggctcgggtttaa

SEQ ID NO: 7916 - DNA, 268 bp, Glycine max
  Peptide Sequence Number=SeqID_99601
atgcctggcgttaagccagaaagttctggctgtggaagagactggagagaaccgagcttgaagaggaagctattttgcagagcattggacgagattttgagtgattgtgaggtttctagagatggaggagacatccccactacatgtgatacagaccttccggcttcccgtgacaacatgacgggaccaaacatacaacacaattgtaatgacccgacgcagcgaaaaagcgcaaggttttgcgtcgcagtcgagacgcaaaatcaag

SEQ ID NO: 7917 - DNA, 1134 bp, Glycine max
  Peptide Sequence Number=SeqID_99602
atgaaaggcagtaacaaatcccgctgggcaatcgccgctggcatcattgtggtggtccttgccgccgcctggtactggcacagtcaatccgcgaactccgccgcgcccgccggtgccaccagccagccacagcgcccggctggcggaggacgtcacggtatgcgtggcggcgcgctggcaccggtccaggcggccacggcggtgaataaagccgttcctcgctatcttacgggactcgggaccattaccgccgccaacaccgtgacggtgcgcagccgcgtagacggccagctgatggccattcacttccaggaaggccagcaggtcaaagctggcgatctgctggcggaaatcgacccgagccagtttaaggtcgccctcgcccaggcgcaggggcagctcgcgagagacaaacgccaccctcgccaacgcccggcgcgatttagcgcgctaccagcagctggtgaaaaccaatctggtctccccgaaacgcagggcaccattaaggctgacgaagccgcggtagccagcgcgcagctgcagctggactggagccgcatcaccgcgccgattgacggccgcgtcggcctgaagcaggtggatatcggcaatcagatctcaagcggggataccaccggcatcgtggtgatcacccaaacccacccgattgatttagtctttaccctgccggaaagcgacattgccacggtagtgcaggcgcaaaaagccggcaaagggctggtggttgaagcctgggaccgcaccaataagcagaaactgagcgaagggtccctgctcagtctggataatcagatcgacaccaccaccggcaccatcaagctaaaggcgcgctttaataaccaggacgatgccctcttcccgaaccagttcgtcaatgcgcgcatgctggtggcgaccgaagagaacgcggtggtgatccccaccgctgcgctgcagatgggtaacgaaggcaacttcgtctgggtgctcaacagcgagaataaagtcagcaagcatctggtgaaaaccgggattcaggacagccagacggtggtgatcagcgcgggcctttccgcaggcgaccgcgtggtcaccgacggcattgaccgtctgaccgaaggggccaaagtggaa

SEQ ID NO: 7918 - DNA, 610 bp, Glycine max
  Peptide Sequence Number=SeqID_99603
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccgggtgtcattccgctgttatgggccgcgttttgtctcattccacgcctgacactcagttcccggggagggcagtttcccctccaagcctggactgtatgcacgaacccccccgttcagtccgaccgctgcgccttatccggtaactatcgtcttgagtccaacccggaaaagacatgcaaaagcaccactggcagcagccactg

SEQ ID NO: 7919 - DNA, 300 bp, Glycine max
  Peptide Sequence Number=SeqID_99604
atggatgaatactttagggagtcaaattgcaaaacaactatctctagaacatgtccattggatttaatgatgaaatatgtgcaatttcaggtgaaaaagaagttaagtcatgaagtgccaaaacacgcatccacctctaagtgtagcttcaacgtgcttagtgcgatagaagaatatggcagggcatcaacatcaaggtcacgcgctaagcgcgagatcagtgcgctaagcgcagcatgtgtcttcagccaggctcagcgcacgactggtgctaagcccgaatccacttactcgcgctaa

SEQ ID NO: 7920 - DNA, 174 bp, Glycine max
  misc_feature (153)..(153): n is a, c, g, or t
  Peptide Sequence Number=SeqID_99605
atgagagtgccttggataagaagcttaggaaggaaacttcaatggaggaaaagaaagagagagagagaaagagatacaggggagcacgaaattgaaggaggaaaagaggaagagaagattgcattatatcctcccccttggaaaggatttganctcaaatctcaaggttcttga

SEQ ID NO: 7921 - DNA, 524 bp, Glycine max
  Peptide Sequence Number=SeqID_99606
cctcctttaatcaatgcagacttgccagctgttctgcactcttgtggggttaagctcatccctttcaatcttaatcactatgaggcctgtcttcttaggaaccacttggactggactcacccactggctgttagaaatagggtagatgattccagtagatgggctaataccaagagggtcctggggtttccaactctgattacgggcctctgtcagttctacagagtgcccattgctcttagcaaggtggcaggcgggggtaccttatggttatccgcaccttttgtcaaccagaggcaagcaagcccgttgacagataaccaagcggttatccgtacaaagatttctgttaatcctgacccgggaagtcaggtggcaggcggagatacccaagcggttatctgtacaaagatatatgttaatccttacccagacagcgagtccgatgacatgtgggggataccttatggttatccgcacctttcgtcaaccaaggaaaacgaggtcgatggtatcgggataat

SEQ ID NO: 7922 - DNA, 270 bp, Glycine max
  Peptide Sequence Number=SeqID_99607
atgccaatctccccctgcaaaagtatcagttgggatcgcacccacaagacacccagtggacccggaaaagtccaacagggccctggggtttccagctctggttacgggcctctatcagtcctacagggtgcccgtacccccccgacaagagtacctataacctccagcaagggcatcaggccccctactgatcgagctttcatcaagaagtactgcgtccctaggcaggcgcagggcgaaacaccacagcagcattgggatggccggtag

SEQ ID NO: 7923 - DNA, 306 bp, Glycine max
  Peptide Sequence Number=SeqID_99608
atgctcaatggaatgccctggggctcctccatgataagcacacattgcgttcgagtcgtatcctcagaaaaatggaggttgaggaaccctagcaggggttatggctaccattgcagtatcaagtggtgtttagcattggttgtgtggaaggtgggttttgtggttgatttagggatggcctttgtggataattgggtggttggtgggaaacttggtcgtataggaatggcagtcgcagcatgggtttcttcttcattctcaccctcttcatttgccccagttttctcactcgtccaagcaggatga

SEQ ID NO: 7924 - DNA, 675 bp, Glycine max
  Peptide Sequence Number=SeqID_99609
atgggtgatcaagaggagacacaggaacagatgaaagccgacatgtcggctctgaaagaacagatggcttccatgatggaggccatgttaggaatgaggcagctcatggagaaaaacgcggccaccgctgccgctgtcagttcggctgccgaagcagacccaactctcttggcaactgcgcaccatcctccctcaaacatagtaggacgggaaagggacacactggggcacgatggcaaccctcacctgggatacaaccgagcggcttacccttatggattgccgcccaactactcaccacccgtcttgcaagacgatgcgggccatattgcttctcccgtccttgaaagagagcctcctcaacagcccgacgaggtccacaaagaccctcaagactatgctcgaagtgatgtcgagttctatccccccgatcccgaagggccggcacccagcatgttgcctcagcccaacatcacgacacaaccaatagttttgtccacggaaggaccgcccccggcaactgaagaaaggaggaagctcgatctcctcgaggagagattgagagcccgtggaaggatttggggactatccgttcacagacatgacggatctttgcttagtacccgatgttgttatcccccccaagttcaaggtaccggacttcgacaagtataa

SEQ ID NO: 7925 - DNA, 201 bp, Glycine max
  Peptide Sequence Number=SeqID_99610
atgggtcgatgttcgcttactcgaacccactcaaggatactaggctgccttgcagtggcgttttccacttgtccagagctgggaagggacgacgatttgtcggtcgtgaccctagcctcaatttgcgtccgtccctatgtacctgaaagtaggaaacaacaatgcgtggcaaatcgtgaccgcatcgtcgtcttaccttga

SEQ ID NO: 7926 - DNA, 563 bp, Glycine max
  Peptide Sequence Number=SeqID_99611
ctgatgtcggtggcttcttccttcctttcgcttggaggcgtatacctccacggaactgcgtggctgtttcggccttcgaaaacttccctcatctgcggactgcatacatatatgctgctcttcactcccctcatcgccgacttccagccggcctcgatctatcatctgttgcaacagataaatctcttggggatcgtcacgtccttcaaaggcttggatctgtgcggcctacccgactcgacgacattaattgctccccctccatgattggcgagcgggcatttttcggtggagtggcccggggttttcccatggtatgcgcaggttgcgtcagggttataccactttggaaaaggaggctagttgatcttctcgggagatatcacagccatctggttggcgatgagggatggcaagaggtcttcgtacgtcattgggatcagggtgaactctggagttggcctcaggggaagttccttatcgcgttgaaaccggcgccaaagttggcgttgccggtcgggcgagtcggggttggagccggagcttggggggcctccctctag

SEQ ID NO: 7927 - DNA, 276 bp, Glycine max
  Peptide Sequence Number=SeqID_99612
cacttggttcgccagcaggcggccaatcacagggggcaggtgcagatccatgagtgtctcaaccagcttagcctcagtcagcagagccagggtttcgctccttttgcgtgccctactccagatcagtttaaggctgaggtcgcatggcccggagattggcccgaggaccagacagaggaggcacctataggagctcccgacggtgcagaggacgcccgcatggatgaggagatgatagatttactcgatttcttgggaggaagaggagccatgtga

SEQ ID NO: 7928 - DNA, 168 bp, Glycine max
  Peptide Sequence Number=SeqID_99613
atgtggtaccatccccaaggaaatagcctaagcgtgtccacacgacactcacacttaggaaaactaggcaggacatccaacaaggtcactgcacccccctcccccatgaacatacacatcacacaacgtatgaaacatgggcaccatcaatgcactgaccgtggataa

SEQ ID NO: 7929 - DNA, 94 bp, Glycine max
  Peptide Sequence Number=SeqID_99614
atgaattggttgaaaggtctaacccatacacagcatttgaaagatagggcaatttaccactcacaagctccccatggatatgattatgagagag

SEQ ID NO: 7930 - DNA, 4782 bp, Glycine max
  Peptide Sequence Number=SeqID_99615
atgcgaactcactttctcaacaacgactacttcgctctccctccacctcaaaccttccccttcctccacttcccaatccctcgcctccctccgcctcctccctccgccgtccaccacctcctccgcttcgatcctccgatccacctccccctccacctcgaccccttcccggtccacgccacgctctccaccttcctccccgccatcctccctcaccgaatccgcatcaactctcacgatctcgccactccgtcaaatcccgcaatagaggcggaggttatcttcgaagatcgtgtatccgaagctgatatcaaattttcgaatgagagtaaaattattgctttcaatgataagaacgatgatgtttatgagacaattcagttcgaaataccagagcttggcacgttcttggaaaacgtatgtgtcactgagacggagaggatgcaaatgctgtctctaactccagaagttgaaaatactctggaaatgctcaagcctgaaccatcaaggcaatatccttatgaggctctggaatcagtattgttggttgaagatgtaatttcagagtacttgatgggggaaaatgcatattctctagaaggtcatatttctgttcagcaccagccacactctgataaaaacaaatttcttattttggaagtggatgaggaaagtttgggaactcccacgtgcttgtctttggtagacattgttgactcatattttgaaaatatcagatctcaaaattttgatgaacaatatcaatctgttatagagggcaaggaacttttgggttctatgaagcataacatgatggagtttttctcagatgagtgtgtatcaaagaagagcctggagttatcagatctgtttcctgaaagggattttatgaatatgctggaaactgaacatgttgataggaatattggcctgcaaaggacatcgcatgctaatagtgatctgatactgaattttgttaccttccaggagtttgtgttccttgatgaagacttaatgcaaacctttgaagctttctatgacttaaaagcttcggatgatttagtttcagaagagtggatgcttaggaaagagtttaacttcaagagttttgatgaattgattgttagtaatgagacagcactaacagatgacacattcaaatcactgcccgtacctgttatctctgatcacaaaaagatgataactctacatgacatcattgtagaacaattttccagcttgaagacccggcccctctctgcctctgatggaatttacttaagctgggatctacttgaagaagataggtgcaattgcaaaatctctaactggtatcagaacatattggccaagatagatctgaacaaccaagattttggaggaacatcttttgatgatggaaaattggcatttgatctagttttctgtgatgacaccatagatgaatgtgacattaaacaaaatgaagagttcaagaagttgctttctgatggcatgcctctagttgacaatcatccagtagaagttgcttcaggcaaagttatagaacatgtatcttctaaacaaggaagtcaagaacaattacctgaacaaaaggctgagagggcttcattgttatttaaatctctgtcagaaatcagcaatcttgattatttcttaaaccctaaagaagcgactggtaaggggaattgtaattatgcagtagagtccactaatgctaatgtttgcattccaaaagtttcatccaatgaattgaaggttggtgcacagtcacaagtgttccatactgttctgcatagagttagattgtccgataatattgtggcccttgctggatattttgaaaaaagctatctagccattctgcacagtgatacagagatgacaaaaatgcataactcggatgcagattatttaaaattgttgggtcttcaaaagcacaagctgattaaataccatgtaaatggaaacaatatggcttttgctgtgttatgtgctattaaacaggctgcttggtacttgtgtttctatggtctccatccagcattcttgtatttagacaaattatgtcaaaacttggagtatttgaaatcaaagttaggcttcctccaatctttgatcaaagatgaaaaggggaaggtggacagcaatgttactatggcacacccatcattaacaattgtcaagaagattttacagtcatacaccaaacagaatagttcaaaaactttaattgtggctgaagaagtattctggtattcattgaaaaatatcctcctttccctagggttatcattcattgaactaaatgattcttatagaaatcagccatatgccaatactgtgcctaaggacacagatactaaaacgaaagaacttctgatttcagactgcttgttggtttcacacaagcatgtttttcccttgtttcctttgaacaaatttgacattatcttggaatatggaggcccatatgactcatctaggatatctgagctttcacaaaacttggttgaattgcctcatcttcactttttgagggttgaattggatggtcatgctgctctcgaagcactctgcgaaggtgttgaaatgcccccaaacattgaaatgttaatggaaagtgagactcgtctcattttcaatcataaggaaagtatgaaccagaacttggagagactactgaacttttgtcctgtggagcaaagctatgataaaaaatcttcaaaggttgcacctgaagcagataatcatgcgccactaattcctgctgtgaaaactgagcatgatcataaaagcatggaggtttttcctggaacagttatgatcgtaaatactcaaaatgtagataaggaaatgataatgtctagaagaagctcttaccaattaattcttgcaatggagaaagaaggaattcaagttgttgaacgtgatttagatttgcctgtggatattatattaagttctgctatttgcttggcacagtatgatagtagaaaccttgggaagaaagcaactcctgcgactgaagcatcctcaagcttgcctttatgtattgagaatattgccacagatgttctgacattgcttagtttttacttccgtggttgctttctggtgtttgaaggagagcttaactttctttcaactgtaatggaatcctcagataggctctatgctgcagcaacaagcctgggaattgatttgcagatattcttctcttactcacctgagttgacaaatgaagttattgtaagctgcattaagagtgctaccaatatgacaaggggtctgtatcctaaaatgcctgactcagtaacttttgccgagtcatttcttacagaatttcctggaataaatcctttaactgcacactatatactatcttcaggggtcatgcttaatgagtttcttgcatggtcacatgagcaaaggatgcatgttttagaaaagtatcatgttccagaagaaagtatttctctattcagtgttttctgcagatatggggaaccggaggattcaaaatccataatgacagattgctcctcttcagtatcttctggtctggactcagatagatgttgtttatatgaagttgaaaatgaaagaaaaagaaaaaatcctataagtagtgatcagatagatgaaccatctttggatgaattgttgcaatttgagacattaaatcaagtagttgaggctgtcccggattcctctaccttgccaaaaccttttgattttggtatgtcaaaaaatgcagggagatctagtgacttcgcaaacgcaagtttttccatgagtgagtttttcagtcaaaagcaaagcaccggtgcagttacaatgagaaacctttctggagtctcttattcaccagggaactgcaaagctccccacaaatcagagaaactgaaacaacccagtttatccttgaaaaataaagagttggctcaaaatgaaatactgggcactgctttgatgggcaaaggtgtgaattggcataactttagtaattctgagaagctgcatggagacattagaggtgaggtggtggacttgacagataaccccttatttgataaaagctttgccactcctgattccatgtacttcacaagtttgatggcagagacagatcagatgagaaagaataaaattgcaaggaaattgtcatttgataatagtagtcacccagcatccagctcatcgaaaatatggagatcctttaaagatacacgaggacaagttgacaactaccctgaaccagattttcgagaagatgtttttcctcctgatttcaagccccgcaaaaacattgttgtaactcaggcatcgatgagaaacttagaatcaccattcaaggaggaaatctcacatttgggcataactccattctcatttgcccgccagtcagctattatattaaagaattcaccttggacaactgagtttattaataaagtaaaagaaaagagcggattgcgtcaaaaatcattatcaagtgagaactctggcccttattttgggtacccagggagcatgtccaagacttctaagagaataaatccttccgtaattgatttgtttaagtaccaacctaatagagcatctagaaatgttccggaacagaaaagacagaagcaatcagagggtaattctcagactggtgatgaaaatggagttcgagatcagaacaggaagttagatagcgtactggataatctatctttgaagccaatggggatttcacatgatgattcatttaagatctacgatcctgcttag

SEQ ID NO: 7931 - DNA, 444 bp, Glycine max
  Peptide Sequence Number=SeqID_99616
ggcgcagaagacgacgttagtctctgcgtgctatcaggcgtttcgtcttacagacagcaaaaagtttatacggataaccactcgggtatttccgcccgtcagcgtgactcaaaagtcagtatgacagatcttgtgagcgcggaagatgacggcgcagaagacgacgttagtctctgcgtgctatcaggcttttcgtcttacagacaacaaaaagtttatacggataaccactcgggtatttccgcccgtcagcgtgactcaaaagtcagtatgacagatcttgtgagcgcggaagatgaccgtgactcaaaagtcagtatgacagatcttgtgagcgcggaagataacaagcaaaaagtttatacggataaccactcgggtatttccgcccgtcagcgtgactcaaaagtcagtatgacagatcttgtgagcgcggaagatgac

SEQ ID NO: 7932 - DNA, 810 bp, Glycine max
  Peptide Sequence Number=SeqID_99617
atggcatccaagaaaaggaaagctccttctacacctacccgggccagatttgatagatccagtttcacatcccaagaggcttgggagagatatacagacattgtggtgcctcgcaagctactaccagagaggaatgtggtagtttattacatagagtttgacgagttcaaggaggaactcgaaagaagacattgtgaagagaagttgactaatttttctaacagcagtatagacatcgccattgtgaaggaattttatgccaacgtgagggtgaaaggtcacttagtgaagtttgataaggataccttaaacacattcttgaagacccctgtagtgctggaagagggggagaacttgtgtacatattccaaatttgcattcctgaggcctgatcctcaggagttggctgctaagctttgtatcccagggaggggattcgagcttaatgctaatgggcagcctttgaagattatgaggaagaacatgaccactctagctcagacatggagtgttatttccttttctaacctcattcctacctctgatgggtacctcatctcccaacagatccctctgatttcacagcatgacacatctagacttggattccatgccttgatcacagctctatgcaagtgtcgcaacctacccttttgcgggagggcgacgcgagggctcatgggtgcgtcttccaaaggaggaaaatgcgtggagtcgccaccaacgtttattgaaaggaaaacgttagaaaaaccaaaggaaaccggtcatgaagaatattccagattcggaagttgtatttacgtttga

SEQ ID NO: 7933 - DNA, 411 bp, Glycine max
  Peptide Sequence Number=SeqID_99618
atgaaaatctcttccttccatcaatttccagatgaatccctcaacgaggcgctcaaccgcttttgcgggttgctaaggaaaacgcctacacatggatacagtgagccggtgcaactcaacatcttcatagatggcctaagacctcaattgaagcagctactagacgcattcgctggaggtgatcatgccattcttcgtgatcgcacatatgcaccgactaagagaagctttctagaactcacaacacaagatgcaaccttggtgcaaaataagttgctatctagacaaatagaagccctgaccgagaccctcagtaagctaccacaacaactacaagcggtaggggggatgtcatacatgtggagaaacacacgagcctggacaatgtacaatccaagaagacccttctag

SEQ ID NO: 7934 - DNA, 243 bp, Glycine max
  Peptide Sequence Number=SeqID_99619
atggccaagttcgatctagatatagtcctcgagttttacgccaatgcttggcctacagaggagggtgtacgggacctctggtcatgggtgaggggccagtggattcctttccaatggggccaggagtgcgaatacggtcagaggaggaaccaggccgatggatttgatgaggaggccatcgctcagctgctatgcataccaggtcaggattttgcccggaccgctgctgggagacgggtgtga

SEQ ID NO: 7935 - DNA, 256 bp, Glycine max
  Peptide Sequence Number=SeqID_99620
atgacccgagccttcatcgagaagtactacatgcctaggcaggcgcagggtgatgcacatcaggccacagacgcactgccaccacctcgacaggccgatccagctgggtcactgggcgtggagcgctatctacagcatttggggcagggttccaccccttttgtatgccctaccccggagcagtttggggctgaggtcgcatggtctggagactggcccgatgcccaggccagggaggagcctgcaggatccctcg

SEQ ID NO: 7936 - DNA, 708 bp, Glycine max
  Peptide Sequence Number=SeqID_99621
aggatccccattgtggccaaggtactcatcaataatggttccaacttaaacgtgatgcccaaaagcactttggagaaattaccatttaatgcttcgtatctaaagccaagttccatggtagttcgtgccttcgacggcgcccgccgagagctgcctgttgggacgcccatggatccattcagtggaagtcgttccctctacactccatcagaaattgaagttcgtagtggaagggcatttggtcatcgtatcgggcgaggaagacatcttggtgagttgcccatgcccatcctctatgccatatatggaggccgcagaggagtcgttagaaaccgccttccaatctttcgaggtggtaagcatttcctccgtggactccttctctgggcaaccttgcctcccggaatgggcttaggcaaggacaacggcggcataactagcctgataagcgccaaaggaaatcatgggaagtttgggttaggctacaaacccacacaggcatatataaggaaaagcattgcgggaaggaaaaacggaggtcaaggctcgcgattaagacaagaagccaaaggaagcccgccctgccacataagtaggagctttataagcacgggtctaggggacgaaggccaagtcgttgcaatatgcgaagatgatgctccagtggtttggatttggtacgaccatgccctcctgatttccagctag

SEQ ID NO: 7937 - DNA, 117 bp, Glycine max
  Peptide Sequence Number=SeqID_99622
atggaatgccccagggctcctccacgatatgcacatgttgcgttcgagctgtatcctcagaaaaatggagggatggcctttgtggataaatgggcggtaggtaaggagaagggttga

SEQ ID NO: 7938 - DNA, 399 bp, Glycine max
  Peptide Sequence Number=SeqID_99623
atggcggcgcagctaatccatgatcgagtggagatggagtgcctagagggagcttgggagaccctcgaaggcaacacgaggtgtcgatttcggggcacgattcgatttacagctacttcattgcgtactgtggagtggatactacccacgcctacaccataccgtctagtggagccagtccaagtgatcgaggtgacgtcatccgaggaagaccctgaggaggatcccgaggaggtacctcctgagcctgctgtggatgctcttgactttctagagggtgatgaggacccactccctgaggtggattctcccgaggacgtcatgtcggcatctgaggcagactctacggaggatagtggtcctggagagatggcgatcagtggaagctcttcatcatag

SEQ ID NO: 7939 - DNA, 324 bp, Glycine max
  Peptide Sequence Number=SeqID_99624
atgaggacacgtagccctctaaagcgaggatgtgtagtcctcttcaaggtgagggaatacagccctttgttggcgaggacgtgtagtcctctcaaggtgagggcgtgtagccctacgaaggtgaagacatgcagtcctctgatggcgagggcgtgtagccctcttaaggtgagggtactagtacccaaggtgaggacgcgtagcccactcaaggcgaggacatgtagtcctcttgaggtgagggcgtgcagccctccgatggtgaggacgtgtagtcctctcaaggcgaggatgtgtagtcctctcaacggtgagggtaactag

SEQ ID NO: 7940 - DNA, 1641 bp, Glycine max
  Peptide Sequence Number=SeqID_99625
atgttgctactggcattactgctggctgggttggtggtgcaagcttggtggcaacagcagtcattacaacagcggttgcagcagttgcctgtgcctgccgtgatcgcggcaaagacagccaagcctgaggcgacgaagcctcttatggcagatacagttttgacggcctggccagttgaagaagatgccgagcgtatcagtgccgaaatcctgaccgaggcggatgccatgggcatgatcttcgagcgggcagagttccagtctttgccagttgcacacgccagtttgcaggtacaacgcattaaattgccgctcaagggtgttacagcgctatcccagcctggcgctcagccagttcaagttgcaacggacagatgtgatgcagccggtcatagaggcttatgtggagttcagtttatatacacgcaagcggggtcagccatgacgcggcgctggttagtgtggggtgcattggtgtgcgccttgctggcttgctggtgggtagagcaggccgaacaagctgaacagcctgtggcaatggcgacccaggcgcctgtcgtgcaacggcgtacccctttggcccaggcgatgcctgccctgaaggcaacggatacgacagcggtgacagccgaaacaccagcggccgaacaagatgtcggtgtggatttgtttgctgtactggaaatgcctgcgatggcgaccgcagagtcggaagttcccgcggcggtgaatccttatacctatgccgggcgcttgcaggaagcggggcgctggaccgtgtttttgaccgatggacaacaacaatatgtcgtgcatgagggcgaccactttgccgaaggctggcgggtggcggtgctcgaccaacagaaagtcgtgctgcaacacgcagccgatcgctttgaaatcaggctggatgacggggtggtattacaggaggcgccgaataaccgtgccgccagtgatggcgtgcaaaaggtacagtcagcccgccagcatgctgcgcaaattgaacaggtgaaaatcgccattgcggcagaggactgggcgggtgcggaattcggcttgcgcagtatcttggccgaacaacctgcgcatgtcgaggcgcgacaattgttcgagcaactggaacaaaaaaagaacgaaaaaagcagtgtggtgcgtcccctgcaatcgtcactcaggaagaaagtgacgctggagctgaaaaatacgccggtcaagcaagcctttgaatatataggcaaggcgggcaacctgaatttctcgtttgaccaggagctcaatgagggcatacgcgtcaatgtgttgttgcgtgagacgccgatagagcaggcgctcgaggtgattttgaccagtcaccaactgggcaagaaggtgctcaatagcaatacgctgctgatttacccgcaagcccgtgccgcacaatatgaggagttgtttgtgcgcagtttttacctgacgcatatggatgccaaacgtgcgctcaatatgatgaaaaccgtgttgcgtgccagtgatgtttatattgatgagaagctgaatacgctggtgattcgtgacaccttggaccggattaaagtggcggaaaagctgattgcctcgcaagacctcaatgagccagaagtcatgctcgaggtggag

SEQ ID NO: 7941 - DNA, 291 bp, Glycine max
  Peptide Sequence Number=SeqID_99626
atgaccataatttgtctccacatgtcatcgggcccacctcctctggatgacaaaaggagtagaatgaccataatttgtctctgcgtgccatcgaacacaattgtgtctgaatggcgaaaaggtaagtggaatgaccataatttgtctcttatgtcatcgggcccaccgcctctggatgacaaaaggcgcaaaatgaccataatttgtctctgcgtgccatcggacacgattgtgtctgaatggcgaaaaggtgagcgaaatgaccataatttgtctctgcatgtcacatga

SEQ ID NO: 7942 - DNA, 531 bp, Glycine max
  Peptide Sequence Number=SeqID_99627
ggcaatattgccaacaacgcatcacaactggctgcacagtggcgcgtattgtttgcgcaagccatgatacaactggaaatggcagatgcagccgcagcagaaaccggggtcgccctcaaagcggaccaattgcgggcagaaacctttagtgatgccaaggtcgttggcagcgtcaataaaaacgatgccgtggagatcctcaacaaaaaaggggcctggctacaaatcaaagcggcaggcaaaaccggttgggttcgcttgctcacggtaaaacgcaatagcagcagtggcaataatgttgcgggtgtggtgggtgtcgccactggacgcagcgggaccggtaaagttgtgtccaccaccggtatccgtggattaagcgccgaagacctcaaaaccgcacaattcaatgaggccgagaccaagaaactcgaaagcaatacagtgagcgccgaagaagccaaacaatatgcaatcagcggtggcctaagcagccaccagtatccatactttacagaaggtggtcagcaatga

SEQ ID NO: 7943 - DNA, 84 bp, Glycine max
  Peptide Sequence Number=SeqID_99628
atctatgagcactttccgagtgtgcatcagtgcatcaccgatgatgcgtacgaggagacgtcccccatgcctcccggtggctga

SEQ ID NO: 7944 - DNA, 422 bp, Glycine max
  Peptide Sequence Number=SeqID_99629
gtggacccttgggtactagtacctatcacctttagaggactatatgtccttgccatcagaggactgcacatcctcgcctgcagagggctgcacgccctcgcctttagagggctacgcgtccttattttcattcctgggccaccccctgatattggagggcgaccaacagtgcgagcacatccagagagggaggctatcacgcatctgctatgcataccagggcaagatttcacccatgccgctgcaaaaagacgagtgcggatcgtgcgcatcaacatgaccactcttatatggatatggatgacggatcgcgcctgcaagacacccagtggacccgaagaagtccaacagggtcttggagttgccaagctttacttatgtgcctctgtcagttctacggagtgcctgtcggccccagcaag

SEQ ID NO: 7945 - DNA, 138 bp, Glycine max
  Peptide Sequence Number=SeqID_99630
atgactatgtcaggcttaaaggagcactcaaatcgggtgacccccaaggcctacactccgaagagtctgtcagagtctctccctcgtgattcaagtccaacccataaaatcatttttgcaagcagacactgctcatga

SEQ ID NO: 7946 - DNA, 864 bp, Glycine max
  Peptide Sequence Number=SeqID_99631
atggttcatggcccatgtggaactctgaatcctggatctccatgcatgaaagaaggcaagtgtagtcgtttcgatcctaaaatgttccggccgcatactgttttacatgttgatggttttccagtctatcgtagaagaaacaatggtcatgcaattgagaaaaatggtgttataattgataacagagtaactgttgttttgattcatgaagataacgatcaaactgagaatggtggcactcataatgatgagatcaaagaatatctagattgcagatacatatgtccctgtgaatctacttggagaatctttggatttccaatacatggcagaaaacctgctgttgaaaggctacacttctatcttctaggccaacatagtgttctctacgaagaccatgatgatattgatgatgtattgtcaaagcctagtatctctgattcaaagtttatttcatggatgaacaccaaccaaaattctattgaagggagaaatcttacttatgcagaatttgtttctaagtttgtatacaatcagaagaaaagatgttggcaccttagtaagaaaggctacacgattggcagattactatgggttccaccaattacagggaaattattttatttgagaatgatgcttactgtttgtaaaggacctacctcatttgaggatttaagaacaattgataatgttcagtattctacatataaagaagcatgttttgctatgggatttttacaagatgataaagaatttattgaggcaatcaaggaagcaaaaggctggggttcaacacattatataagaaagttatttgtgttgttacttttaactgcaacaatgagcaaacctgaacaagtttga

SEQ ID NO: 7947 - DNA, 168 bp, Glycine max
  Peptide Sequence Number=SeqID_99632
atgacaccggtaaaccgaaaggcaggaacaggagagcgcatgagggagcctccagggggaaacgcgtggggggcggagcctatggaaaaacggctttgccgcggccctttcaattccctgttaagtatcttcttggcatcttccaggaaatctccgccccgttcgtaa

SEQ ID NO: 7948 - DNA, 189 bp, Glycine max
  Peptide Sequence Number=SeqID_99633
cggggttccgccccttttgtatgccctaccccggagcagtttgggactgaggtcgcatggcctggagactggcccgatgcccagacaggggaagagtctgcagaatcccccggtgagacggatgaaacctatatggatgaggatatgactgacctgctcagtttcttgggagggagtggagccacatga

SEQ ID NO: 7949 - DNA, 732 bp, Glycine max
  Peptide Sequence Number=SeqID_99634
atggggaccaccacgggtacatataatgaattgaaaaactcggtttggggtacttaccgattgaagactgaagaaaacgaagaacgaacgatgaatgtcaaagaacggttgaaaatcttcgcagaatacgaagtgccaagaaggctgaacctttccttcttcattcctccccctatttatagcaaaataggggaggagcttgccacccagctcgcccaggcgagccaggttgcttcctccaaaagcaacctccttctggaggaagaatctagaaggcccaaggtgctaagtacttcgaagcggtcaatcaaaggttgcatgccatcaagcaatagtccccggacgaaattagggtatgacagtatgcttcttgacccgacaagagttctaaggaacagattgggtgttggtggtctaacaacatccaataatcatgctgtagtcactgacgactacttgcagatcatatatggactgaaatcagtcttgacctcaagattcattgattatttcaatatcgatgtttctaatgagattgtagacttcaccaaagcctttaatgagataaccaaaaggcatctcaagaagcttggcatggcatatgttgatcatgaatggatcacggcaagagaacaaccagcaacagaaaatgttgatctgacggaagaagaagctaaagaagaagctcagcaagagtcaactcctcaatggaaccttatgagtcccttatga

SEQ ID NO: 7950 - DNA, 903 bp, Glycine max
  Peptide Sequence Number=SeqID_99635
atgcagaattttgctgtcaaaataggtgcagcaggattttggcttgtgcagaaaaatgcttgtgtgtggttggctgtggaaagagtagtgcagaatgagttctggatgttttctagtagatcccaacgtgagaaaagctgtgatttggttggtgttttggcagagttttctgcctttgctctgttttgcttggctcttgggaggattgatggggacccggtgttgagagaaacgaggatatgggctacgtgggagtacgtgagctcagatggaggtgggcaacaggggatggtgggtttatgcgcgctttgtggatgtggaaaacttgttgtgcaccatcgcccgaccgccacctatggtacctggagatatgtcgcgggggtcaggagaccttggggacgtcaggcgagctcctggcagtcaacagataaaaggaacaaagaccacaaagcgaggaggcttgtggtggctggccagcttcaggaaactaagggagcctctggtaatcgattaccagcctgtgtaatcgattacacagaggaatgggtcactggtaatcgattaccaggctgtgtaatcgattaccagagatggaaagccataaaataccccttttacttgcatatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggacagctccttggattagttttgtatattttttagggtgggtgtatctaggactgactgttaggtttactgttttgttttgtatgggtagacctgatgtatag

SEQ ID NO: 7951 - DNA, 375 bp, Glycine max
  Peptide Sequence Number=SeqID_99636
atgagtgaagtagaggaggtgcaagaacagatcaaggctgacatggaggccatgaaagagcaaatggccacgatgatggaagccatgatgagcatgaggaagataatggaagccaatacagttgcagttgccgctaccagcgctgtcgctaaggtgaactcgatgcccccatctggcctcaagaaaatgaatcatccaacctcagatatggtaggcaaagatttgggaagtagggacggcccccatggtgtgcaaattcaaaacaagcatgccttcccgccatatggcctgcctcccaactgtacaccacccaatgtggggtacattcccaatgatgatgtcaataactccactcccatactcattgaaagctga

SEQ ID NO: 7952 - DNA, 210 bp, Glycine max
  Peptide Sequence Number=SeqID_99637
atgttgaaagacgggagacttttcacatcgtctgctacgatgacgcgtcataaccgatgtagaatgggtcaaagaactgatgtaaaaaggttgttttctagtagtgtccctttttctaatcttcacgggtcagcttttgggaaaaattgctgtgacgctttgaagtgcatggcaggtgaatttattattcaattctcagaagatccttga

SEQ ID NO: 7953 - DNA, 372 bp, Glycine max
  Peptide Sequence Number=SeqID_99638
atggtccatgacatcttcgtcaaggtgaaactggaagtaacagggacatcagcagccctaaatgtgtttggcagtagacgaagcagcgatgtaacacgatcttttgccccaattttcaagatggttacttccatacttcaacttggctcgatgaaccttttcgtaaaagcacgagcttggttcaaccccataacccaggtgtcgcaacgtgcccttcgcgggcgagcaaaggcgaggctcacgggtgcactttccaaaggaggaaagatgggcggagtcgccaccaacgtttatttgtggaaaacgtcggaaaaaccgaaggaaaccggtcaaaatgaaaattctaagttcgggagttgtatttacgcttga

SEQ ID NO: 7954 - DNA, 744 bp, Glycine max
  Peptide Sequence Number=SeqID_99639
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggagtggcaaacgactggctgtattaccttgctccaaggtccatctcgagctgggatgaccttaagagagtattcttagaaaacattttccctgcttccaggaccacagccatcaggaaggatatctcagtcattagaggagtgcatgaggtagctacaaacccatctgcatcatctgaaactaagaagcttgaaggcaaactggatgcattggttaacttggtaacccagctggccttgaatcagaaatctgtacctgtcgcaagggtttgtggtttgtgctcctctgttgaccaccatacagacctttgcccttccatgcagcaacctggagcaattgagcagcctgaagcttatgctgcaaatatttacaatagacctcctcaacctcagcagcaaaatcaaccacagcagagcaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacaacaacaaccctag

SEQ ID NO: 7955 - DNA, 357 bp, Glycine max
  Peptide Sequence Number=SeqID_99640
ggacctccagagcctgaggttggtccctcagctgctcgtgtcagcacaaaggagagttgtgttgatccctcaaggaatgatctagacacgggtgacttagacaaatgcaggttgtacatcgaacaaaaccctccccgcctgattgccctagaaagagattatgagggatccacaaccgttcacaacatccctttgttgcatgatcaagtgaaggtcggtattgaggaggttaaagatgcagatgctcccgttcctgtacccactagcgagggagttgtgggaccaacaaaacctgcagataggccggatcatgaggttgatgatcccctatatctaatggcattgaccatcccatag

SEQ ID NO: 7956 - DNA, 447 bp, Glycine max
  Peptide Sequence Number=SeqID_99641
atgcccgctaggaggaaggaggccgtatctgttttccaaattatacccctcgatggcaaggatagcctaagtggtcaaagtctcggtgcaagaattggaccgacactattggtgttcagagtcatcctctttccaaacgtggatgggctagtagatctagcagcgatcaatgtttttcttgcttatcaccacaacaaggaaagtctggtcgttgctgtgttggccgatgcctatgacacatttgaccggagatgcgagaagagtggagcaaggattgcctattgcacactcgctctttatgtatggctggtttctcatattttctgccatgaaagtagacctgtctatcccctacaaggtcactgcatgtgtgtcgagaaagcgaaagcaagttgggagcagttcttggctggtatggtaggggcatccattaattggttcccctga

SEQ ID NO: 7957 - DNA, 441 bp, Glycine max
  Peptide Sequence Number=SeqID_99642
atggcacaagtaattaataccaacagcctgtcgctgatggcgcaaaataacctgaacaaatcccagtcttccctgggcacggcgattgagcgtctgtcttccggtctgcgcatcaacagcgccaaggacgatgccgcgggtcaggcgatctccaaccgtttcaccgctaacatcaaaggcctgactcaggcttcccgtaacgctaacgacggtatctccctggcgcagaccaccgaaggcgcgctgaatgaagtcaacgataacctgcagaacatccgtcgtctgactgtgcaggcgcaaaacggttctaactctaaaacagacctgcagtctatccaggacgaaattaccgagcgtctgtctgaaatcgaccgtatttcccagcagaccgactttaacggcgttaaagtactgagtaaagatcagtctctgactattcag

SEQ ID NO: 7958 - DNA, 510 bp, Glycine max
  Peptide Sequence Number=SeqID_99643
atgcggagacaaaatttggtcattccgcaccccttgccattcagacacagtcgtgtcgatgacacagtcgtgtccgatggtacgcagagacaaaatttggtcattctgtaccctttgtcatccagaggcggcgggcccgatgacacgcggagacaaaatttggtcattccgcacccctttgccattcagacacagtcgtgtccgatgagacaaaatttggtcattctgcaccctttgtcatccagaggcggcgggcccgatgacacgcggagacaaaatttggtcattccgcacccctttgccattcagacacagtcgtgtccgatggcgcgcagagacaaaatttggtcattttgcatccttttgtcatccagaggcggcgggcccgatgacacgcggagatttacattatcttccgcactcacaagatctgtcatgctgacgggcggaaatacccaagtggttatccgtataaacattcttttgctatctgtaagacataacgcttga

SEQ ID NO: 7959 - DNA, 234 bp, Glycine max
  Peptide Sequence Number=SeqID_99644
ttcagggcagaggtcgcatggcctggagattggcctgaggcccgggcaggagaggcaccagcagaggctcccgacgaggcagatgaggcccgcaaggacgaggagatgaccgatttacttgatttcttaggaggaagcggggccacatcattgggagatcccttgatccatatttcttttttgtttccatttgtttttttctatttacatatcatcttatttttgtttgactaa

SEQ ID NO: 7960 - DNA, 508 bp, Glycine max
  Peptide Sequence Number=SeqID_99645
atgattgatacaccatggagttatgacagttgtccatattgtacaaccacttttgatccattaaaaataggtgcagcctgtcgttcgtgccagaatcatgttactcacactattccaaggtataagttagttgtcaagatggaacagaatggggagaaggcgaacttccatttttgggatgcagtatgtatcaaaatatttggtaaaactgtagatgaatgtcgtcaagagttgattgcgagtggtgatgagatcaaggtgttccctgcgtgtgttgatcaattgttgggtaaaacttgggttgaacatcatatacagtcagtgatatccacgctaggtctacaggatgaacaatgtttaagcaacaagtcagctgatgttggtgctgcatcttcatcacaacaagattaccatcctacaccttcattgtcacagtcatctgaatatgatcctggaaatgctgcctttgtaactcctgcaaaaagaacgtccgatcagcaaggaagta

SEQ ID NO: 7961 - DNA, 318 bp, Glycine max
  misc_feature (230)..(230): n is a, c, g, or t
  Peptide Sequence Number=SeqID_99646
atggcaccagctgatgtagaggacattgtggcagacattcctgcagacacaggcgcgaaggctactgaggatgagtatgagggatttccgggtggtccaagcgacccatccgtgttgacccaatatgcgaatcacgttgcttgcagcgtatggacgggagaggagcgtcctgagttgaagttatcctctcacgggaggaaagtccatagtttaggcaggcctgtccctgncattgagggactcgttgttgggacaggactaagtcctctaatcgcgtgttcggtagacaccggcgatcggggacttttgtcctcgttt

SEQ ID NO: 7962 - DNA, 540 bp, Glycine max
  Peptide Sequence Number=SeqID_99647
atgtcaaattataaaagcaccgagtcagcactgaaagaccttgaggtccatgtgggacaactagccaagcggataactgacaagtcatccaacagttttgtggcgaatacagaaaagaatcccaaggaggaatgcaaagctatgatgacaaggagtaagaggtttgtggaggcggaggatgaggatagtgttgtatccaagaaggaagctgttgaaaagaaaagtactgatgaaaagaaagttgaggtgttaggcgaaagcaatcaggaaaaagaaaaacaaataatggtcaagaaaaaagaatttaatgaccaagaaaaagaaaaagaagtagaaaaagaaaaagaaaatgaaaatgaaaaaattgaaaaagatgaaaaaaataagaatgaagagaggagtagaagtgaacaaactagagagaagaaaagagaaaaaactgttaacgaaggtgcggaagtaccatatcctgtggtaccttccaagaaggagaaggaccgccatttggcgagtgatcgaggccgtacccgaatcaaataa

SEQ ID NO: 7963 - DNA, 537 bp, Glycine max
  Peptide Sequence Number=SeqID_99648
atgagcattgtcaacacatctcttttcatactagacacctattcactgaatatagctttaccaagtaacacaagttccccgagagttggatactcggttcttaccgttttatactacttgcgtgatccggtgcacttgccgagctccaacaagtttttggtgccgttgtcggggaacttctttctatttggagtatctcccacaggaaatttagttcctttggacttggagattgaagctacgttaagaaggaacggagccgagaggaaaagaaaattactacaagacaggacagtagcgtccattcttgaggaagaaactcatttttctaattttacatcatctgactcacaatcatcaagggaatctgcgacctatttactagaagtcgttcctttggcggatgaacaccagcaaagagttacccttgaggactattcaagtagtttagtgttccaattctttaccagcattgcacgtcctaaagtgcaagctcacaacataaactaccctcattctttgattcatttaatatag

SEQ ID NO: 7964 - DNA, 214 bp, Glycine max
  Peptide Sequence Number=SeqID_99649
atggcccttgcaaaagaacttatgggattttcctcatttgtttctgcttcttacaaagtgtttctgcacaacaagcatggcaccttctgggtcaatcctatcttgcttccttcggataacacaagagttgtgaggttgaggaagggagcaaagtttcgatggataggaacaagaaatattgtgctggagcttatcagcaccaatattgatccaa

SEQ ID NO: 7965 - DNA, 423 bp, Glycine max
  Peptide Sequence Number=SeqID_99650
atgttgagtcagcatcccaatatgttaaactacactgactctgtgatgaagagagaatctcctctatccctgcattacaaactgtttgaagggacacatgtcccagacattgtctcgacatctgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaagaagaggaagatgcagcagaagagacagaatccgatgatgattctgaagccaccccatga

SEQ ID NO: 7966 - DNA, 481 bp, Glycine max
  Peptide Sequence Number=SeqID_99651
cgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgtgggatc

SEQ ID NO: 7967 - DNA, 570 bp, Glycine max
  Peptide Sequence Number=SeqID_99652
atgggtgatcaagaggagacacaggaacaaatgaaagccgacatgtcggctctgaaagaaaaattggcttccatgatggaggccatgttaggaatgaggcaactcatggagaaaaacgtggccaccgttgccgctgttagttcggctgccgaagcagacccaactctcctagctaccgcgcaccatcctcccccaaatgcggtaggacgaggaagaagcacactggggagcaacagcaacccccatttgggatacaactgggtggcttacccttatggattgtcgcctaattgcacgccgccagtcatgcaggatgatgcgggtcatgtctcttcccccatccttgaaggggagcctcctcgacagcccgacaaggtccacgaagatcatcaagagtatgcccaaggggatgtcgatttctaccccccgatccctgtcgaggggtcggcacccaatgcattgcctcagcccaacctcacagcacaaccaatattcttgtccacagaaggaccacccctggcggccaaagaaagaagaaaactcgatctcctcaaggaaagattgagagct

SEQ ID NO: 7968 - DNA, 498 bp, Glycine max
  Peptide Sequence Number=SeqID_99653
atggcgcctaccaggcaccctctggacccagataagtccaacagggccctaggatttcccgccttgatcacaggactctgccagtcgttcggcgtccccgtcacacctagcaagagacaggtccagggtgatgcaccacaggccgcggacgcgccgccacctcatcaggctagtccggccagatcatttaacacggagcagtatttgcggcatttggttcgccagcaggcggccaaccaccgggcacatgtacagactcatgattgtctttatcagatgagtctcaacctgcaaagccagggctttacttctttttcgtgccctactccggaccagttcagggcagaggtcgcatggcctggagattggcctgaggcccaggcaggagaggcaccagcaggggcaccagcagaggctcccgacgaggcagatgagacccgcgaggatgaagagatgaccgatttacttgatttcttaggagggagcggtgccacatga

SEQ ID NO: 7969 - DNA, 285 bp, Glycine max
  Peptide Sequence Number=SeqID_99654
atgcaacaggaggatggaggaactgaagaacacacaattctcaagtcaagatgcagcttcttcttcacatccggagcaagtgattcattgcttcacttagcagcatatcataagaaagaacatattgcagcgttgatttgtgatcactttcctaagcttcttattaggagaaacgtaagaggagatacaccacttaatgttgttgctgtgaggtctaagaactctactatagtcaagctcattctctcccaatatgccatagagaagacaaaacatgatgattag

SEQ ID NO: 7970 - DNA, 393 bp, Glycine max
  Peptide Sequence Number=SeqID_99655
atgacgaattgtgcccaagtgtgccaggattttcacaaatcaaggatggcaagaacatcaatgtttcctactactgcttataatccacctgaagattctttaagtcaagatgtgattgcgactgtagagaagagtatgaaaaaatatgctgacaacctaatgcggtttctagagggaattagttcaaggctatcacaattggaattatactgttacaatcttgacaaatctattggagaaatgaaatctgatataaatcgtgaccatgtggagcaagattcaaggctgaaatctcttgaaaaacatgttcaagaagttatactgtgtggtttcactcattttggtgtgcttgataaattgcttatggctctaggttgcagttgcacaaagtag

SEQ ID NO: 7971 - DNA, 552 bp, Glycine max
  Peptide Sequence Number=SeqID_99656
atggcccgagtgatgttggggaatggttacgagcccggaatgggtttaggcaaggacaacggtggcataaccatcctgataagcgctaaaggaaaccgtgggaggtttgggttaggctataaacccacccaagcggacataaagaaaggcattacaggaaggaagagcagaggtcaaggctcgcgattgggacaagaagtcaaaggaggtctgccctgccacatcagtaggagctttataagcgcgggtctaggacacgaaggccaagtcgttgcgatatgtgaagatgattcgccaagtagatccgacgacgagtccctcaaaggtactaatacctgggacccgaccatcgatttcgagcaagaaacgaatcaaacagaggatgaaaaggacgaggatgtaggacttcccccggagttggagaagatagtcgcccatgaggaccaagaaatggggcctcatcaagaagagacagaactagtgaacttaggaaccggcagtgggaaaaaggaagtaaagataggcacagggtatgaccacacccattcgtga

SEQ ID NO: 7972 - DNA, 222 bp, Glycine max
  Peptide Sequence Number=SeqID_99657
atgcgtctaccagggaaggagagtccgctgatggaatcccccataaccataaatgagattttggatgttagcatttcgtttctaaatgaccatttagaggaaacaccgggttcgacaaaaatagaagaaaatcactcaaagtgtatcaatctcgcacaggattttggctcaaggcttgtagaagggctagacatgatacatgtcggggtttggtttgactaa

SEQ ID NO: 7973 - DNA, 619 bp, Glycine max
  Peptide Sequence Number=SeqID_99658
gagtgtcatttctagccagatgaattctgtagcccagtctaactcttctagacttaggtttcctgctctgatcaccggcctatgtcgagccagaggggttgtctctgatagcctcacttttgagcgcccaagtccggtcattaatttggcctacatcaggaagaactgttggaatcttgatgatatgacagtttttatccgagggactaggagggcgaggccaactgatcttccttccacatctgcagcttctactccagcatccacttcagcagctccttcagtcccaactcagatggattctcagtactttgaagccatgcttcagagcattcataaggggcaaatcaatttacttcagagtttacaggtggtggtgcctccaggatccattccttccattgagcagtttttggagagggtagcttgtcctggggcccaaccttctcttcatagggaagatgaaggtgagacacaggttagacaggaagctgctgctactcctgagaggtcacgagaggacccgaccacaccagtcctgactctgaacacttctcctccagctactctagtacttcatctgacagatgaggaggatgttcagacacaggacacttag

SEQ ID NO: 7974 - DNA, 512 bp, Glycine max
  Peptide Sequence Number=SeqID_99659
atgaaatattctaaaataatcctggtgtttactgtacttttatttcagttggggtttgcgcaggaaaaagcagatgtagtccttaacaaagctcttacagatgctaaaaaggaaaataaaaatgtacttcttgtattccatgcgtcatggtgccaatggtgtaaactgatggaaaagaatatgaatcttccggaaacaaagcctttgtttgataaaaactatgttacggcctatgtggatgttcaggaaagaggagaaaagaaagttcttgaaaatcccggaggcgaagcaatgatgaatcaatataagggtgagaatgcaggccttcctttttggttggtattgaattctaaaggtgaggttcttacagattcttttaatgacaaaggcgaaaatctgggatccccagcaacttcggaggaagtagatgtttttttagcgaaacttgaaaaaactacaaaattgaacagacaagaacttgaaactattcaaaaagttttctgcagtaccag

SEQ ID NO: 7975 - DNA, 180 bp, Glycine max
  Peptide Sequence Number=SeqID_99660
atgaaagaaagagaacggaagatcttcagaccagataaattttcggcaaggtcgttctcgactggcgatatcccaccctacatgaacaaagaggaaaagaccgaaacacccagcgtcctctccaaaaacactaccctcgagaaaatcctattgatccatgatcgtacgtgtaatctctga

SEQ ID NO: 7976 - DNA, 195 bp, Glycine max
  Peptide Sequence Number=SeqID_99661
atgggcccaaaatctaccctaaggctcatgagagcccaagggccttctcctgcatctctggcccaatcttcttggaatctcctagtcatggctttggtgatgggtgtttcgctctctgggatactacttgtttgtgtggatgcgaaatctaccgacaagtgcaccgggtcgtcaagcttaagtactaaacactaa

SEQ ID NO: 7977 - DNA, 69 bp, Glycine max
  Peptide Sequence Number=SeqID_99662
atggagttcttggagcttgagcaaggaagtatgactgtggctgaatatgcagccaagtttgaggagctg

SEQ ID NO: 7978 - DNA, 574 bp, Glycine max
  Peptide Sequence Number=SeqID_99663
tcataacttatgcaagagcctaagtgaagaacttcatgactattatgaaggaaggcatagagcacatcctagacctcactcacattggagagaaaaggaaagaaaacctcaagaggctaacattaacctcccacacttccatgggaaggacaatgtagaggctaacttagatagggaaataagggtagagcaacaacttaaaaggaagtctacttcaaaatcttatgactctcactattatccaaagaaagaccaaggtaaaggcatcttaggggtgataccttctaagcccaaagatgataaggggaagacaatagaaaagcaaccacttaaggctagtatgcaagagaagactagctccataaagtgctttaaatgtcttggaagagagcacattacttctcaatgccccaccaagaaaaccatgattatgaggggccaagacatttatagtagccaagatgaggctactacttcaccttcctctagtgaaagtgaagaagcaaaacgagaagaatctagtaaagagatctaccccaaagaagaaggacaacctttaatggttaaggagtag

SEQ ID NO: 7979 - DNA, 303 bp, Glycine max
  Peptide Sequence Number=SeqID_99664
atgaaggccgacatgaaagccatgaaagagcaaatggccacaatgatggaggccatgatgagcctgaacccaatgtccccatctgatcttaaccaaatgaatcatccaacctcagatatggtaggcaaagatttgggaagtacgggcggcccccattatgcgcaaattcaaaacaagcatgtcttcccaccatatggcttgcttcccaactatacaccacccaatgtggcatacactcccaatgaggatgtcaataactccgatcccatactcattgagagccgacaccctcatcatatacat

SEQ ID NO: 7980 - DNA, 369 bp, Glycine max
  Peptide Sequence Number=SeqID_99665
atgaattgcgttttcgttcatgcgtcctccaaccacgagtttggagccatgcgtagtgattgcttagtgcaattctccgttctcaatctttttcggagccccatgaattgcgttttcgttcatgtgtcctccacctttgagtttggagccatgcgtagtgattgcttagtgcaattctccattctcaacccttttttcggagacccatggaattgcgttttcgttcatgtgtgctccacccacgcgtttggagccatgcgtagtgattgcttactgcaattctccattctcacccctttttcggagccccatggaattgcgtttttgttcatgcgtcctccaaccttcgaggttggagccatgcggtag

SEQ ID NO: 7981 - DNA, 339 bp, Glycine max
  Peptide Sequence Number=SeqID_99666
atgactagaggcaatccaagtgacttacaaccctttgatcctgaaatagataggacatttcatagattatttaggcatagtgtgcatcttgattaccctggacattttgtaccttttgagcatcctaagcattctgttattggtgagtttgagcattctgtggttggtgattttgaacatcctgattttgagcattataattttgagcattctgattttgaacattctgaaaatatggctcaacatccacctcgtgagaggactctaagggaaatggcatcacctgatttcacctacgaaagcttgtgcatccaataccctgatcccatatgttcttaa

SEQ ID NO: 7982 - DNA, 480 bp, Glycine max
  Peptide Sequence Number=SeqID_99667
ggacacgctttacgacgcccttaccgaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatgacacatgaaattccccaccacaatctagccgacttcgagccttggctcgaatatgccactgaagggcaagtagttggtggtataccccttgaaaacacttcggaaggccctcagtatcacccccaaccacaaccctcatgttccacagcggttaaaaaccctcatgactatggcaggaatgggaaaggtggatcatctaaaggaaaggctcagggccattga

SEQ ID NO: 7983 - DNA, 687 bp, Glycine max
  Peptide Sequence Number=SeqID_99668
acgttggtggcgactccgcgcattttcctccttgtggaagacgcacccatgagcctcgcctcgctcgcccgcaaaaggggcctagatgtcaccagccttaaggagttgggacggtttatgggacccctccaaaggcaagccttccgcaaagtgtacggaaagattttagatttgaccgcagtggaggtatttacggaagctgttgtatccctcgcccaatactatgaccagccgttgagatgcttcacgtttggggacttccaaatagtatcgactgttgaagaatttgaggagatattaggatgccctcttgggggaagaaaaccgtatcttttctccgggtttcttccctccttgagcaagattgcagctgtggtcggagattcggtaagaaagttggatcgtatgaagcaaactcgaaacggcgtagtgggcctaccgcggaaatacttggaaggcaagacaagggatatggcaagtaaagaagagtgggtctcgtttgtggatatactagctttgctaatctttggggttgtcctctttccgaacgtggacggtttggtggacctagccgcaattgatgctttccttgcatatcaccatagcaaggagagcccagtggtggctatcttggcggacttatttgatacctttgacccaagttgcgagaagaatagcgcacggatc

SEQ ID NO: 7984 - DNA, 195 bp, Glycine max
  Peptide Sequence Number=SeqID_99669
atgaaggagacatcttcttcaactctggtaatccttgattccatagcatcgaaccgcatgttgtcgcaacgtgccctttcgcgggcgagcgaaggcgaggctcacgggtgcgctttccgaaggaggaaaggtcgacaaaagcggggcttttgctcctgcgtaccctcctttggagaggaaatcagacctacgtag

SEQ ID NO: 7985 - DNA, 663 bp, Glycine max
  Peptide Sequence Number=SeqID_99670
atgaatttgcgtacaaggtgtcgtacaaaaaagcttggttggcgaaacaaaaagccatttgcaattgaatatggcgattgggatgagtcatatgagaaactttcgtcgtggctaacacacatgaaaaatcattctcctggatcatattttcaaatactacatgacgattttatcgttgggaatacggttagtcgcgaacaccgtcagtttcatagagttttttggacttttggccaatgtaaagaggctttcaagtactcctacactccttgcaagcacatttttgatcaaaatttagaaaaattttgtgaactaagtctagccataaaaacatggattgatcgcatttcaaaggaaaaatggacgatggcttatgatagagaaggacgtcgatatgaccacatgacaaccaacctctcagaatgtatcaataagcttgttaaagaacttagaaaaaatcaagaacaagtttgttcgcacatcgttcgcgtgtatgacatccactccacaaggtttgaagtagaggagaccttcaatcctattacgcaacgtggcggacaaaagtgggcagttaacttgaatggtcattattgtcaacacggaagcttgtggttacgtgagcctgaactactaccaatatatagatgttgtttatacaaatga

SEQ ID NO: 7986 - DNA, 231 bp, Glycine max
  Peptide Sequence Number=SeqID_99671
atggtgagaactatggttagtcattcttccttgtcagagtcactttggggagaagccttaaagactgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 7987 - DNA, 237 bp, Glycine max
  Peptide Sequence Number=SeqID_99672
atgggtgccaagtacctcaaagcggtcaagcaaaggtcgcatgccatcaacaatggtccccggacgaaattagggtatgacacttgtcgcaacctacccttcggcgagagggcgaggcgtgactcgcgggatgcgtgttccacgaaaggaatacgcgcggagtcgccaccaacgggagaaacgttaaggcgttggaccattaacgatctcttgtttttgaaaggagagaaacgttaa

SEQ ID NO: 7988 - DNA, 135 bp, Glycine max
  Peptide Sequence Number=SeqID_99673
tgtgaaagacacaagaaacaagaacaaggacgtgacaagaacaagaacgcaaataacagaacacaagacgcaaacaaaaacgaaacaagatgctacggaggtttggatgacgccacttccggtgaaggaagataa

SEQ ID NO: 7989 - DNA, 126 bp, Glycine max
  Peptide Sequence Number=SeqID_99674
atggtgggagcaggagggtctcttaatgccttcctttttcttctcatcggagttatttcacaaagacttgccatggtaaagaagaagggggacaagcacacttggagagcgcagtacaacggatag

SEQ ID NO: 7990 - DNA, 1356 bp, Glycine max
  Peptide Sequence Number=SeqID_99675
atggctaaagcgaaaacacaatatacctgtactgagtgcgggaccgtagagcctaaatggcagggccaatgcccaagttgccatgcgtggaacacactggtggaaacggtgcctgagaccgcgacgcaaagccggtttgccagcctggcaccgacggctcaattgcagaaactagctgatgtcgaggcgcaggatgtttctcgccaggcgaccgggattgctgaatttgaccgtgtgctaggtggcggtctggtggctggtggggttgtgctgattggtggtgatcctggcattggtaaatccaccttgttactgcaaacggtatgcagggtatcccaatcactcaaagcattttatattagcggtgaagaatctgcgcagcagatcgccatgcgggcacaacgtctggggctggatgcgagccaggtcgatgttttggccgagattaacctggaaaaaatcagccatgtgctgcagcaccatcagcctgacgtcgtggtgattgattctatccaaaccatgtattccgaagcgttgcagtctgcacctggttctgtggcacaggtgcgggaatgcagtgcgcaattgacacggattgccaagcagttaggtatcagcatgatcctggtcgggcatgtgaccaaagagggttccctggccgggccgcgtgtgctggagcacattgttgatagcgtgctctactttgaaggtgaccagaattcaagtttccgtttgatccgtgcgttcaaaaaccgctttggtgctgtcaatgaacttggtgtgtttgcgatgacggaaaaggggttgcgcgaagtcagcaatccttctgccttgtttttatcacaccacgaatcgcctgtgcctggttccagtattactgtcacccaagagggtacgcgacccttgctggtggaaatacaggctctggtggatactgcacatgcaccgaatcctaaacgtctctgtgtggggctggagcaaaaccgtcttgccatgttgttggcggtgttgcacagacatgccggcgtagcctgttatgaccaggacgtcttcatcaacgccgtaggcggcgtcaagatcagtgaacctgccgtggatttggcggtattactggcgattgtgtcttcactcaaaaacaaacctttgcctagcaagctgattgtgtttggtgaggtgggcctggcaggcgaggtacgcccggtacagcgtggacaggagcgcctcaaggaagcggccaagctaggctttacccatgccattattcccaaagccaatgcgcctaaaggcggtgtcgctggtttgcatgttgaggcggtcgaccgactggaacaagcgatagacgtgctacgcgcataa

SEQ ID NO: 7991 - DNA, 398 bp, Glycine max
  Peptide Sequence Number=SeqID_99676
atggctactccacctacctcgcctcctcctgctcctcctgcagacgcatcaacgtctccgtctaccttgaagcggacacgcatggtgacacggctacgatcgttggccactagaccacctggggcagatagaccagtggtcaacgttgatcctgctaccggcaaggccaacggtccctacaagaagaaattaagaacatatttggggattgtcgcttatgataaggtcgacgtgacatacgagacctggaaggaagtccctgcagctcagaaggatttgatatgggaggatattcaaacggaatttgaaatccctgaagcttctgacagtaggctaaaaaagaaaattcttcatactgtcggcgagcggtggaggcagtttaaatctgacttgaccag

SEQ ID NO: 7992 - DNA, 1069 bp, Glycine max
  Peptide Sequence Number=SeqID_99677
ggtgcacggcaaagacgatcttcagcagctcaaccagcagatcccggcggaatggctgctgtcgctgggggtgatcaatggccgtaacgtctggcgcgccgatctcacccgctggtttgagcgcctgcagccgctgatcggccagcgtcagcaactgtggattggatcttcctgttcgctgctgcacagccccattgacctgagcgtggaaacccgcctcgacgacgaggtcaaaagctggttcgcctttgcgttacagaagtgcacggagctgtcgctgctgagtcaggcgctgaaccagcacgatgccgctgcgctgcacgcctggagcgcgccgattcgcgcccgggcaaactctgctcgcgtgcacaaccccgccgtggcgcagcgtctggcgcaaatccaggccagagacactgagcgcaacagcagctacaccgtgcgtgctcaggcgcagcgtcagcgctttaacctgccagcgtggcccaccaccaccatcggttctttcccgcagacgaccgagattcgcggcctgcgcctcgacttcaaaaaaggcaacattgacggtggccactaccgcaccggtatcgcggaacacatccggcaggcgattgcggagcaggagcgtctggggctcgacgtgctggtgcatggcgaagccgagcgtaacgacatggtggagtacttcggcgaaaacctcgacggctttgttttcacgcagaacggctgggtacagagctacggctcgcgctgtgttaagccgccggtgatcatcggggacgtcagccgcccgcagccgatcaccgtcgagtgggcaaagtatgcgcagtcgctgaccgacaaaccggtgaagggcatgctgaccggaccggtcaccatcctgtgctggtcgttcccgcgggaagacgtgacgcgcgaaaccatcgcaaaacagattgcgctggcgctgcgcgacgaagtgcaggacctggaaaaagccggtatcggcatcattcagattgacgaaccggcgctgcgtgaaggcttgccgctgcatcagtctgactgggcagcctacctgcgctgggcg

SEQ ID NO: 7993 - DNA, 3114 bp, Glycine max
  Peptide Sequence Number=SeqID_99678
atgagcaaaacacacttaacagaacagaagttttccgacttcgccctgcacccacaggtagtggaagcccttgataaaaaaggctttcataactgcacgccgattcaggcgctcgcgttgccttttgcgctttcagggcgtgatgtcgcgggtcaggcgcaaaccggtaccggcaaaacgatggcgttcctgacgtcaacgtttcattatcttctttctcatcctgctgctgaaggccgccaggttaatcagccacgcgcgctgatcatggcaccgacgcgtgagcttgcggtgcagattcatgccgatgccgagccgctggcgcaggccaccggtctgaagctgggcctggcctatggcggcgacggctatgacaagcaactgaaagtgctggcagacggcgtcgatattctggtgggcaccaccggacgcctgattgactacgccaaacaaaatcacatcaacctcggcgccattcaggtcgtggtactggatgaagcagatcgcatgttcgatctcggcttcattaaagacattcgctggctgttccgccgcatgccgccggccacccagcgcctgagtatgctgttctcggccacgctttcttatcgcgtacgtgaactggcgttcgagcacatgaacaacgccgaatacgttgaagttgagcccgagcagaaaaccggccaccgcattaaagaagagctgttctacccttcgaacgaagagaagatgcgtctgctgcagaccctgctggaagaagagtggccggatcgcgccatcgtcttcgccaacaccaagcaccgctgtgaagatatctggggccacctggctgccgatggtcaccgcgtgggcctgctgaccggcgacgtggcgcagaaaaaacgcctgcgcattctggacgacttcaccaaaggtgatgtggatatcctcgttgccaccgacgtcgccgcgcgcggcctgcacatcccggcagttacgcacgtcttcaactacgacctgccggacgatcgcgaagattacgtgcaccgcattggccgtaccggtcgtgctggcgccagcggtcactccatcagcctggcctgtgaagagtacgcgcttaacctgccggcgattgaagagtacatcggtcacggtatcccggtgagcaagtacaacagcgacgccctgctgagcgacctgccgccaccgaaacgcctgcagcgtaaccgctcgggcaacggtccacgtcgcggtggcaacaacagcaaccgtcgcggcggtgccccgcgcaacaacaaccgtaaactgtccggcagtattcagaccgtcgcgcgaattaaacgcaaggtgcgtctggcggcaggtcttgatgcggccaaccatctctcggctgaggcgatgcagcgcggctggcagtgcctgcgtctgttctccgaacagttgcaggacattcccccggaacaaatccgcgtggtggcaaccgccacgctgcgcattgccagcaacgcgcaggattttctgactcaggcggaacagattctcggctgcgcggtgaacgtcatcagcggcgaggaagaagcgcgcctgatctatcagggtgttgcgcacaccaccggcggctctgaccagcggctggtggtcgatatcggcggcggcagcaccgagctggtgaccggcgaaggtgcgcacgccactacgctgtttagcctgtcaatgggctgtgtgacctggctggagcgcttcttcagcgatcgtcatctcgccaaagagaactttgcccaggccgaacaggccgcacgtgaaatgatccgtccgattgcgccggcactgcgagagaaaggctggcagatttgcgtgggcgcgtccggcaccgtccaggcgctgcaggagatcatggtggcgcagggcatggatgagcgcatcaccctgagcaaactgcagcagctcaagcagcgtgccattcagtgcggcaagctggaggagctggagattgaagggctgacgctggagcgtgcgctggtgttccccagcggcctgtcgattctgatcgccattttccacgagctgagcattgagagcatgacgctggccggcggcgcactgcgcgaagggctggtgtacggcatgctgcatctgccgattgaccgcgatattcgcagccgcacgctgcagaacgttcagcgtcgtttcgccattgatgttgagcaggccggccgcgtgcgccagctggcagagagctttttccgtcaggtgagcagcagctggaagctggatcagcgatgtcgcgatttactcctcagcgcctgttcaatccacgaaattggcctgagcgtcgatttccgccaggcaccgcagcacgccgcgtatctgattcgccatctcgatcttcctgcaaaacgccgtgccgccgcgcatggcagagcggctgagccgtctgctgcggctggcaattatcttctccagccggcggcgcgacgacacgctgccggcggtgcgctggctggctgcgcatccgctgcgcgccgagctgctggagcaggagagccattaccagtcgtatgtgcactggctgctgacgatttcctgatcgaacctgctgctgctgcgttgaaaaacgcccggcaactgcgcctttacgcgagtgaagtttgctttgccgggcgctttgcctctgcggcgcgcgcaacagatttcgccagaggccaggcttgcggctgtgacgaaaccattaccccttcttcgcgttctccagcatcgcacgaagcggcttggttccggacgcaccagctcgccgtactgacggcgctcgcggcacagggtaaaagtcagctctttctgcgcgcgggtgatgcccacgtaggccaggcgacgctcctcttcgatattgttctcatcgatactgctctgatgcggcagcagcccctcttccatgcccaccagatagacataggggaactccagccctttcgaggcgtgcagcgtcatcaactggacctgatcgagctcttcatcgctctcgccgcgctccatcatgtcgcgcagggtaaagcgcgtcaccacctgcgccagcgtcatcggctcgttaagctcgtcgccctccagcatttcggtcatccactgaaacagcgtattgac

SEQ ID NO: 7994 - DNA, 506 bp, Glycine max
  Peptide Sequence Number=SeqID_99679
caacttcaccagctcatactggctggtgttggtgtcctgatactcatccaccagcagatagcggatgcgctgttgccagcgttcgcgcacctcctgattccgctgcagcagcagggtcggcagcagaatcagatcgtcgaaatccagcacgttacaggctttcagatgctgatcgtacagcgcgtagcagtgggcaaaaatctggtcgcgctcgccagctgatcctgatcgtcgaacagcgagaaggtcgatttcatgccgagcgccttgtactcacgcttgatgatctccaggcccagcgtgtggaaggtcactgccgcgatatggcgcgcctgatagccgcattcacggatcagatgggcgattttattggtgatcacgcgggttttaccggaacccgcaccggccagcaccagacagggaccggtgacaaattcgacagcacggtgcgcattgatgcgcacctgagcgcaaaggtcgccatcaatggcgacccttacaactga

SEQ ID NO: 7995 - DNA, 1205 bp, Glycine max
  Peptide Sequence Number=SeqID_99680
atgtcgcgtacaggaaaaataattagctgggtggtcgggattttattgttgctggttgtggtggtcgtggtgattatcgccacctttgactggaaccgcctgaagccaaccatcaaccagaaagtctcggcagaactgaaccgaccgttcgctattcgcggcgatcttggcgtggcctgggtgcgcaatcgcgaagaaccaggctggcgcagctgggtaccgtggccgcaggtacacgctgacgatgtcatgctcggtaatccgcccagcgtgccggaagtgacaatggtgcatttgcagcgggtggaagccacgctggcgccgctggcgctgctgcacaaagagatttacctgccgtggattaagatgcagcagccggatgcgcgactggtgcagaccgccgataagaaaaataactggactttcaacctcgccagcagcgaaaacagcgaccccaatgcgccgccttcggcatggtcattccgccttgataatatcctgttcgatcagggacagctgcgctatcgcgacgccatcaacaaagccgatgtcacggtgaggatcaatccgctgggtaaaccggtgccgtacgcgcaggtcgcgggcggtaacgaccagcaaaaaggggctggcgattttgtgtttggctggcaggcaagcgggacctacaacaaccagaaactcgatggtgacggtaagattggcggtatgttgtcgctgcgcagcaaaaccacgccgttcccgttgcagctcgacgtacgcaacggcaccacacgtgtgcgcgtggatggcaccctgcaggatccgctcaatctcggcgggctggatgtgcggctgcgtttctccggcgacacgctggcaaatctgtacggcttaaccggcgtgctgctgccggacacgccaccatatgaaactgacggccacctgattgcgcgtttcaatgaagagaaagggccgctgttccgctacgaaaaattcaacggtcatattggtgacagcgatattcacggttcgctcagctatcgtcagggcaaaccgcgtccgacgctgagcggcgagctgacgtcgaaccagctgcgtatggcggaccttgggccgctgattggggttaactccggcaagggcagtgaaaaaacggcgcaggccaaagcgcagcgcggtgaggccagcacccagccggcggatcgcgtgttgccacatgacaa

SEQ ID NO: 7996 - DNA, 837 bp, Glycine max
  Peptide Sequence Number=SeqID_99681
atgctggcgcatgatccgggcgaacagccgcgtgcgccggtggatatcgcgcagcttaatgcgttttaccagcagtggtacacgccggacggcatgacgctgtacgtggtgggcaacgtggatagccgcagcatggcggagcagatcaacaaagcgttctcgccactgcaaggcaaacgggtggcgcccgcggcgctgcccacgctgtcgccgctgccgcatcagccaatcaacctggttaacggcggcatgatacaggatcgcctgtcgctggtgtgggatacgccatggcagccgatccgcgactcgcagaatctgcagcgctactggcagagcgatctggcgcgcgaagcgctgttctggcacgtccagcgcgcgctggccgacagcaaagcgcaaaacgtgcaggtaggcttcgactgtcgcgtgctgtatcagcgtgcgcagtgcgccattaacatggattcgcctaacgcgtcgctggcgcagaacctgaaccaggtggcgcgtgagctggccaccgtgcgtgacaaaggtctgccgcaggaggagtttgatgcactgatggcgcaaaagctgctggaactgaacaaactgtttgccacctacgcgcgcaccgactaccgatattctgatggggcaacgtttgcgctcgcagcagaattccgtggtggatatcgcgccggagcagtaccagaaactgcgtcaggcgtttctcactgggacaaggtgatgaaggttccggatgcgcccgccgccgccgctaccccggatgaggctaaacccgaaaataatggcagcgcgagcgcgaccgatccggctcaaccctcgtcataa

SEQ ID NO: 7997 - DNA, 1473 bp, Glycine max
  Peptide Sequence Number=SeqID_99682
cgccggcgaaggccggtagttgagcgtcagcagcgcgcgcgtgaccacctcgtcgctgcgcacgccaaactcaatctggctggtggggacggtgccgcgcagcgtcatgctacccggcggcggtgccacctgggtaaacagcagctggctatcgcgcagcggggcgctggcatcgagcggttggttcacgtcgggcagcggcgcagaggttgccgcaggcggtgcatcaggaagcgccgccggaagtgccgcctgcgccagagacgccgtgcccagcagcagggcggtgaaccaactcagttttctcgtcatggtcatatcatcagcttaggtaaaatcagtgttgagcgttgccggtcgcggacggacgttgtgcggcaacagcgttgccagccagtgcagtccggcggtcaggccacggaacaggcggcgcagcggtgccggaccatactccgccagccgcaaatagcctttgaagccgagcagcataatgtccgccaggctctgcaccggtttatcctccggaaaaccgtcctgccacagcgcccaggtatcggcgcgcgcaaaggtgcactgaatgaattcgatgtgctggcgggtggagagctggtgcaggcggatacccgcgcggcggccaaatacgcgctgtacctggcacgggaagctgaactcctgctgtccgcgccgcagcagcagcgagacgctttcgttctcgcgcagtgcatccggctcgcgcagttcgacgcccacgccgccgtcagagtagtcgcgcagcgtgcacggcagcatatgaccatcggcgcgtgccagcgccgccggcatggcgatctccacgcggtgcgcttcacggatttgacgcgcttccaccgacaccgccaccgcgccgccgagaataatcatgttgtaaaccacccacaccagactgacccagatggtgagcagctcattggccgggccgtgtgccatgcgccagaagcccatgccgataccggcaatgttcagcagcaccagcagcatatagggtttggtgatcacccagtcgagatgacgctcttctaccaggccccctttggcggtcacattgaatttgcctttgtgcggattaaacagcgcgacggtggtagggcgggcgatgtaccaggcgagcacggtttcatacacctcgctccagaacgagtggcgccagcgcccctggatgcgcgagttggtcaggctggtatgcaccatgtgcggcagcacgtagatggcgatggccagcgcgggcgcatagatgatgtaggcatggcacagcagaaacgccagcggcgccagcagaaagatcagccgggggataccggcaagaaagtgcagcatggcgttggcgtaacacagccgctgtaccagcttcagccctttgccaaacagcggattatcgagacggaagatctgcaccatgccgcgcgcccagcggatgcgctggccaatatgcgctga

SEQ ID NO: 7998 - DNA, 1782 bp, Glycine max
  Peptide Sequence Number=SeqID_99683
atgcatgaactggcggatcgcctggcgcaaaaccaggcgttcgggcgtgccggggagctacgcgcccgcggtgatgaagccgccgccatccgcttgctgcaacagcagccggcctcgccgcgccgcgacattacgctggccgactgggcgctggagcggggcgatgccacaacagcgctggccggttatcagcaggtgctgcagcaggacgccagcaacaacgatgccgcgctcggccgcatcgaggcgctgctggcgctgcagcgcaccaccgaagcgcgcgcagcgctgcacagcctgccggacagcgtggcgcagcagagcctgaacagcggccggcgcgtggcactcgcctggcaaaacagcggcgatctcctcaaagcgcagcagctgttcagcgcgctgaaaacccgcgccgccgctgtcgcgccgtcacaggaaaaagcgctggtgctgcgtgatgccgcgcggctggagagacagcagcgccagcccgcgctggcacagcaggattaccgcgcggcgatggtcgccagcggcatcacccctgcgctgccagacgataacgcccgctatacccggctgacgcgcacgcaggcccaggacgactggctgaagcgcagcatccgcagcgacgccgctgacctgtatcgccagcaggacaccaccgtgacgctggaacaggactactcgcgcgataagggcaacggaggcacctctgactttaccgcccataccaccatgctgcaggcggaaaccccgctggccgatggccgcagctttgtgcgcgtcgatcacgtacaggtgtctgccggaacattttccaccactgatggcagccacagtgaacagttcggcagctgtaacgacgccaacgccgggggctgccggcgcgatttcacccagcgggacgaaggcaccgcgctgggcgtcggctggcacaacgatcgctggtcagccgatatcggcaccacgccgctcggttttaccgtcactaactgggtcggcggcgtaagcgggaaaaccgacatcgacgatctcggggtgacctttaccgcttcacgtcgcccaatctccagttcgctgctggcttacgccggcgcgcgcgatccggccactaacggcggcaaaaactggggcggcgtcgtcgcgaccggcggcggcatcggcctgagctacgatcggggcggcgcgcacggggtgtgggccgatctcagcgcccatcaaatcagcggtgaaaacgtggcggacaacagccgcgaacggctgatggcaggctattactacaagctgatcaatagcgacaaccagcgcgccaccatcggcctgaacagtatgctgtggcactatcagaaagatttgagcgactacacctttggccagggcggctattacagcccgcagcgctacttctcgttggcggtgccgctgacctggcgtcagcgcaccgaaaactggtcgtatgaactcggtggctcggtgtcgtggtcacagtcaaccactaacgctcaggcgcgctacccggtgaatcccggctttacgctggccagcaatccgccatcggatagcagttcagggcgcggtttcggttatacactgcaggcgctggtagagcggcgcatcacgccgcactggtcgctgggtttagccatggacattcagcaggcgaaagattacaccccaagccacgggctgctgtatgtgcgctactcaatggccggctggaacggcgacatggatatgccaccacagccactggaaccgtatgcggattttaaataa

SEQ ID NO: 7999 - DNA, 1185 bp, Glycine max
  Peptide Sequence Number=SeqID_99684
gctctgatcatgaagaactacgacgatctgcagcgtttccaggaaaaaacgcaaacgctggacattgcttttaaggatatgtccgggcaatcgctggaagccgatcacagccagtgggcgatcatccgtcagctggcgacggatgatgagccggagctgggtagcggccagcgcgtcgatctgccgcagccgcagccgattcgcggcgatgagtttgtcgcgccgccgcaggctcttaatccggcgcccgtcgcccgcagtgaaaaggcgttgctgctgcagagcctcgccgccagcgcgccggcacccgacaaagaaacaccgcgcagcgcccacgcacgtagcgcgtcaggcggccacttcactgttcccaccgccgccggcggtcgcccctgctgccgcagcaccggccactgcgcccgccgtggtgcagccggagcctgctacgccctcgcgctttggcgcactgttccgctcgcgtgcggcggaaccgggggagtaggaaaaaccaccatggcggccaacctggcctggagtctggcgcgtgccggcagcaaagtgctggcgatcgattttgacgctgactggagtcagtcgatccttaccaccggcagcaacatctttgtcatgccttacggtgaggtgactgaagcgcagcgtgagcgcttcgaacacaacctggcgcacgatgcccatttcttaaaacgcggtctggataccgtcctgaattatccgggtctggtgattattgcggattttccgccgggacccggtccggcgctgaaagccatgcaggagctggccgatatgcatttagtggtgatgctggcggataccgcctcggtggcgctgctgccgcaaattgaaaaccatcgcatgattggccagccattaaataatcagcacggtcattatttcgtgctcaaccaaagtgataatcgccggaatatcagccgtgaagtaaccgcatttatgcagcaacggctgggcgataatttacttggcgtggtgcaccgcgatgaaagcgtggctgaggccaatgcctcgcagcagtcaatctatgatttcagcccggcttcggcagcggcgtttgatattgaactggtggcaaaacgggtggcgaatatcctgaatatcaacgtaggcaacggcgaagttcaggcaccgatccgcagtcattattaa

SEQ ID NO: 8000 - DNA, 1623 bp, Glycine max
  Peptide Sequence Number=SeqID_99685
atggagcaaaacatgatcaactccctggccaaatccaggatgctgaaggtcggtcttagcctgattgctatgaccgtggccgcgggcgttcaggcgaaaaccctcgtttactgttcagaaggttcgccggaaggcttcaacccgcagctgttcacatccggcaccacttacgatgccagttcagtaccgatctacaaccgtctggttgagttcaaaaccggtaccactgagctgcagccgggcctggcagaaaaatgggacgtcagcgaagatggtaaaacctataccttccatctgcgtcagggcgtgaagtggcaaaccaccaaagacttcaagccgacccgcaccttcaacgctgatgacgtcgtgttctccttcgagcgccagctcgataaaaacaacaagtaccacggtgtctccggcggcagctacgaatacttcgaaggcatggacatgccgaagctgatcgccaaaatcgaaaaagtggatgactacaccgtacgcttcacgctgacccgtccggaagcgccgttcctcgccgaccttggcatggacttcgcgtcaatcctgtcgaaagagtacgccgacaacatgctgaaagccggcacgccagaaaaactggacctcaacccggtgggtaccggtccgttcgtgctgcagcagtaccagaaagactcacgtattctgtacaaagccaacccggacttctggggcaccaagccaaaaatcgatcgcctggtgttctccatcacgccagatgcttcagtgcgctacgccaaactgcagaaaggcgagtgtcaggtgatgccgtatcccaacccggctgatatcgccagcatgaagaaagacaccaaaatcaacctgatggaacagccagggctgaacgtcggttacctgtctttcaacaccgagaaaaaaccgctggataacgtcaaagtgcgtcaggcactgaccatggcggtgaacaaacaagcgatcattgatgcggtctatcagggcgccggtcaggcagcgaaaaacctgatcccaccaaccatgtggggctacaacaatgacgtcaaagactacgcttacgatccggccaaagccaaagagctgctgaaagaagcgggcatgccggatggcttcagcattgacctgtgggcgatgccggtacagcgtccgtacaacccgaacgcccgtcgtatggcggaaatggttcaggctgactgggcgaaaatcggcgtgaaagccaaaatcgttaccttcgagtggggcgagtacctgaagcgtgctaaagccggtgaacaccagaccgtgatgatgggctggaccggtgataacggggacccggataacttcttcgccaccctgttcagctgcgcggcagcgaaagacggttctaactactcacgctggtgctacaagccgtttgaagatctgatccagccagcgcgtgctgaagccgatcacaacaaacgtattgagctctacaagcaggcgcaggtggtgatgcacgaccaggcgccagcactgatcatcgcgcactcaaccgtgtacgagccagtgagcaagaaaggccagcatggctggccctcgggcggcaccttcgccgcccgtactccgcactttatttccggctaa

SEQ ID NO: 8001 - DNA, 1509 bp, Glycine max
  Peptide Sequence Number=SeqID_99686
atgcgactgctgtcgctgggtggcaaatggttttatcgcgtgatcgccagcctgctggtggtgatttcggtggccgccgcctattacatggcgttctttaacgtggtgatcggttacggcatcgtggcgtcggtcatgaccaccgatgtcgatctctctaaagaggttatcgggctgcactttgtgctgtggatggtgctggtgagcgcactgccgctgctgctgatctggcgcaataacctgagcctgacgctgattgaacagctgaaaacccccggtcagcgcctgaaacctacagtgatcctgctgctgagcgtagcgctggtatggctgccgattcgctacttcgacaagctgcaaaaagccaatgaagagctcaccaatatcgacctgccaagctatggcggcgtagtggcgcactcttatctgccttcgaactggatcgcggcgctgggcctgttcgcctggaccaaggtggatgagaggctggacagccaggagttactcgatccggcgaagaagtttacctatatagcgccgcctggcattgacgatacctatgtggtgtttgtgattggcgagaccacgcgctgggatcacatgggcatgctgggctataaccgcgataccacgccgaagctgtcgaaagagaagaatctggtggcattccgcggtgaatcctgtgataccgccaccaagctgtcgctgcgctgcatgtttgtgcgcgagggcggcaccatggataaccctggccgtacgctgaaagagcagaacatttttgcggtgatgaaagagctgggcttcacctccgagctgttcgccatgcagagcgaagtgtggttctacgacaacgccgatgtgaataacttctcgttccgcgagcagattggttctgagaagcgcaatcagggcaaagcggtggacgatatgctgctggtgccggagctgcaggcttcactgcagcgcttcccgaaaggcaagcatctggtggtgttgcacacgaaaggttcacactatctctattcgcagcgttatccgcgcgagtatgcccgctatcagcctgaatgtattggcgtggacgataagtgcagcaaagcccagctgattaacgcctacgacaactcgattctgtatgttgataccatgctggacagcgtgctggatcagctgcgtgataagaaggcgattgtgttctatgccgcggaccacggtgagtcgatcagcgaaaatatgcacctgcacggtacgccgcgcgagatggcgccgccggagcagttccgcgtgccgatgattgtctgggcgtctgataagtatttgcaggacccgactaaccgcagcaactttgagcgcttacagacgcagcagcgcgtcggcaaaacccatcgtcatgttgagctgttcgacaccattttagggtgtctgggttatacctcgccggatggcggtattaaagcagcgaataactggtgccaggcacctgccactgccagcagtgcgaaagcgctgtaa

SEQ ID NO: 8002 - DNA, 784 bp, Glycine max
  Peptide Sequence Number=SeqID_99687
atggcgtcaggaatttcccgcatctggatgcgtagcggcatgctgctgaccggcgtgctacttgtgctgcagcttaccgcctgcggcgataaagagggcgatcagcgcaaagcctttactgattttctgcaaaacaccgtgatgcgcagcggtgaacatctgcccagcctgagcgaaaaccagaagcaaaccttcggtaattacgccagtgattacgccatcctgtatggcttctcgcagcaggtgaatcaggcggtggatcagggcatgcgcccggtggttgatgagctggcggctattcgcgtgccgcaggattacctgacacgccgcgacagcctgcgccaggcgagcggcaatctgagcgtgctgacgcagcagattcagagcgccaaaatgcaggccgacagcagcaaagccacgctgaagcagccggacgatctgaagaaagtgtacgacagcgtgtacgccaaagtggtgacgcagccagccagcacgctgattccgctgctgccgcagctgcaggcgctgagccagtcggcagttcaggccggcgattatctgcagtcgcagggcgcgcgcgtcagtttcaatgacggcggcgttcagttcccgacccaggagcaggccacgcaatacaatacgctgatgagcaatctcgccagcaacacgcaggcgctgacccaggcacaaaatgccgtacagggtgtcaaggtcaaggttcagagctttggtcgctttctgagtaatatggtgatgccaaacatcggtgcgtttatcgcctggg

SEQ ID NO: 8003 - DNA, 2511 bp, Glycine max
  Peptide Sequence Number=SeqID_99688
atgtcccgattgtatgtagccacacccggcaagtccagcagcacaaggcctgcgagggaaggtgcagcgcagcgggggtttttggccctaaacacaggcaaaagacgcgaaaacgcgcatttttatgacacggcacacaaaattcgatttcgctatttctcgtttatgctcacaacgaacacactcaaaggtcagtgcatcgccgagtttctcggtaccggtttgatcatcttttttggtgccggctgtgtggcggcgctgaagctggccggtgccgcattcggccagtgggaaatttgtatcatctggggtcttgctgtctccatggcggtttatctgagcgcaggcgtatccggcgctcacctcaatccggcagtcacggttgccctgtgcctgttcgccaacttcgaaggccgcaaagttttaccttatattgtgtcgcaaatcgctggcgcgttctgtgcggcggcgctggtctacggtctttactacaatctgttctttgattacgaagccagccaccagatggtacgcggcagcgtgcagagcctcgatctggccggtatcttctccacctatccgaacccgcacatcaccgtggcgcaggcgttcctggtggaaatggtaattaccgccgtgctgatggcggtgatcatggcgctgaccgacgacggcaacggcgtaccgcgtggcccactggcgccgctgctgattggtctgctggtggcggtgattggcggttccatgggtccgctgaccggcttcgccctgaacccggcgcgtgacttcggtccgaagctgttcgccttcttcgcgggctggggtaacgtggcgttcaccggtggtaaagatattccttacttcctggtgccaatttttggcccgctggtcggagcctgcctcggtgcctttggttatcgtgcgctgattggccgtcacctgccgggcaaccttgcagaaaccagtaaaacagaaaaaccgggcacaaccagctcacgtgccgtggtgctcgatcatgacgccaacatcgtcgccgtctcacagcgcgaattcacccagatctacccgaaagctggctgggttgaacacgatccgatggacatctgggcctcacagagctccacgctggtagaagtgctggcgcacgctgatatccgttctgaccagatcgccgccatcggtatcaccaaccagcgtgaaaccgcgattgtctgggacaaagagaccggcaaaccgatttacaacgccatcgtctggcaggatccgcgtaccgccgactactgtaacaagctgaagaaagagggtctggaagagtacatccagcacaccaccggtctggtgattaacccgtacttctccggcaccaaggtgaagtggattctcgaccatgtggaaggcgcgcgcgagcgggcgaaacgcggcgagctgctgttcggcaccgtcgacacctggctggtgtggaaaatgacccagggccgcgtgcacatcaccgatcacaccaacgcatcgcgtaccatgatgtacaacatccacaagctggagtgggatgcgcgcatgctggagattctggatattccgcgtgaaatgctgccggaagtgaaaggatcgtccgaaatctacggccagaccaacattggtggtaagggcggcacgcgtattcctatcgccggtatcgccggtgaccagcaggctgcgctgtatggccagctgtgtgtgcagcctggcatggcgaaaaacacttacggcaccggctgctttatgctgatgaacaccggtaccgaagcggttacttcgactcacggtctgctgaccaccatcgcctgcggtccacgcggcgaggtgaactacgcgctggaaggtgccgtgttcatcggtgtgaaagacaccaacggcgtgtacgtggtgcctgcgttcaccggtctgggcgcaccgtactgggacccgtatgcgcgcggcgcgattttcggcctgacgcgtggtgtgaattctaaccacattattcgcgccaccctggaatccatcgcctaccagacgcgtgacgtgctggaagcgatgcaggcggactccggcattcgtctgcacgccctgcgcgtggacggcggcgcggtggcgaacaacttcctgatgcagttccagtccgacattttgggcacccgcgtcgagcgtcctgaagtgcgtgaagtcaccgcgctgggtgcggcgtaccttgccggtctggccgtcggcttctggcagaacctggacgagctgcaggagaaagcggttatcgaacgcgaattccgtcctggcatcgaaaccaccgaacgtaacttccgctacagcggctggaaaaaagcgtcccctcgcccctttggggagagggttaggtacctcatgaaacgtgaacttgctatcgagttttcccgcgttaccgaagcggccgcccttgcaggctataaatggctgggtcgtggcgacaaaaataccgccgacggcgccgccgtccatgccatgcgcattgtacttaatcag

SEQ ID NO: 8004 - DNA, 1518 bp, Glycine max
  Peptide Sequence Number=SeqID_99689
atggcagcgctatttcatgaatcgcgttatgcggaggaaagaatgcgacatccactggttatgggtaactggaaactgaatggcagcaagcacatggcgggcgagctgattgaaggcctgcgcaaagagctgtcaggtgtggaaggctgcggtgtggcgattgctccgccggcgatctatctggatcaggctaaacacgccatttccggcagccacattgcgctgggtgcgcagaacgttgacgtgaacctgtctggcgctttcaccggtgaaacctctgccgagatgctgaaagacatcggcgcgaaatacatcatcatcggccactctgagcgccgcacctaccataaagagagcgacgagttcatcgcgaagaaattcgccgtgctgaaggccgcaggcctggtaccggtgctgtgcatcggtgagaccgaagccgagaacgaagccggcaaaactgaagaagtgtgcgcacgtcagatcgacgccgtgctggaaactcagggtgcagcggccttcgaaggcgcggttatcgcctatgagccagtctgggccatcggtaccggcaaatcagcgaccccagcgcaggcgcaggcagtacacaaattcattcgtgaccacatcgcgaagaaagatgccgctatcgctgagcaggtaatcattcagtacggcggttcggttaacgacaaaaacgccgcagaactgttcacccagccggacatcgacggcgcgctggtgggcggtgcatctctgaaggccgacgctttcgcggtgatcgtcaaagccgctgcagcagcgaaaaacgcttgcgctccagcgccagcagcgccaggcgtccatccggcagctgggccagcgccagcccgtattgcccatctcaccacgcgcatgcggcacctcctctgccagccggataaacacgctctgctgcgccagctcggcggtgctcagcgtgcgaatcagccaggtatgccgcagcagcgttgccgtctgtcactgcgcattcagcttcggtgccagcgtatccagctgctgacgcacatccggtcgcaggcaggagatatgaatgtgcagctgattctgcgtacggccatactgcgcgttgatggccagcgacagcacacggtcgtcgacaggcgcaccgcgcttctgcgccagcaggcggcgctgctgccaggcggcagcaaacaggttcggcgtagtgggttcgagaaggattgggctctccatgccggtgatttttgctatcggcatcagcagatattgcagcgggccattcagatctgtgagcgtgacgtgaccctgcgccagattgacctgctgacagggggcaggattaccgcgttgcgtcatcccggcaatcagaaggatgaacgcgataatcagcaacgtaacactacggcggcgcgcctgcatggccagatcctcagtgatgagctgtcagcatcctcacctgtcgccagcggaaagtcacggctttttccgcgccgtaaagcaaaacggccagcgcagggctga

SEQ ID NO: 8005 - DNA, 669 bp, Glycine max
  Peptide Sequence Number=SeqID_99690
ttccgcaacgaagaagtgcgtcaggtcgcgatcgaaaacctgaaaaagcgcggcattgatgcgctggtggtgattggcggtgacggttcttacatgggtgctaagcgcctgaccgaaatgggtttcccgtgcattggcctgccgggcaccatcgataacgacgtcgccggtaccgattacaccatcggttatttcaccgcgctggaaaccgtggttgaagcgattgaccgtctgcgcgacacctcttcttcgcatcagcgtatctccatcgtagaagtgatgggccgctactgcggtgacctgaccttagcggcggccatcgccggtggctgtgagttcatcgtgctgcctgaaatcccttacacgcgcgaagagctggtggcagaaatccaggctggcattgcgaaaggtaaaaaacacgccatcgtggcgatcaccgaacacatctgtgacatcgacgatctggcgcactttattgaagctgaaaccaagcgtgaaacccgtgccaccgtgctcggccacatccagcgtggcggtgcgccatgcgcttacgaccgcattctggcatcacgtatgggcgcttattcaattgagctgctgctgcagggctacggcggtcgctgcgtgggtattcagaacgagaagatggtgcatcatgacatcatctga

SEQ ID NO: 8006 - DNA, 1719 bp, Glycine max
  Peptide Sequence Number=SeqID_99691
atgaacaagtggagtattggtgtcaccctgttactggcttcaaccagtgttctggcaaaggatattcagctgttaaacgtctcttacgatccaacccgtgagctctacgagcagtacaacaaagcgtttagtgcgcactataagcaggaaaccggcgataacgtggtgatccgccagtcgcacggcggttcgggtaagcaggcgacgtccgtgatcaatggcatccgcgcagatgtggtgacgctggcgctgcagtccgacgtcgatgctattgctgaccgtggtcgtatcgataaaaactggatcaagcgtctgccggacaactcggcaccttatacttctaccatcgtgttcctggtgcgcaaaggcaatcctaaaggcattcatgactggccggatctgattaagccaggcgtttccgtgatcacgccaaacccgaaaacttccggcggcgcacgctggaactatctggcggcctggggctgggcgctggaccagaaccacggtgaccaggccaaagcgctggcttacgtccgggcgctgttcaaaaacgttgaagtgcaggattccggtgcacgtggcgcgaccaataccttcgttgagcgcggtatcggtgatgtgctgattgcatgggaaaacgaagcctatctggccgtcgataagctgggcaaagacaagtttgaaatcgttacgccgagcgaatcgatcctcgccgaaccgacggtctccgtggtagataaagtggtggatgagcagggcacgcgtaaggtggcggaagagtatctgaaatatctctactcaccggaaggccagaccatcgcggcgcaaaacttctatcgcccgcgcgatcctgaggtggcgaagaagtttgccagcagcttcgcgccggttaagctgttcaccatcgatgacaagtttggcggctggagcaaagcgcagaaagcacactttgccgacggtggcagctacgatcagctcatcactgaggatctggccatgcaggcgcgccgccgtagtcttacgttgctgattatcgcgttcatccttctgattgccgggctgatcgccggtgcgcgaaaagtgcgtaccggacatgacgcaacgcggcaatcctgccccctgtcagcaggtcaatctggtgcagggttacgttacgctcaaagatctgaatggcccgctgcaatatctgctgatgccgatagcgaaaatcaccggcatggagagcccaatccttctcgaacctaccacgccgaacctgtttgctgccgcctggcagcagcgccgcctgctggcgcagaagcgcggtgcgcctgtcgacgaccgcgtgctgtcgctggccatcaacgcgcagtatggtcgtacgcagaatcagctgcacattcatatctcctgcctgcgaccggatgtgcgtcagcagctggatacgctggcaccgaagctgaatgcgcagtggcagacggcaacgctgctgcggcatacctggctgattcgcacgctgagcaccgccgaactggcgcagcagagcgtgtttatccggctggcagaggagctgccggatggacgcctggcgctgctggcgctggagcgcaactggctcaagctgaatcgcggttcggcggaagaactgcaggatcaccagtgccgtttgctggagtgagtggcatcgcgactgctcaggcaataaaaaaggcggcttatcagccgcctttttctgcgtga

SEQ ID NO: 8007 - DNA, 1302 bp, Glycine max
  Peptide Sequence Number=SeqID_99692
atggtgcccaaactcgattcgcgccagatgacctcgctgatggagagcgaacagcgccagggtaccatgattgagcaacacgttgaggcggagctgtcacaggatccgcccaacgacctgatgtggtggcgccggctgtttcgcgccatcgacaaatgggcaccgcccggtcagcgcctgctactggtgaccagcgaaggacgggtgatcggtgcgcagcacaatgaaatgcaggtgatccgcaactttatcggccagtccgataatgccgatcatccgcagaagaaaaagtatggccgcgtcgagatggtcggccccttcgcggtgcgcgacggcgaagacaattaccagctgtatctcatccgtcccgccaccagttcccagctcgatttcgtcaacctgctgtttgaccgtcctctgctgctgctcatcgtcaccatgttaatcagctcaccgctgctgctgtggctggcgtggagcctggcgcgtccggcacgcaaactaaaacatgccgcggatgaagtggcgagcgggaatttgcgtcagcatccggaactggaatcaggcccgcaggaatttcttgctgccggttccagtttcaaccagatggtgagcgcgctcgaacgcatgatgacggcacagcagcgtctgctgtcggatatcagccatgaattacgcacgccgctgacgcgtctgcagctggcgactgcgctactgcgccggcgtcatggcgaaggcaaagagctggagcgcattgagaccgaagcgcagcgtctggacggcatgatcaacgacttgctggtactgtcgcgcacccagcacaagaacgcgctggtgagcgaagcgatgaaggccaaccagctgtggaacggcgtgctggaagatgccaaattcgaagcggagcagatgggtaaaaccatggacgtgccgtatccgcccggtccgtggccgctgtacggtaacccgcatgcgctggaaagcgcgctggagaacattgtgcgtaacgcgctgcgctattcacacacgcacatcagcgttagctttgcggtggatattcagggcattaccgtgcacgtggacgacgacggtcctggcgtcagcccggaagatcgcgagcagattttccgtccgttctaccgcaccgatgaagcgcgtgaccgtgaatccggcggcaccgggctcgggctggcgattgtcgaaaccgccgtgcaacagcaccgcggctgggtgaaagccgatgacagcccgttaggcggtctgcgcctgacgctgtggctgccgctgtactccgcccggcaataa

SEQ ID NO: 8008 - DNA, 1041 bp, Glycine max
  Peptide Sequence Number=SeqID_99693
atggactttagctgcgttttgctgtcatcggcgctatgcgcggcgacgggcaacagcaacgcacccgcacaaagcaggctgagggagatatcggatccagcgaaattgacaacggagatgccgggtcgttgtaacggccccggtctggagtcgttacccctcatgcaagaaattatgcagtttgcaagcaatcaccccatccttagtctggcatgggtcgctttacttattctggtgattgtaaccaccgttaaaggcatgttctctaaggtaaaaaccatcagtcgtggtgaagcaacccacctgatcaacaaagaggacgcggtggtggtagacgttcgttcacgcgacgactatcgcaaaggacacatttcaggggctattaacatcgccgcagccgatatcaaaaaaggcagctttggcgagctggaaaagcacaagtcgcagcccataattgtggtatgtgccaccggccagagcgccgcagaaccggcagccacccttagcgcagcgggttttgataaagtgaccgtgctgaaagatggtgtgagcggctggagtggcgaaaacctgccgctggttcgcggcgtgtcataccaggagattcccattgatggggacgcggtaaagcgcgaagagatgatcaaacgcagcggccgcaccacggtgccacagatctttattgacgcgcagcacattggcggctgtgacgatctctacgcgctggacgggcagcatagcagcaacgaaatgcagttccagattcaacgcgtttacaccaaagacgtctcatttgaagcgccaaacgcacctcaggttttccagaaagagtgggaaccggaagtgaagctggatctggacaccgcctcttctcagctggcggatgaagtgtatgaagtcgtgctgcgcgttactgtcaccgccaccgtgggcgaagacaccgcgttcctgtgcgagtacagcaggccggtatcttcaccatcagcgcctggtgtcacgcggtaccttccctcagctcaatctggcgccggtcaactttga

SEQ ID NO: 8009 - DNA, 495 bp, Glycine max
  Peptide Sequence Number=SeqID_99694
atggcggcagcggtgtgtaagcacgtcggcgcgcgaaacgtggtgatcactgacatcaatgagtatcgtctcgggctggcccgtgaaatgggcgtgacgcgcgcggtcaacgtggcgcagcagaatctgcgcgaggtgatgacggaactgggcatgaccgaaggctttgatgtcggactggagatgtccggcgcgccgccggcgtttcgtaccctgctggagaccatgaatcacggcggacgcattgcgctgctgggcattccgccgggtgagatgtcgattgactggaatcaggttatcttcaaggggctgtttatcaaggggatttacggccgtgagatgtttgaaacctggtacaaaatggccgcgctgattcagtccggcctcgatctgacgccgatcatcacgcatcgctatcacatcgacgacttccagcagggcttcgacgagatgcgctccgggcgttcaggcaaagtggtactgagctgggattaa

SEQ ID NO: 8010 - DNA, 1340 bp, Glycine max
  Peptide Sequence Number=SeqID_99695
atgaagtttgtccatggccgcaccggtaaaaacctggtgatacaaaccgctaaaatcggcgactatattaatatcacgccgttattatcccacctgggaaaaagcgatgccctgctgagctatagtgtcgccccgctggctgaacgtgacgccacgctggagcacatctgggaatcaggccaaaaccattccgccgttaatctggagttgtttaaagttgccggtcagcgaaacaatctggtgagtctggtaggtaaaattccgctcgaggcgctgcctgccgccattaacgagatggatttctatatcgcctcggattccggcaatgtgtatattgccgacgcgcaacaggagcaaaggccgctgggtgacgtgctcttaattggcccgaaccacatcgcgccctcttcgtttgtgttcgctgcgcaatacaaatttgcccatccggttgaacagctcccgataagctcatccccgctactcagtctcattatcccgatgtttaacgctggtgctgattttactggctgtatcaatgcattgctggcgcaaaccctgacgtcgctggagatcatcattgttgatgatggctccaccgacggttccggcgagcgcgccgacgcgctggcgcagcagtaccagcatattcaggtgattcatcagccgaacggtggcgtgtcgcgtgcgcgtaatgccgggctggccgtggcgcggggtaaatacgtcagctttcccgacgccgacgacaccatggacccggcgatgtaccagacgctggtcgacatggcggagcgcgatcggctggacgctgcgcagtgcaacgccgagtggtttttcaaggccagccagacaattaagccgatgattccgcgggatcgcctcaccagcaccggcgtattaagcgggccggagtggctcaacaaggcgctgaaaacccggcgttacctgcacgtcgtgtggctcggtatctaccgccgtgagctgatcgaacagcttaatctgcagtttgaacccggtctgcatcatcaggacatcccgtggaccactgagttcatgctcaacgtacagcgcgtgcgctacaccgatcgggtgctgtatcgctactacatgcacgatgcgtcgatcagcaaccgcaagcgcaccggccagcacaacgtcgactatcagcgtcactacctgaaaatcgcgcgcatgctggaagagatcaacacgcgctatcgtcacaaggtgaagatttacccgagcttccacgcgcagattacccgcgaagcgctcagcgtgtgccacgctatccggcgcgaaccggacgccgcagcgcgccaggcaatgatcgccgatct

SEQ ID NO: 8011 - DNA, 825 bp, Glycine max
  Peptide Sequence Number=SeqID_99696
atggcgaattttgccctggcgcagaacgcgaacgtgctggtgcgcggtctgcgtgcggtatcggactttgagtatgagcttcagctggcgcacatgaaccgtcatctgctgcccacgctggagagcgtgtttctgatgccgtccgaaggcttctcgtttgtctcgtcgtcgctggtcaaggaagtggcgcgccatcaggtgctggcagcgtggacaccagaaggtgctgcgctgaccgtgtttaccgctgaggatcggcgtaccgcaggcacgacagggctcgccggcacggccatacacctgcagctgctgcgcaaaatagcccggcttaccgtcggtctgcaggaaatcacgcagcgtggtgccgccctgctcaatcgaacgcagcagtacggctttgatggtgttcgccagcagctcatcgccggacgatcgggtaagatcccggcgatacccgccgctgaaggcatcgctcagcggttccggaccgaggtgcgccagcacgctgctgccttccggatcggtagtccacagccaggcgccgaaacgccgcggatcggtatagcgcagcactttgccattgctcatcaccaaatcgacgtggtcgtgcttcgcagccggcagttcgccgggcagaacgcgcaggctgccggacatgccaagatgaatgatgatccagccgtgcggcagctccagcagcagatacttggcgcggcgctgtacgctgagcaccggctggtcgctcagcgcgtggatttcatgggaaaccggccagcgcagacgcggattgcgcacaatggcatgcagaatggtttctcccaccag

SEQ ID NO: 8012 - DNA, 870 bp, Glycine max
  Peptide Sequence Number=SeqID_99697
atgccttggacgcgcccagtcgatgctggctctataccctggttaacagggacaatttctaaggctacctctttaacgcgggctttgccgtgcccgtggtgccagcagcactgcggttcaccgccttgtcccatgtcgtctgcaatggggagtattgctatgctgagcgcatttaaactggagcgcgatcgcctgacgcgcatcgagctggaagacaacaacgataaactcaacacctcggtgtgggtcgatctgatcgagccggacgacagcgagcgtgagcgcgtgcagtcggaactggggcagagcctggcaacgcgtcccgagctggaggacattgaggcctcggcgcgtttcttcgaagacgaagacggcctgcacatccactcctttttcttttttgaagatgctgaagatcacgccggcaactccaccgtggcgtttaccatccgcgaagatcgcctgtacacgctgcgcgagcgtgagctgccggcgttccgcctgtaccgcatgcgcgcgcgcaatcagcagctgaccgacggcaacgcctacgagctgctgctcgatctgttcgaaaccaaaatcgagcagctggcggatgagatcgagaacatctatagcgcgctggaaaaactcagccgcgtgatcatggaagggcagcagggcgaagagtacgacgacgcgctgtcgcgcctggcggagctggaagatatcggctggaaagtgcgtctgtgtctgatggatacccagcgtgcgctgaacttcctggtgcgtaaagcgcggctgccgggcaatcagctggagcaggcgcgcgagatcctgcgcgacatcgaatcgctgctgccgcacaacgaatcgctgttccagaag

SEQ ID NO: 8013 - DNA, 990 bp, Glycine max
  Peptide Sequence Number=SeqID_99698
atggaagtggtcaatccggaacacatccgtctgcgcgtgtatgaacgcggcgcgggcgaaacccaggcgtgcggcagcggcgcctgcgccgcagtggcctgcggcattcagcagggcattctggcggagaaagtgcgcgtcgatctgcccggcggcacgctgcatatcgcctggaaaggggccggtcagccgctgtttatgaccgggccagccacacacgcggtgagcgcctggctgcgtcacaaccccgatttctttattcgcaatgcgcgccaggttgagcaaatgatggtgccgcatccggtgcgcggcagcgtatcgctggtggaatggcatatggcgcgtcagcgcaaccacatccagcagctggaagaggagattacgctgctgatggagcaggcaaccgccaatcatcagctgttcgatcgcctgctggcgttgcagagccatctcgcggcggccgatagcctgcaggagatgctgacgcgcctgcatcgctgggcgcgcgagcttggcctggcgggcgctaatgtgcggctgttcagcgaccgctggcgcatcggcgcaccctccgatttcacccagcttgcatcactaccttggcagcctgaacggaccggagctgctgctgctgctgccgcaggcgaaagccgtcggatcggtggcgatgtcgctgatgggcgagcagggcgatctcggcgtactgatcttcagcagccgcgacaaccagcactatcaggcgggcatgggcacgctgctgctgcagcacctggcacaaatgctgcccgacctgctgtctcgctgggtggagcgtgcatgagcagcgccagcccgctgttgccggccgttgagggctttctgcgctatctgaaagtcgaacgccagctcagcccgctgacgcaaaagaattaccagcgccagctgcaggcgcttatcgccatggcggatgacatgcacattaccgcgtggtcgcagctggaaccggcacag

SEQ ID NO: 8014 - DNA, 1350 bp, Glycine max
  Peptide Sequence Number=SeqID_99699
atggccagcggcaagctgtgcggcgacggcggctttacccggcgctgtcagcagtggatggagcagcattttggcagcaaaaaagtgctgctgacgccctcgtgcaccgcttcgctggagatggccgcgctgctgatcgatatccagcccggcgatgaagtgatcatgccgagctacacctttgtctccaccgccaacgccttcgtgctacgcggtgccaccattgtgttcgtcgacgtgcgtccggatacgctgaatatcgacgaaacgcagattgaagcagcaatcacgccgaaaacgcgcgccatcgtgccggtacattacgcgggcgtggcgtgcgagatggataccatcatggcattggcggcgaagcaccagctgtatgtgattgaagatgcggcgcagggcgtgatgtcgcagtacaaagggcgcgcgctgggcaccatcggccatattggctgctttagcttccatgagacgaaaaactacaccgccggcggtgaaggcggcgctacgctgatcaacgaggcgaaactgatcgagcgtgcggagatcatccgcgaaaaaggcaccaaccgtagccagttcttccgctggacaggcggcttatctgtgggcacagctggaagcggcggaacgcatcaaccagcagcgtctgcgcctgtggcagaactattacgacgcgctgcagccgctggcggccagcgggcgcattgcgttaccggcggaagcggagatcctcaccgtgttccactatatcccgctgcactcctcaccggccggcacgcgttttggccgcttccacggcacggatgcgttcactacgcgcgagagcgagcgcctgctgcggctgccgctgttctacaacctgtcggacaacaaccagcgtacggtaatcagttcgctgctgagcttctttgcctgatgtcgttagccagagcctcagtgtggaccgcctcgtccacgctggtaaaaattgtcgctggcctgctggtggtgaaactgctggcggtgagcttcggccccgagggcgtcggccaggcggttccgccagcagccggcgcagctgcgcgccgtgaccggcaccgcgtcggcaatggtgctggggttttccacactgctggcgctgctgttcctgctggcggcggagcccatcagccgggcgctcctgatcggcgtggtgggttatgtgctgtgctggtggctgggtggctatgccggtgcgctggtcgggctggcgctggtgccggcgctgctggtcgggccggcgctgtggatgctgcgacgccaccgcgaggaactgccgctgcgctggctgatgccgcagtggcagccggcactggcgcgtaa

SEQ ID NO: 8015 - DNA, 288 bp, Glycine max
  Peptide Sequence Number=SeqID_99700
atgaagaacgtcgaagaacggtcaaaaacctttgcgaaatcactcacggaaacgttacggaagcgcctcggcttggattttcttcacggaaacaatttttctaagcaaattcgaaagagagagaaaaaattgggggagaagcttgccacccagctcgcccaggcgagcagggttgcttcctccagaagcaacagccttctggaggaatcttctggagggcccaagtgggcctggttgctatttgcacccccatttttactaaatacacccccctaccttttttggtga

SEQ ID NO: 8016 - DNA, 345 bp, Glycine max
  Peptide Sequence Number=SeqID_99701
atgccaatctccgcctacagatgtatcggttgggatcaagcccacaagacgcccagtggacccgaagaagtccaacagggccctgggtttccagctctggttatgggcctctatcagtcctacagggtgtccgttcccctggcaaggtcacatcaccatggcatagggatcgcgctgcaagacacccagtggacccgaagaagtccaacagggtcttggagttgccaagctctaattacgggcctctgtcagttctacggagtgcctgttgcccccagcaaggtcatcaggccccctactaatcgagctttcatcaagaagttctgcgtccccaggcaggcgtag

SEQ ID NO: 8017 - DNA, 432 bp, Glycine max
  Peptide Sequence Number=SeqID_99702
gcggaatttgaaatccctgaagcttctaatggtaggacaaagaagaaagttcttcagactgtcggcgagcggtggaggcaatttaaatctaatttgacgaggaaatgggcacttgcagccgacaaggacggtgtggaggacactgtctgtgaaaaatacaacattagcaaggagaaatgggcccatttttgtctgacccgcagaaacccctcgtgggaggagcaggtgtcacagggttcgtttgtcccccatggacgtcaggatctcctaactgttgccattgggcgaccagaacaccctgaccatgtacgtgctgctggagtcagtgtcaccatcaagcaatacttcggattggttcaacgaagctttcgcagttcgtcctccatgcctcccaaagaactcgagcagctgactcaacaaatcagggactag

SEQ ID NO: 8018 - DNA, 282 bp, Glycine max
  Peptide Sequence Number=SeqID_99703
atgagttttggggatgcagatgcatgcagcctttgccttggaatgcggttgattgtccttttgaaagaggtgatgattcatgtagcctcatcctatctttgcaaatctcttcgggaactccctcagagtggaacctattgggtgagaatttcttatcttcccctaggttcacttgaggtttatgcatggtgcctttcattgccccagtgtagggctctaaggtatccatcgttgtctggttttcacaaccttgtagcaaggaagaatgaaagaagcggttga

SEQ ID NO: 8019 - DNA, 168 bp, Glycine max
  Peptide Sequence Number=SeqID_99704
atgtcggctattgagttttctattcaatcccttaatgaaatatggatgatgtcggctaaaggcccaagtggagaagtacgaaggcccaggtggagaagtacaaagccccgagtggagaaggtgaaggcccaagtggagaagggtgaaggcccaagtggagaagggtga

SEQ ID NO: 8020 - DNA, 714 bp, Glycine max
  Peptide Sequence Number=SeqID_99705
atgggatcaagtcaaacaccttcgcttaaaaagaggttctatcaagtcaaggtcaagagcctaggaatcaccagtttaaaagagctagggcagttgatggtcagctccaacggcaagctttttgcaaagattacgacaacttggctaccctatgagaggggcaccgctagaggaagagatcgcacctgtcctttcaacgtagagacgcttcagaaggtccgcaaggcatgggaggtggtgcgaaagaaggacaaagaactcaggggcagtaacaatgggcccatcggtggctaccgtaagtggttgagagcccatgtgcaaggtttggattggctcctgagtttgagaactgcaaaaagggaggaagttgaggcaccggaggaagacgaagaggtgcaggcccttagggcagaactcgagcaaggccaaacagtcaaagaaaggttcaaatcagtagctctgaagatccgaaaggagaatgccgaactaagagatataaatatagctaccaccaaggccttggaacaagagaccaagagggctcgtagggaagagcacggccggaacaagttccgaggggctctgtggggcagcaacagcgagcttaagctccggagagaggaaagggaccaatcccaagtagacagtttgatcttaaaagatgagttgaaggtttgctcgaggtccaaaagaaacctgtctcagcggttatga

SEQ ID NO: 8021 - DNA, 189 bp, Glycine max
  Peptide Sequence Number=SeqID_99706
atgaccaaacttggtctctgcttgtcatcgggcccgccgcctctggatgacaaaaagggtgcggataaccgtaagggtgcggataaccgtaagggtcagtatgacaaagattatggggcggccgacaaaagcaaggctcttgctcctacgtatcctccaatgaggaattcagacctacgtagttcttga

SEQ ID NO: 8022 - DNA, 447 bp, Glycine max
  Peptide Sequence Number=SeqID_99707
atgacgcccaatgagttagagaataaaattcagaaagaattgttcagctgcgtagatggtttcaatagcttttattttagtgcaggtgccggcgcgggtaaaacacatgcgttgattgaggtgttgaaatatattgttaaccgtaaattaaattacaataaaactttgcagcaagtagcatgcatcacttataccaatattgccgtgtcagaaataactaaaaggcttggtaattcagatgcggtgatggtttctaccattcatgatagattgtgggacataatcaaacgataccagccagagctgattatctgccataaagaaaaaatcactaaagtcattcaagcatgccaacatgaccttgctaatgaaaagagagctcaattttataaagaactaaacggctcagaaaaagaggatgcaaaaatatttatgatgatggagtag

SEQ ID NO: 8023 - DNA, 849 bp, Glycine max
  Peptide Sequence Number=SeqID_99708
atgccttcgcggctgcggccgctggacaacgcaatgtacgcgtacgccggcatcgcgtgcagcagcactcaccgcatccagcagcgccgcgcactgcagcggttgcccggccaccggaacaacgatgctgccagcggcgaaatcggcctcgccctgtgcagtcgaagcggtaaatggctggaacgttgcgcgtgtgctcaaacctttggcctgcagcaccgccagcgcacgcccggcgttgtagtcgcgccagtcgatgacataggcgaagccggcctggccacccaagaccgcgccctgctcctccggcagcgcggccacgcgggcgccaccttcgatacgactgcggctgccggcgaaggccacaccgtaggccggtgcgatcgcatagctggtgctgccgtagaacacatcccccttgatcggcggcgtttcggcaaagatcgaatgcaccaggcggaactgcgcctgctgcaccggcaccacgtaggcgctgccggcatcgattttttttttatcgacagtaactgcacgatccagcgcgcgcgcctcgatgcgatgcaacagcaacagctccagcaggcgacgggtcagtgccgggtcatgcgcgtcgccgaacacgaagctcttcaccggctgctgcgcagcctgcttcaacgcgctctggaagaactgcttctgcaggtcgaacaggccgttgcgttcggtcaccgcgccgcgcaccgtgcccagaccggtggcgacctggttgcggatggtgaacgggaaggtcagcaggccattcaccgattcctgcacgcgaccgcgcgagctggcctgctcgacggtaacgccgacagcgccatggaa

SEQ ID NO: 8024 - DNA, 477 bp, Glycine max
  Peptide Sequence Number=SeqID_99709
cgccgaacaccagcagcgcttgaggccatcaagggatggtcatttctccgggagcgacgcgtccagctcagggacgacgagtataccgatttccaggaggagatagttcaccggcggtgggcatcactggtcacccccatggccaagttcgatccagacatagtccttgaattttatgccaatgcttggcctacagaggagggcgtgcgagatatgaggtcctgggtgaggggtcagtggatcccgtttgatgcagatgctatcggccagctcctgggatatcctttagtgctggaagagggtcaagagtgcgagtatggccagtggaggaaccggtccgatgggttcgatgaggaggccatcgcccattcgctatgtataccggggcaggattttgcccattcgcaccaacatgaccaccctcactcagatctggatgactttcctgctcagcaacatccagcccagcgaccataa

SEQ ID NO: 8025 - DNA, 484 bp, Glycine max
  Peptide Sequence Number=SeqID_99710
gcaccctttggacccagataagtccaacagggccgtgggatttcccgcactgatcacaggaccctgccagtcgttcggagtccccgttgcacctaccaaggtaattcggccggccatcacccgggcttttattgagaagtactgtacccggagacaggctcagggtgatgctccacagtccgtaggcgcgcccccaccacctcatcaggctggccaggctgggtcatttgacatggagcagtatttacggcatttggttcgccagcaggcggccaaccaccgggcacatgtacagacccatgattgtctgtaccagatgagcctcaacatgcagagccagggcttcgcttctttttcatgccctactccagaccagttcagggcagaggcacccccagaagctcccggcgatggcgaggaggcccacgaggacgaggagatggccgatttgcttgacttcttgggagggagtggagctacatga

SEQ ID NO: 8026 - DNA, 519 bp, Glycine max
  misc_feature (514)..(514): n is a, c, g, or t
  Peptide Sequence Number=SeqID_99711
atggcttcgagacttgtatcagagccagtgcaggaccagacgatgggttgtagtagcccgcacgctttcagggacctggcccaggcagggggattcgcctggggggcggctgcattagtccacatgtacgaccatctgaatgacgcgtcgcaggcctctacacggcagctgggcggttatattacacttctccagtgctggatatacgagcactttcctacagtgcatacatccgtcgttcatgatgcttatgatgaggggagcccccgggcctgcaggtggcttacgggtaaggctcatatgacggggatcaagggggccctgtatcggagacgtttggatgccctgagtgtgaatgacgtgtgctggatgccctatggtgagcaccggcgagtcagggcctttgacttgatatcgtcgtacaccagccagcttagatggggtcagattgtggtgtacgttcgacctgagcgggttcttcgacagtttggctaccttcagacggttcctccgncgccg

SEQ ID NO: 8027 - DNA, 153 bp, Glycine max
  Peptide Sequence Number=SeqID_99712
atgagtgaaatcgaagaagtacaggaacaaatgaaggccgatatggaggccatgaaggaacagatgacaatgatgatggaagcaatgatgagcatgaggaagatgatggaggttaacactgctacagttggtgttgcaagcactgctactgag

SEQ ID NO: 8028 - DNA, 561 bp, Glycine max
  Peptide Sequence Number=SeqID_99713
atggaaccgattgcatccctgtcccagtattatgaccagcccctaaggtgcttcacatttgaggacttccagcttagtgccgactgtgaaagagttggaagaaatcctgggatgccaactgggaggaaggaagccatatcttttctttgggttctatccctccacgacaagagttgccaagggcaaaggccttggaaaatcaaggcgaatgggctttcttttattgacatcttggcgttttttatctttggagttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaagggaaagggagtcaagaacttccccgattgctagccaaggccaaagcagtggcggacacctactccgcccccgaggagatccacggacttctcagctattgtcagcatatgatagacttaatggaccatatgattag

SEQ ID NO: 8029 - DNA, 534 bp, Glycine max
  Peptide Sequence Number=SeqID_99714
atggagatgagtatgattgatgctgccagtggtggagcccttggtgatatgactcctgctgaggctaggaatttgattgagaaagatggcttccaactccccaacaatttcagtgcaagaaatgatgctattgtccttagaggagtccatgaggtggccacggattcatcttcatctactgaaaataaaaagcttgaaggaaaacttgatgccttgggtcaacctagttggaggaatcatccaaatccgagatggacaagtcctccacaacaacaacagcctatccctcctttccagaatgttgctggtccaagcaagccatatgttcctcctccaatgcagcaacaacaacaacaacaaagacaacaagcaactgaggcccctcctcaaccttccttagaagagttattgatggcaaatgaccatccagaatatgcaattttagcaagagacaaaaacctccattcagagtctaacaaatcagatggggctgatggctactcagttgaaccaagctcagtcccaaaattctga

SEQ ID NO: 8030 - DNA, 381 bp, Glycine max
  Peptide Sequence Number=SeqID_99715
atggggacaaggggttgcatcacttacaatcccgttcttgctataaggcaacttggctaccctatgagaggggcaccgctagaggaagagctcgcgcctgtcatttcacgaggtttcaataacaccaacgtggagacacttcagaaggtccgcaaggcatgggaggtggtgcaaaagaaggacaaagaacttaggggcagtaacaatgggcccatcggtggctaccgaaggtggttgaaagcccacgtgcagggtttggattggctctcgagtttgagaaccgctaaaagggaggaagttgaaacaccggaggaagacgaagaggtgcaggtccttagggcagaactcgagcaagcccaaacagtcaaagagggctcgtag

SEQ ID NO: 8031 - DNA, 261 bp, Glycine max
  Peptide Sequence Number=SeqID_99716
atgggttctccacctgcctccactactcctcctccttctgctcctcctccgtcggacgcattggcttcgccgtctgccgtgaagcggacacgcaaagcctcacgtctacgatcgttgtccactagaccacctagtgttgagagaccagtggtgcatgttgatcctgctaccgggaaggccgacggtccccacaggaagaaattaaggacatatttggggattgtggcgcgtgataaggtggacgtcacctacgagaactag

SEQ ID NO: 8032 - DNA, 180 bp, Glycine max
  Peptide Sequence Number=SeqID_99717
atgccacttcaaggagaagataagtcaagaagaagctcagcaccattggaagtcatgaataagagcttgaaggtaggagaagacgagtggagggagaggagaaggagcacaaaattttgtgcctcaaaagagcccactaatccaagatcaagtccaagattctccactaagtgtacttag

SEQ ID NO: 8033 - DNA, 174 bp, Glycine max
  Peptide Sequence Number=SeqID_99718
atgggggtgcaaatagcacccaggcccacttgggccctccagaatattcctccagaaggctccgaggcgcttccgaaacgtttccgtaacgttttccgtgaagaatttcgcaaaggtttcgaccgttcttcgacgttcttcattcgttcttcatcgttcttcgatcttctacgg

SEQ ID NO: 8034 - DNA, 637 bp, Glycine max
  Peptide Sequence Number=SeqID_99719
gaggcgatattttgctgacagagttgcttgaggtgtctgccgaggaggctagagccgagacagcactgacatctcgtgcttatctgctgcacctggtcggttgcactctttttgctaataagagtgcaacatacgttcatgtggtgcacctagacgcttttcgcgacctgggtcagagtggtggttatgcttggggagttgtcgcgttggttcatatgtatgaccagttagatgaggcttctaggaccaccacacgacaaattgcggggtacctgactctattccagtccgtgacagatgatacataccaggagacatccccatgtgcttcctggtggctgacgtcgaaggcgtacatgaagggaatcacaggagcaccttacagggcacggtcagctgagatgaggtcctatggtggtcacagctcgaccggagagggagatgacaggtggatgcattttgcggagcacgtactacctatgggtaagctttgtctagtgcttgggcagcccagagatgcaccagccgcagaccctgaggagtacatacagccgcccagcccccaggttccagtggcatttgacccctctccacatgcagtggatgattatgacggctatgaggtgattgcacagag

SEQ ID NO: 8035 - DNA, 270 bp, Glycine max
  Peptide Sequence Number=SeqID_99720
atgcaaagaagatcttctgcaagtgatttgattcccattgatttggagattaacaccacttgtagaaggcgtaatcaagagagaattagaaattttttgctggacttagaggaagcagtaattccagaggaagaacctcaatcttctgaggcatcttctagttttcctattgcagaacattctcatttagatcctagtgaagactacatcatggttgaagatccaagaagagttactctggaatattattcaggttctaatgtaccataa

SEQ ID NO: 8036 - DNA, 537 bp, Glycine max
  Peptide Sequence Number=SeqID_99721
atgtcgcgggggtcaagagaccttggggacgtcaggtggggtgctattgcccaaaaccaagcttggctaatcccgacccaacctgggcatagtcatttaatcgcgatgacaacgcaattgatccatgatcgcgtggtaatggagtgcctagagggtgtttgggagaccctcgaaggcaatgagaggtgccgattccgtggcacaattcgactcactgctacttcattagtacatctggaggaaccagcacgcacacttcagcagcctgtggagtggatactacctacacctactccatatcgactagttgagctggttcaagtgatagaggtgtcatcctctgaagaagatcttaaagaggacccagaggagttacctcctaaacctgctgtggatgctcttgacttcccagaggatgatgaggacccactccctgatgttgattctccaaaggatgttatgtcagcatctgaggcagactctacagaggagagcagccctggagggacagcaaatagtgacgactcttcattgtag

SEQ ID NO: 8037 - DNA, 132 bp, Glycine max
  Peptide Sequence Number=SeqID_99722
atgtcaaggtatatgtgctatgcaaaagtgcagtcactagcacttgctattatcaaagtttccaacactagtggagttgataggaaggtcctcgtctgggacttggaagatggttactgcactcattcctag

SEQ ID NO: 8038 - DNA, 441 bp, Glycine max
  Peptide Sequence Number=SeqID_99723
atgttgcggaaccttacggattacgtaatcatcccttttttgccttccggaacgttacggaactttacgaattgcgcactaacatttccttttaattttcagcatgtcacggaacttcacggattatgctacaacgcttttcttttggcttccggcatgtctcaaaacttcacaaattgcctaacgatgggtgccaaatacctcgaagtggtcaaacgagggtcgcatcccaacaacggatggtccccgaacgaaattaggcttgatgtagaagcaagcttcatgatgatgaaccaagcaatttttatgatgacaaaagcccaagcgattgattcaagattgattcaagacttcaagatcaagcatcaagaatccaatccaagattcaagattcaagagaagaaatcaagaagcaacaagtcaagacttcacataggataa

SEQ ID NO: 8039 - DNA, 492 bp, Glycine max
  Peptide Sequence Number=SeqID_99724
atgaccatcccagagcttttcttgaggccttaccaggttacatgggatgccaccatttttggggtctttaatccaaacttcccgctctacataaagcacgaagacctctccaaaattgcacacggttgtcaatgtctcagcatattagtgcatctgacggaaagaagtatgcgagtggggaattctgatatctatggattcctcgagccacagtccattcagaggtttgggcaatcgcagtttgagactaaaagttacataaagagttggatgcagagttcaaaatgcgatgtctaccttggagcctacctgaatggtggacactggcagatggtggtcatcttgcccaaggaacacctagttgtctggttttgttcattgcataacaggccaaacaactaccttaaggggatcaataacagtgtaatagacaaaaaggaagtactgagtgcggcttttatgtcatgcactggatgtccatcatcattttag

SEQ ID NO: 8040 - DNA, 283 bp, Glycine max
  Peptide Sequence Number=SeqID_99725
atggtttcaagtaactctaaagttcgggaaattgcataccctgatcaaaactctatgtgtcctcctccagcaaaggtcaacactaaaggtgcaccgaagaaaccgatgaacagaaaccaaagatcaacaaagtatgatttgtcttactgggacaactcttcagtgaagcgtagtgcatcatcttctgaccagccgaatccaagaaggatcatgtcgatgttggatcaatttcagccatttatacatgatgttattgacaacattgtggatgtcaaagttgacg

SEQ ID NO: 8041 - DNA, 132 bp, Glycine max
  Peptide Sequence Number=SeqID_99726
atgcccttgcggggttggattgcatcatgtttgctagggcagcatgacgagtcagggaagagggagcgggccgtctattacttaagtaaaaaggagaaacttatgaaagtgccaaagtcaatgtctcgctaa

SEQ ID NO: 8042 - DNA, 222 bp, Glycine max
  Peptide Sequence Number=SeqID_99727
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtccctccaccaaatagagtcttggcttcctctaatgccttcctccaatgccctccagcctccatactttga

SEQ ID NO: 8043 - DNA, 435 bp, Glycine max
  Peptide Sequence Number=SeqID_99728
atggtcatgcaacatggcttaattgggtttaatctccttccttttggtgttcttcctcaaacaaattctattgaagatgtaagggctactcaaagggtccaagacttctctatcgggtggtttatgaatcccttcacatttggagattaccctgatataatgaaaaagaatgctggctcaaggcttccttcttttactcaaaaggaatcaaatctggtcaggggctcaatcgacttcattggaataaacttttactactcattttatgttaaaaacagtcctggcagcctgcagaaggaggatagagattacattgcagatctatcggtggaaattgaaagccaacaaacacctcataattcatcattagatgactggccgagggtgaattacttgcatgaatacataggaagtttggttgatgcacttaggtaa

SEQ ID NO: 8044 - DNA, 735 bp, Glycine max
  Peptide Sequence Number=SeqID_99729
ggcatcattggtgggtaccatggatggctgaaagttcatatacgaggtttagattggctcgccaagttaaaagtcgtcagcgaagagagttttgaagcaccggaagaggacgaggaagtccaagctctcaaaagcgagttaggaaaggcgaaacttgccaaagagaagttcaagttggccgctacacacatccggaaggagtgtgccagattacgggaagagaatgcaactaccgcgagagcccttgaacaagagaccaagagggctcgcaaggaagagtatggccgtaacaaatttcgcggagctctatggggtagcaacagtgaactcaagctgcgaagggaagagagggaccagccgcgagcacatagcatggtcttgaaagaggagttagttgcctgttcaaggtccaaaaggagcttgtctcagcgtttatgcgagacggagaccaacatgctagctatcatcgccaagtatcaagaagagttacgcctatccacggcccacgagcatagggtcgcagacgagtatgcccaagtatacgcggaaaaaaaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaattcatgggcttatcggctattgtcagcatatga

SEQ ID NO: 8045 - DNA, 850 bp, Glycine max
  Peptide Sequence Number=SeqID_99730
aggactacacgtcctcaccttcagtggactgcacgccctcgccttaacaggactgcatgttctcacctacagaggactacataacctcgccttccgagggctagacgcgctcgccttcagaggagtacacatcctccccttcagatggctacacgccctcgccttcgtagggttacacacccttaccttcaaaggagtacacatactcaacttcagaggactagggctacacgtcctccccttcagaggacaacatgacctcccctttagaggactgcacgccctcgccttaacaggactgcatgttctcaccttcagaggactacacaatgtcctcgcatttcgagggctagactcagaggactacacgttctcccctttggaggactacatgtcctttccttacgagggctacacggcttcaccttttgaggactacacgccctctccttcagaggattacacgtcctcaccttcagaggactacacgtcctcaccatcagaggattacacacctttaatccgagggctagacgccctcgccttcagaggagtacacatcctccccttgagagggctacacgtcctcgccttcagtgggctacaagctctcgccttcgtagggttacacgcccccaccttcaaaggagtacacgtactcaacatcagaggactatacatcgtcgccatcagagggtacacgtcctcgcattcagagggttacacgtcctccacttcagaggactacatgcccataccttcaacctcgccttctgagggctatacgcgctcgccttcaaaggagtacacatcctctccttcggatgaatacacactctcgccctcctaa

SEQ ID NO: 8046 - DNA, 330 bp, Glycine max
  Peptide Sequence Number=SeqID_99731
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtcagaactggtctggagggacctggactcactgttgctcagaagctttggtattgtgttgccactgttggtggccagtatatatgggctcgcttacaatccttctctgcttttcgtagatggggtgatactgagcagaccgttggctcgacgtttatggatcttgatacagcggatagaaggaatatatag

SEQ ID NO: 8047 - DNA, 777 bp, Glycine max
  Peptide Sequence Number=SeqID_99732
gaaccggtcatatatgattaccatgagaaagaaagagccccggatcttgaaagtattttggcagacttcatgatgtaccaagcaagctctaaaggttattgttattctatgcaacaacagggaattcaatttgaaaggaaccagtcttctgcaggttatcaatgggagtcattccggcaatctgagtatcacaataaagcagaaggagttcttaatctggatgatctgttaatacaattcaaagatacggaagagcgtacagagattgaaacacatcaagaaagcatttgtcaagttacctcaatcaatcatcaattgaccaacaaagaggaaacacctgaagtctccagtactccagaatatccctacttggatactgttggctatgtaggagggaaagataaaggtaggttggaactcagcataaaggttgaaaagatcttttttgatctctttgaggccatgaaacacccagatatgggtgatgcctattttgaagaagaagaggtggagcaggaaataacattatcaaccgcaaccatggtactacaatctcccttggaaaaagaacctggctatgggagagattgcttagcttgtgatgaagagcttgatgattcaaaagacagttgtgttgatcaggtggtttttgaagaattggaaaaactaagaccagcagaaaagcccaaagcagaattaaagacccttccggcacatttaaaatatgtatttttggaagaagatgagaccaacctgttatcattagcaactctttga

SEQ ID NO: 8048 - DNA, 526 bp, Glycine max
  Peptide Sequence Number=SeqID_99733
gcaccctctagacccagataagtctaacagggccctgggttttctggcattgatcacgggtctctgccagtcattcggggttcctgtcacacctagtaaggtgattcgaccgccgatcacccgggctttcataaagaagtattgcacacccagacaggcgcagggtggcgacccacaggccccagacgcaccaccgccacctcctcaagctgacccagctgggtcatttgacacagagtggtatttatggcatttggttcaccagcaggcggccaaccacaggacgcacgtgcagacccatgactacctctaccagctcagccttagcctgcagagccagggtttccctccctttccatgccctacttcggatcagttcagggcagaggtcgcatggcccggggattggcctgaggcccaggcaggggaggcacccgcagaggctcccggcgatgcagatgaggcccgcatggacgaggagatgaccaatttgcttgatttcttgggagggagcagagccacatga

SEQ ID NO: 8049 - DNA, 102 bp, Glycine max
  Peptide Sequence Number=SeqID_99734
atgagcgcagctagattacataagggtgccaaagctgttgacactgttccactgttagtggttggttattcacgttttagaatagattggggtgagttttaa

SEQ ID NO: 8050 - DNA, 598 bp, Glycine max
  Peptide Sequence Number=SeqID_99735
ggcgtagaagacgacattagtctttgcgtgttatcaggcttttcgtcttacagacagcaaaaagtttatacggataaccactcgggtatttccgcccgtcagcgtgactcaaaagtcagtatgacagatcttgtgagcgcggaagatgaccaaaaagtttatacggataaccactcgggtatttccgttcatcagcgtgactcaaaagtcagtatgacagatcttgtgagcgcggaagatgaccaaaaagtttatacggataaccactcgggtatttccgcccgtcagcgtgactcaaaagtcagtatgacagatcttgtgagcgcggaagatgacgtacatctccgcatgtcaacgggcttgtcggacgcgattgacgaaggcttttcatcttacggacagcaaaaagtttatacggataaccactcgggtatttccgcccgtcagcgtgactcaaaagtcagtatgacagatcttgtgagcgcggaagatgacgtaaatctccacgtgtcaacgggcttttcgtcttacagacaactaaaagtttatacggataaccactcgggtatttccgttcgtcagcgtgactcaaaagtca

SEQ ID NO: 8051 - DNA, 186 bp, Glycine max
  Peptide Sequence Number=SeqID_99736
atggaaaaagatcccaagaagactctcaaattcttagatgctacaaatgcaaccaacttggtcacatcaaagcaaattgtccctcaaatgaggaatggcctgagaagagtgataagaaaagagaaggagatcaaccttctaaccaaggactatgagagtgatgagaacatctctcaagaagattaa

SEQ ID NO: 8052 - DNA, 96 bp, Glycine max
  Peptide Sequence Number=SeqID_99737
atggaggttgaggaaccctggcaggggttacggctaccatggcattatcaagtgatgttcatcattggaagtgcggtagacaggctttgtggttga

SEQ ID NO: 8053 - DNA, 84 bp, Glycine max
  Peptide Sequence Number=SeqID_99738
atgcatattgttgtggtacttaggaacggatgcaagtggggatggggtcacgaccgactgatcgtcgccccttctctgcgctaa

SEQ ID NO: 8054 - DNA, 333 bp, Glycine max
  Peptide Sequence Number=SeqID_99739
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgtctatggcaaagcttgcagagccaaattcaatgctggagtaccgagctcgaattcgtaa

SEQ ID NO: 8055 - DNA, 585 bp, Glycine max
  Peptide Sequence Number=SeqID_99740
atgacaaaaagatattggaacataatcttggaagagatgatggaagcaggagttcattttggccacgcaagtgagggaaaacaattcttaattgttggtacaaaaaaaaaagcagcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 8056 - DNA, 1029 bp, Glycine max
  Peptide Sequence Number=SeqID_99741
atggttagaaccaaaggtttaggtcatgctttaggcagagttataagaagagccatagggagagaagataattgtgattcagatgaagctccccaacagcgaaggcctacaacattcgcacgtaggcaacgggaagttgccgctgttgctaaggatgctcctcatgtagatgacggagttgaagaggtcttcgaacaacataaagaagcagttgttgatgaccagggttatccaggcgggccgcgtgacacatcagttttgactgcctatgctaatcatgttgcaatccttgtttggaatggagagaaattcaggaggcatgctgttgagattgaagggttagtcgctgccacaggattaagtcttttggacactggcgatcgggaacttatatcagcttttgtggagagctatgagactcttcatgtcgacgaagcggtgttgatgttagtggagttacttgaagtcaatggagatgaagccagagctgagacagtacagtgtcatggggcatattgcatgcatatggtgtttttggacgcctttcgagaccttagtcagagtggaagctacgcatggggagccactgccctagtgcatatgtacgatagtttgaatgatgcttgtaagagcgacaacagacaacttgctggatatatcacactattccagatgaagacaatggtgaaagttcaccctgtgcctgccgttggacctctacgaaggcattaccagcgtcgacgcatcggaaatctcgaggatccacccaaacatccacctatcgtgcaagatgagacatatgtggaaccaaatatgcctcagtacccgccacactctctcacttcactcagcagattttcagaagctttttcctcatctcccacgttgcttttcttctccctttctcctccaccattgttgcccattaaagctccaaactttgctcatcacttctactccaaattgcaaaaggaagccattttcgaagtcgtgaagcgcacctctacgttgtgggacttcgaatttcag

SEQ ID NO: 8057 - DNA, 437 bp, Glycine max
  Peptide Sequence Number=SeqID_99742
gagagaaatctgtttgttcatctcagaaagtcagttataatcaagagactgattgtctcttggattgtgagaattgtaatttagagacgggttgtctcttggagaatattgaacacaagggtgagagatcccaaggtgtgttcaaagtctgtaaaggatttacagagatagtggaaaatctcaagtgggttgctagaggactggacgggttggacggcaagcaacggtggctcgtgatgccaccagtggttgtgggtggtggagaagaaggtgtttggatctcacttagcgggagtccactttgcgtacgtagcatgacaattcacgctgagcgcaactccccttgcgctaagcgcaacaattctcgctcagcgcaattcactctcgagttggaattgcgcttaattagcgcgcttctcgcgctcttcttgtgctaa

SEQ ID NO: 8058 - DNA, 138 bp, Glycine max
  Peptide Sequence Number=SeqID_99743
atggtgtggtgtctccaatcacctttcttccttctccattccactgccattgatcttcaagaagcaaaggactccattgatgaagaagatccaaggcctacaagctctacatggagctacattagggatgagccttga

SEQ ID NO: 8059 - DNA, 225 bp, Glycine max
  Peptide Sequence Number=SeqID_99744
atggcgcacactacctacttacgtctaaccacaaggctcctcccctgcctgggcctcgggccagtctccaggccacgcaacctcagccctaaactactcgggagtagggcatgcaaaagggacggaaccctgcccctactgattgaggctgaaccggtagagacactcatgtatctgcacctacccacggtggttggtcacctgctggcgaaccaaatgctgtag

SEQ ID NO: 8060 - DNA, 522 bp, Glycine max
  Peptide Sequence Number=SeqID_99745
atgtctaatgctatgatgatggtagcccgtgtgatgttagggcacagatatgagcccaaaatgggcttagggaagaacaacgatggtgtggccagtttggtagaattcaaggaaaaccacaggaggtttgggttaggctataggcccacgcgtgctaatgtaagaaaaagcgccctagaaaggagaagcaagggcatggaccaacaacaaaggccacaagtgaaagaggctcctccatgtcacatcagcaagagcttcgtgagtgcgggctggagatccgacgacgagtcctgtaaaggtattaataccgaggaccctgacgtcaattttgaacgaatagcaagccaagccgaggatggagaagatgaggatgcggggtttcccctggagctagaaaggatggtcactcaggaagaccgagaaatgaagctacaccaaaaagagacggaaatcgtgaacttgggtgttggcgaagaaaggaaagaggtaaaggttggtaggggcatgactacaccggtctga

SEQ ID NO: 8061 - DNA, 276 bp, Glycine max
  Peptide Sequence Number=SeqID_99746
atggcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttaatcccgtgaaccatcgagtctttgaacgcaagttgcgcccgaagccattaggccgagggcacgcctgcctgggtgtcacacatcgtttccccaacgcaaacatgtaa

SEQ ID NO: 8062 - DNA, 705 bp, Glycine max
  Peptide Sequence Number=SeqID_99747
atgggttccaaaaagagaaagagtattggtacaaggcccacattgcagtatgatacaaggaggttccactcctttgaggcctggacccgatacacagataatgttctaggaagacatatactgcctgagaggaaggtagaaatttaccacactgagcaggacgagtttaaggctgaattggagaggcgtaacttccataaatgcctcaccaatttagttgacaacaacatagatctagctttggtgaaggagttttatgccaatctttacagttccgaaggaccttcaccaaatcaagtcagggtcagaggccacgtggtgaagattgatgcagacagcctcaacacctttctggaaacacctatggtactagctgagggtgaaaccttacccgcatattccagatactgcaagttgcccactgatattagagaaattaaggctatcttatgtatcccaggtcgagggtttgtgttgaatgctgaaggccaccctgggaagattcttaggaaagatttaacaactcttgctcaggtgtggagtgttctcttgtactccaacctggcgcctacttcccacacctcggacctgatagtagatcgagctaggctgatatttggcctagtctctcagatggacatgaatgtgggagctcttatctctggtctgattacatctatggattacatctatggcccagtctaa

SEQ ID NO: 8063 - DNA, 324 bp, Glycine max
  Peptide Sequence Number=SeqID_99748
atggaagaggagcatgcacggcaagtgacactaaaggactactctagtacagctacccttgaggcgctcgaccgtttccacggactactcagaaagacgcctacacatgggtacaacgagctggtgcaattaaaaatcttcataaatggcctgcaaccacagtcaaagcaactccttgactcatctttaggggaaaaaatcaagttgaagacaccagaggaggcagtggagctgatagagaacaaggcggcccgtgatcgcgccatccttcgtgatttagcatacacgccaacaaagaggagccttttggaactcatagcttga

SEQ ID NO: 8064 - DNA, 645 bp, Glycine max
  Peptide Sequence Number=SeqID_99749
atggcaggaatgggaaagttggatcatctagaggaaaggctcagggccattgaaggaggtgaagattatgcctttgctaacctagaagagttgttcctaatacccaaacatggtcattcccaagttcaaggtgccgaactttggcaagtacaaggggactactcgctccaagaaccatctaaagatgatcttcttgagtccattcttggaaggactaatggttccttcattaggcagtgtcagtacaattctgatatggctccggataggatgcaactacaaaaagtgtgcaaaaagggggcacgaatctttcaaagaatactcccaaagatggagagacttggcaactcaaatttggtcttcgccagcaaaaagatcgaagtggatccgaaaagaggcaaatttgatcatcctactaggacgactgagaaaactggggcaaatgaagagggtgagaaagagggagaaacccatgctgtgactaccattcctatatggccaagtttcccaccaacccaacaatgtcattactcagccaataacaaacctcctccttaccccaccacccagttatccacaaaggccatccctaaatcaaccacaaagtctgtctaccgcacttccaatgacgaagaccacctttag

SEQ ID NO: 8065 - DNA, 414 bp, Glycine max
  Peptide Sequence Number=SeqID_99750
atgtggtacagtagagggtacatctacttgggtttgactgagaacaagagagggtacatctcttatggatcagttctagtggagggtacatccactagggtttcaaagagaacaagggagggatgtaccctccaatgtgttaagacaaagaattctcagacgattagtccgttgaatctttgtaaggggaaacaaaagatatctatggtggttagtcctttgaatcttttgacaaaagggagaagggagaatcagacgcttgcttctacaagttccaccttcaatgtctctgccttatctctttttgatgcaaatggagaatctgatttgagggcaaatccttctcaagagggagagaatgatgaggacatgaccaagagcaagggcaaggatccacttgaaggacttggatga

SEQ ID NO: 8066 - DNA, 846 bp, Glycine max
  Peptide Sequence Number=SeqID_99751
atgcgtagtgattgcttagtgcaattctccattctccacccgttttcggagcccatgaatcgcgttttcgttcatgcgtcctccaccttcgagtttggagccatgcatagtgattgcttagtgcaattctccattctccacccgttttcggagcccatgaattgcgttttcgttcatgcgtcctccaccttcgagtttggagctatgcgtagtgattgcttagtgcaattctccattctcaatctttttcggagccccatgaattgcgttttcattcatgcgtcctccaccttcgagtttggagccatgcgtagtgatttcttagtgcaattctccattctcaaccctttttcggagcccatgaattgcgttttcgttcatgcgtcctccaccttcgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaacctttttcggagccccatgaattgcgttttcgttcatgcgtcctccaccttcgagtttggagtcatgcgtagtgattgcttagtgcaattctccattctcaacctttttcggagtttttcggagacccatgaattgtcgttttcgttcatgcgtcctccaccttcgagtttggagccatgcgtagtgattgcttag

SEQ ID NO: 8067 - DNA, 390 bp, Glycine max
  Peptide Sequence Number=SeqID_99752
atgtggctaccacccaaagccttggaacgagaaaccaagagggcttgtagggaagagcacggccggaaaaagttccgaggggctctgtggggcagcaacagcgagcttaagctccagagagaggaaagggaccaatcacgagtagacagtttgatcttgaaagatgagttgaaggtttgctcaaggtccaaaagaaagttgtctcagcgattatgcgagacagagaccaacatgttagctatcatcagcaagtaccaagaagaactaaatctagccatggcccacgagcatagagtggcggacgagtatgcccgagtttacgcgaaaaaggaggctagaggaagggtgatcgacttgttacaccaagagacaacaatgtggatggactga

SEQ ID NO: 8068 - DNA, 147 bp, Glycine max
  Peptide Sequence Number=SeqID_99753
atgaacaaaatgcaccaatggaaagctaagaattcaaggattaaatacttacttgttggagggttgctcgcccaggcgagctcagcttgcccaggcgagctaacctacaatttgttttttaggggaaacataaccatggccccctaa

SEQ ID NO: 8069 - DNA, 382 bp, Glycine max
  Peptide Sequence Number=SeqID_99754
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatgcctgcacctgatttcacctatgaaagcttgtgcatccaataccctgatgaggatgtcccatatgttcttaaaactggactgattcatttgcttccaaagtttcatggccttgcag

SEQ ID NO: 8070 - DNA, 870 bp, Glycine max
  Peptide Sequence Number=SeqID_99755
atgcaaactagaaatgctttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcgggtatggtaaaaaaaatcatacgaaaagaaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 8071 - DNA, 681 bp, Glycine max
  Peptide Sequence Number=SeqID_99756
atggcgggccgtatcgcgattcagggtacttgtctgaaggcagcaacaggcgccgctcggaatcatcctccagaaaggtcacgggatccctcccgcaagccgtcgtcacggaatcgcatagccacagcttggaaccatccagcaactcagtcgaattctccaagcggttgcgattctgaatgctggctgcggcgatgtctgcgttgcgctcggcttcgatggtggccgattcgttgctcaacaatgccgcctgtcccgtcgccttgccggcgccgtccagcgcgccgccgatccgcaggtcgcctgccgcatagatcagcgcatgctcgcggttggtcaacgtccccacgcccagccgccgtcgatcaggccagcgttggccagcaggccgccgatgaccagttcgttgttgcgcacggcgatcaattcaccgcccgcgcggttggtgagcgtatccgccgttatcttcaggtcctggcccgagtggatcttgccatcgttgtccaggttgtcggtcacgagttccagcgatgttcccgcggtcagcgcgccgcccgtgttggccaggcgggtgaaagccagcgtggccttggcatcggacgacacgttgccacgcgcgttcctcgagcgtgccggtggtcagcgccaggtcctgtccggcgcccgatgcggccggcctga

SEQ ID NO: 8072 - DNA, 201 bp, Glycine max
  Peptide Sequence Number=SeqID_99757
atggagcgtacatcctttgtgctacagctagagcgtacatctacttgggttgtgatactgagaacaagagagggtacatctcttgtggatcagttcaagtggagcatacatccacttggtggttcaaagagaacaagggagggtttttacaacgttattggaaatctcaagaaccggtggttgcttggggactggatgtag

SEQ ID NO: 8073 - DNA, 348 bp, Glycine max
  Peptide Sequence Number=SeqID_99758
atggaagtgagggacaaggttgaactccttccatatggggacctagatgagctagtccaactttgtataagagtggagcaacaacttaaaagaaagccttcttcaaaatcttatggctttcactcttatccaaggaaggaccaagcccatggaattttgggagctgcaccttcaaaacccaaggaagataaggttcacattgcctctcaatgccccacaaaggaaaccatgatcatgaggggtgaagacatttatactagtgaagaggacactacttcttgcccttcctctagtggaagtgaagatgaagtaagtgtagaagcaagcttcatgatgaatcaagattga

SEQ ID NO: 8074 - DNA, 123 bp, Glycine max
  Peptide Sequence Number=SeqID_99759
atggtgagccaagcgcgcctctgtggactttctggcctgtattttgaccgcattaaaatggtttcaagattaagtgaatctcagttgaatgccttatatgcgtcagtcttatctgttatttga

SEQ ID NO: 8075 - DNA, 1185 bp, Glycine max
  Peptide Sequence Number=SeqID_99760
atggtttcaagttgtatagcttctcctattggaggagagtttctgatagatttcttgatgaaaagtttggaaggaaaaggtatcacatattacacggtgaaccttgccattggaaatcccccaaaggtttatgaacttgacattgacataggtagtgatctcacttggattcagtgtgatgcatcatgcaaaggttgcaccctacctcgcaatcgacaatacaaaccacatggcaaccttgtgaaatgtgtggatcccttgtgtggtgcaatccaatcagcaccaagccctccccgtgttaacccaaatgtgcaatgtgactatcagtccgtgatattatcccgcttaaactcactaacaaatttatcacgttctatgctcaccttcgggtgtggatataatcaaatgcatgatggtcataatccaccaccttcaacagtaggggttcttggccttggaaatggcaaggcaagcattttgtctcagcttcactctcttggcctaattcgcaatgtgctaggccactacttaagtgggagaggaggaggctttttattctttggagatcggctcattccccaatctggagtcactgtgatacctttgttatattctccaagggtacatgatgaattcagttataacagtggtatatttcaatggaaggtttctggaaaatatgttgctttgcaaatttgtgatgacaaagatgttgaaaccatgctcgaaagttttcaacaacaaaatcaaatgtcagttctggaattgtacatagaaaaggatgtgactggtggttctatgtttcattctgcaaattctcttacatcatgcggaaataatttatctaataatgaggcgcaaccgccaacaaatgtgagcaacttacatggtgatgaagatgatgatgatgattattatcttctgtctaactcatacgttgaagagtctttagacaaagatgatagtgttgacggtatatctgatacagacgatgaagtcgccgacatgattcaaccagtgtacaaggaattgaaaatccattttggaatgatgctttgcattataacaatatctattggagtcatcctgatgaggaagacatttgtggtttggagatgccatcgagttttaatgttggacaagaattatatgttggcatggattttgatactaaagatgcggtaa

SEQ ID NO: 8076 - DNA, 516 bp, Glycine max
  Peptide Sequence Number=SeqID_99761
atgcctaaatatgaccctaaaattgtcatggaattttatgcaaatgcttggcctattgaggaaggtgttatggataagcgctccaaagtaaaacagccagagcaagatcaacaacatcagccagcagcagatgcaccactaccacctccacatcagccaccatgcttggagtccatctcaacccacttacagagggtggagcaccatatgcacacatacatgcgtcatttggctgaccagcaggcaacaaatcataggggacaaatgcagttgaatgacaacttctaccattacacactgcaccagcatcaccaggaccctaacccttacccttggcctattctcgagcagtttagagccactattgcaaggcctggtgtcacaacgtgcccttcgcgggcgagcgaaggcgaggctcacgggtgcgctttccaaaggaggaaagatgcgcggagtcgccaccaacgtttatttgtggaaaacgtcgggaaaaccgaaggaaaccggtcaaaatga

SEQ ID NO: 8077 - DNA, 273 bp, Glycine max
  Peptide Sequence Number=SeqID_99762
atgtcgatctccccctacggaaggatcgtgcccacaagacacccagtggacccggagaagtctaataggtccctgaggtttccagctttggttacaggcctctgtcaatcttacagggtgcccgtcaccccagcaaggtcatgccatcgtgacatagggatcgcacccgcaagacccccagtggacccggagaagtccaacagggtcttggggttttcagctctgattacaagcctttgtcagttctacggagtgttcgtcgcccccaacaag

SEQ ID NO: 8078 - DNA, 153 bp, Glycine max
  Peptide Sequence Number=SeqID_99763
atggaaggctatcatcggatgggaatgcatgatgcaatcctccctaggaagggaccaatcactagaaccatgagcaagaggctccaagaagattgggctagagctgctgaagaaggccctagggttctcatgaaccatagggtagatttctga

SEQ ID NO: 8079 - DNA, 201 bp, Glycine max
  Peptide Sequence Number=SeqID_99764
atggatccgaggttggagattggattttcataccgaatgatcaaaaggttatgctatatccgttacgaagacaccgttggtggcgtgaaatctgagaacgacgcaagaagagggaagctggtaatacgtaagactaagacattgaatctgaggattgcgagtcaaacacgtgtgcctcttgacatcaaatttgtgtcctga

SEQ ID NO: 8080 - DNA, 570 bp, Glycine max
  Peptide Sequence Number=SeqID_99765
atgccactgaaagactctactgagacaaagacgggctgtcaagaacgtagaggaggtaggatgggcagttggtcagatctagtatggatcgtacatggacggaaaaagaatccatggaccgaccccatcgtctcaccccgtaggactacgagatcaccccaaggacgccttcggcatccagggtcgcggaccgaccatagaaccctgttcaaaaagcggaacgcattagctatccgctctcaggttggacaaatcagtcggggcctgagaggcggtggtttaccctgtggcggatgtcagcggttcgagtccgcttatctccaactcgtgaacttagtcgatacaaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagtttga

SEQ ID NO: 8081 - DNA, 288 bp, Glycine max
  Peptide Sequence Number=SeqID_99766
atgtctcttgctaccttatttggaaagttacaggaacatgaaatggaattgaagagattgaatcaacatgaggagaatgataagaagaaaaaaggaattgctcttaaagcttcatcttcaatgcaagaagaaagtgataaggaggattcaattgaaatagacgaagatgatgatcttagtatttttaaaagaatagagaaatctgaaaagaaagttgttaacgaaaagaaggaaaagaaggcctacattacatgggatgacaatgatatggactcatctgaagattaa

SEQ ID NO: 8082 - DNA, 189 bp, Glycine max
  Peptide Sequence Number=SeqID_99767
atggggcacagcggaactgcagatggtggtcatcctgcccaaggaatacctagttgtctgtacagtgctttaaaaggtcttgatgatgctccacaatctaaatcaaaggttggtggatttgtaatagacaaaaaggaagcactgagtgcggctattatgtcatgcactggatgtccaccatcatattag

SEQ ID NO: 8083 - DNA, 489 bp, Glycine max
  Peptide Sequence Number=SeqID_99768
atgataaacatccaaaatctcatttatggttatgggggatttcatcaacatactctccttccccggtggacgcattgtttttcactcaaaaaagcatatgctgctctaatcagttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgctttttgttaccatgactcaaaagctggtagcttgcggagacaccttacggttatcagcgcctcgtcattcagtgaccccaagtgtgattgatgagcagaggccagtgtggtcatttgcaccctttccggagatgtcaacatcttccggtcgagactttttcaagtctcacaagttatctagactacgtagtctgagttcctcattggaggatacgtag

SEQ ID NO: 8084 - DNA, 219 bp, Glycine max
  Peptide Sequence Number=SeqID_99769
atggcgagggcatgtagccctctgaaggcgaggacgtttagtcctctgatggggaggacatgtagtcctctgaaggtgagggtacgctacgctctgaagaaaacacaaattgattgtccttttgaaagaggtgataattcatgcaaccttatcctatcttttgcaaatctcttcgggaactcccttagagtgtatgttctatttgatttagtcacttga

SEQ ID NO: 8085 - DNA, 1236 bp, Glycine max
  Peptide Sequence Number=SeqID_99770
atggaacttcaacggctaaatcaaaatgaagaaaccaacaacaggaaacgaagcattgcactaaaagcctcctcatcaatgcaagatgaaaatgaagatgaagaatcagaagatgaagaagacttctcactctttgtgaagaagtttcacaaatttgtcaagaatagaagaatcgagaggcgtcaaattttcaaccatggaaaaagattccaagaaggttctccaactcttagatgctacaagtgcaatcaacttggtcacatcaaagcaaattgcccctcaaatgagcaatggcctgagaagagtgataagaaaagccatgaagaaagaaggaccaagaaggcttacatcgcttgggatgacaatgattcattcgaaggatctgaaaaggaggaaatcaatcttctaacaaaagattataatccgctaagacgcgatttttgcaacaacgcgaccctaaaatccttaaacttcataactcgatttctccctcaattcttgaccaaatcacgtctcacaaagcccaaaattcatcatttttcattctctttcatctccactgatcaaaacttccaaaaactccctcaaagggcagaactatcaaagaagcgaaagggtgtttcaacttcatccacagtcatcggaactcgaagccacggagcatctaaagcacagacaacacaaatttctccctccatatcatctcctacgttgttttccttggatgaacaacatatccggtgcaattcccttttctcttctcattccattatcgaccctaagtttgtagacttagctttctttgatgatgaagtgtttgattgttttcaagcatttcaaaattctggattaattcaatttatttccatgaaacttcctttttatcctaaattagttagagccttttattctaacttagaaattcaagaagattccttgattttcgaggtatatgggattaagatggtcatagaccagtcctttttctttaaactcacccagttatccagtgatggtgtaccatttgaagcggatatgaccaaaaggcttcttgctggatcattggcattcgaatgccacatcatgctctacctgattgtgcgcatcctacttcctagatcatccaaccttgcacaagtttctgaggaagatttgataattatgtgggttttcttaaccggttgtcaaatcgattgggcccatcttgtgagatatcgcatgcataaggcattgtga

SEQ ID NO: 8086 - DNA, 873 bp, Glycine max
  Peptide Sequence Number=SeqID_99771
atgtctggcagttattcaatctggaaatcttcccgtcgaatgttggcgcgcggcgttgctgtagcgcttgtgactgcaggtcttatcctgcctcaggctgcttatgcatgcaccagtttcattcttccgacaaaagacggcagtttcgtttacgggcgcacgatggagttgggttttaatatcgattccaaaatgatcatgatcccgcgcaacttcaaaatgacttcgcagctttcggccgataccgcagggaagacgtggaatgccaagtatgcggctgtaggcatgaacgcctttggcctcccggcactgatcgatggcatgaacgaaaaaggtcttgcggccggaaaacagcctcgcccatgggatttcctgagctgggcgctgggcaatttctcgacagtggcagaagtgaaagctgcgctcgaaacggtagccgtcgtgggcgtcaagcagtctgatatgggcttcgtcccaccggtccattacacgctgcacgacacaaccggcgcgtcgatagtgattgaaccggtcgatggcaagctgaaggtctatgataatccgctaagtgtcttgaccaacgcgcctacattcgactggcatatgacaaatctgcgcaactacgtgaatctgtcgccaaagaatgtcaaggcgctgaaaatcaacaatgaaaccatcaagcagttgggcgagggatctggcatgctcggcgtaccgggcgatatgacgccaccgtcgcgctttgttcgtgccagcgccaatcttctatcggctcgcagcgtaggcaagcggcatcgagagcgtgcgcctggcggaacacattttgaacagtttcgatatcccgatcggccttgttcagggcgaagcgggtga

SEQ ID NO: 8087 - DNA, 544 bp, Glycine max
  Peptide Sequence Number=SeqID_99772
gatcccgccacctaccaggcaccctctagacccagataagtctaacagggccctggggtttccagcattgatcacgggtctctgccagtcatttggggttcccgtcgcacctagtaaggtgattcgaccaccgatcacccgggccttcattgagaagtattgcacgcctagacaggcgcagggtgatgcaccacaggccgtagacgcgccgccaccacctcatcaggctgacccagctgggtcatttgacacagagcggtatttacgacactcggttcgccagcaggcagccaaccacaggaagcaggtgcaggtccatgagtgtctctaccagctcagcctcagtctgcagagccagggttttgctccttttgcgtgccctactccagatcagttcagggcaaaggtcgcatggcccggagattggcccgaggcccaggcaggggaggtgcccgcagaggctcccggtgacacgaaggaggcccgcatggatgaggagatgacagatttactcgatttcttgggagggagcagagccacatga

SEQ ID NO: 8088 - DNA, 282 bp, Glycine max
  Peptide Sequence Number=SeqID_99773
atggctaaaccaagcagccccgcaaacttggcatcagccatcatttgtttctttgcctcaaagaagttcccccatagactaaaagcatcaccgggaaaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 8089 - DNA, 93 bp, Glycine max
  Peptide Sequence Number=SeqID_99774
atgtctgagcgggttcctcttgagatgactggaattttaaatctggaatgtgcagttctgcctccaggtaagctaatggagaaatatatctga

SEQ ID NO: 8090 - DNA, 627 bp, Glycine max
  Peptide Sequence Number=SeqID_99775
atgacgacgagtttcaaaacagaaccgccttcctattctgtcttttataatactaaccctagcttgatgccgcacctcaacttctctcttccacctcgcatatcaacaatcggcctcttctcctcaccttcaccttcgtttccccttcttcccttcgtcactcctctccttcttcctccctctcccccccaagctcccttcctccttcgcctccgcctccaccgctccctctcctttcccttcaaacgaatgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcacatgttgatgctaaagtagataacatggcgaggtgtttcagaaccaaccagaggatactggtgagaaaggggtattgtcagcagcggggagttgccaaaaagatgaagctaaaatttactaaagaatggattgcatatcttagattgcctcttccaattgatgtttacaaagagctgaagcattatattctgaaacatggtgcgaatgccatgtaa

SEQ ID NO: 8091 - DNA, 177 bp, Glycine max
  Peptide Sequence Number=SeqID_99776
atggaaagcaagaaagagaacaggagatcttcggaccagtcgctctcgactggcgatatcccgccccacataaacaaagaggaaaagactgaaacacccagcttcccctccaaatacaccaccctcgagaaaatcctattgatccgtgatcgtgcgtgtgatcttttggttcgatag

SEQ ID NO: 8092 - DNA, 307 bp, Glycine max
  Peptide Sequence Number=SeqID_99777
tgacatccttggccagagtggatttgattgggatggcactaagcacatgatcatagttgaaaatgaaaatgcttggaatgaatattgcactatagagtcaccagtcatggagctgaaactgctatggatgtttgatgaagcgatgagtagagaaacaaatgaagtggaattcatggggttaggtgctactgccatagatttagaagaaccaagctctaatacaaaaggaaaaagacaaggttcgacttcttctggtggcacacatcctcacaggacaagagaaagatgggagaaaaagaaggaatag

SEQ ID NO: 8093 - DNA, 327 bp, Glycine max
  Peptide Sequence Number=SeqID_99778
atgtcaggatttacacgtgattctcctcaaatttcagccagcccgcatcaattagaccttgcaccttacgcttcaggcccctacaatgctcaatggaatgccccagggcttctccatgacaagcacacgttgcgttcgagtcgtattcttggagaaatggaggttgatgaaccttggttggggttatggctaccattgaattatcaaatagatatgggagcaagctttctcgctgcaaaattcatttcttggttggtgtttttggtttgtgctaaaggtggtgttcgtcattgggagtgcggtagacagactttgtggttgttttag

SEQ ID NO: 8094 - DNA, 228 bp, Glycine max
  Peptide Sequence Number=SeqID_99779
atggccggtgtcggtcgctatatggccccgactgatatcccttcagccgacattgcgcaatttcttttacaaacgctggccggaaatgtttttttacggtcggctaggtttttccgtgcggcctcaaccgaggttgtgtttcgaccgacacgggcatgttctcatttaatcggccaagaaaacgttagcccaccccggcagaaaaaaaacatcattcacgaaaattga

SEQ ID NO: 8095 - DNA, 117 bp, Glycine max
  Peptide Sequence Number=SeqID_99780
atggctaggtataggttccaagaagtgtatcatagtaaggttgttgaaggcttttcaagattaaaattcaagacaatacttcaagattacaagtcacaacatcaagatgatcactag

SEQ ID NO: 8096 - DNA, 135 bp, Glycine max
  Peptide Sequence Number=SeqID_99781
atggaaggtaaaggaaatttaagcaagttagacggtttcctatgtgaagacttggatgaccctttggaggggttggacctgaatcaggaaggtgagaccttaacagattcttctgagtctaggtctttggggtaa

SEQ ID NO: 8097 - DNA, 84 bp, Glycine max
  Peptide Sequence Number=SeqID_99782
atgaagagcctgacaatccacatggctcttaaaaagtggctgatgaagggtattcaagagaccatgttctctcctttctcttaa

SEQ ID NO: 8098 - DNA, 814 bp, Glycine max
  Peptide Sequence Number=SeqID_99783
ggtggacccttgggtactagtaccctctccttcagaggactgcacgtcctcaccttcagaggattgcacgtcctcacctctagaggactgcacgtcctcgccttcagaggactacacgtcctcgccatcagaggactacacgtcctcaccttcagagggctgcacgccctcgcctttagaggactacacgtcctcaccttcagaggagtacacgtcctcgccttcaaagggtcatggctacacgccctcgcccttagagggcgacacgccctcacctttacaggactacacgtcctcgccatcataggactacacttcctcgccttcaaaaggcaacacgtcttgaactttagagtttctgggccactccctgatattcgagggcgaccaactgtgcatgcacaaccagagagggaggctatcacgcagctactatgcatatcggggcaagatttcacccgtgccgctgcaaagagacaacgaccgcaatgccgatctccccctgcggatgtatcagttggtctgtgtcgtcccgacatagggatcgtgcccgtaacacacccagtggacccggagaagtccaacaaggtcttggggtttccagctctgattatgggcttctgtcagttctacggagtgcctgtcacccccgacaaggtcatcaggccccctactaatcaagctttcatcaagaagtactgtgcccccaggcaggtgcagggcgaaacaccacaacagcctggggatggctggcagcgggcaacaaatgcaccgccaccacctctagagtttacctcagctcatccacaaaaag

SEQ ID NO: 8099 - DNA, 339 bp, Glycine max
  Peptide Sequence Number=SeqID_99784
tctttggctcatgagcaaaagctagtagaagacttcgcacaagcatacgccgagaaggaggcaagagggagggtgattgatgcattgcatcaagaagcgaccatgtgcatggatgggttcgccttgaccttaaatggaagtcaagacctcccacgactactagccaaagcaagggccatggtcgaaggagtgcaagaacagatgaaggccgacatgtcggctttaaaagatcagatggcttctatgatggaagccatgctaaaaattcaaaaatcaatagaagacaatgctacggtggctgcttccaacaaaactacggaagcggaactgatgctatag

SEQ ID NO: 8100 - DNA, 210 bp, Glycine max
  Peptide Sequence Number=SeqID_99785
atgatgacaaaggtgatgacaaaaagctcaaagatcaatcaaagaacaactcaaaacaattcaagagttcaagataagaatcaagaagaattcaagactcaagacgaaagtttagagtcaagaatcaagattcaaggttcaagatctcaagaatcaagatcaagattcaagattcaagactcaagattcaagaatcaagagaaggcttaa

SEQ ID NO: 8101 - DNA, 621 bp, Glycine max
  Peptide Sequence Number=SeqID_99786
gcggaatttgaaatcctagaggcttctgacagtaggatgaaaaggaagttacttcagaccgtgggcgagagatggaggcagtttaaatcagacctcacgaggaaatgggtccttgcagttgataaggacagtgtggaggacactaagctcctggctgagaagacaaagaagaagctggaggaagctgcacagtcaggaagcgttgatggcatcatcgaccctccatccccggtcagatgccacgtgaagtggaagatggcccgcacgaagaaaacaggggagatgacgactgaggccgcaaaggaaatcaatgcgaagatcgattcctttgaggagcaggcgacacagggatccttcgtcccccatggacgtcaggatgttctcaccgctgctattggacgtccagagcaccctggacgtgttcgcgctgctggagccggtgtcaccatcaagcaatactttggattggctccacaaacgtcccgcagctcttcctccctgcctcctgaagaattgcagcagctgacccaacaaatcagggaccaactagaggagtccatcacagaaagagtgacgcggcagctcatggcatccttcagccagatgcagtcccagatttag

SEQ ID NO: 8102 - DNA, 336 bp, Glycine max
  Peptide Sequence Number=SeqID_99787
atggttttaaataatgttggtttcaagcaagtatgggacttgaaagtgacaatttactcaactaatgatttgaaaatgagaatttggctatctataattgataaactgccttcttcttggaaagacttcaagcataccttgaaacataagaaggaagagttgactctggttcaactcggtagtcatttcatgattgaggagtcgctgagggctcaggaaattgacaaagtcaatgataaaaccatagcaggttcctcttccgttaatatggtagaggaaagtgaacagttaagcaaattcaatgctaaaggtacaacgaaaatttcaaggaaataa

SEQ ID NO: 8103 - DNA, 584 bp, Glycine max
  Peptide Sequence Number=SeqID_99788
acaaagaaggtacaagcctcaaaacaaagctgagaaagcccaaatagccaaagaaaagttcaagtcaacagctattaggatccgaaaagagaacgccaaactgagagacgtcaacatagccaccaccaaggccttggagcaagagaccaagagggcccacaaggaagaacatggctggaacaacgaacttaagctccgaagagaggaaagggaccaatcgcgagtagatggcatgattctgaaggatgaattgaagacttgtctaaggtcaaagaggagtttgtctcagtggttatgcgagaccgaaacaaacatgttgcccatcatcagcaagtacaaagaagaattaaatttggccaccgcccacgagcacaaagtggcggacgaatatgcccgagtgtacgcggaaaaggaggctagaggaagggtgattgacttattacatcaagaagcgacaatgtggatggatcggtttgctcttactttgaacgggagtcaagaacttccccgattactagcaaaggccaaagcaatggcagacgcatactccgcccatgaggaaatccatgggctcctcagctatt

SEQ ID NO: 8104 - DNA, 183 bp, Glycine max
  Peptide Sequence Number=SeqID_99789
atgaaagcaaaatgcaaccaaaggtggcttgggggagcaaaaaccgggttgctcgcccaagtgagctcagctcgcccagggttgccttgcagcgccgttttccgcttgtccagcgccgaaaagggacgacgatctgtcggtcgtgaccatatcctctattttcatccgtccctaagtacctga

SEQ ID NO: 8105 - DNA, 267 bp, Glycine max
  Peptide Sequence Number=SeqID_99790
atggttaaagttgtctctagaatatgtccattggatttaataatgaaatatatgcaatttcagttgagcttagctcatcagtgggctaagcacccatccaccgctaagcgcaacttcagcgtgcttagcgtgacagaaaaatctggtagagcatcaacatcaaggtcgtgcgctaagcacaagatcagtgcgctaagcgcagccgttgtctttagccaggctcaacgcacgactggcgctaagctcaaatccacttactcgttctaa

SEQ ID NO: 8106 - DNA, 519 bp, Glycine max
  Peptide Sequence Number=SeqID_99791
gatctaacagtttctatccgaggggctaggagggtgagggcaaggccagctgagcttccttctacttttgcagctcctactccagcatctacttcaacagccccttctatcccaattcagatagattctcagcgctttgaagccatgcttcagagcattcatcagggacagatcattttactacaaagtttacagatgatggcacctctagactctattccttcagtacctcagcatgtggaggatgagtcatctgaggccaccatcccagagccatttgttataagagaagaggcagaggagacacaggggagacaagtaactgctgccacacctgagcgatcccttgaggctactttagagccttctgcacaaggggaggatataccttcacctcagcatgcagcagacccctccactcctcttctagagatgccagaggacccgactacatcagtcctggctatggacacttctcctctagctactccagtattgcatctaatagatgaagaggat

SEQ ID NO: 8107 - DNA, 376 bp, Glycine max
  Peptide Sequence Number=SeqID_99792
caccctcttccttcaacacttgaacgtccctcttgattctaaaccttatgttccaattaagagatcctttctaataggtgctgctatcattgcatcctttggttatcaaaaagagcatgatggctcttgggtgaaaaagagtgctcgacctgttgatgaagaaggacatggtggagaagattcctctcttcttcaaaagattttggataggttcgatggtcttcaaacctttgttgatgaaaggtttgatactttggagttacaagtggacatgcgctttaatgagatggagtcaagaatcaccaaggttgaagaagatgtttcttatattcgtacgagctttgatctaccaccaccgccgcgaccatcatcttag

SEQ ID NO: 8108 - DNA, 606 bp, Glycine max
  Peptide Sequence Number=SeqID_99793
atgaggaaaaggattcctccaagaagattgttaagaaggaaaatcattttgcaacaaaaaggtgatattaaaagagcacttcttcttaaacaatctttctaccttctcctatcaagggaaacatcccttagcaccgccatacctcttgagcttgaggttattcctcaagtcaaggagttgttggatgagggttttgttcgcaagagcttaaatccttgtgctttgttggtgcctaaaataggtattattaggcaccaaatccctatgataggtggtatgatgaatatgttgagtggtgcaacactcttttgtaaaatcactcatgcatccaacatcttcatggtttgtgtacatagggactcattaggtagtgatcaagggcttcccatggaccctaagagaataaaggtcattcttgagtggcctactccaccaagtgttgagggaagaagcccagagtttcaagaacctctagatttgaggtcaaatccttttcaagggggatggaatgatgcaatcctccccccccccccccaagggcattggatagaagactccaagaagattgggccaaagatgcaagagaaggtcttagggttctcatga

SEQ ID NO: 8109 - DNA, 909 bp, Glycine max
  Peptide Sequence Number=SeqID_99794
atggagcgttatgccccgaatgcgaaagacctggcggtccgcgacgtgttggcgcgttccatcatgatcgaaatccgtgaaggccgcggctgtgatggcccatggggtcctcacgcgaagctgaaactcgaccacctgggtaaagaggtgctggaatcccgtctgccgggcatcctggaactgtcgcgcaccttcgcgcacgtcgacccggtgaaagagccgatccctgtcatcccaacctgccactacatgatgggcggtattccgaccaaagtgaccggtcaggcgctgaccgtaaacgagcagggcgaagatgtggttatccctggcctgttcgcagtgggcgaaatcgcctgcgtatcggtacacggtgctaaccgtctgggcggcaactccctgctggacctggtggtgtttggtcgtgcggtgggtctgcatctgcaggaatccattgccgagcagggtgcgctgcgtgatgcgaccgacgacgaaatcgatgctctcttgagcgcctcaaccgctggaacggcaaccgagtgcatgcagcacaacttctcggtattccgcgaaggcgacgcgatggccaaaggtcttgagcagctgaaagcgatccgcgagcgtctcaaaaacgcccgtctggatgacacctccagcgagttcaacacccagcgcgtagagtgtctggagctggataacctgatggaaaccgcgttcgcgaccgcgatggcggcaaacttccgtaccgaaagccgtggcgcccatagccgcttcgacttcccggagcgtgacgatgaaaactggctgtgccattccctgtatctgccagagtcggaatccatgacgcgtcgtagcgtcaatatggaaccgaaactgcgtccggcgttcccgccgaagattcgtacttactaa

SEQ ID NO: 8110 - DNA, 156 bp, Glycine max
  Peptide Sequence Number=SeqID_99795
atgtcaaattctgattgcagaacctaccaccgagcgatccgtcagataccaaccaagtggggtagttcaacatgtactgccttaaacagtgggttgcccacaccagggcacaacatgtcttttagagcaaagagtagttcatttcacatgccgtga

SEQ ID NO: 8111 - DNA, 577 bp, Glycine max
  Peptide Sequence Number=SeqID_99796
agggttgtacgccctcaccttcagaggactacacgtcctcgccttcagagggtcatgtaccttcaccttcagaggactacacgtcctcaccttcagaggactgcacgtcatcgcctttagaggactacacgtcctcgccatcagagggctgcacaccctcaccttcagaggactgcatgtcctcacctttagaggactacacgtcctcgccatcagagggctgcacgccctcacctttagaggactacacgccctcgcctttgtagggctacacaccctcacctttagaggacttcacgtcctcaccttcagagggttacacaccctcatctttagaggactatacgtcctccccttgagaggactacacgtcctcgcctttaggggacctcacgttctcgccatcagagggctgcatgccctcgccttcagaggactacacatccttgccatcagagagatgcacgttctcgccttcaaagggcaatatgtcctcgactctagagggctgcatgcctacgcctttagagggctacgcgtccccaccttaagagaatttaaggtcatctgcccttaa

SEQ ID NO: 8112 - DNA, 192 bp, Glycine max
  Peptide Sequence Number=SeqID_99797
atgacgaagggggggacgttttttattcaaaaacttccccccctcattcaaaaaagaaggctcacgggactcacggattttgcagcccttaggtcaccattttttgcgtttttgattccgttttgctctattattcgtctccaacaaggacagcatgaaggatttaaaatgagtgcccgaatgcaattctag

SEQ ID NO: 8113 - DNA, 294 bp, Glycine max
  Peptide Sequence Number=SeqID_99798
atgggagattcagctcaagacaaacagaaatgtgcagaatccctgacagctgttgcaacgtgtctgccatatttgggtgctgacgcgaaagcacccacagcagattgttgcagtggtctcacacaagccatgaagatcaacaagaagtgtgtctgccttattctcaaagacagggatgatcctgaccttggcttaaagattaacatcacaattgctgttggtctcccttctctttgcaaaacacctgataatctctgttactcgttggcaagtgtaccaaatcgtcacaagtag

SEQ ID NO: 8114 - DNA, 385 bp, Glycine max
  Peptide Sequence Number=SeqID_99799
attcatttccgagggcgcttgggagagatatgaccagaatgttcactcccggaacattcttccggagaggaacatcatattatacatttcggagtatgatgagttatgtcgggagctcgagaggtgtagttggtataaaaccttgaccaggcagcctgatggtcacattgatgtggccttggtcaaggagttttatgccaacctctatgatccagaggataaatcccccaggcaggttcgagtgcaaggaaagcttataaagtttgatgctgagtctctgaacaccttcttagagacccccatggttttggagccaggggagaggtacaccacctaccccaggttcagcagcactcacccagaccctcaggagctcgctgcctga

SEQ ID NO: 8115 - DNA, 115 bp, Glycine max
  Peptide Sequence Number=SeqID_99800
atggcgctcataattggcgattcctatccagttcctccaccacgccaatgggaccctccctccaataagtctatcggatttttgttcaagaatgaaatcttattggaactgtcca

SEQ ID NO: 8116 - DNA, 492 bp, Glycine max
  Peptide Sequence Number=SeqID_99801
atgaaacgacatgagtttgtctgggagccatacacaccaactgtgatggcagcgctgcctcaaatttgtgtggttggaagtgtagtctggttcgcggtggtgccactgatttgttttcatgttgttgagtggcaccaacccgatagggttttacgacaatatggattgcaacaacctattcccgggtgtccttcgcaaccgcagaatctccatggcataacgctcaaaggcaaacaagatgagaattggttccacctgttggccccaatcattagtcagtggaacaatgcagcgcagtttagggtcgacgtttatcctcgacagcagggcctactaggttttaactcggactatatggtgtggtataggcgtaaaacaaagatgtttgtcgacccaaacaatgcaaacacagctgcattggtgtggtataggcgtaaaacaaagatgtttgtcgacccaaacaatgcaaacaccaccatttccatcttgtga

SEQ ID NO: 8117 - DNA, 531 bp, Glycine max
  Peptide Sequence Number=SeqID_99802
atgaaggttaatctcgagtcagcagcctcttctatcccagctcaaatagattctcagcgctatgaagccatgcttcagagcattcatcagggacagatcattttattacagagtttacaggtggtggcgcctccaggatctattccttcagttgagcagttcagggagatggtagcctggcccgggacccaaccttctcttcatagggaagatgaaggtcccacagcccaggtacctcagcatgtggaggatgagtcatctgaggccaccaccctagagccatttgttataggagaggaggcaggtgagacacaggggagacaggtagctactgccactcccgagagatcccttgaggccacttcagagcctcctgcactagtggtggacctaccctcacctcagcatacagtagacccttccactcctatcttagagataccagaggacccaaccacacctttcctagctatggacacttctcctccagctattccagtacttcatctgacagatgaggaggatgtttag

SEQ ID NO: 8118 - DNA, 523 bp, Glycine max
  Peptide Sequence Number=SeqID_99803
atgacacaggaaaacattgatatagaatactcattaaatgacccaacaatagatgatcttgatgaatatgaagtacagacttttctatctgcctcatctgcataccaaaatacaggtggtacttacattgatatcggagatcctgtatgggaatgcccacattgtaaggctatgatgtggatgcatgatatgcttgatgaacaaattatcattgcaatcaaagacatgcttgatcatcacaatcactatgctcaaaggtttcgaatggcaagggacaaattacattctactgcagttccagacctaaagatgaaactcattagtcaaagacaaacagacggaaggttgtataacttaccaactaccactaaagttgttgccttgattgttggtgatgaacactcagctgataaaagagatattataatagaaaaacaatccggacttctgaagagaatacatgaacttcatcctgcatatttgcctttgcaacatccacttttatacccaaaaggagaagatg

SEQ ID NO: 8119 - DNA, 354 bp, Glycine max
  Peptide Sequence Number=SeqID_99804
atgactaattgcctgagatttctttgtcttaacacattggaggctacatcctttgtggtacaagtagagggtacatctactaggattgttataactgagaacaagagagggtacatctcttgtggatcagttcaagtggagggtacatccacttggttgttcaaagagaacaagggaggatacatcccttgtggatctttgcttgtaaaggtttttacaaggttgaaagaaatctcaaggaccgcaggttgcttggggactggatgtaggcatgggttgttgccgaaccagtataaaattcttatgtttgtcttcttcttccatacacttttaatttctgctgtgcacttttaa

SEQ ID NO: 8120 - DNA, 630 bp, Glycine max
  Peptide Sequence Number=SeqID_99805
atggtgtgtcctcgtctacccatttgggatgctgctaacaaaaagggtttcaaggcctccttgtctggctatgatggaagtgaaaatgttgttcaccacgatatcattcaaggggagaatgtaaatcatgaagattttgatgatgtcaagaagaatttgcttgacaaaggggagaatgtgaatcatgcatatcttgatgatctcgaaaagaaatcacttgattgtcatcatcaaaaagggggagaatgtgaatcttttgctaaagctgcggacaacaacattgtatgtaaggtcactattgatcttatagacattggtgtcatggatgagatcccagaagcattcgatataactctagttgacaagggtgaacctaatgctgtcattatctactccacaagctcaggacctacccccttgaactatgcaccccccactgtcatgaccaaagatcaatcttccaacctcaaagttgttcttcttcaaatgaccatgctaggagttgttgttgcacttacactcatgcctacaccaaaatccccaacacttgagcctacaccaccatccgttgaaccaacactatcacctccacctacccaacctctaccaccacctcaagttcaagattga

SEQ ID NO: 8121 - DNA, 318 bp, Glycine max
  Peptide Sequence Number=SeqID_99806
atgaggtcctttaatggttattttccaccatggagatgcagcggaagacaaaggagaagaggtgagaggaggcgccatccactagggaataagccatggaagaaggagcttcaccaccaagataagccttggataagaagcttggaaggatgcttcaatggaggaaaagaaagagggagagaaagagagagaggggagcacgaaattgaaggaataaaagagggagagaagtggaactttgaagtagcttccatgagaagctttcttgagaaaacttccttgagaagcttctttgagaaaacttccttgagaagctag

SEQ ID NO: 8122 - DNA, 420 bp, Glycine max
  Peptide Sequence Number=SeqID_99807
atgacgaacaaggccaaaggaaaaggaaaggagctcgtcagaaaaggttcagccgggaagcgcaagggcgccttcgacgatgacaagaccggtggcggccgcaagagaaacaagcgaggatgtagcatagatcaactgaaggatttgatcaagcaagtaacacctaaagggaatcctccttatgggattcacgaatcccaagttgtaaggcgtttgttttatcgacaacctagtcatttggagtattctgagaaagtcttagaatttgaaattattgagctaaaatgtgacgacgacgtgctaaaggtgctggtagagtccaattactggaaacaatttgtgccaatagaaattttggctctctttagtaaagtggttatagaaaatgaggacgatgtggttacgtccttgcatgattga

SEQ ID NO: 8123 - DNA, 291 bp, Glycine max
  Peptide Sequence Number=SeqID_99808
atggcggaagaaacgctcacagcaagccaatggcgaagacgggaaccaaaatggagaacgaaagccgacgagaacaaaggcctgtggaggagaacaagggaaccaaaatggagaagcaaagcttgcgcgggggaagaacggaagaagaccaatgaagaagacgaagggagggagaagacgaattcttggtgcacagacgaagaagaagcgcggaagaagaaaatttttctgggtgcacctagcaacaccctaaactttgccgagcctaggccccagggtccaaacagctaa

SEQ ID NO: 8124 - DNA, 387 bp, Glycine max
  Peptide Sequence Number=SeqID_99809
atgttgtacaattgtttgatgtgggctatgaaggaaatcgcattccttgaaagagaattctcggttcatagacaggttcttctaggtggtccatcaagtgaccaaactcatgatcttcccaaggcaagctcgatacctggtggtgggtcaatatttaggttttggttgccatcctcatctgcatcacttcatcgccattattcaaacttattttttcctcatatttacttaatggaccaactacttcaacaagtgaactatcctctgcgtattgaggttaagattgttgcggtgaaggcaaaggatctgcaactagggcactctatgatgcatgttgcatgctccctgaagcgtaaggaatatgttgttcgtatccataaaatgtag

SEQ ID NO: 8125 - DNA, 198 bp, Glycine max
  Peptide Sequence Number=SeqID_99810
atgctccaaccatatgggatcagcataggcttaaaggaacactcaaacccggtgacccccaaggcctacactccgaagagtccgtcagggtctctccctcctgattcaggaattaatgaaacattgggcttaatccggattttggttgtggacttgaagagggcaaataaagaagcgcttaccttagttaatttctaa

SEQ ID NO: 8126 - DNA, 2598 bp, Glycine max
  Peptide Sequence Number=SeqID_99811
catgctgatccaagattgtatccaccccaggtgatgttgcttattggaaaacatctattgtttttaatagatagagaaagtgctgaaggaagatgtgttcaagatgctgttaattatctgaatggatacatggtgcatcaaatatgtcatgacaagcaagtgctaaggatgtctcatgccaaggagttcttaactgtggcgcaagagttaggtgcaaagataattgcacaaagatcatcaattgaaaatgctaagatgattattgcacagcctgctccatcggtagtgttaattgaatggattaaaaagcaaaaggaagacccaaagatatcaagtgacttggtggctgcatctttagcttcttttggactactgaataatgaaatccttgattgttcctttggagctcaacacgcaaatgattcacttcatcatactaatgaatcctcttcacataagaatgctgaagatgcagaaacagatgacgttgtaccagattatgagaatgaactattagattgtgttgatgataccgctgaagacattagcataggtgacccttctcaaatatgtccatattgccaagctgctatgtgctatcaagaaaagacgaggaaaaatagaaagcaagctaatcccaaatatagtctttgttgcagcatgggaaagatacaacttccttttctcaagaatcctccaatgcttttgcaacaacttctatgtgatgatgaatcacgcaaaagcagaaattaccaacaatatatcagggcttatagtatgatgtttgcatttagctctcttggggccaagatagatacaaatgggaagaaggatgaaaggatttataatttgcccacagttttagaggtggctgcagttattgttggtgatgcaagtcaacctataaatcgagacataatacttgaaaagcaaagaggaagattacaaagaatcaatgaacttcatccagatattgacacaatcgaattccaaaaaagaggtttgccacatgctcgtatcttgttgtttttggatgctgggagcaagtatccatctcctgtagatattgatcgtatcatatcagctgagataccatattctattgaacaaccacaactctatgagtgtgtcaagaaacatatgatgcatggtccatgtggtcatacaaacaagcagtcaccatgcatgaaagatggaaagtgttctagatatttcccgaaaaatggaaagctgaaattgttgttgaccaagacggctgtcatgtttataaaaggcataatgatggctcacctcaacatagaatggtgcaatcaatcaatatccatcaattatttattcaagtacattaataaaggttatgatcacataaccacagctcttatgcctgtcgaaaatgaagatggaaaaactgaacaaactattcacaagagatcacctattgttgaaaggttgtactttcatttgcctggtgagaattcagtcatatttgaagatggtgatgacattgatgccttgttgtccaagccaaccattaaagagtccataggctatacaattggaagacttaattgggtgcctccaagtactggagaattctattatcttaggatgatgttggttgtggttaaaggaccaacaacttatgaacaaattcgtacagtcaatggtcaattgtattctacatttagagaagcttgctttgctatgggtttcttggttgatgatgaggaatatattgaggctttaagagaagcataccattggggttctagccaattccttagaagattctttgtaacaatgttgttaacaaacaacattgagagaccaaatcatgtatggtctaaaacatgggagtgcctaattaatggtatccttcatcaacaaagaaggataagagacatacctggcgctggtggaatgtttttcctctatgggtatagaggtactgggaagacctttatgtggaagacattagcttttgcattatgttcaaaaagtgatattgtgttaactattgcgtcaagtgggatagccttattgttattaccaaatggcaaaactgcacattcaaaattttctattcctgtgtctacattacaaaactcaacgtgtaatatccaccaaggtataaaacaggctgaactcttaaaggaaaccaaattgattatatgggatgaggctcctatggctcataggtattgttttgaggcattagataagacattgaatgacatcatgtgtatgtgtaattctgacaatgttccatttggtggaaaaattgttgtatttagaggtgatttcaggcaaattcttcttgtcattcctagaggaagtagatcagacatagtgcatgctactataaatgcctcatacttgtgggactattgtactctcttatacatgacttcctatggtggtgagcttgttcttgactcatcttctcctttaagtggtgtctccaattatctttcttgcttctccattccgttgccattgatcttcaagaagaaaatgactccattgttgaagaagatccaaggcctacaagctccacatggagctacatcatgtggtatcaagagcatattcatctag

SEQ ID NO: 8127 - DNA, 264 bp, Glycine max
  Peptide Sequence Number=SeqID_99812
atggcacgcaaaccgagaaaaattcagaaagctttccctcactctcacattgcttttctcttcctcttcctctccattgaagcctccattaaagctccaaactttgctcaccatttctgctccaaattgcaaaaggaagccattttcggagtcgtgaagcgcaccactacgttgtgggactttaaatttcaggtagaaaagtgtgagattttgagggctagagaagctaaatctggggttagtgtaaattggagtctaaagtga

SEQ ID NO: 8128 - DNA, 630 bp, Glycine max
  Peptide Sequence Number=SeqID_99813
atgaaattgcacgaagatagtacaaatggaggtttcaatcccttctccttttccctaacgtttgggaaccctaacagagcaaccggaggaggagctctagagagcaccaaaaacatcacaattgataatggagaacgcttgagggactacatcgaggtaagggatgagtttatcgcaattgaggatgaattgttgttgatggtgaagcttggatccttgagactaaccatgagtgaaatggtggatacagaggccctttacctagtgtcgatggttatcatggtggctaaggccaaatgggcctatagaatggatgagtggttgattccctatatagcgtacccttgcgttgttgcacgtgtggtttgtgcttgcgatgatcctgtatctgatgtatgtggggagcaaatggttaggagtgatgacgatggttgtgagcacgatgtctccaccatagatcttgctttgtgcctgaaatacaaggaacacacaagaaaagaggggactccttttatagacttcagtgaaggtatctgttacaagattagagccttccttgataagatcgttgtctctgtgctgtcaaggttgctatgtggtagcgtggagaggagaaagagaggaaactaa

SEQ ID NO: 8129 - DNA, 522 bp, Glycine max
  Peptide Sequence Number=SeqID_99814
atgggttcgggtatggtgagggcgtgttttgaggtgaaactacgggtggattgcttgtgtggttacggtttgacgcgaaacgatgctttgaaggtgttatggaaggagccgagggtgatttgttatgaggttggggatattgagaagaaggttgagtttttggtgcagaggatgaagtgtggtgtggagtgtgtggttgatgtgcctaagtacttgggtgtgagctttgagaagcatattgtgccgaggtacagtgtggtggagtgcttgagagggaagggtgcaatcgggtttgaggttgggttgaaagatttggtcatgccttctaggcttaggttttataatctctatgtgaagccatacccggagtgtgagaagatatatgggaggttgaaggggtgtggtggtgaaggtaagaggaagcatccggtggggctgtggaagctgtttaaaccagagaagtttcctgagagtggcgaggatgtgaagaatatgaggtccttcatggagtcactggtttag

SEQ ID NO: 8130 - DNA, 81 bp, Glycine max
  Peptide Sequence Number=SeqID_99815
atggaggagaaggtagcttccttgagtgagaagcttcctggagaaactttcatgagaagcttctttgagaaacttccttga

SEQ ID NO: 8131 - DNA, 948 bp, Glycine max
  Peptide Sequence Number=SeqID_99816
atggaagcagtagatgagtggctaaaggaacgggatcaaattcttactagcttagcaaggaaattgacgaaggcacaacgaatgaaagagtttgccgataaacaacgtcgtgatgtgaattttgaagtaagagactgggtgttagttaatttacgaccccaccagcagacaaccgccaccgaaagaaaatactctaagctcgcaaaaatacgtacccttttgagttatccaacgaataggggcaatttcgtacaagctggaattgccgccaacttcaaagattcatcccacacttcatgggagaagtgggagaaccttaaagaagattacaatcttgaggacaaggcagtttgggaagcccggagggatgttatgagtgaggacactgaacaaaatgcagcaatagagcatgaggcaaaatcaatacaaggagagcacagaagtggtgcttcaaagagttcatactgtaaaacatccaagattcaaaatagttctaggaagaatgttccctttatggaaggtaccctagttgtaatcttggatgatagccaagatccctttccatttgatgaggatgactttgcaccctctaacaatagagacatcaattgttccaattctgatgttggtgatcaaaaagattccatccttctagttggctaccttcttactgctgcaaaggttctgatgaatttgaccaatgacaaccccgttggctgtcggcaaattgctaactatggaggactgaagactatgtctatgttaattgttggtcatttttcttctttcagctcgacgtcatcctttgctcaaataaaggaaaatggtgcaagaactacaaaagatcatcaatttgataggcatctaactgatcatgtgttagatttccttgttcctattttgggcttacttctaaacctggtcgagaaggatggtcataacgggtaa

SEQ ID NO: 8132 - DNA, 480 bp, Glycine max
  Peptide Sequence Number=SeqID_99817
atgtgggctttccttaccggtcgtcagatcgactgggctcacttggttcggtatcgaatgcataaggccttacgggccaatgcacatctcccttaccctcaattgataactttgtttctgcgtcattttcaaattccacttgatgatgaaccatttgttcaagtcaagcgttcctttgcaattggtgctggtgcagtgacttcctttggatatcgtaaggatcagaatggtcaatggctgaagaaagacgcactccctcctcaagatgagcatactccttctcctcctcctcagcaagatgattcagccctcatgactgaagttctttccgagttacggggtcttcgttcttatgttggtgaacgttttgactcgttggatactcgctttgccggaatggatatccgtctcacacaacttgaagaagatgtgggttacattcgtcagagtttcgatcttccaccaccaccaccttcttag

SEQ ID NO: 8133 - DNA, 150 bp, Glycine max
  Peptide Sequence Number=SeqID_99818
atgaattacatcagaatgagaaggatccagaggttgtgcagtgtgagagccgctgataggtctgtgaatgtatgtatacatgattttgataatgtcaaagaagaatcaaacaaggctgcttcaaatgataagcatttgcttcaagaataa

SEQ ID NO: 8134 - DNA, 1626 bp, Glycine max
  Peptide Sequence Number=SeqID_99819
agtcactgttgttgttgtttatgatgctaatggtgcacttgagaatcctatcactcaaaatgatgagattaaagaatatgtagattacagatatatttctccttgtgaagctacttggagaatttttggttttccaatacatgctagaaagcctgttgtggagagattacattttcatcttccagggcaacacagtgttctgtatgaagacgatgatgatatagatgatatcctatcaaagccaagcatttcagattcaaaattcttagcttggatgaatagcaacaaatgtttttcagaaggtagaaatcttacttattcacaatttgtttccaaattcatgtacaaccaaaaggctagatcatggaacctcagaaagaaaggcaatacaattgacaggctaatatgggttcaaccaaccactgatgacagagaatttgtggaagcaatcaaagaagctaaggactggggaacagctaattatttgaggaaattatttgtcttaatgctattaacaagtgtcattactaaacctgaagaactttggaatcagacaaggaattggttagctgaagacattgcatatcattataaaaaaacaactatgaacacagaattagacattgatgatgaacaacttaaaaatttaacattactggaaattgaaaaacttctacgtgcaaaccaaaaatcactcaaagactatcctacaatgccatatcctgagggtgcaaatcctgcatggtgtctagagaatagcttgatattatctgaacttaattacaacaatgatgaggctagatcagaattcaaaaatcttttttcatctatgacagatggagttattgggaatcaaaatgatggatatgctacggttgaaattcctgagtacctactgattactgaatataatgaccccattgatgctatagtcagatcagcattcccatatttatatcaacaccatagtaatcctgaattcttcaaatgtagagcaatattagcttccaccaatgaaacaattgaagagatgaaaaatcccatgattggaccgccattgatcatccaatttatcgctgccttcaacaatgacaaaaacatcatacaacttccagcgttctaccatacacaatgggcaccacagtatccggagtttgttcatctgagatataatggagccatctacgaaatacgggtcagacgacacaaagaaaaaatctatttggcagatggactcgaaaacttcaggaaagatttgaaaatctacgagtcaaccaccatcaacttttttgcctgtgaccatcactgcatatttgacatacatttcataccaccactggagcggcaaacttgtagcaggcagaggcattcatcgagaaagcatatctggactgttcgacttactcaggaaatgctggatgctcctaaacccctgaaactcccgcgttgtacagaagttactcttaaatcttgcggtcaccacatgacaatcttaaggcgatctggccctccattgcaatggaaagttgaaaccctgaatcctactgttggtggaaaaggcgttgttcaaccatggtatgattttcttgaagaaatggactttgacgatggagatgaaatctctat

SEQ ID NO: 8135 - DNA, 3714 bp, Glycine max
  Peptide Sequence Number=SeqID_99820
atgaataagaatataaagcagctgcagaatttaacagagaatgaccctgccaaggacatctcatcctgcagtgcatcatactttggatccctgggagccagcaaacaggatggaggaccagagattttatctgaatcagagcacatcaaatctgtaagatctgttaccaaggtttgtagtcctgtgaatgactccactaaagtggctgaattacccctgggtgcagctttggagaaatctacagctcctgtagatgatgatttcacacgtaccggtacttctgatcacaatgaaaccactactactgatagagattctgggctactcattagtagtggcagcccaataagacttcttcaagattatgcttctgatgacacttcagataatgaagatgaaggcaatgctgcggatgctaatgttttcacggtctcaggaggtgctgacactggtgtttcagctgcacgtaaagattctgggagttatatggagactgatatcggatctaagattccttccagtgcccaaaaggggtttggaccgctctccagaaaatcgcaggatgattcagaaatagctccacatttattacgagagtctaaggaaacccgttaccgtaaaaaatctgtctcacgttggtctagtgagcataacctcaaaaatcaggtgtctgctttaaagggcaaagatggattagagagtactggcattgacagtggtagtaaaagtggtaatgctgaaaaggaagatgaggggaaaacctcaaagttggaaccaaattttctgaaagttgatgaattcgggagacatctcaaagaaggtcttacagatagtgactctgatgattcacgctatcatcagacaagcagactaaacaaaagagatagaagctggagtcgcagccggtctcctccaggcaggaggagtaggaggaataggaggagtccctgcaggagaagggataaaagaaacaggtctcgcagctggtctccctggcaccgaagaagtaggagtaggtctccaatctcaagacgttcaggtgactttcgtggtgagaatgtgaaaagggacaaggatcagtgcttggacttccttcgaggaaagtgctatcgaggagcatcttgcaagtacattcacaatgaatctgacatgaatgctacttcaaggcgctataggaataaacatgatctggaagccagttctcgtgcaaaagaatctaagattaatggagacatgaagagtatttcttctaaagtgttggataatgagcgtgatggattcagaagtcaggatgtgaatcttttccagaatgtaactagccaggaagtaatgaagaaaaaagaagattcaggaaggcatgctgttgcatcaactaccattcatcttgatggtcaatcagttaatatcaatctaagtaaatctgaatgtagcagagaggttgctcctgaaaagctggaaaccatagtagtgagggaggaacctaagactttaatccttaaaaatgatggtttgaaagcaggggattctcatcagcaacacttagttgatggttttcaccctgaagctttaggcagtggtgatgcttctaaaccatctggtacatataaagatgtcattccctcagaagatggttcatttgttcggcaaatgcaattcaatgtttctgctgttggaattccagaacattctgggtacatgtctcagcatgtgaatgcatcctttgtgactgattcatcacctgataaaagatcaattgtttctgctagtgttaatgaagctcctggtagtgaactgttaccattgttgtcatcaactcagcaacagtcagccactagttctgttgggcaatgtgtcacatcagagcagccttcattgcactctgaggcttttgaagagttacctccacagagtggttcttctggggaattaccgcttcatacttaccagttgccagcttctgctgtttcacatttccagggtgaaaatcctgtgcatatgccacaaatttcaaggcagtatggtgcaatgcaacaaagtcaattctttcctttccaatccactacgagagaaaagtttgaaccttacccagctccattacacatgcagaatgctcacttcaatgtaccacctaatagctcttggacatccttgccactgccaccaccaccgccaccaggcccaccaccaagagcggtgtataattccagtttaaactcaggagttgtaaaatcatatatttcttctgaattcaatcagagtcaattgcattcaagaactgactttgtttctcagacttccatgaagtctgggttaccaactggttctcagaattctgaatttcaggatcaagcataccctccaatgcaggatcattcactaattttcatgcttacagaacctttctctccaaagcatctccctcaggggaacccagctagtcaattgccttcaggctctaatctcaatagagatgattttcataatcaacttcctatgcaggattcaaaattttcaagtaccacatcatttgggagcctgcagcctcaatcaaatcaattttcctggaagttggatgtgaacagactacaacctactctgggtggcaagttgcctccagaaggacatcttatgacatcttcccacatcgattcattatcacagaagcaacaaccaatgtataattttcaatgttctgtatccgaggctaatttgggtgtgcctggggagactgttactgtttcaagatatccatctgattttctggatagcaatcattcaacttctcttccatcttttgggggatcaagaatatctgctcactataatccttatgcatcaacctttgagaaaccactaagttccaaattcagttcaagtatttatagacaggaagatgaaataatccatggtaacaattatgcttcttctagattgaaccatactcctgtaaatggggaaggtgatggtgtggttggattaagacagtcagcttcctcatcaaaatcagctagagctcttggtcagattttacctaggtctggtggtgaccaatatgacccgatttttgacagcattgaaccatcatcctcttctctgaaaaaaattgattttgatcagaagaaggaagttacaggtgaatccaacatcagcctaaggcccaaaagttcttacatgtctttggactcggatgagaagaacaagcaggaggaggttggggctgttgcctctaccacttctcaaaatattgatgaatatggtgaaacagcagatgcagaagttggtgctgttgaaaatgagagcctaagtgatgatgtggatgttgcaaaactgacttcaggggaggttgagattaatcaggtcaagtctcctgggaaaagaaaaaagagtaaggattccagatcaatgaaattgttcaaagtttccattgcaaactttgtaaaggaggttttgaaaccatcatggcggcaaggtaatatgagtaaggtggctttcaaaaccattgtgaaaaagactgtggataaagtgtcaggagccatgaaaggccaccgtgtacccaagtcccaaacgaagataagtcaatatattgattcatcacagcgaaagttgactaaacttgtgatgggttatgttgacaagtatgtcaaggtgcatcatttcaacaggaaacatcgatgcttccctggagttgtctcctctcaattaaaggcatactag

SEQ ID NO: 8136 - DNA, 615 bp, Glycine max
  Peptide Sequence Number=SeqID_99821
atgaatacaagtctggtgaagaaaaatgttgatgactcacccgattatggcttgtctgataaaaatctgtgtgttataacctatgcaaggagaaaaatggttaattccagttgcagaagaaacagtggttccccaagtcctgaaaatggtaacaaggaaccaactattcaggatcatcaaaaggatgattcacacgaatcttctgatggaccattgagagtttgcttgatggatggagaaacaaaactttcaattgatcaagttacctcacaaagtggagctgccgctgaggaaataaagttgagtgctgacaacattaatgagcaaagatttatgactacatcttctgcagtagacattccttcggagcatcttgaaacagatggtagacagctagatcatactgggattacaagaaataatctgtattgtgcagatgaggaaatagagttgaacactgacaacattaaggagcaaagatttatgactacctcttctgcagtagacattccttttgagcaactcgaaacaaattgtagaaagctagataatacagagattacaagaaatgatctgtgttgtgcaggtgatgtttctgatttaagcttagacaca

SEQ ID NO: 8137 - DNA, 1752 bp, Glycine max
  Peptide Sequence Number=SeqID_99822
atggcattcgagtatgattcttgtcctgattcccttcatgttggacgcaccattaacgtagaggctctaccagttcgtactggagatcaaactttgaaagttctacagaccatgctaccatcctccttgccaattcagcgccaccttctctatcatttggtagtgcttctcaatgtcatggagtatgtgattggtgaggttgagctaacgacttcctcaaatactgagagatatagaagtaggggtactcctggcctaggtcaagtcaggactggcagtgtggcaatggtcttcttaaagaccaagaagacttgttcgcagaatggattcgcttttttggcgagctttgggaggaacttggacagggatgtcggtctaccatttaacttatggacttactggacgttggcacatgtcatatttgcggatttctccgaatacttcttccaggtctaccatgtgttgggctatgctatggaatttgatgaccatgtctttgacatagacctcgacatttcgtttgatctgctgtttgaagatccggcatccaggaagcttagtacttggaacccagatgcttcatcgactagcttgtcgatgctgagtaaaggatattcatccttgggtcatgccctgagcttgtccacttcctctctgaccattttgcgtcgttattcccccatcttcctcttcttctgtgatactggttttagcttggggacagatggcaagcttgtggcatataatgctagggtggatacccggcatggctgccaagtgaacagacccttcgtccatgctcatgacttgagtatcgccactcgttgtgaggtgagacttggtaggctccctgctcctcgagagctggccttgatcaaaggtggtaatgaggccgatgtagcctctgatgtcgaaggagctgccctggtcaatgagaaccttggacacgatgaagttgacgattatgatggagacaaccatggggtcgacatagttgatgtcgatgtccttaatggcgtggaggtgacgcttgcaagattggctggactgccttccgtaagagaatgtacttgcaatgatgttgattacacctcttatttgctggatgggcttgttttcccgttcttgcggaggttgttgaccgcgtctttgcttgtggtgtctctatcttcctcgatcttctgctttgtcccttcttccgtcgacatcgtgattcctatgttgatcctcttggtgtcctccagctgcaatggtatctgcagtatttggtcctgtctaaccccaatctgggaggaagcgacagaggggtatgttagcttctatgatgcagtcgacaaaggggtctcaatgagtagtttgcccttcagaacgatgtatgtggaagagactgggatcatcttgggtgttgactgtgtgtcggggctttctaagttactccatatggcgtcgctctatctccgtaatgcaagtttggagttgttggggagtatcagtacctgtcatggttgctggaagaggattggagccttcgaaaggggtctcgcgtttgaggctagaccgcatgctaaccatggggtggacgtggccgatatgggctctaagatctcacatgttggactgagagtagcctttgttaaagggacaagagggggggacctacaaaacaaaggacttcgacgctcaagtaagggttgttacgatggtgtaacaacccttgtagataattatcggcttgtagataatagccaatag

SEQ ID NO: 8138 - DNA, 720 bp, Glycine max
  Peptide Sequence Number=SeqID_99823
atgtttgttgacccacaaaatgcaaagacggctacattggctgaagttgttgagacattacaatacatggtgtctcctcaagggaggaatacatggacagttgatgatctcgtgccttatgtgaaaaaaattacaattttatccaaagagcaagagagagtcactgggccagtgtcacatggtcctgcatcagagcgtcaatttcccgcacaacagtttcacatacttcagtcaagtgttgaaactcagggcatagacagacgaagggagactgttgaagcagaagaatattcccaacaaatgccggagcgtggccatggaatgtattacacgccacaaacatttgctgagtatccgtcacagatgtatcagtatccttttcaggttcatcacactgatacttctgcaagccagaaatcgttcggtggtgttgcggaaacacaagctcatttttcatggcccacaatgaccccttcacaacaatatcatggcccaattccaacacctaatgccccgttaggaacacaatggaatgtactgggacaaatacctaatacgggtgacttattcggtgttgatttgcgtcacgcattttctgcggaggctgacaaagaagaagcggggaggcatcggggcagaagaaatcctgattgccaagtacgaagatgggatcgaccatgtggcacatcctcacggcatcacggacaccaaaatgaatga

SEQ ID NO: 8139 - DNA, 225 bp, Glycine max
  Peptide Sequence Number=SeqID_99824
atgaagaaattaaaggttgctgcagttggtgtctcgttaagcgaggcatatgcgcttagcgagcaacatctgctaagcgagacatcagctcgcttagcgagtcaagggaatctggaagagaatttgccacgcatgcatgcacccagcacgccatcagctcgcccaaactggatagagcagggctatagaactgtattgtctggacacggagtgaagggattctag

SEQ ID NO: 8140 - DNA, 99 bp, Glycine max
  Peptide Sequence Number=SeqID_99825
atggggcttggaatcatattcagatgtcatgctggtcaaattttggctacaactactcatttccttcctcattcttacagtactcagattgacaactga

SEQ ID NO: 8141 - DNA, 1226 bp, Glycine max
  Peptide Sequence Number=SeqID_99826
atggcaagttcaagagaaggtcgtcaagcaaagcaagagggtgacaccactaatattgacaagttctcccaggcatcgtccacttcaagacaatggtcagctttcagaaatccaagaattgtgagagtgtcacgttcttttggagggaaagataggcatagcaaggtttgcaccataagagggttgagggacagaaggattaggctctcagttcccacagcaattcagctatatgatcttcaagacaaacttggactaagccaaccaagcaaagtgatagattggttgcttgaagccaccaaatttgacattgacaagctccctccactccaattccctcagggttttggtcaatttcagcatccacaaaccctactccccttccatgattcaagtgctgcctctcatcagctctctctaggacccttctgtgatgctagctccacatttgtgagggatggggggattcaaaacctcatggcaaagtcaaggtattgggagaacatagattcaatgtcaagattaagaggcaataaggaagctgaaaagggcaagtggatcaaaacaagtgagcaagagaatcatgatcaagatggtgttgttggaggttacaacagcttgcaagtttctactcagaggcttttcccaatgcgtagtagtagtactactactactactactcactcccttttacctggtttgtttaacaattccatgccatataactcctacaactctgagccttctagtttgtctttatctcaatttggaagccatggattgttccctactcaacaagtagatcctaatccaagcagcggcaacaatggtgtgcaattccaatcttcttttccattaccatcatctggctctcaattattttttgggtcatcttctgctacaccatcaatgttcaccacctatgctccatttattgcaccctcagtggacactgatccaagacagttcaaccacattcagttcttgaactcaggttctcatatcttgcctcaccctcctctcattccatctcttcatcactcattcaattcacatgtcagacccttcccagaagcaccctttagttcaaagcttttggattcaaacagcagcaaccgtagccaggaaaatcataagggatcatgtgagatggtattcttcatagaaatcactcaagaagctaatgcagaatgtattttatacactttcaagtttcaattaccaag

SEQ ID NO: 8142 - DNA, 375 bp, Glycine max
  Peptide Sequence Number=SeqID_99827
atggatgcacctgacctcaactttcagatgcaatgcggtacgtaccgtatccaataccaaggaaatagccctaagcgtgtctacacgacacctcacttaggaaaccatgcagtatttttcgaggccacccagtcatgcaccgtaactcccccaggtgatcaacctatggccacaaggagttccctaccaggtgacacaccccctagtacaaagtacatactgctacagtttatactatttcccgtgtcatatgagaaaatcagcatgcaacagggacagacagatattctcatagctaggttccctgaccctaactatggtgtcaaaatgaggtctctctcgttcatgctcgttcttcactatatgccaaaatga

SEQ ID NO: 8143 - DNA, 540 bp, Glycine max
  Peptide Sequence Number=SeqID_99828
atgacagatgctgcagcaagtgaatcttatgaagctattacactagaatttccacattcattgaagacatcagacatacctaatcataagataaggctgaaaacagacacacttattatgttcattcacaatttagatcaagcagaaggtctttgcaacggaacaaggctaattgtctatagaatggccaatcatgttattgaagtgcaaataatctcaggaaaaaacataggaagtttggtgtatattccacgaatgtctttatcaccatctcaaccaccatggcctttcaagatgattagaagacaatttccattcatagtttcatatgccatgacaatcaataaatcccaaggacaatctcttcaaagtgtaggattatatcttcctaaaccagttttaagtcatggccaactttatatggcattcttaagagttcagagcaaaagtggattgaaaatccttattcatgataaagaaggaaaaccactaaacatgacaaccaatgtggttttcaaggaagttcttcaaaatctctag

SEQ ID NO: 8144 - DNA, 225 bp, Glycine max
  Peptide Sequence Number=SeqID_99829
atgagactaacatatgtatggaggacaaccttcatttttaaattgcctatgcacatgatcttctgtaacagtttagacaacaacaagaaatatatggattgtgatgcaatcctccctagaaagggaccagtcactagagccatgagcaagaggctccaagaggattgggctagagctgctgaagaataccctagggttctcatgaaccttagggtagatttctga

SEQ ID NO: 8145 - DNA, 279 bp, Glycine max
  Peptide Sequence Number=SeqID_99830
atgggcatggcactggctgcagcatcatcaacccaaactccactgtctggtctgcctgcatcagcatcgtctccgtcatacgactgtcagtgcggtgttggacccaaattcagagtcgctctggtggagcacgctgttgcagcgcgaaaatcggaagcggcacaaactgagcaatgccggtgcgaaggaaacgattatgggcagctattgcacccgctgattgcggaggtaaacctgtgggtgaaagtagagagtgaaagtataggctatggcttgtga

SEQ ID NO: 8146 - DNA, 543 bp, Glycine max
  Peptide Sequence Number=SeqID_99831
atggcctctagtaatcgattaccaaaggtgtgtaatcgattaccaggcctaaaaatgggatcaggaaagcttagaaatggagacagtatgttgtggaggcctctgatcgcgatggcagcacaattaatccatgaccgagtggagatggagtgcctagagggagtttgggagaccttcgaaggcaatgcaaggtgccgatttcggggcacgattcgattcacggctactttattggtacatccagaggaaccagcacgcacgcttcagcacactgtggagtggatattacctacacctactccatatcgactagtggagcgagtccaagtgatagaggtgacgtcatctgaagaagaccctgaggaggacccagaggagctacctcctgagcctgctggggatgctcttgactttccagagggtgatgaggacccattccctgaggtggattctcccgaggacatcatgtcggcatctgaggtagactctacggaggagagcggtcctggagggatagcgactagcggaggttcttcatcatag

SEQ ID NO: 8147 - DNA, 1107 bp, Glycine max
  Peptide Sequence Number=SeqID_99832
atgggctcagaaatctaccctgggattaatgagaaccctaggaccttcttcagcagctctagcccaatcctcttggagcctcttgctcatggctcaagtgattggtcccttcctagggaggattgcatcaaggagttccaaaagatgccattcgcctcaacctattctcattctccttggttgctcctcaatgcctccatcggtgggaagattaaattggagactttagaagaagccatcaagctaattgagaatatggtagccagtgatcatgacatcctccgtgatcaagcctacacacccacaaagaagagccctcttgagttcacttctcaagatgctatgttagctcaaaacaagctcttggccaagactttagagatcctcataacaactctgagtaatctccctcaacagctgcatgcttatgcatggctcaagacgatgcatccaacgaagttaaatacatggccaatcagaatcgtcaaggattccatcaaggaggaccgccaggatatcatcggggaggaaatttctctcagggccaaggttagagatcctatccagggaataacttcagcaaaggccaaagagagcactgagtcagccatcaagaatttggaggtgcaggtgggtcaattagctaagcagatggttgaaaggcccactagaacctttgtggccaatactgagaagaatcccaaggaggaatgcaaggaagtcgtcactcgaagccagaagaaggacgatgttgaggaagaaaagagagctaagggagtactggaaaaggtctatgacttcaggagtttcttctttagatttgcaaacacaacttctcagtctaccagaagtgcatcaattgctgcaattttagaggtacctgataggtattgtggaaagctaggaggaccattctgcccaaatcaggaacttctcccaggtggagggtttgctgtgaacaaaagctccggaactcatgcgcaatctagtgccactcaacttgaacaattcttgccaaaatttgttgatgaacaagggatctcgatcaagcacaaggctgtgaggcatcccatgatgttttccaacaatgtccatgaagaggagtga

SEQ ID NO: 8148 - DNA, 231 bp, Glycine max
  Peptide Sequence Number=SeqID_99833
atggcagcggaatggagaaggaagagagagaggacacgccacttcaaggagaagatgagtctagaagaagctcaccaccataggaggccatggataagagcttggaggaagaaagagatgaatgaagggagaggaagagaggagcacgaaattttgtgctctaaaagagctctgaaatctgaacccactaatccaagatcaattccaagattctccactaagtgtgcttag

SEQ ID NO: 8149 - DNA, 1182 bp, Glycine max
  Peptide Sequence Number=SeqID_99834
atggtcttaatatcgggaatggatgagaagacaacgctcacatgggtgagatgctttggtatccgtttaaacgtctggggtgagaaatgtttctctttggtggctcagatatgtggaaagtatatgaagatcggggtggagacagatagcttacagaggatggagtcaacacaccttctaatccaaacaccattcacaaagcaagtcgatttttgccagagtatcaagatcaatggcaccgtatgctatatgtgcaaaggaaatcaattagatggtgaagagtctacacttgggaataacttgggtatggaaacgcattcatcacagtctgaatactcgttggagagccatggccagggggtggaaaaggtggaagaaactcatatggtggtttgttgtgctaaactatacactgatggagaagaaagtggtttttgcccactaaacaataaatatgaagacatggcagataatgaaaagatggaagggcagacatgtgtcgagggggagttgggggaaggaaaaggtgaggggcaaatgcatagtgtgggcgttgaaaaggagtttgatggggtagtagtgaggaagcagctttttgaagtcaacactaccctagagaaaggatacccacaacagtcatttgtgactatgcccaagattacttattcgggctctgtaccccaaaagaataaattgtgttctactggaagaaccattttccggaagctttccggaagaaccttcttccggaagaacaaattgttgttcttccggaagaaggttcttctggaaagtttccagaagaaggttcttccgatagaacaatttattcttccggatgaacaatttgttctaccggaagaaccttcttccggagaagttaccggaagaacttcttctgcaatgttgctgggtgcacctagcatgtcccttgtggtaataccgaagggcagtaggcctaaaacccacgatggaggtggaagaaaagaagaacacaattggaatggaagcaacaagcgactagggaagtatatgtataccctcaaaattcgagtaagcttggaggagaggaggataagacctcattttcaacttgatggatgcccaagaggtcatcaacttcaaggtctgatgggtgtactgagaaagaatctccgcttcgaagaggataaaactcactag

SEQ ID NO: 8150 - DNA, 222 bp, Glycine max
  Peptide Sequence Number=SeqID_99835
atggataagagcttgaaggtaggagaagatgagtggaggaagagggagagaaggagcacggaattttgtgcctcaaataagcataagttaaaagaagaagatttcaagtgctttggaggaaaattgatgcaaaaacttgaagaaaaagccttgaagaaaaagtggaagattgggacagctcacttagcacataagataggcccagcgcgtctcctcgcttag

SEQ ID NO: 8151 - DNA, 267 bp, Glycine max
  Peptide Sequence Number=SeqID_99836
atgagtctgcctcttaaattctgttacatgcttgctcctcatgagttctttgttgatacaggaatattagctattaagaatgctgattttgatagcattgagcgtctgcctttggtaactagtggtgaaattgcgtcaacctttcacaatcctaagtctgttaagcttgggcattgcgaccttattgaggagattatgattggcgaggataaactgattcatttttctggtgttgctatggagcaggaatgtataatagttttgtga

SEQ ID NO: 8152 - DNA, 270 bp, Glycine max
  Peptide Sequence Number=SeqID_99837
atgtcttatcctctcaaaagacaattagagagattccaagagaacttcattgccaaatgctctctcaaaagaaactcttgggcaaacacttgcaaattcattaagagttcatccatggatcttcattgtaatattcttctcttgaagagagaattcttcttccattcttcttattcaatgagattggctaagagactcctatccctcttaagattattgaggccacaaggtccaacatgcaccaaatgccggataatcaccactcactaa

SEQ ID NO: 8153 - DNA, 495 bp, Glycine max
  Peptide Sequence Number=SeqID_99838
atgaagctactacttcaccttcctctagtgaaagtgcagaagcaaaaggggaagaatctagtgaagaaatctacccccaagaagaagacaacctttaatggttcaggaggagacattgctacacctcttggacttgagtttattcctcaagtaaatgagttgttggatgagggtttggtttgcaagagcttaaatccttctgctttgttggtgcccaaaataggtattattaggcaccaaatccctaaaataggtggtatgatgaatgttttgagtggtgcaaccctcttttgtaaaatcactcgtgcacccaacatcttcatgatttgtgtacatagggactcattaggtaggagtgaatctttcagaaggaccaatgatggaccaaaccgaatggatgggcagaatagaattgaaggagtaaaactcaatgtaccccctttcaaaggcaagagtgacccaaacggctaccttgactgggagatgaagatttag

SEQ ID NO: 8154 - DNA, 477 bp, Glycine max
  Peptide Sequence Number=SeqID_99839
atggagaggtgttacaatgagaaagagtacaagtccaacaaaacagaccttactctaaagcttccaccttgtggtgagaatgtagcagaagagagggggttgagaaggtcatcatcatcatcattagtagttggtgttgcaaatgcggcccagtggggtccatctcttggcagatcttgctcactgccaacagagaggcagaggaggagggtggctgcactttcacctcaagtgcttgcttgggtggctgcttcttctgccgtcaatgtcaacaacacaccatcttcacttctcaaaccgaaggcactcccaaattcttctcaggattcaggccttggtgtgtattcttatgtcttgtttaatcccttgactaatgtttctgagcctcacatggcaatcacaagtgtgcctagtgttggtactcaaattttgccatggatttcaagatgtgaagaagaaactatactgaattactga

SEQ ID NO: 8155 - DNA, 156 bp, Glycine max
  Peptide Sequence Number=SeqID_99840
atggaagtaattggtggtacaagtccagaagtatcacccttcaatattcacggagcaaagagcatatcgagaaacataacaaactttgtgtggagcagaagtcaagcaatgagtcccacaggcgttacagtggtgcaaggtactagagcaggctaa

SEQ ID NO: 8156 - DNA, 330 bp, Glycine max
  Peptide Sequence Number=SeqID_99841
atggtgcctcttccgcaccactgccgctattactgtccccagggcggcctcgtgtcgcggcgccatgcaccggtggcaccgaggaggcgtgccaccctccgtggtggcttatcctattggggcactgtttgggaagctaggtcatctagggttatttcaactctgatgcctaaatgcgggttgggccagttgtcgcaccctataattgcccatcccaaaatgagtatgcatcctatgtggcatggccagctggctagaatgcataagaagaagctatggaggaagacacagtgcatgatggcggtggagatgagggccattaagcgctag

SEQ ID NO: 8157 - DNA, 435 bp, Glycine max
  Peptide Sequence Number=SeqID_99842
atgactaggggcaatcctggtgatttacaaccctttgatcctgaaatagatagaacttttcatagattagttagtcatagtgtgcatcctgatcattctgtgcattttgagcattccgtgtattctgtgcattttgagcattttgttgctggtgattctgaacattttgattttgagcattcggctgctaattttcatactgagaacatggttcaatctccacctcgtgagaggactcctagggagatggctgcacctgactttacttatgaaagcttgtgcattcaatatcctgatgaggatgttccatatgttctcaagactagactaatacatttgctgcccaagtttcatggtcttgcaggtgaagatcctcataagcatcttaaggagttccatattgtctgttccaccatgaagccccctgatgtctag

SEQ ID NO: 8158 - DNA, 300 bp, Glycine max
  Peptide Sequence Number=SeqID_99843
atggaagcggaattccaacctaagattgattgggcaaagttccctctcgaagttgaagaagaggaagttagttgtccctcatccaagcaccaagagcattatgttgtgtctaaggcttttaagaaggacccaccaacatggatcgaagttcttcctcctccaaagtggaagcgacaaaaccccaaggtgtccaagccttcatctctagtggcacaacgtaatgatgtctacagaattccttctagagcctacaaaccaaaggtttcaacaaggctagccaaagcacaagtcaattcctaa

SEQ ID NO: 8159 - DNA, 1074 bp, Glycine max
  Peptide Sequence Number=SeqID_99844
atggccctgaagaaactccatgctaaaagagctaggaagacttctacaggagagggatctagtacagctccacctgtagacatcgagtttgatgggcaccacttccaaaaatttcaggcggatattgttaagaggcagtggacgcagctagtagagcccatggctaaatatgatcctgaagtagtcatggaattttatgcaaatgcctggcctactgaagaaggcatcatggataagcactccagaaaaaagggcaacaatgcaaatacactgaaaagaagccaattttcaagttttgatgaagagaccatagatcagctactttgctcccccggacatgattttgcacgaagcgtagcagggaagtgggtatggatcatgcgcactagcatgaccattctgactcaaatctggatgacttttttacttagcaacaacctttcgagtgaccacaactctaatctcatgctacccaaatgtcagctggtctacagcatcatgacccagatcagtgttcatgtggcacagcttatctcatatgccatccaccagtttgtaggtattgcacctccaagacacccagtggactcagagaagtccaatagggcactaggatttccgacattgattacagaaatattgcatgccaaggaaggtacaacagtcggggcaatactagcagcactagccggctgcagatgcaccgccaccacctccacatcagccaccatccttagagtccatctcagctcacatgcaaaggatggagctccaaatgcaccatacatgcagcatttggctgatcagcaggcaacaaaccataggggccagatgcagttgaatgacagcttctatcagtatacactgcaccagcatcaccaggaccctaacctttacccgtggcctactctcgagcagttcagagccactatcgcatggcctggggataggcctaattttcaggaggaggcaagtcctatagaagctcaaggagctgcccaaggggacaaaggtggagctgaggatgatggagacatggtagatttgcttgatttcttcattggaggaggctga

SEQ ID NO: 8160 - DNA, 81 bp, Glycine max
  Peptide Sequence Number=SeqID_99845
atgttcatggaactataccatgatggcattgataagcaatacacgttggaggatttattggttgctgaggtagcgggttag

SEQ ID NO: 8161 - DNA, 264 bp, Glycine max
  Peptide Sequence Number=SeqID_99846
atgggaatgaatggaaagtcaaaaaaggctaaaaatcttgaagtgctaaaaggagtagttgcgctaagcggaccgtgtgggctcagcgcgcatccgctgttaagcgtagcttcagcgcgctttgtgagacaagggaatctggaagatcacaagaatcatggtcacgtgctaaagcgcgagatcagctcgctaagcaagacgtttgtctctttccaggctcagcgcacgaatggtgccaagcccaaatccacttgctcgcgctaa

SEQ ID NO: 8162 - DNA, 405 bp, Glycine max
  Peptide Sequence Number=SeqID_99847
atgcaagggatagcttggctcaaaaagctaaaggatctgaatggggaagaggcaaaagtgcttgaggagagtgaaaaggtgcaagccttgaaggctgagctcgaaaagacaaagaaagaatatgataagctaaaggatatcaacatgaccacgactgaggcgctagactgggaaatgaagaaagccagaaaggaggagtggagcagaaacaagtttcgaggcgctttgttaggcagcagtaacgagctcaaacttagaaaggccgagagagacaaatcaaggatggagaacatgatgttagaggataagttgaggaattttcagaggtcaaagggatgcgaaggtgtcggtcttgcggagtcaagagcttccgaggctgttagccagagccaagacggtggctaa

SEQ ID NO: 8163 - DNA, 582 bp, Glycine max
  Peptide Sequence Number=SeqID_99848
atgcataaggcattgcgatcaaatgctctacttccatatcctcatttgatcaccttgttcttacaatattttaatgtccctcttgactttgaaccttgtgttaaagtcaagagatctttctctattggtgtgaatgtggtctcctcttttggataccgcaaagagagagatggttcttgggtgaagaaagacgctcccgcacaggccacagaagactgttctccatcaccacctcctcagagagaagattcttcatctcttatgcacaacattcttgacaggttggatggactccacaccttcgtcgatgaacgctttgactcattggacagccgtattgatgccatggatgcacggtttgcaagaatggatacacgcatcaccaagcttgaggaggatgtgagtatgttcgtcaatgggggagattgtggaagcaatgtcttccaagattattttgatgatgccaaagaatcaagagtcaagcaagttccaaagaatcaagatcaagattcaagattcaagaaaagaatcatgactcaagattcaagaatcaagagaagactcaatcaagataagtattaa

SEQ ID NO: 8164 - DNA, 1143 bp, Glycine max
  Peptide Sequence Number=SeqID_99849
atggatgggctagtggatctagcggcgatcaatgcttttcttgcttatcaccacggcaaggaaagtccggtcgttgctgttttggctgatgcttatgacacattcgaccggagatgcgagaagagcagcatgagaattgtctgttacccgactgtcccctacaaggtcatcgcatgtgtgccgagaaagggaaagcgaattgggagcaactcttggcgggtatggaagggggcgtccgttaaatggttcccccgatggaaagaaggaggggcaagagttttgtgctcatgtgaagggttcccaaatgtccccttgatgggaacaagaggttgtattaattataatcccatattggccataagaaagctaggctaccctatgagaggggtgccattggaagagattatcacacctttcatcgcacgaggtttctatgaaggcaattcaaatgtgcttcaaagagttcaaaaagcgtggaatgctgtggaaaggaaagataaagagcttagagtaagcaacaacgatgttattggtggctatcataaatggttgaaggctcggatgcaagggataacttggctcccgaagctaaagatttcaagtggtgaagaagccgaagtcccggaggagagcgaaaaagtgcaagccttgaaggcagaacttgaaagaacggcccaaaaagaagaatggggtcggaacaagttccgaggggctttatggggcaacaacagcgaactcaagcttcgaagggttgaaagggacgagtcgaggttgggaagtatgatattagaggacaagttaaaggcttgtcaaaggttgaggaggagcttgactgaacagttaagtaggatggaagagaacatgtggacaatcattgaccaacgagaggacgagcatgcaaaagtatgggctctgcaagcggaaagggaagcaagagagatagtgatagattcattacacatagaagccatgaaatggatggataggttcgctttcactctgaatgggagtccagagcttccaaggttgttggctagagccaaggcaatggtgaatgtatactcagttcccgaggaagttcatgggcttttcgattattgtcagcatatgatcgagttgatgtcccatatacttttcgattag

SEQ ID NO: 8165 - DNA, 628 bp, Glycine max
  Peptide Sequence Number=SeqID_99850
gttttcgcgcgtgctccacgctgctcccgacactcctaatgccttcattcatgacgtttcagggctctacgatttcctcgccgacacacataggaatgatgccatcattcagttccccatccccaaggtgttacacggtgcagagagtggcagtggcgggagtgagaatgactttggacagagcaacatcggtggaaacgaatcaggggaaaccttcatggagggagagagagaacaactggaggagaaggagagcattggagtgaagatatacttcggccttagggcacaagggaactacaatttgactaaacgctacaataacaatgaggtgttgaaggctctctacgctgaagctggttggaccgatgaagaagacgaaaccacctattgcaaggaaatgttactggagaggagcaaggtcaagccaatagaagctatagtcgaatttgcaagtgtggagaaatggaaggaagtgagaaagttcagaagatgctattgtgcaaaagttgtggcaagaagtaccataggaattgcttcagaagttggagtcaaaatagaggcggatgacattgatagtctccgcaagacaaaagactctgatggtctttcaaaagtaaaggagtag

SEQ ID NO: 8166 - DNA, 687 bp, Glycine max
  Peptide Sequence Number=SeqID_99851
atggaaaggagttcctcatcgtacacctccaaggcccgaagtcgcgtgttgtgtctctgtaacatagaggctccactggtgacatcgtggactgaggataatcctggaggcgtttctatggatgtggtctatacaaggaaagggtgtaattattttgagtggcacgatccaattgtcaacattcgtcagaagaagattattgtagcactgatgaagaaggttgatgaattgaagttgagggaaaaggatttgcaaagcaggatcagtgacatgaagatgaaggaaaattttttagggattgttttggttgtttcttggattgtaattgaggaattgttgaattggtatgttagtgaaagaagattttatgggtgttcaaatttgcttgtagagtgttttgtgaatccttggttgggaaaagttaacaaaaccaagtacagtgatgcttacaaaaccacaaatggtacattgttgttgttaacaaaactgttagagattggtagtatactaagagagttgccaccttactacagaaagcaaggcatccataaactcaccatatttgcaaaaaaacaaggcagatataacattgcaattaaaaaggctgatataacattgtttgatattgtgcagactttaattacaacaactggtaaaaacttaatgagtgcattacaaggcctctga

SEQ ID NO: 8167 - DNA, 339 bp, Glycine max
  Peptide Sequence Number=SeqID_99852
atgctctcctttcgcgatttggagcagaaatgggcaccaaaggtcgaagctttgtttggagcttcaatggagaatgaaggagaagagaatggaaactgttggtttgacaaagacaaaggaaggcaaatttgggacttgttcatgggttttaatggaggcactttggtgccaggttgtggatggcacataactcatcccaatttcccccaagaagtgtcatcaagggaaagaccacaccattggaccaaagctttgggggtgagagcactattaacctccacgatgcgaaggtttagaatagtcaaaggagtgactaagggatcattggcacgagattga

SEQ ID NO: 8168 - DNA, 315 bp, Glycine max
  Peptide Sequence Number=SeqID_99853
atgattgagacacaccttttgaatgccctactgagagatgtcttggctatcttgctcgcaggatgccaatgtgtggatctttcttcttctcatggcccctttgatcctaaacatgacaaggacgaaggagcttatgatgcccctgttgttagttctagtgctaggtctttgaataaagacaaaaatgatctccccatctcgacaccagaagtgaggaaagtagctgagaaaaatgatgaagaaaaggatgaagttcagagtcaaatcgaatcatctacatcgaaacaccaatctcatcaagagcctattttctaa

SEQ ID NO: 8169 - DNA, 687 bp, Glycine max
  Peptide Sequence Number=SeqID_99854
actattgatgaagaaatgttgaagtttgaagaaaagcctatgcaagtggatactaatcctttccaagttcaagccaattatgttgaacctgtcaagattctgatggtaagggctttgattggtacttcaaagcttgaaactcttttttctgaagatgaagttaatcaagctttggaaaaattcaagaaagaagaagaatatgtattcccatatactggggatatgttgctggagtttctaacaaagaagcataaagctgggaaagaagatccttctttgagtccaaaggctgtttgggtgactcaagtgttttgtttcactctttatcatcatgctactgtgtttggtccaccttcagatgaaaagaaatctcatatgaagccccttaatctaactactatggtggaggatcagattatcaacaaaattcaggtggatggaggagcaactatcaacattctaccaaaatctatgaagtcgatccacaagatgggtgttattccttcgactgtgcatcagaaaatctttttatggaatgaaaatggcaagttagaagttgcagaagcagatcaaacttcttatggggtttgtgcttcgtttgctgatgaaagtgataagatactgtcaattactgcacctttcgatattgaggactcatactatgtgaacaagaagactaaaagatga

SEQ ID NO: 8170 - DNA, 630 bp, Glycine max
  Peptide Sequence Number=SeqID_99855
atggctgatagaggagaaggaaatagaccaccaaggaggactcatgttgactatgcttatcaacaaggaccaaagcattacaacaacatagtcattccttctttcagcaacaaggttgtggagttgaagccaacattgctcaatctgattggttcacacctttttgctggaatggatcatgaggatccatacacacatttgtctaccttcatggagctatgcagtacaatgggagcttctgacgaagatgttgaagttgtctacctcagagctttcccattctccttggcaggaagaggaggcccattatttgcagaatcaaaagtagacctcaatagaactttcaaggaaattaccaaggctacggaggtggctcagaagaacactgatgcttccattaaaaatcttgaagttcaggttggacagcttgcaaaacatttgcctgagcatggaagtggatctttttcaacaaacacaccggttaacctaaaggaacaatgcaaagcaattacaacaaggagggggactgtggttggtttgaaggatggtgttgagaaaaagaaaaatgaaggagttgtagaaaaaatgatgaaaaggaagaagttgaaaaagaaaaaaatgaagtggtga

SEQ ID NO: 8171 - DNA, 87 bp, Glycine max
  Peptide Sequence Number=SeqID_99856
atggctaggagactccaggaagattgggccagggatgcaggaaaaggtcctagggttcttatgagccttaggggctccatagtgtag

SEQ ID NO: 8172 - DNA, 348 bp, Glycine max
  Peptide Sequence Number=SeqID_99857
atgggccccgacgggtgcagagaaacgtggggaactggaatcagagaggcggcacgcaaaactgaggcaggaattcagcattcaaaaggtcaaaattttctctcatttgtggctgagtatgaagtcaaatcaagggaaaaagcttttcttccttcttcttcttctccattgtgcctccattatagctccaaaattcctcctcatttctactccaaattgcaaggagaagccatattcggagtcttgaagcacacctctacttcgtggggcttcaaatttcaggtatgggtggacttcttctcacatgaaattcgtgggtgttgggttttggggagttatgatgggtag

SEQ ID NO: 8173 - DNA, 617 bp, Glycine max
  Peptide Sequence Number=SeqID_99858
gaaagctggagttgctgcacatgatgtccaacgttatgtcaaggaatcagatcgggctgcacaatgcacaaggcaagataaaatgtcaaatgaagaattgaagctgcaggatccacgatattttcaggaaagtgatagatctcatccagcacaagtagttgcagcccagaaacgcacactgctatataaacatggaggctgcacgagttctgtaccaagtccgggattgaagaagttgatctctgtagtttgtgtagagttgatctctgtagtttgtgtagagttgatctctattgttcagagagcaatctctgagtggctcttaggtagaggtcgcacgggtagtgtcacatacaatctgcatgttctgaagcgtgatgtcgtgacatccgtgcaaaccaaggaaccattcagtgtttcgatcaagaatgcaaaaaataccaaaaagagtggcaaaaagggtgaaggaaccaactcgcctgggcgagctatatctcatctgggcgagccagttacttcaggagtaagcatcagctcgcctaggggagctgccattgccccaagtgcccattttcctataaataggcgtgcttgggaggctgaggagaggttccaag

SEQ ID NO: 8174 - DNA, 1329 bp, Glycine max
  Peptide Sequence Number=SeqID_99859
atgggagagttttggggtgtacccgacacttggacgtataacatcctcatttctcttaatattaagaataataaggtcaaattggcaactaaatattttgcaaggatgaaagaggccttccttgaggcagacgttgtgagttacctaaccctgttgtatgcatactcgactaggaaaatggttcgagaagcggaagagctcatacgggagatgggcaaaagggatcttgagattgatgaattcacccaatttgcgttgactagaatgtatgtagaatcaggtatgcttgagcagtcgtggttgtggttcaggaggtttcacctagctggaaatatcaattctgattgttattatgccaatattgatgcatatggaaagcgggggtatactttagcagccgagaaagtctttatttgctgcaaagaaaagaagaagctcactgtccttgagtttaatgtgatgattaaggcttatgggataggaaaatgctatgataaagcatgtcaattgtttgatagtatgaaaaaatttggtgttgttgcagacaaatgcagctacagttctctcattcatattttggccagtgctgacaagccacacattgccaaatcttatcttaaaaaaatgcaggaggcaggacttgtgagtgactgtgtcccatactgtgttatgatatcaagcttcacaaagttaggccaatttgaaatggaagaagaattatacaaggaaatgcttcgatatgtcgtccagcctgatgtcattatttatggtgtttttatcaacgcttttgctgatgctggaagcgttaaagaagccatcaattatgttaacgaaatgagaaagtcaggactgccagggaatccagctatatataactctttgataaagttgtatactaaagctaagggaagctacagagacattcaaggaaatggccatccgaccccagcaagacaaatgggtaggaggctaagggaagctacaaagacattcaaggaaatgataaaatctggcgccatccgaccccagcaagacagatggtcaaaccacgatgacaaatggaaatgggattctggaatgggaacaagttttgacttttactacgagtatccttcaagatcagtaatgggaattggattgttgaaacctctttggaactacatgaactgctttctcctctttttcttcatttcaaggactaaaaaattggtcttgtatgctacattctttggtgtatggagaagatatggtttgacagtagaggattttaatcttgcacaccgtattgttcagctgcattttggtgtcacttgcattgccactaaatga

SEQ ID NO: 8175 - DNA, 246 bp, Glycine max
  Peptide Sequence Number=SeqID_99860
atgggttgggctctagctttacacggcaatggcagagacatcccactttcactgctgatggagtgttgccagcctcgagaggaagcccttcgcctttgcctgcaaattggagttgaggcccttcaagccaacatgccattggatgtagtagagcttgtgttgtggacctttgtatattcttcctcagagaaggcgcacaacaaagcgtttcgagctttagagttcagcagaaacctttgtctttga

SEQ ID NO: 8176 - DNA, 1008 bp, Glycine max
  Peptide Sequence Number=SeqID_99861
atgcggtcaattcctttgggaacctcagtatctccaactcctataaacacctcaaagttatcacctttcagtgttaattttaagaagccaaccacctttccatcttggggttcaactcctcctcgtgaattctctctttcccaatcagtactacggattttgatttcacttaatgcagaaccatactcgttttggcttgatttatttaaggaagccaactatgagtggggactagtaatcaaggagtggatacatggggtgatgaaatatttcccatttattggatctagctcctctaaattgagcaaatgtgtaaaggcccctacagcactgattaataggctaacttccattcaaaggcaatttctttggggtggtagctttgaatggaagaagatagcttcggtagcttggagacaggtgtctgcctctagagatttgggaggcttggggatcaaacacattaaggctgacatagtggaacagattcgaacaactggactcttcaaacacgtcacaaggtggttggattctgaaagttcatgttgtaatactttagcaaaccttggtgacaaagatatgttaccagcacttgctgccagtgtttgctgccaagcagcagatcttttgactgtttgtgggaagctgaaaactcttactgagagtaccatcagagaaagagctttaacagcacaacatagttccatgatcactatctcaaaatttgagtatgagtatctaacaaatcatgtagcctcagtagaagaaattgctgataaaaaagtagcagcaactgaggcatggattgaagctctcaaggccaatgagaaggaaatactgatggaaacaaaaatagctcaaagacaactcaaagaatcaaaattggagcaagagctggaggtttacaccaaagagaagatgctttcaagaagagttagtagtagtggggagcttgacaattggccaagaaaacacgagaagagttcatccaagaacttcatagtttaa

SEQ ID NO: 8177 - DNA, 462 bp, Glycine max
  Peptide Sequence Number=SeqID_99862
atgggttctccacctgcctcccctcctcctcctcttcctctttcacctccttgtcctcctcctcttcctctttctcctccttgtcctcctcctcctcctgctccttcggacgcatcgacttcgccgtctgccgtgaagcggacacgcaaagcctcacgtctacgatcgttgtctactagaccacctggtgctgagagactagtggtccatgttgatccagctaccggcaaggccgacggtccccacaagaagaaattaagaacatatttggggattgtggcacgtgataaggtggacgtcacctacgagaactggaaggaggtccctactgctcagaaggacttgatttgggaggatattcaggcggaatttgatatcccagaggcttctgacagtaggacgaaaaggaagacttcagaccgtgggcgagagatggaggcagttttaaatcagatctcatga

SEQ ID NO: 8178 - DNA, 426 bp, Glycine max
  Peptide Sequence Number=SeqID_99863
atgcaagaacgaaaagtggtggttttaaaagtcaggcaaaaaccaagaattgataattttatagggactaaaaacactattaatcctttttttctcccttgccataggcaaatgcatatgatatcactagatgttatagtcttagtcattgttgtggaaaatttaacctggggaaactgtacgagaagatcggctttaacaaagaaattatatcaaggggaagatatgctgagctccttgctgctgagcaacgtcctttcagtgtgccagtcacatacctgggacccaaaaggcatattggattgcctccagcttattcactcaagatttttcagcatggaggcttacttaactgaggtctctaggttctatggatctccctttcggagtgatgatcaccgaggaagattactaatgaagggatga

SEQ ID NO: 8179 - DNA, 264 bp, Glycine max
  Peptide Sequence Number=SeqID_99864
atgggtaagggctggggtcctagcactgctggtgcagggtatactggtagaagttgtcgttcaactgcacatgtcccctatagttggttgcctgctggtcagccaaatgctacatgcagagctccatcctttgcattacttctcaatgaaagacctgttaatgggaggtcagatgagctttgtgggtgtaactggcaccccatagaactggtagagacctatgatcaaagctggaaatcccagtgctctgttggacttttctag

SEQ ID NO: 8180 - DNA, 57 bp, Glycine max
  Peptide Sequence Number=SeqID_99865
atggtggttctcgtgggtcttggggagcctttgaccatgctcgccgaggcgagttga

SEQ ID NO: 8181 - DNA, 555 bp, Glycine max
  Peptide Sequence Number=SeqID_99866
atggttagaacgagaggtttaggtcatcatttaggcatagttataggaagagtcctggggatagaaaataatcgtgattctaatgaagctccccagcagcgaaggcccacagcatccgcacgtaggcaatgggaagttatcgttgttgctgaggatgttcatcacatgggaattctgactgtttatactgatcatgttgaagtcattgtttggaatggagaggaatgtcttgaattaaagttttcatcccatggaaggaaggttcaaaaattcaggagacctgctgctaagattgaaggaggtcaccatccccttaatgatgtggcctctttgcttcatctacccatcacaggcgccttccatagctttgagactcttcatgcagatgaagcggtgttgatcaaatgtgatgtcggacactggactgtagtagctcgagcttatctgttgcatttgctaggttgcattctttttgctaacaagagtgcaacacatgtgcatatggtggtcttggacgcctttcgagacctcagtcaaagtggaagctacgcatag

SEQ ID NO: 8182 - DNA, 336 bp, Glycine max
  Peptide Sequence Number=SeqID_99867
atggcatccttcagccaccttcagtcgcagatgcaatctcagggacttgcagtgcctcctgagcctgtggttggtcctggtccctccggtcctcgagtgagcacaaaggagagttgtgttgatccctcaggaaacgatcctgagaccggtgactctgacaggtgcggcttgtacatagaagcagatcctgcacgcctggttgccatcgggagagtttatgagggatccactgttgttcataactctcctttgttgcctggccaagtaaaggtagctgtgtctccgccaaaaccacctccgaagcccaatccgaagtcgatgatccgctttatctga

SEQ ID NO: 8183 - DNA, 504 bp, Glycine max
  Peptide Sequence Number=SeqID_99868
atgccagcatatgagcataatgacacagtgcctcatgatgtagaaacgagccctttgctctttgaccagcctagcacactttctagcaaaagcacacttcctctgagtggaagaagaagaagaattcttcatgatagaggaagaagaagtttgttgacatacattcaaaaaagaaattgtgggaggggtgtattcattgatggttcatggactgacgacccacacaaggtgaaggaagaggtgaaatcctttttcttccataggttccaagaaccaattggtcagcaacccaagattgatggaatcaggtttcaaactgttaatctacaacagaataacgagcttctggcacctttcatggacgaagaaattcagaaggcaatttttaaagctgcaacgaagttttttatgaaggaaggcaattcacaaaaggattgcatggatttaatggaaatcgatatgcttaccaaaagaaaaggctggcttgggcatcaaggatattga

SEQ ID NO: 8184 - DNA, 537 bp, Glycine max
  Peptide Sequence Number=SeqID_99869
atggaggagttgataaacaaaatacaactctctcccaaaataatgccaacgtcgtcacgccggctcggtggctcctcaccagaatcttactccttgcaccctactgctgtcattctgctcccacgaacaatgttcgagatcatcacaagtatcaaccatgcgatacaaaatggcaaggattctttaaccacgcttgtcccccacgaatgggccatccaacaaggtcagtgcactccccccccccatgaacatacactacatacgacgtatgaacgtggccataagaaagtgccaaagaccatggaccaattaaagcgcctaagcatcccctcagaaatgcttagattctttaaccacgcttgtcccccacgaatgggccacccgacaaggtcagtgcacttcgccccccacgaacatacacaacatccaatgtatcgaacatgggcaccatcaagtgcaatgaccatggacaaattaaagcgcctaagcatcccctcagaaatgcttagattctttaaccactctagtcccccatga

SEQ ID NO: 8185 - DNA, 363 bp, Glycine max
  Peptide Sequence Number=SeqID_99870
atgacggttccaaagtcagaaacgatgcaaagacaagctgaaactaaaaagaaacaacgtagaaccatgggttcctctcggtgtggggtttcaatggagaacaacgatggtttgtggtggctaatggtggctgtgggtgatggagaaattgcttgggactttagaaatggctttggaagaaagaaaggagaagaaattgcatttttcctaagctacacgaaagcaaaggctgaaaccacatttagagaagatccaacggttaacgaaggctgggtagcatttttaccgaggcagcttcatgtagcttcctcaagaagcttcattaagaggcttcttcaagaagcttccccgtggcttctttga

SEQ ID NO: 8186 - DNA, 276 bp, Glycine max
  Peptide Sequence Number=SeqID_99871
atggtggttgatgaggtggcaggagtaaatgcagaaataatggtggttgataaggtggcaagagtaaatgcagaaataatggtggttaatgaggtggcaggatggatagtgccacacaggcttgtttcttgcaattccaagatacatggacgcttcctaagagatgacatgttctacttatgcttttcctatctagtttgcaccctgcaaaatcaaaatctgaaaagccaattagatttaaagaggtgcatttgggataacacaaacccacattag

SEQ ID NO: 8187 - DNA, 252 bp, Glycine max
  Peptide Sequence Number=SeqID_99872
atggcgccgtcgtcgttaatgggttcggttcggttcgggttgggtggaaagggcgaggaaggagtgaggtttggttttgagcggaatgagagtgggaggaggagaatagacctaaagctgaaggtgaattgttttgcgcgccaaatggggtttttgtgttttagggacttggcgggaggggtggaaagagagggcgcagatgatgagaaagagggggagggtgaaagtgacagaaagaaaggaaaacgatga

SEQ ID NO: 8188 - DNA, 315 bp, Glycine max
  Peptide Sequence Number=SeqID_99873
atgaagaagtttcacaaatttgtcaagaagagaagaatcgagaggcgtcaaaatttcaaccatggaaaaagattccaagaagactctccaactcttaaatgctacaaatgcaaccaacttggtcacatcaaagcaaattgcccctcaaacgagcaatgggctgagaagaatgagaagaaaagtcgtgaagaaagaatatccaagaaggtgtatattgcatgggatgacaatgactcatctgatggttcagagaaggagatcaaacttctatccaaggactatgagagcgatgagaacatctctcaagaagattaa

SEQ ID NO: 8189 - DNA, 660 bp, Glycine max
  Peptide Sequence Number=SeqID_99874
atggctaagtatgaccttgagatagtcatggagttctatgcaaatgcctggcccacggaagaaggagaggggcagcattatgaatacaccgaaagaaaaagccaggtctcaggttttgatgaagaggccataggccagctactgtgctccccgggacaggattttgcatggagtgtgactggaagatgggtgcagatcatgcgcactagcatgaccaccttgacccagatctggatgatgcttctcctcagcaacatccttctcctcagtgttcatggcactgggatttccagcattgatcacaggtctctaccagttctatggggtaccagttacgaccaacagcagcaaccagttgtagatgcaccaccgccacctctacatcagccactatctctagagtccatctcagctcacatgcagaggatggagccctacatgcagcatttggctaaccaacaagtagcgaaccataggggccagtgccaggaccccaacccttacccgtggcctacccccgagcagttcagggccattgttacatggcctggggataggcctaattttcagggaggtgcaggtcccacaaaggcccgaggaaatgaagataaagctgaggaagacggagacatggcagatgtgatggatttcttcctttga

SEQ ID NO: 8190 - DNA, 231 bp, Glycine max
  Peptide Sequence Number=SeqID_99875
atggaaacaactaagcttgttggccttcctcaaagttgtcatgactgcagacaagaagtgtcgcaacatgcccttttgcgggcgtgcaaggtgaggctcacgggtgtgctttccaaaggaggaaagatgcgcggagtcgccaccaacgtttatttgtggaaaatgtcggaaaaaccgaaggaaaccggtcaaaatgaaaattctaagttcgggagttatatttacgtttga

SEQ ID NO: 8191 - DNA, 174 bp, Glycine max
  Peptide Sequence Number=SeqID_99876
atgtctcatcatcaaagaaagctatgtctagaaaatagagtagatgatcatggagatgacaaggaaggaggagctggtgctgtgggtgcttcagatggtccgtggcgtcgatggtcagcagcggcagtggtggtggaagagccttttctctttttcattgattcagccatttga

SEQ ID NO: 8192 - DNA, 213 bp, Glycine max
  Peptide Sequence Number=SeqID_99877
atggatgcctcagagccctacattgaggcaatgaaagacaccatgcataagcctcaagcgaacctaggggcaaatcagaggttctcacccagtaggttccctactgcaaggagtagagcccaactcaaaagttgggtgaacaaaaggtacaagcaagacgctcttaaggtccttactcaatataacccccaaacactctttgagcatgtctaa

SEQ ID NO: 8193 - DNA, 273 bp, Glycine max
  Peptide Sequence Number=SeqID_99878
atggtggaagcttcacccttagaaccaaccctcaaaaataagttatcttcttcgtcttctaataaggcgtcatctttagattgctcctcagataactcattagcttttagagcttttggtgcaatcatatgtggtcttcactcagtagaaccttcatatgatacagtaaaagtgtcccacatttctttggtgcttttgatacagtggacctttgcgtactcttcttctaatagtgcacaaatgatgttgtttcttgcttttgagttcaactag

SEQ ID NO: 8194 - DNA, 510 bp, Glycine max
  Peptide Sequence Number=SeqID_99879
atgcctccaaattcttcaagcttatatgagcagtcatcttcagctttaaaatcccaaaacaaggaacctaccaaccttactaaaattttgaattccctcgaggatgatccgcatagcaatgaaggattcaatctacaaattggagataaaaatattaaaaaacagatgccaaagggcaagaatttacatacacaaagccagagtttaaggtatacttatggtcagattgagaaggagaaagttcaacaagagaaaaacaagaacttgactttctcaggagttatttcaatggctactaaaggcgatgttcgaacaaggcctatgattgaggtagcttttaaggatttaactcctactttcaaaggtaaaagaaaacatataatgagatgtgtgactggtaaactcatgccggatcgagtttctactatgatgggtctatctggagtcagcaaaactacatttctttctgccttagagtcagcaaaactacatttctttctgccttggtag

SEQ ID NO: 8195 - DNA, 494 bp, Glycine max
  Peptide Sequence Number=SeqID_99880
atggcatcttcatcatcatcttcatcacatattaacattaagtctggccccatcaatgctgatgtattatggatgcaacctaagcatgtttcagaacatgtttggaatgggaagaagataggaaattgcatatcagacgagctgtccccacgtaccaaggggaagaacaaattcctgagcaaatttttccttttcttctacaatctggtttcgcctggattatcaagatggggtataagtgtggatggtttaccattaattggtccaacaaatcttgattgggctgatttatgtgaggaattattgggagtcagaccacaagaagatgaaattagaggtagtgtggttaaattaagttggctggctcaccattttgcccaaataaataatgacgacgacgaagaacaaatacgaaggtttgcccgtgcatggatactgagattcattggaggtgtcttgttcgttgacaaaagcagtaacaaagtttcgctaag

SEQ ID NO: 8196 - DNA, 345 bp, Glycine max
  Peptide Sequence Number=SeqID_99881
gcttttcgtcttacagatagcaagaagaatgtttatacggataaccactcgggtatttccgcccgtcagtgtgactcaaatgtcagtatgacagatcttgtgagcgcggaagatgatacatcaaaaaagaatgtttatacggataaccactcgggtatttccgcccgtcagcgtgactcaaatgtcagtatgacagatcttgtgagcgaggaagatgacagcacaaaaaaaagtttaacggataaccactcgggtatctccgcccgtcagcgtgactcctgtgtcagcatgacagaacttgtgaaggtgcaaagactaaatctccgcggacggcttgctgcctga

SEQ ID NO: 8197 - DNA, 610 bp, Glycine max
  Peptide Sequence Number=SeqID_99882
gtctccgcaaagtcgtaaagaccatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 8198 - DNA, 327 bp, Glycine max
  Peptide Sequence Number=SeqID_99883
atgggtgaccaagaggagatacaggaacagatgaaagccgacatgtcagctttgaaagaacaaatggcttccatgatggatgtcatgctaggaatgaggcaacttatggagaataacgtggccaccgctgccgctattagtttggctacccaagcagacccaactctcccagctactgcacaccatcctctcccaaacgtggtaggacgagaaagaagcacactggggcacctcagcaacccccatctgagatacaaccgagtggcttacctttatggattaccacctaattacacgccaccagtcatgcgtgatgacgcggatcat

SEQ ID NO: 8199 - DNA, 681 bp, Glycine max
  Peptide Sequence Number=SeqID_99884
atgtactttattgctccccatcaggtggtgcagtttgaagatattctgctttctgacgttaaaggaagtgtattggtgattcacccggattttttgcagggctatcctattgcttcttccataaaggattacggttatttttcctattctgccaatgaagctttacacctttccgaaaaagaagaaaattccgttacggaaattatcgccaatatacggagggaaacggaaaataatatggatgtttttacccaggatttactgatctccaatattgacctgcttttgaaatactgtgatcgtttttataaccgtcagtttttaaccagaaagaaagtaaataatgatctcttaacgcaattggaaacactgcttgatgagcagtttaaaaataacagcctcatcatcaatggaattccgtccgtacaatttatagcgaacgaattgcacatcagtcctaattatctcagcgatatgttgcgtgtccatacgggacaaacaacacagcagcatatccagaaccggctgattgcaaaagctaaagaattgctgtctacgacttcaatgtcggtttcggaaattgcctatcatcttggttttgagcattcgcagtcttttcaccgtttgtttaagaacaggacttcgctttctccacttgaattccggcagacttttaactga

SEQ ID NO: 8200 - DNA, 384 bp, Glycine max
  Peptide Sequence Number=SeqID_99885
cgctattcatgcatcctccaccaaggagtttggagccccgcgaagttattgcgtagcgctgttcgccaattctccattctccaatcttattcggagacccatgaatttgttgcctagcgctgttcatgtgtcctccgttatcaagcgcggagcctctggtgactgggaaatatgtttttctccggatcgtaaaaaagaaggagtagagacgagagtcgtcatcacggaaagggcaggacggacgaaatcagtgtcttatctttgctttcctcttatctccgatgagagatacttggcaccctttgttgcacaatatgtgaagtcccgagacgtgccgaaaatcaaaaggaagcaggcttacgcgatccgtgaaaattccgtaat

SEQ ID NO: 8201 - DNA, 78 bp, Glycine max
  Peptide Sequence Number=SeqID_99886
tgaggggcaaccctcaccccttgagctagcttttggggttgagttaggcctaaactcgcattctaagattctaagatg

SEQ ID NO: 8202 - DNA, 393 bp, Glycine max
  Peptide Sequence Number=SeqID_99887
atgagcgagatagaggaagttcaagaacagatgaaggtcgacatggaggccatgaaagaccaaataaccaccatgatggaggccatgatgagtatgagaaaaatgatggaggtcaatgcagctgcagtcgctgccacaagtgccaccactgaggtggacccaactcatccatctggtatcaatcaagtaaatcgtctagtcccagatatggtaggtcagggaggcgaagcattgggaagtataggcggcccccattttgtgcaggtccagagcaagcatcccttcccaccatatggcttacctcccaactatgcaccacccaatattgtacatgcactcgatgagaatgtcgaccactccgctcccatacccattaagagccaacaaccctaa

SEQ ID NO: 8203 - DNA, 261 bp, Glycine max
  Peptide Sequence Number=SeqID_99888
atgaaccatttggttttttatcacataccggctgtcaattgctaccattttcatagccccaatcggctacttttagggacaggtctggagattcaacagctcgaatttggaaaattgttgatggagcttgtgactctagtgtgcaaaatgaaccacacttcaaagaaagcaccaatgagaaaagcaaggaacccatttactagcaaaatgcacacacagggtggttattgtcttttcattccacaattaaaggaccaatag

SEQ ID NO: 8204 - DNA, 306 bp, Glycine max
  Peptide Sequence Number=SeqID_99889
atgcgtctaccggggaaggagagtatgctgatgaaatcccccataaccataaatgagattttggatgttagcatttcgtttctaaatgaccatttagaggaaacactgggttcgacaaaaatagaagaaatccactcaaagtgtatcaatctcgcacagatattgtctggtcaaaagacctttctgcacatttcttctgatttctttcgatccttgatcaggagctttctttccttccttttactttctcccactctttggttgggaatttcctttcttttcttttcgctttctcccactctttga

SEQ ID NO: 8205 - DNA, 225 bp, Glycine max
  Peptide Sequence Number=SeqID_99890
atgagtgcaagggataattcaatcatgcacaagggaaataaaaatcctgatcctgtcaatgatcctgtgcggagtctatggcatgctcattcaggtccagttcaggagtgcctgatgatgaatcctggggaaagggtcggtctggcactggtgcagatgactcaggctgagaagaagacatgtctcgcactgcagtggaaggctttggtgtcacttgtggggtag

SEQ ID NO: 8206 - DNA, 633 bp, Glycine max
  Peptide Sequence Number=SeqID_99891
atgtacggcattagcaaggagaaatggacccaattttgccagagccatagagacccttcatgggagaatgtgcgaaaaaaagcacaggccgtccaaaaacaaaacactgcccctcacgtgatgtctcgtgggggttatgaatatttagaaaaaaagttgatggatgagaagagaaagaaaaaactagaggaagcaactcaatccggaagcactgacaccgtcattgatcctccatctcccatcaaacgacacgtgaagtggaagctagcccgcaccaagaaaactggtgacatgacatctgaagcagcaaaggaaattgctgacaagattgatgcgcttgaggagcaggcctcacagggttcctttgttacccatggacgtcatgatatactgactgctgccattgggcgaccagaacaccctggtcgtgtgcgtgctgataggagccggtataaccatcaaacaatactttggatcagcttcaaggacctcctccattgctcccgaatacctgcaacagttgacgcaacaaatcaaggaccaactagaggattcaatcacagaaaaaatcactcgacggctaatgttatccttcagccaaatgcaatcacagggactcgcactgcctcctga

SEQ ID NO: 8207 - DNA, 393 bp, Glycine max
  Peptide Sequence Number=SeqID_99892
atggaacacgcatcccgcgtgactcgcgttgccctcccgccgaagggtaggttccgacaacagccttccagtgttttgaggtgtaatggtggcccgagtgatgttggggaatggttacgagcccgcaaagacaacggcggcagaaccagcctgataagcgccagaggaaacggtgggaagtttgggttaggctataaacccacacaagcggacataaggaaaagcgttgcgggaagaaagagcgggggtcaaggctcgcaattgggacaagaagtcgaaggaggcccgtcctgccacatcagtaggagctttataagcgcgggtctaggacacgaaggccaagtcattgcgatatgcaaagattattcgccgagtgggttggatttgcaataa

SEQ ID NO: 8208 - DNA, 699 bp, Glycine max
  Peptide Sequence Number=SeqID_99893
atggcaaatcaagaggagtgggtcccgtttatggatgtattggcattgctaatctttggggttgtcctctttccaaacgtggatggtttggtggaccttgccgcaatcgaagctttccttgcataccaccatagcaaagaaagcccggtggtagctatcttggcaaatttatttgacacatttgaccgaaggtgcgagaagagtagcacacggatcatatgttgcttgcccgctctttgtgtatggttggttccacacgtgttccaacaaaacacaaggcatccatgtccgctccaaagccatcgctcgtgcggtgaaaagagaagagtagattgggaccaacacttggctaggataggaggtagaacaatcagctggtttcctcgatggaaggaaggaaaggaggaagtccttttctcgtgtggggagtacccaaacatttctttgatagggacgaggggttgtattaactacaatcccgcacttgctataagacagttagggtaccccatgaggggagcatcgacggaagaaagcctgtcccctttccttgtgagagattttggtgtgcaaagcttcaaggttatacaaagaatccataaggcgtgggaaaatccgttaaggaaagataaagaacttaggggcattcgtaatggcatcattagtggttatcatgaatggctgaaagttcatgcatga

SEQ ID NO: 8209 - DNA, 496 bp, Glycine max
  Peptide Sequence Number=SeqID_99894
atggggctccgtaaaaagggtagagaatggaggattgcactaagcaatcatgacatggctccaaactcttggtggaggatgcatgaacgaaaacgcaattcatggggctccgaaaagggtagagaatggagaattgcactaagcaatcactacgcatggctccaaactcgatgcatgaacgaaaacgcaattcatggggctccgaaaaagggtagagaagtgagaattgcactaagcaatcactacgcatggctccaaactcgtgggtggaggatgcatgaaggaaaacgcaattcatgggagtctccgaaaaagggtagagaatggataattgcactaagcaatcactacgcatggctccaaactcgtgggttgaggatgcatgaacgaaaacgcatttcatggggctccgaaaaaagggtcgagaatggaattgccctaagcaatcacgaaggatgcatgaacgaaaacggaattcatggggctctgaaaaagg

SEQ ID NO: 8210 - DNA, 204 bp, Glycine max
  Peptide Sequence Number=SeqID_99895
atgtctggcacttatcgattgagctcaaagaaaactaggaaaggaaagagtcccggaaaaggtgggaatcgattttggaagtcacttgtggttggctttaagactcccaaggaagccatcaaaggtgatttgttcgtcttctttagtcgctgtcaaggttcattgttgcttgtgttctgtgtgctgctaagtgatcagtgctga

SEQ ID NO: 8211 - DNA, 231 bp, Glycine max
  Peptide Sequence Number=SeqID_99896
atggagtcaagaatcaccaaggtcgaagaagatgtttcttatatttcccatgagaatgatttcaagtttgagtcaagaacaattcaagaatcaagagaagtttcaagtttcaagttttcaagaatcaagaataatcaagaacaagattcaagactcaagattcaagaatcaagaaaagactcaatcaagataagtactgaaaagtttttcaaaacattgagtagcacatga

SEQ ID NO: 8212 - DNA, 201 bp, Glycine max
  Peptide Sequence Number=SeqID_99897
atgaagaagatccaaggcctacaagctccacatggagctacatcaaaagatagccgatttggtagaattgcagcattatatggagatagaggacttgctgcacaaatctattcaagtgtcaagaagttggacatattgcttctcaatgtccaaattgtcgcaacctacccttcggcgggagggggatgcgaggctcactag

SEQ ID NO: 8213 - DNA, 108 bp, Glycine max
  Peptide Sequence Number=SeqID_99898
atggaacacagctccaaactcgaaagtggaggacaagaatggaggattgccttgagggatgttggcgggaccgaacggtccaccgggtttttccacctaacaggataa

SEQ ID NO: 8214 - DNA, 471 bp, Glycine max
  Peptide Sequence Number=SeqID_99899
atgatgaaaagagatagaggccatcaaagtgtgtcattggagaataagataggagattcaactgtggtcaagatgagtgagaaaaataataatgccgattccggtgactacatgattcttgatgaccatgaaggagaagagcattgttgtggcaaaggaacaaatgcgaggagtgtttcttttttgccaagaagccaagagaagataggagattcggctaaagttgtgataaaacaagacatgaagggaggagagcataaatatgggtttaacaacaacgtgagaagccagagaagactaaccagagagactcgttcagatgatgcatttcattctcaatgcggtctcgctcactcctcaggaattcttttatgccttgtgattagttccagagtttctattattagtgtttacctttcggaaagggcagggtatacatctgttgtacaacatagtttgtatgcaaaatga

SEQ ID NO: 8215 - DNA, 252 bp, Glycine max
  Peptide Sequence Number=SeqID_99900
atgaagaaggttgaagcaactggtgtctcgctaagcgaggcactcagctcgcttagcgagtggggagaatctggaagagaatttgtcattcatgcacgtgctaacttgcaatggaaggtgtcataccctaatttcgtccggggacctttgcttgatgacatgcgacctttctttggtccttgtgagaacattttggaagttgggttgcttaaggaggaagcaactgggcggcaagctcctccacgtttttga

SEQ ID NO: 8216 - DNA, 180 bp, Glycine max
  Peptide Sequence Number=SeqID_99901
atggtttttagcacaaatgaatctacaaacaaggttgtagtttgcgttggggtgctagagaaaggaggtaaaggtaagctggatatggcagattggctgaataatgctttggggcctctaaaagggagatgtggtaaaggaaaaggtggtcttgcaacgggtttgaggattgagcattag

SEQ ID NO: 8217 - DNA, 321 bp, Glycine max
  Peptide Sequence Number=SeqID_99902
atggatgcttggtttaaagtagttatgctcgcggtttctctggagccttattccttcataacatcatctttcatgggaggagtggttgcatttgagtcgtctattaagtgtccgattttggatttaaagacccaccttttacatgggattgttgtggtgttagagaatgcattgataggacagtctacaacgataaatggaggttttccgttttttgatacctcattgttgcacctcatttccattaaatctgataataaagctttgttgttgaacttgaagtttcaacaattcttagggggagccaataggtcgttctaa

SEQ ID NO: 8218 - DNA, 586 bp, Glycine max
  Peptide Sequence Number=SeqID_99903
gtcgactctagaggatcccactcgtcttacagacaacaaaaagtttatacggataaccactcgggaatttccggccgtcagcgtgactcaaaagtcagtatgacagatcttgtgagcgcggaagatgacgtcgcagaagacgatgttagtctctgcgtgttatcaggattttcgtcatacagaatgcaaaaagtttatacggataaccactcgggtatttccggccgtcagcgtgactcaaaagtcagtatgacagatcttgtgagcgcggaagatgacgccgcagaagacgatgttagtctctgcgtgttatcaggcttttcgtcttacagaatgcaaaaagtttatacggataaccactcgggtatttccggccgtcagcgtgactcaaaagtcagtatgacagatcttgtgagcgcggaagataacctaaatctccacgtgtcaacgggcttgtcggccgcgattgacgaagggcgcagaagacgactcagtatgacagatcttgtgagcgcggaagatgacgtaaatctccacgtgtcaacgggcttgtcggccgcgattgacgaaggtcgcagaagacgac

SEQ ID NO: 8219 - DNA, 261 bp, Glycine max
  Peptide Sequence Number=SeqID_99904
atggaagaggaacatgcacaacgagtgacactagaggactactctaatacaactaccccacaattcttcaccagtattgcaaggtcggaggttcaagcggccaacatatcttcttctcactctctcatacagctgatacaaggaaacctcttccacagtctaccaaatgaggatccttatgctcatcttgccacctacatagaaatttgtaacatggggaagcaaaaaggtggttacactccttcaaaggcaatagcttga

SEQ ID NO: 8220 - DNA, 873 bp, Glycine max
  Peptide Sequence Number=SeqID_99905
atgcccgaacccgtcgccgaaccggcgctcaatggactgcgccttaatctgcggattgtctccgtcgttattttcaactttgccagctatctcactatcgggctgccgttggcggttctgccgggctacgttcacgatgtgatgggttttagcgccttctgggccgggctggtgattagtctccagtatttcgccacgctgctgagccgaccgcacgccgggcgctacgccgatctgctcgggccgaaaaagattgtcgttttcggcctgtgcggctgtttcctgagtggtttgagctacctgctggcagcctggagcagcagctggccactgctgagtctgctgctgttatgccttggacgagcgatcctcggcattggccagagctttgctggcacggggtcgacgctatggggggtaggcgttgtcggctcgctgcatatcgggcgggtgatttcgtggaacggcattgtgacctacggcgcgatggcgatgggcgcgccgctgggcgtgctgtgctattcatatattggcctcagcggcctggcgatggtcattatggcggttgctctggtggctatcatttgcgcgctaccgcgaacggcggtgaaggcaacgaaagggaaagcgatgtcatttcgcgcggtgctgggccgggtttggccttacggcatggcgctggcgttggcttctgccggctttggggttatcgcgacctttattaccctgttttatgacgcgaaaggctgggacggcgcggcctttgcgttaacgctgttcagctgcgcgtttgtcggcacgcggctgcttttccccaacggtattaaccgccttggcggcctgaacgtggcgatgctctgttttagcgtggag

SEQ ID NO: 8221 - DNA, 370 bp, Glycine max
  Peptide Sequence Number=SeqID_99906
atgaaaagagaaaaacatgcctcctatagtagtcataactcttgcaagagcctaagtgaagaacttcgtgactattatgaaggaagacataagtcacatcttagacctcattcccatagaagagaaaaggaaagaaagcctcaagatgccaacattaacctcccatacttccatgggaaggacaatgtagaggctaacttagattgggaaataaaggtagagcaaaaacttaaaagaaagtctactttaaaatctgatggctctcactcttatccaaagaaagtccaaggtctaagcatcttaggggctgcaccttctaagcccaaagatgataaggggaagacaatagaaaagcaactccctaaggcta

SEQ ID NO: 8222 - DNA, 216 bp, Glycine max
  Peptide Sequence Number=SeqID_99907
atgaagttctcaaggattatgattattggtctttcctaccaaccaggaaaggctaatgtagtagccgatgcgctgagccaggaagtccttatatgttgcgaccatgatgattctagaacagaggttgatagaggaattttgagatctaatctagcaattgagatgcgacctaagagcttattgtgggagcgttgcagatcaccaatgaattcataa

SEQ ID NO: 8223 - DNA, 534 bp, Glycine max
  Peptide Sequence Number=SeqID_99908
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggctgtaatcgattaccagcaagatgcatatgctacaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 8224 - DNA, 123 bp, Glycine max
  Peptide Sequence Number=SeqID_99909
atgcgcttagcgagtaaaggggaatctggaaaggcatctgctacgcttagcgcgagattggcgctaagctcaaattcactcactcgcattaagcgtgacatcgagatcaggaaccctttctaa

SEQ ID NO: 8225 - DNA, 990 bp, Glycine max
  Peptide Sequence Number=SeqID_99910
cagaaacgatattcaaatcttttctcatctcgttccattatcgaccctaagtttattgatatggaattcttttctgctgaaacttttgattgcattcaagcctttcagaacctaggtcttatacctttcatgtcattacaattgcctgtttatcctgaattggttaaagccttttattgtaatcttgaaattcaggacaacactttaatttctgaggtttttgggataaaaatggtcattgaccaatcccttttccatgacttaacccaattgtccagtgacggtgtaccatttgaaggtacactgaatgacgattggaagtttgatttttctgcacatgatgcccgccagttggtttgcaccaacaatgcggatatgaccgaatgccttcttgccggttcattggcttttgaaagccgcatcctacattatctgattgtgcggattttgcttccacgatcttccaatcttgcccaagtttctgaggaagatcttgttatcatgtgggcctttcataccggccgtcaacttgagtgggcacatcttgtaagatatcgcatgcataaggcattgcgattaaatgcacctttgccatatccacatcttgtcacactctttttccgccattttcaaattcctcttgattctgaaccttatgttccaatcaagagatcttttttaattggtgctgctgtgattgcttcttttggttaccgcaaagaccatgatggctcttgggtcaaaaagggcgctcaacccgctgatgaagaaggaaacctaccagttgaagataattccactcttcttcgaaggcttatggacaggtttgatggacttcagactttcgttggtgacaagtttgatgccatggaattgcaagtcgacatgtggttcgatgccatggaatcaaggatcaccaaagttgaagaagatgtctccttcatccgtacttgctttgatccaccactaccgcctccatcatcgtcttag

SEQ ID NO: 8226 - DNA, 192 bp, Glycine max
  Peptide Sequence Number=SeqID_99911
atggtgaaagttggaacctcttacgtgccgatcaacgtgtcatttccgccaaaagctggccctgggcttcccgctgtccctcctgttcagctaccgacggggtggtgcgtaacggcaaaagcaccgccggacatcagcgctggcaagtgtagcggtcacgctgcgcgtaaccaccacacccgccgcgcttaa

SEQ ID NO: 8227 - DNA, 228 bp, Glycine max
  Peptide Sequence Number=SeqID_99912
atggcagcggaatggagaaggaagagagagaggagacgccacttcaaggcgaagatgagtctagaagaagctcaccaccataggaggccatggataagagcttggaggaagaaggagatgaatgaagggtgtcgcaacctacccttcggcgggagggcgacgcgtgactcgcgggatgcgtgttccacgaaaggaatacgcgcggagtcgccaccaacgtttatttga

SEQ ID NO: 8228 - DNA, 299 bp, Glycine max
  Peptide Sequence Number=SeqID_99913
gtacattccacagaccaccaagtggggcatttggggtcggtagttcattattttgggtgaatgaaggagtcccccctgaaggaggagaggattcaaatatgcctgtcatactgtaccctggttggaaatcatgtgggtatgaatacatcggcgccatctgcgatggttcttgggcggcggtgtgtaatacattccatgttctcgttctggcatcggaggcaaactgtacggtgctgcatcaacagtttgccgacgtcgccctaagcctcgagtctccacacttcgctgtagtatattaa

SEQ ID NO: 8229 - DNA, 337 bp, Glycine max
  Peptide Sequence Number=SeqID_99914
ctttcgaagaagttacggaaactcacggattgcgcaaaaacacctcttttcgatttctgccacattacggaatttcacggatcgcgtaagcctgcttccttttgatttccgacacgtctcgggacttcacatattgtgcaacaaaggatgccaagtatctcaaagcggcctaccaaaggttgcatgtcatcaaggcaaggtttatggtgagttgggactttggctcaaggcttgtagaacggatggacatgatatatgtcagggtgttggtctggccagtggttcagggataaaggggatgtcccacattatttccatgacacacatgcaacaatga

SEQ ID NO: 8230 - DNA, 645 bp, Glycine max
  Peptide Sequence Number=SeqID_99915
atgcgtattattctgctcggggcaccgggcgcaggtaagggcactcaggctcaattcatcatggagaaatacggtattccgcagatctccacgggcgacatgttgcgtgcggctgtcaaagccggcaccgaattgggccagcaggcgaaagccatcatggatgccggtaaactggtaacggacgaactggtgattgcgctggttaaagagcgtatcgcgcaggaagactgcaaaaacggcttcctgctcgatggtttcccacgcaccattccgcaggctgacgccatgaaagaggcgggcatcaaggtggattacgtgctcgagttcgccgtaccggacgagctgattgtcgatcgcattgtcggccgccgcgtgcatgcgccgtcaggccgcgtttaccacatcaaatacaatccgccaaaagtggaaggtaaagatgacgtgaccggcgaagagctgaccacgcgtaaagacgaccaggaagagaccgtgcgtaagcgtctggtggaataccatcagctgaccgcgccgctgattgcttactacagcaaagaagccgaagccggtaacaccgaataccacaaaatcgacggcacccgccaggtgaccgaagtgagtgcacagctggccgatatcctcggctaa

SEQ ID NO: 8231 - DNA, 581 bp, Glycine max
  Peptide Sequence Number=SeqID_99916
gttatggtcactgtcgggctctcattcgccgctatcgcgtgttcgagggcatctggggcacggacccgatcaccgtcaccggtccgggatggttgggtcagacgacaacagtgctcggcgcgaacatccccaacaagtactgggtgctcatcatcgccgcgggaatcgtactgaccgctctcgtcctcttcctgaagaagacccgctacgggatgatcatccgcgcgggcgtggagaaccgtgccatggtcacggccctcggcatcgatgtgcgccgctcattcacggttgtgttcgccatcggcggcgcggccgccggcatcggcggagtgctcgcgatgcacgcgatgacctacgtatccgcgcacctcggctcgacgctactgatcttcgcattcatcgtgaccgtcgtcggcggactcgggtctcttaccggcgccgccatcgcttccgtcctcgtggcggtattgcagcagatagcaaacacctacctcggaggcacaggggaccttatcgttgtcgcgctactggcggtggtattgctcgtgcgcccacgcgggctgatggggaggacagcatga

SEQ ID NO: 8232 - DNA, 281 bp, Glycine max
  Peptide Sequence Number=SeqID_99917
ccgacaaggaaagtgctgatgacactgtattggaaaagtacgacattagcaaggagaaatgggcccaattttgtctatcccgcagagatctttcgtgggaggatgtgcgaaaaaaggcacaggccatcccgaaacaaaacactacccctcacttgttgtctcgcgggagttatgaatatctagaaaacaagttgatggaggggaagagaaacaaaaaagtggaggaaactgctcaatctagaagcactaacaccgtgattggtattccatctcccatctga

SEQ ID NO: 8233 - DNA, 549 bp, Glycine max
  Peptide Sequence Number=SeqID_99918
atcatggttaggactagaggattaggtcgtgccttaggtcaggtcactggcagaggtctgggcagaggagatcgtgatgattccgatgatgctccgcagcgtcgacggcctactgcatccgcacagaggcaacgagtcgctgtgactgtggatcacgtcgatgagctagtcatccctgcgccagatgttcaggatgacccgatggaggcaccagctgttggatttccgggtggtccgagcgacccatccgtgttgacagcgtatgcggatcacgttgcttgcagcgtatggacgggagaggagcgtcctgaattgaagctatcctctcatgggaggaaggtccacagtttaggcaggcatgtccctgccattgagggacttattgctggtacaggactaagtcctctgatcgcgtgttcggtagacaccggcgatcggggacttttgtccgcgtttgtggagcggtggcaccgggagacgactagtttccatctcccggtaggagagctcaccatcgcattggaccacatctcctctgggatcctctag

SEQ ID NO: 8234 - DNA, 330 bp, Glycine max
  Peptide Sequence Number=SeqID_99919
cccgggggatccactacttctagagcggccgccaccgcggtggagctccaattcgccctatattcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 8235 - DNA, 1179 bp, Glycine max
  Peptide Sequence Number=SeqID_99920
atgacgaatcaagaggagtgggtcccgtttatggatgtattagcattgctaatctttagggttgtcctttttccaaacatggatggtttggtggacctagccgcaattgacgctttccttgcatatcaccatatcaaagagagcccggtggtagctatcttggcagacctttttgacacatttgaccgaaggtgcgaaaagagtagtgcacggatcatctgttgtttacccgctctttgtgtatggttggtttcacacttattgcaacaagacgtaaggcatccatgtctgctccgaagccattgctcgtgtgtcgagaaaagaagagtagattggaaccaactcttggctgggataggaggcagaatagtcaattggtttccacgatggaaagaaggaaatgagggttttctcttctcatgtggaagctacccaaacatcccattgataggaacgaggggttgcattaactacaatcccgcgcttgctataagacagttagggtaccccatgaggggagcaccgacggaagaaggcctgtctcctttccttgtgagagattttggcgcgcaaagtttcaagattggctccgccaagttaaagattatcaacgaagagaatttcgaagctttggaagaagatgaagaagtccgagctctaaaaaccgaactaggaaaaacgagacttgccaaagaaaaattcaagttggtcgctacagacgtccggaaagagtgtgccgggttacgagaagaaaatgcagctaccgcaaaagcccttgaacaagaaactaagagggctcgcaaggaagagcatggccgtgacaaattccgtggagcattgtggggaagcaacagtgagctcaagcttcgaagggaagagaaagaccgatcacgagcacatagcatggtccgtttgcgcgagacagagaccaacatgtttgctattatcacccagtaccaagaagaactaagtctagccacggcccatgagcatagggtggcggacgagtacgcccaagtgtacgcggaaaaggaggctagaggaagggtgatcgattcgttacaccaagaggcaaccatgtggatggaccgatttgctcttaccttgaacgggagtcaagaacttccccgattgctagccaaggccaaagcaatggcagacacctactccgccccctag

SEQ ID NO: 8236 - DNA, 258 bp, Glycine max
  Peptide Sequence Number=SeqID_99921
atggtcatgttgacatctgtcgcaacctactcttcggcgggaggacgacgcggggcttgcgggtgcgtcttccatgaaaggaaaatgcgcggggtcgccaccaacgtttattcgaggaaaacgttagaaaaattggaaaggtgtggtctacgaactttaagtgtgaaaggtttaggagttgtatttatgcacggggaagggtgtttcccttgctcctacgtattcctcaattgtgataaggaaatcagacctatgtag

SEQ ID NO: 8237 - DNA, 201 bp, Glycine max
  Peptide Sequence Number=SeqID_99922
atgtcgtaccggatgtcacgacatcacgcttcagaacatggagatcgtatgtgtccgtatgaacagattaaacaagtccaacacttgatgctagggtaccatcaaggtggctcacaaaagactcaagtcccaaaaactcacaaactaactcttcaatcccggacttggtacagaactcgtgcagcctccatgattatatag

SEQ ID NO: 8238 - DNA, 471 bp, Glycine max
  Peptide Sequence Number=SeqID_99923
atggataatgatatcatgcttaatccatatgtcatttggaaggaagacgaaggaagcgattttggtttggaacatgcttggcgacttttgaaagatcaattgaaatggttagggcagtttactaaaaattgctctaaaaggacaaaaaatttcgcatttggggcatattcattgtcatctaatccaggaacatcggtcgaagatgctaaggctgacacaccgtctccaattgtccgtccaatcatgtggaaaagagtaggaacatctaccaatcatgtgaacttgattggtgtggaggaagcaacgagggaaataaatgttctcgacactaaactagcagccttaaggaagaatgaattggaaaatgagtattacgacattctaatgaaggacacatctacaatgtctgaaactcaacttgaagaccatcaagccttttgtaaaataattaggcgcaaactaggaatctag

SEQ ID NO: 8239 - DNA, 201 bp, Glycine max
  Peptide Sequence Number=SeqID_99924
atggctcaaattggtgccaacatggcagccttctaccttggcaaaaagaattgccttcctcctcctactagcaataccattcttttggcccctattaaccgagctcccagcataagggatcctccaatggatgtcgcccctctaactgctaagaagcctatgggaaaggacaaacacaaaaacaaaaaagtgaagccgtga

SEQ ID NO: 8240 - DNA, 336 bp, Glycine max
  Peptide Sequence Number=SeqID_99925
atgagtgttgcacttagcaaacgctcgctaagccagcagattggcttagcgagaagaccttccaacaggccaattcaacaagggcctaacatctttcagaggactactaagctggaggagactttgactcagtttatgcaggtgggacaactacccaagcagatagctaacaagtcatccaacaggttcatggcgaatatagaaaagaatcccaaggaggaatgtaaagttgtgatgacaaggagtaagaggtttgtggaggcggaggatgaggatagtgttgtatccaagaagaaagctgctgaaaagaaaggtactgatgaaaaagaaagatga

SEQ ID NO: 8241 - DNA, 525 bp, Glycine max
  Peptide Sequence Number=SeqID_99926
atggagagaagccataacttcaacaatgggaagagatctcaagaagtttatcctacacttaaatgttataagtgtaatcaacccggtcacataaaggcaaactgcccctcaaatgagtcatggcacgagaagaatgagaagaaaagctataaagaaagaagatccaagaaggcatatattgcttgggatgataatgactcatccgatggttcagagaaggagatcaaccttctatccaaggactatgaaagtgatgagaacatctctcaagaaatgacttctaggaaaagaaaggcaccctctacacctacccaagccagatttgatagatccatattcacttctcaagaggcttgggagagatacactgacattgtggtgcctcgtaagcttttattagagaggaatgtggtagattactatttagagtttgataagttcaaggaggaactcgagagacgccattgggatgaggagttgactgactttgtggacgacaatattgatgtttccattgtaaaataa

SEQ ID NO: 8242 - DNA, 1802 bp, Glycine max
  Peptide Sequence Number=SeqID_99927
agatccataccgatctctggaaagctgcagaatcagatgatctgaatgataccatcagctatgcggatatcaatgatattatccttgaggaaatgaaagttaaatcaaaacttctggaacatgtggccggaagaattatttcaaaaattaatcaaaactttcctgaggtttcttatatcaagcttaaaatcaccaaaacagctcctcctatgcagggagaaatgaaagttgacaaccaactggctgattataattttccaaagataaaatccagcattaccatgccggttaccattccgcttgctgaaattggtaatatcatcaattcttcagtaaaagaattgatttatcaggatgattcctacacggataacaacaatgaccagtttaaggtaaaagtatggaaaacccggcctatacgacttgtagggggaacgaatcaaaaccttttaattgaagttcctctgaaaatatgggcagagaaagggattggtaccctgggactttatacttaccagaatactacatttgaaacggtaatgtatttcaacacctcccttaatttcaaaaataactggactattgttaccaatacgcagcctatgggattcaaatgggttaccaaaccggttcttaattatggaaaagtacagatcccgattaccgcacttgttgaaaaaagcctgaaagagcaacaactgaaattttgcaaaacaatagatcagcaaatgggtacccagcttaatttccagcaatatgcagtgatggcctggaatgttttcgcgcagccttttaacatttcggaggaatacaacacatggctgaaagtaacccctgtaaatgtaaatattactccattgaaattctatggaaatcagattgatgccaatatcggaattgacatttactccgaaacctttaccggaagtaaaccggcatcttcagctcctattaaaacggcagctaacttcaatttcacccctgtacttggagaccagttttcgcttcagacaacagccaatgttccttttaccgaagcgtctaatattgccagaaaaatgttcctaggaaaagaatatgatgttcgcgattctaaagtaaaaattaccgatatcagggtatacggcattgagaacagaattatgatcgaagctcagaccgaagggtatataaaaggaactgcacttatttcgggcattcctgtttatgatgatgccaggaaaaaaattgtactgtccgatactaagtttaagctgaagacaatgaatatcctccaaaaaacagcaagccttctatttcagggaaaaatcgtaagaatgatagaagaagaatatggtatcccaacacaggaactggtggatacttcaaagaaaagtattgaagaagcttttaataaagaatattataaagggctaaagatgaatggaagggtttttaatctgaagccaggccagatccttctcggtgtattgggaattgcctatgcatttattacaggaaataccgtagaagaaataggttatagaatggaaaatatgaatcctttactggaccggctgatcaccttatccgcttaccttctgatgatgttcttcacagagctgatcacccagggaagaagcttagggaaactgatcaccggaacaaaggtggtcatgatagacggaacctctcccggtgcagataaaagtggattccatgataaatggagtgaaacctgcgttgttgtaaagaaaaattatgaagctgagttacagttaaaaagcgatataaacacgttgggaactaaagaaaatatctaa

SEQ ID NO: 8243 - DNA, 856 bp, Glycine max
  Peptide Sequence Number=SeqID_99928
atggcgcgcacccgccgcaccctgctgcaaagcgtggtctctccggtcatttccacctcgctctattttatcgtgttcggcacagcgatcggttcgcggattcaggaggttggtggggtttcctatggcgctttcataacgcccggcctcatcatgctgacgcttctgacgcagtgcatcggcaacggctccttcggcatctacttcccgaaattcaccggcaccatctatgaaatcctctccgcaccggtggcgatgacggaaatccttgtcggctatgtcggagcggcggcgacaaaggggctgatgatcggtacgatcatcctgataaccgcgtcgttcttcgtggatatcagcatcgcccatccgttcatgatgatcctgttttttgtgctgacggctgtgagtttcagcctgttcggcttcatcatcggcatctgggcaacaaatttcgagcagttgaacctcattcccatgctggtggtgccgccgctgaccttcctcggcggcagcttttattccatcgacatgctgccgcccttctggcagacgcctggcgatgatcacgctgtttctggcgctatgcctaggcgttgtcggctggatgttcaagacaggcacaacgcgagcgcaggatcaggcgacctgcttctgcgccacttcctcgacaacctcacccttgagataagaaacgaggtccttgatcgtcacgaccagcaggccgtggcgctcggcaaagacttcgagctggggcaggcgggccatggtgccgtcgtcattggcgacttcgcagatggtgccgcaggggaatttgcccgccagacggcaaatatcgacggccgcttcggtatgaccg

SEQ ID NO: 8244 - DNA, 662 bp, Glycine max
  Peptide Sequence Number=SeqID_99929
tgatcgatgacccattaccacagaactggcaagaattgcagacaggtgtccaacggatattccgtaatgtgggcttacttgcagaagttgaggtcgatttagaaacaccgcgtggctcggtgaatgtggatgttctcgcgacagatgttaggagtgtggacaaaatcagatacatcgtggaatgtaaaaactgggcatgggcttcagcaaggtacttttgcccacgtatcggcgatgctgcagacgaaccgcttcaatatgttgaacctgtcaactataagcgcgatcgcgaatatgccaaacttaaccttcgagaacaagagaagttcgatcggttaaggcaagagaaaggtgtatcagtaatggctctctctatgcttaattacaggtttatgtcgaaagctttaaacactggcaacttgctgaacgtcccaaagagtctggatgattttaagaccagagttctcacccaaatttgtcctcacatggaatggcattgtgatacgtacagagagctgctagaaattatcttagaatatttatcagacaccaaagcagagtttgatgcgatatttggtgggactatctttgaaccgctagggactatcacgggggttactgccgctggcccctctctggatgatggtatttatcataattaa

SEQ ID NO: 8245 - DNA, 584 bp, Glycine max
  Peptide Sequence Number=SeqID_99930
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatgggcttacgaacgggggcggagatttcctgggaagatgccagggaagatactttaa

SEQ ID NO: 8246 - DNA, 66 bp, Glycine max
  Peptide Sequence Number=SeqID_99931
aacgttttggaagttgggttgcttaaggaggaagcaactgagcggcaagctcctccacgtttttga

SEQ ID NO: 8247 - DNA, 447 bp, Glycine max
  Peptide Sequence Number=SeqID_99932
atgacgcatacacagcatgcgattgaattgggaaacggcatcgtcaacattttgaatggatgggggctgagagtgaaagtgagaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 8248 - DNA, 129 bp, Glycine max
  Peptide Sequence Number=SeqID_99933
atggtcattgaccaatccctcttctatgatttgactcaattgtctagcgaaggtgcaccatttgaaggaattaatgaaacattgggcttaatccggattttggttatggacttgaagagggcaaattaa

SEQ ID NO: 8249 - DNA, 934 bp, Glycine max
  Peptide Sequence Number=SeqID_99934
catgttaaacatcctggttaaaaacatttccaagcgcctgcccgatgcctggcaccatcaggttaaatacgcgctctatttcaagaagctgccgcacctgtcaaagccgaccggcttcagcgaaaagatcatgcgccgcaaaatttacccgcgcagcatctacaccaccttgtcggacaagttcaaggtacgtgaatttatcgccggtctgtggggcgaggagtatctggtggagctgtatgcgcatggcactgaactcagctacgacatgttcaggcaattgcccaacgcctttgtgctgaaggccaaccacggcagcggttataaccggttggtgttcgacaagcggcaggttagctacgcagagttgtacgatctcagcaacgcgtggatgcgcagcaacttttatgagcagagtcgcgaaaaacattatctggatatcgaaccctgcatcatggtggagcgcatgttgctggatggcgaacaggtgccgaacgatatcaagtttcattgtttcaacgacaatcatgaaattcgcatgttcatccaggtggattatcagcgtttcggcacccatcggcgcgatatttttgatatcgactggaaccgcaccgaaatccgcatcagcttgcccaatgccgacgaaccgatgccgcgccctacgcggctggatgaaatgatacgtttggctcgccagacggcgcagcagttctcttatgtgcgcgtggatttctaccaggtcggcgagaaggtgtatttcggtgagttgacgtttacgcctggtgcggggctaagcaagctgatgccgaaaaacattgagcaggaatggggcatcgcgggatttgatcaatcaatccatcgtattgaccttcctgctgatgtttttcgtgaaaaccttcctgacctcgggatcgttcaacagcgagctgattaa

SEQ ID NO: 8250 - DNA, 224 bp, Glycine max
  Peptide Sequence Number=SeqID_99935
gatagtcttagttggaaaagctctcattgatttgggagctagcattaatttgatgttgctatccatgtgcagaagaattggagagttggagattatgccagtgcaacagtttaccttctctgcgaactttgttgtcatggacattgaagaggatactgagatcccactgattttgggtcgtccattcatgttaatcgccaattgtgtggtggatatggggaaag

SEQ ID NO: 8251 - DNA, 579 bp, Glycine max
  Peptide Sequence Number=SeqID_99936
atggataacgaagagggactgcaagaacagatgaaggtcgacatgtcagccttaaaagatcagatggcttctatcacgaaagccatcttaaaaattcaaaaatcaatagaagacaatgccacggcagccgcttccaatacagctaaggaagcagaaccggtgctacagcccacaataaacttgggccgagacaaaaacgcgacgggtttcaatcggaggtatagtcctcaagcctacccttatggtttgcctccagacttcacttcttgtaccgctccagacgatttgagccaagcccctaccttcgaggggcaactccctcctcatgccgactatcctctacaggaagatgatgaaggagatgcccatctaggccctctacttcccctcaaggagccggccccccatgagttgccccaaccaaacatgatccaccatgccccgtctcaatccgcacccgttaaggaactcattcccatttcaaaagacaagggaaagatcgatctacttgaagagaggttgagagcggtggaaggcctcggcaactatcctttctcggatttagccgatctgtgcctg

SEQ ID NO: 8252 - DNA, 468 bp, Glycine max
  Peptide Sequence Number=SeqID_99937
atgggatgccaccagttcggggtctttaatccagacttcccgctctacataaagcatgaagacctctccgaaatcgcacacagtgatcaatgtctcagcatatcagtgttacagttgtggattttgcatctgactgaaacaagtatgccagcagggaattctgatatctatggattcctcgagccacagtccattcagaggtctgggcaatcgcagtttgagactggaagctacataaagagttggatgcagagttcaaaacgcaatgtctatcttggagcctacctgaatggcggacactggcagatggtggtcattatgcccaacgaacacctagttgtgtggttttgttcattgcataacaagccagacaactaccttaagaggataattaatagtgctttaaaaggtcttgatgatgctccacagcctaaatcaaaggctcctgctaggtggattgtcatcaag

SEQ ID NO: 8253 - DNA, 821 bp, Glycine max
  Peptide Sequence Number=SeqID_99938
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtctgttcttacctcctccagcttttgatggctccagatgttcctcagcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 8254 - DNA, 246 bp, Glycine max
  Peptide Sequence Number=SeqID_99939
atgggggtgcaaatagcaaccaggcccacttgggccttccaggatgttcctccagaaggcggttgcttctggaggaagcaacctagctcggctgggcgagctggaaaatccaagccgaatcgcttccgtaatgcttccgtgggtgatttcgggaagattttcaactgttcttcgtcgttcgtcgttcgttcttcgtcgttcttcggtcttcaaccgatttctaaaaggcctaaaatcaacatgtag

SEQ ID NO: 8255 - DNA, 189 bp, Glycine max
  Peptide Sequence Number=SeqID_99940
atggtgaaagttggaacctcttacgtgccgatcaacgtctcattttcgccaaaagttggcccagggcttcccggtatcaacagggacaccaggatttatttattctgcgaagtgatcttccgtcacaggtgctccaagtggcttctgtttctatcagctgtccctcctgttcagctactggacggggtg

SEQ ID NO: 8256 - DNA, 305 bp, Glycine max
  Peptide Sequence Number=SeqID_99941
ttgagaagtattgcacgcagagacaggcccagggggatgctccgcaggtcgcagacgcgcccccacttcatcaggctggcccagctggatcatttggtacggagcagtatttacggcatttggttcgccagcaggcggccaaccaccgggcgcatttcatggcagaggtcgcatggcccggagattggcctgaggcccgggcaggagaggcaccagcagaggctcccgacgaggcatgtgaggcccgcgaggacgaggagatgaccgatttgcttgatttattggaagggagtggagcctcatga

SEQ ID NO: 8257 - DNA, 1816 bp, Glycine max
  Peptide Sequence Number=SeqID_99942
cctgtatcagcgtctgatccagtccgatccgcacaaccctatcgatctcaagccaaccctggccagcagctggcaggccggcgccgacaatcgcagcctgactttcagcctgcgcccggacgccaggttcgccagcggcaatccgctgcggccggaagacgtgatcttctcgctttcacgggtggtaaaactcaatctggagccgtcgtttatcctgacgcagctgggttggaacgcgaagaacgtggagcaacacctgagcaaggtggatgaccaccaggtaaaaatcagctggagtgaaaacgtcagcccggccttcgtgctcagcctgctgtcggcgccggtatcgtcgatcgtcgacgccaaagaggcgctggcgcaccagcagggcgacgatctggggcaccaatggttgaacagccactccgccggcagcggcccttacaaaatccgcacctatgtgccgcacgaggttgtggtgctggacgccaacccaggctcgccggaaggggcgccgacgctgaaaaccatcctgatcaaaaacgtgcccgatccggccgcgcgccgtttgctgatcgagcagggcgatgccgatatcgcgcgcaacctgggggcagaccagatggcggccctgaagggcaagccgggcgtcaaaccgttggccattccttacgcctcgctttatttcctgcagttcaacgccaaggcgtcgccggcgctcggcaatccggcgttctgggaggcggcgcgctggctgttcgattaccaaggcatcgccgacgatctgctgaaagggcagttccagagccatcaggcattcctgccggacggttatctgggtgcgctcaaggatcagccgtacagcttcaatccacagaaagccaaagaaatactggccaaagcggggctcagcaacgtcagtttccgtctggacgtcaacaaccagccgccgtacctggatatcgcccaggcgctgcaggccagttttgcccagggcggcgtgaaggtggaactggtgccgggcatcagctcgcaggtctccaccaaggtgaaagcgcttaactacgatgcgacgctgacttcctgggggccggattatttcgaccctaacaccaacgccgcagccttcgcctacaacccggaagacggcagcaagacgctggcctggcgcgccaactggcagatcccggcgctgagcaagctgacgctggccgccaccgcggaaaacgacaccgccaaacgggtggccgactaccagcaactgcaaaaacaggtgcagcaaagctcgccgttcgtcatcggcctgcaggcgcgcagcctgattgcgcaaggtcagcaagtaatggccgctgaactgtccgcctccgccgggacggcccggcggtattggcgctggggcgggcggctgctcggcggcgcgctgtcgctggcgttgacgttgcttggcctgctgctgttcaccttcatgctgtcgcatctggcgccgatcgatccggcgctgcaggtggcgggcgatcatgccagcgaagccacctacgcacaggtgcggcatgagttggggttggatcagccgttgccggtgcagttttggcgttatctggtgcacctggcgcacggcgatttgggcatttcgcgcataaccgcccagccggtgttgagcgatttgctgcgtaccttcccggcgacggtggagctggccacctgcgccattatcctcggcgccctcggcggcattacgctggcgtttctggcggtgctcaaaccgggcagctggctggataacgcggcacgtctgctgtcgctgatcggttattcg

SEQ ID NO: 8258 - DNA, 240 bp, Glycine max
  Peptide Sequence Number=SeqID_99943
atgaggcttcactgttatcaagcgagtcagagacccaacatgaccacagatcaacctccactccttgtggctcacatatactcgagcataaggcctaatatctcaatgttccccagtggagtcgccaactgtcgcaacctacccttcggcgggaaggggaggcgaaataaaaaggtgggtcttctcatgaagaaaacgcatgggagtcgccaccaacgtttattcgaggaaaaacgttag

SEQ ID NO: 8259 - DNA, 423 bp, Glycine max
  Peptide Sequence Number=SeqID_99944
atgaagcacttcactgacaccctcatcagtgccaacataacatggtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 8260 - DNA, 284 bp, Glycine max
  Peptide Sequence Number=SeqID_99945
aagcaaaggaatccattgatgaagaagatcctaggcctacaagctccaatggagcttacatcactaacttactcccatatctactcaataatgcaatggtagccataatcccaacagaggttcctcaacctccattttctcgaggatacaactcgaatgcaacatgtgcttatcatggaggagttccagggcattctattgagcattgtatgaccctgaaacataaggcacaaagtctaattgatgcaggctggctaaaattcgaggaggataagtgcttgtga

SEQ ID NO: 8261 - DNA, 630 bp, Glycine max
  Peptide Sequence Number=SeqID_99946
atgattatgaggggccaagacatttatagtagccaagatgaggctactacttcaccttcctctagtaaaagtgaagaagcaaaaggggaagaatctaataaagagatctacccccatgaagaaggacaacctttaatggttaaggaggagtgtaaggaggtaagtgtctcctccaagaggttagctaagaaggaaagacattttgaaataaagacaaatattaaagaaatttcccctcttagaaaatctccacattttctcctttgtaaaaagacacttgttagcattgccacacctcttaggcttgagtttattcctcaagtaaaggagttgttggatgagggtttggtttgcaagagcttaaatccttgtgctttgttggtgcccaaaataggtattattaggcaccaaatccctatgataggtgatatgatgaatgtgttgagtggtgcaacactcttttgtaaaatcactcatgcacccaacatcttcctgatttgtgtacatagggactcattaggtaggaataatcaacatgaaaataaagaaaaaggtatgttttattccattactttccttacctttttaaaaagtgatcaagggcttcccatggaccttaagagaataaag

SEQ ID NO: 8262 - DNA, 258 bp, Glycine max
  Peptide Sequence Number=SeqID_99947
atgaaaacgagtcgtgacttggttgaatcatgctggaatcgagcatggtggcaacttgcttttccaattcttccttccaaaaatatgggtactgatatggaggtggatgtggtgggtgatgactcgggttggtgggatagtgtgagatcaatggcagtagaatggagaaggatgaaaggtgattggagatgccacttcaaggagaagatgagtcaagaacaaactcaccaccataggaagccatggataagagcttga

SEQ ID NO: 8263 - DNA, 573 bp, Glycine max
  Peptide Sequence Number=SeqID_99948
atgaaaaccgaagacaatatggcacaaaaatccgctaccgacggctttgcgccagcggtgcagcccaccgcagccagcaccatcattaccgccagcgatgccattcacgcgggcgagacgtccgtgccgagccagggtgagaacctgccggcttattatgctcgtccgcaacagtttagcggcacgctgccggtcgtgctggtggtgcaggaaattttcggcgtgcacgagcacatccgcgatctgtgccgccgtctggcactggaaggctatctcgccgtggcgccggagctctatttccgcgaaggcgatcccaacgattaccacgatatccccaccctgttcaaagagctggtgagcaaagtgccggattcgcaggtactgtcggatctcgaccacgtggccaactgggcggcgcgtcacggcggcgatatccgtcgtctggcgatcaccggtttctgctggggcggccgcatcagctggctgtttgccgcccataatccgcaggtgcgcgccgctgccgcctgtggatttgaatgcaccggtgctgggcctgtacggcggccaggatga

SEQ ID NO: 8264 - DNA, 156 bp, Glycine max
  Peptide Sequence Number=SeqID_99949
atgaaggactccttgaagcaaagttggtacattgatagcggttgctctaaacacatgacgagagatgcatcaaagtttattcatatttctcccaaaaatagtggacatgtgacctatggagacaacaacaaagggggagaaatagataaaagataa

SEQ ID NO: 8265 - DNA, 117 bp, Glycine max
  Peptide Sequence Number=SeqID_99950
atgttggctgaaaaatatcaggtgtggctttacaacggccgatgtcgtctattgagtggatcgtttgatacaggctacggaggtttggatgacgccacttccggtgaaggaagataa

SEQ ID NO: 8266 - DNA, 1299 bp, Glycine max
  Peptide Sequence Number=SeqID_99951
atggcatctaagaaaagaaagtcccctgcctcttcatcctctcagatcagatttgacagatcaggattccattctcaggaagcttgggacaaatataacgataatgtagtgccaaggaaactactactagagagaaatgtagtagtatacttcattgagtttgatgagctcaaggaggaactcgagagaaggaaatgggatgaggagctgactagttttgctaaaggcaacatcgatgttgccatagaaaaagaattctatgcaaacctctacgacctggaagacaagtcacctaagcaggtgaggtccagaggtcatctgattaaatttgatgaagatactttgaataccattttgaagaccccagtgattgtggaaaaaggggagaatctctatgcttattctaggtttgcactcctgaagcctgatcctcaggagttggctgctaggctctgtatcccagggagaggattcgggctaaacgctgatggtcagcctttgaagatattaaggaagaacatgaccactttagctcagacatggagtcttctttccttctctaacttgattcctacctcctacacatctgatgtcacattagacagggccaagttaatctatggcatcatcatgaagatggatatgaatgtggggtacctcatctcccaccagatctctattactgcacaacatgattcctccagacttggattcccaaccttgatcatagctctgtgcaaggctagaggagtccaatcagattctagatccctggagagcctgagccccgccactaacttggcatacattaaaaagagctcaccaaagacagttgcaccttcttcatccacagctccaacacctcccagtttgactcctgcaccttcttcttatgctccatctactcagataccacttccaactcgtttatcttttggaccctcagattttttgtttactccagagatgtttcattctatgctccagagcttacacagggggcagatcattatcatgcagagtctccagagctcaggcctgccatctattatgagcactgatgaattcctgatgcaggtggcctggccaggagcccagccttctccttttggagggggtggggccttcgcagcccaggagcctaagccagaggagcccgcaatagcagctgaggagacatcaaagggggaggatgaactcactcctcctgagcccttttattatgatacagatgacccaacagctgctccggtgttggatcttaatgagaatgtagaggatcacccgcaggaggattga

SEQ ID NO: 8267 - DNA, 384 bp, Glycine max
  Peptide Sequence Number=SeqID_99952
atggcctttggaacaatggcaacttgccctagcgagctaatgcttcatcatgaacgagaccaaaccgctaagcgagacaacaatggcttagcaattgaggataagcctgaagagagttcgtccacgccagcacgcgcacaatgcctatctctagaatactttccattggatttaatgatgaaatctgttcaatttcagctcaccatttgggctcagcacacatccatcgttaagcgcaactttagcgcaacagaagaatctggcagcgcatcaatatcaaggccgcgcactaagcgtgagatcagtgtgctaagcgcaacagttgtcttcagtcaggctctgcgcatgactggtgctaagctcaaatccacttactcgcgctaa

SEQ ID NO: 8268 - DNA, 450 bp, Glycine max
  Peptide Sequence Number=SeqID_99953
atgaaagctatgatggaggctatgatagagaacgtaaccaaaagcatagtaaaacaacttcagctgttgataccgtcaaaacaaccaattctctcatgtgaagaatatggaggcaaccaccatgcctgttactatatggaggaagtagccaaggaaaccaaattcatgagagaatgcactacaaagttagaagaaattgtaatcaaccttagcatcacatcttactccaacctcgagaacatcgtgaagttgtatcttcacaaaccaacaaagcaagacaagaagcggcgatatagaaggcttataaacttgatcaagcaacttgatgtcaccattcctttcactaatgccatagacatgatgctggaatactcaaagttcttaaaaaacctcataactaagaagaaaagtttgaaagactatggtgtagtgactcttgaagaggattga

SEQ ID NO: 8269 - DNA, 225 bp, Glycine max
  Peptide Sequence Number=SeqID_99954
atgcaaagagtgggtctcgctaagcgagccacctcgcttagcgcaattctcataaatgcaattctagacaggtttgcgtgcttagcgagtggctgtgctaagcccaattcgaaagaattgaaatctagagaagtttttaggcttagcgtggagcacgcgcttagcgagaccactacagccaatggtcaggggttaaggtgcatagcgcaagcacaactcgcttag

SEQ ID NO: 8270 - DNA, 228 bp, Glycine max
  Peptide Sequence Number=SeqID_99955
atgtcaggattcacaagcgattctcctcaaattttagccagcccgcatcaattagaccttgcaccttatgctttagggtcctgcaatgctcaatggaatgccccagaactcctccatggaaagcacatgttgcgtttgagtcatatcctcggaaaaatggaggttgaggaaccttggctggggttatggctaccattgaattatcaagtagatatgggatcaagttag

SEQ ID NO: 8271 - DNA, 712 bp, Glycine max
  Peptide Sequence Number=SeqID_99956
atggttatgggagatttcatcagcagactctccttccccgaaaacaccgggactttttcaagtctcacaagttatccagaactacgtaggtctgagttcctcattggaggatacgtaggagcaagagcctcgcttttgtcgatcataccgccttttgttatgactcaagagctggtagcccgcggagacaccttacggttatccgcacctcgtcattcagtgaccccaagtgtgattgatgagcagaggccaatgtggtcatctggccttttccggagatgtcagcattttccgatggagacttttcaagtctcacaagttatccagaactacgtaggtctgagttcctcattggaggatacacacagtcgtgtccgatggcacgcagagaccaagtttggtcattctgcacccatgatacgcggagataccttatggttattcgcaccccttttgtcatccagaggcggcgggcccgatgacaagcagagaccaaagaccaagtttggtcgttctgcacccatgatacgcggagataccttatggttattcgcaccccttttgtcatccagaggcggcgggcccgatgacaagcagagaccaaagaccaagtttggtcgttctgcacccatgatacgcggagataccttatggttattcgcaccccttttgtcatccagaggcggcgggcccgatggcaagcagagaccaa

SEQ ID NO: 8272 - DNA, 240 bp, Glycine max
  Peptide Sequence Number=SeqID_99957
atgggtcagctccaacgtcaagccttctgcaagacctatgggaagatttgggacctagctatggtagaagtctccatggaagcaattgcatcccttactcagtattatgatcaacccctaaggtgcttcacgtttggggacttccagctagtaccgactgtggaagaatttaaagagatcctgggatgtccattgggaggaagaaagccttatctcttttcggggttctacccttccatg

SEQ ID NO: 8273 - DNA, 696 bp, Glycine max
  Peptide Sequence Number=SeqID_99958
atggcatctttcagccagatgcagtcccagtttcaatcccagatgcaatctcagggacttgcactacctccagagcctatggttggtccatcaggtcctcgtgtcagcacaaaggagacttgtgttgatccttcaggcaacaatcttgagatgggtgactcagacaagtgcgggttgtacatcgaagcaaatcctccccgcctggttgccttaggaagagtttatgagggatcaacaattcacaacattcctttgttgcctggccaagtgaaggttggtgttgaggaggttaaagatgcacaggctcccgttcctgtacccactgatgaggttaccttagtggggcaggcacttaacaccttccttgcttggccgacacatctcgtgaagcctttatcagaacatgttaactgggatgctaccatgttcgaggtgtttaatccaaacttcctgttgtacataaagcatgaagatctctctgaaatcgcacacggtagtcaatgtctcagcatatttgtcatacagttgtggattgtgcatttgactaaaacaactatgcgagcggggaattccgatgtgtatggattactggatgcacagtctattcagagatctgggcaattgcagtttgactccgaaagttacatcaagagttggatgcagagttcaaaacgtgatgtctaccttggagcctag

SEQ ID NO: 8274 - DNA, 174 bp, Glycine max
  Peptide Sequence Number=SeqID_99959
atgcaacacaaaccaaaagttcagaaagcaagcgcaaaaaagagaaatagtgaacggagtgagcacacgagagatggaggtgacaacacacaggctaaagagcaaagaagcataaaagagggtttattattggacatgtggcaacacacgggaatgaggaaagtagaagcataa

SEQ ID NO: 8275 - DNA, 596 bp, Glycine max
  Peptide Sequence Number=SeqID_99960
tttctatccaaggggctaggagggcgagggtgaggccagctgatcttccttccacatctgcagttcctactccaccatccacttcagtagctccttcagtcctagctcagactgattctcagcgctttgaagccatgcttcaaagccttcatcagggacagatcattttacttcagagtttacaggtggtggtgcctccaggatccattccttccattgagcagtttctagagagggtagcctggcctggggcccaatcttctcttcatagggaagatgaaggtcccacaacccaggtaccacaacatgtagaggatgcgtcatctgaggccaccattctagagccattcattgtaaaggaggaggcaggtgagacacaggttagacaggaagctggtgctactcctaagaggtcacgagaggtcacatcagatccacccacaccagtggtggacctaccctcacctcagcatgcagcagacccctccactcctatactcgagataccagaggactcgaccacaccagtcatgactctgaacacttctcctccagctacttcagtacttcatttgacagatgaagagggtgtttag

SEQ ID NO: 8276 - DNA, 345 bp, Glycine max
  Peptide Sequence Number=SeqID_99961
aaagtttatacggataaccacttgggtatttccgcccgtcagcgtgactcaaatgtcagtatgacagatcttgtgagcgcggaagatgaccaaaagaaagtttatacggataaccactcaggtatttccgcccgtcagtgtgactcaaatgtcagtatgacagatcctgtgagcgcggaagatgaccaaaagaaagtttatacggataaccactcgggtatttctgcccgtcagcatgactcaaatgtctgtatgacagatctggtgagggtggctgacaaaagcgaggctcttgctcctacgtatcctcaaatgaggaactcagacctacgtagttctggataa

SEQ ID NO: 8277 - DNA, 243 bp, Glycine max
  Peptide Sequence Number=SeqID_99962
atgggtgccaagtacctcaaagtggttaaacgagggtcgcatcccaacaaacagatggcgcagaatgaccataatttgtctctgcgtgccctcggacacgatcgagcctggatggcaaggcgcagaatgaccataatttgtctctgcgtgccatcagacacaatcgcctctggatggcaaaaaggtgtggggaatgaccataatttgtctccgcccatctctcgactcactgtccctgaatga

SEQ ID NO: 8278 - DNA, 165 bp, Glycine max
  Peptide Sequence Number=SeqID_99963
atgacaagctacggaggtttggatgacgccacttccggtgaaaggaagataagtcagggtagacgccacaaggattaccttgataagtctgagattggttcaacaaggaactcagagagaaactctcaccaaattttatcaaatgtcaaaagggggatcctctag

SEQ ID NO: 8279 - DNA, 843 bp, Glycine max
  Peptide Sequence Number=SeqID_99964
atgcacgccctagcctttagaggactgcacatactaacgttcagaggtgtacacgttgttacctttagagggctgcatgtcctcaccatcagagggttgcacgtcctcgccttcagaggactacgcgtcctcgccttcagagggctgcatgtcctcacaatcagagggctgcacgtcctcaccttcagaggactacacgtcctcgccttcagagggctgcatgtcctctccatcagaaggctgcacgtcctcaccttcagagggctgcacgtcctcaccttcagagggctgcatgtcctcaccatcagagggttgcacgtcctcacctttagagggctgcatgtcctcaccttcagagggctccacgtcctcaccttcagaggactagacgtcgtcgccttcagagggttgcacgtcctcaccttcagagggctgcacgtcctcaccttcagaagactagatgtcctcgcctttagaggactacacgtccttgccattggagggttgcatgccctcatcttcagaggactacacgtcctcaccatcaaagggttgtatgcctttaccttcaaaggagaacacgtccttgccatcagagggctgcataccctcaccttcagaggattacacgtcctcattttcagagggctgcacaccctcgccatcggagggcgacatgccctcaccttcagagggctgcaggccctcgcctatagaggactactcgtccacaccatcagagggctgcacgtcctcaccatcagagggctgcacgtcctcaccttcagagggcttcacgtcctcacctttagagggtgcacaccctcgcctttagaggactag

SEQ ID NO: 8280 - DNA, 183 bp, Glycine max
  Peptide Sequence Number=SeqID_99965
atgccttgcaaatatgggatggctccgaagaaactctccacgaagaggtctagaaaggacgccactggagaaggcttcagtgccacctcagagtttggtagtcaccggtttcggagtgccgagcaccagcagctcttcgaggccatcaagggatggtcattccatagggagaggcgtgtctag

SEQ ID NO: 8281 - DNA, 175 bp, Glycine max
  Peptide Sequence Number=SeqID_99966
atgatgataacaaaagatgatgacaaaggtgatgacaaaaggctcaaagatcaatcaaagaacaacttaagttcaagatctcaagaatcaagattcaaggttcaagatctcaagaatcaagatcaagattcaagactcaagattcaagaatcaagagaaggcttaatcaagataa

SEQ ID NO: 8282 - DNA, 179 bp, Glycine max
  Peptide Sequence Number=SeqID_99967
caaggagcagaatcgtctcaggccacggtcagaagtcaagacaagccaatggcagaaatcaaccaaggtacatagggacggatgcaagtgaggatggggtcacgaccgaccaatcgttgccccttcccggcgctaaacgagcagagaacgtctctgcaaggcagcccagtatcatttga

SEQ ID NO: 8283 - DNA, 237 bp, Glycine max
  Peptide Sequence Number=SeqID_99968
atgaaaagatgcaaagacaagttgaatctaacaaggaacaagaatagaatcacggttacctcgaagaaaaccgtgaagggttcctctcggtgtggggtttcaacggagagctatgtcgattcgtggtggctactggtggttgtgggtggtaaagaagaagcttgggatgttggggaagggttttggaagaaagaaggagaaaggaagggctgttttcctaggctacacgaaaaataa

SEQ ID NO: 8284 - DNA, 480 bp, Glycine max
  Peptide Sequence Number=SeqID_99969
atggcatctagccttattcgtgtgcactgggatgatttaaccgaagccacccctgcttttatcactgcagcgatgatgccatttacttattcaattactgaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 8285 - DNA, 243 bp, Glycine max
  Peptide Sequence Number=SeqID_99970
atgtctttagaatggaaggtggtttctggcataaaatggatgaatgggatgaaatatagaaatggaaataacggaagctacagggctccaaatgaggtgattctaaaacgagaggtggattttctggaattgtggtttgaaagaacaagggtggagatgataggaaggaaagaatcactctttccagcgagggcaacacacaaaggttgtgaaagtcctttgatacagccagggtgttcttga

SEQ ID NO: 8286 - DNA, 251 bp, Glycine max
  Peptide Sequence Number=SeqID_99971
tgacttcttttggataccataaggatcggaatggtcaacaactgaagaaagatgcactccctcctcaagatgagcgtactccttctcctcctcctcagcgagatgattcagccctcatgactgaagttctttccgcgttacggggtctttgttcttatgttggtgaacgtttcgactcgttggatactcgctttgccggaatggatattcgtctcacacagcttgaagaagatgtgggttacattcgttag

SEQ ID NO: 8287 - DNA, 771 bp, Glycine max
  Peptide Sequence Number=SeqID_99972
atggttccaaagaagcttccagccaagaggtccaggaaagatgtcgttggagaaggttccagtgtggccccacaggtggacatggagtttgatgggcacagaggaaattgctcagaggcaatggtgtcacccacgactaagtacgacccagagatagtcatggatttttatgccaacgcttggcctacagaggagggagttagagacaaatgctcctgggtgaggggccagtggattgccttcaatgaggatgccatcaatcagtttctggggcatccactggtcttggaggaaggccaacattgctatcaaccagttgttgtgcgttctggggctggactttgccctgagcgtagcagggagatggggatcacacctcctcgacacccattggacccagagaagtccaatagggccctgggttcaagcgctacagcaaccaaaggaggaccagcaacagccagctgcaaacgcaccattgccgcctctacaggaggtaccatctctggagtccatctctggtcacttgctgaggatagaactccagatgcacaactaaatgagacattctactggtacaatatgcaccagcagagtcaggaccctagtcctttcccttggcctacctcggagcagtttggggccacacttgtctggcccggaggtgaggccgattttgagacacggacaggacccacaggggcccttgggacgacagaggagctcaagaggatgacgatatggccgacatgctggatttcttcactttag

SEQ ID NO: 8288 - DNA, 756 bp, Glycine max
  Peptide Sequence Number=SeqID_99973
atgtttatagatgggctgagaccacaaaacaagcaactgttagatgcttctgcaaagggaaagataaaaatgaagaccccgaaagaagcaactgagctaattgagaacatgtcagctagtgatcatgccattctacgagatagaacccatcaacccatgaagaaaagcttgataaagctatcatcacatgatgctttattggcacagaacaagttgctttctaagcaacttgagattttaacagaaacactcggctttcagcagtgtctctataatcaacaaggacagtggaggacacaccctagtaaccagttcaacaaagaccagagtgggccttcaaatgggccaatccaacaaggacctaacatattccaaaggaatactaagctggaagagaccttgactcagtttatgcaggtaacaatgtcaaaccataaaagcactgagtcaacactgaaaaaccttgaggtccaggtgggacaactagccaagcagatagctgacaagtcatccaatagttttgtggaaattacagagcagaatcccaaggaggaatgcaaagttgtgatgacaaggagtaaaaggtttgtggaggctgaggatgaggatagtgttgtgcataagaaaaaaactgctgacaagaaaggtactgatggcaagaaaaatgaggtgagaggtgaaagtaatcaagaaaaagaggaacaaataatggtcaagaataaagaattgaaggaccaagaaaaagaaaaaaagtag

SEQ ID NO: 8289 - DNA, 123 bp, Glycine max
  Peptide Sequence Number=SeqID_99974
atgctaggtttgaaggagaaacaaatgatgaaggacatcattgttgtccttgagtggttgatgaaggtggttgagatgccgatggatgatttggtgatggaggacatagggggtaaggcttag

SEQ ID NO: 8290 - DNA, 456 bp, Glycine max
  Peptide Sequence Number=SeqID_99975
atggcggagttagggcaagagacggtggagctatccaccctcgtcacacgtgccgctaacgataagtcctccgatttggttaaccctcttgagcctcaggttagaagctgtgagttgagttggttgatgagttcagtggttttgagaagcctaatgagaatggagaatatcttttctcttcttaggatttggactatgtcaatggagggtgcttttgggatggtgggtgtggaggcaccacttggtgtcacggggactaagggtactgtgttgaatcctggggcaggagcagtggctggtggagagagtggtgtgaatgctggttattgtggttgttgttgtggtggggatgtgggctcagaagagagattgttgtttgatcttcattttagggatcaagatgagagcttaagtgaggagggtgtagggcactttgaggctgctgctactttctag

SEQ ID NO: 8291 - DNA, 402 bp, Glycine max
  Peptide Sequence Number=SeqID_99976
atggcatctagcagaggtatgctcacctatactttcctgaaggtctccaagatctccttttccgcttcttccatctttttgtttagaatttctctaggtgggaatggaagagggataggaggttgcgactctgaatggaagctcttgtctcttgctgaaattgcatattctggatggtcatttgcctcactaactcttctaaggaaggttgaggaggagcctcagttgttggttgtctttgttgtgactgctgctactgctgttgctgtattggaagaggaacatatggcttgcttggaccagcaacattctgaaaaggagggacagactgttgttgttgtcgaggacttgtccatctcagatttggatgattctccaacctggattgtatctgttgcttga

SEQ ID NO: 8292 - DNA, 202 bp, Glycine max
  misc_feature (47)..(47): n is a, c, g, or t
  Peptide Sequence Number=SeqID_99977
gtcgactctagaggatcctccttgcggcatctttgccttccctttancgtttgcggtcaggtcagggggtgtgaacacgcgaccggtgtgggtcatgccgctcagccccatgatattggttactttggccgacagtgagcttatgtcggtggctccttccttcctttcgcttagaggtgcatacccccacggaactgcgtga

SEQ ID NO: 8293 - DNA, 468 bp, Glycine max
  Peptide Sequence Number=SeqID_99978
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcagtaaagcaggggttgctggttgtcacgcaggtcctcatgtgaggcagcaggctggtctggaaggtgggcaagcaagtggtggggagaagaagcggggagcaggggcaaggatcaagcttatcgataccgtcgacctcgagggggggcccggtaccagcttttgttccctttag

SEQ ID NO: 8294 - DNA, 177 bp, Glycine max
  Peptide Sequence Number=SeqID_99979
atgttgatgatgttgaaaatgcactatgatgatgttatgttgtgtatgtacatggggagtgcagtgaccttgttggatatccctgtttggaactcccttgagactcaaactgatcacagtgggggaggtggggagttgcctgtgcacgacaaggtgacatcgacacttactgcctag

SEQ ID NO: 8295 - DNA, 156 bp, Glycine max
  Peptide Sequence Number=SeqID_99980
ggcctctgccggtcattcgggattctcgtcacacctagtaaggtgattcgactgccgatcacctgggctttcattgagaagtattgcactcctaggcaggcgcaggggaatgcaccacaggctgcagatgcccgtgatcaatgctggaaaccctag

SEQ ID NO: 8296 - DNA, 294 bp, Glycine max
  Peptide Sequence Number=SeqID_99981
atggtttctagaggtatcatccccttcgaaaaacatattgcggcaatagggactaccagcaacaatatgttatcaaagagaaaaactctagatgagggttcactgttatcaagcaagtcgaagacccagcatgaccacagattcacctccactccttatgttcccatggacccagtccccagtggagtcgccaactgtcgcaacctacccttcggtgggagggcaacgcgagggctcacgggtgcgtcttccaagaaaggaaaatgcgcggagtcgccaccaacatttatttga

SEQ ID NO: 8297 - DNA, 165 bp, Glycine max
  Peptide Sequence Number=SeqID_99982
atggcagaggaatggagaaggaagagagagaggagacaccacttcaaggagaagatgagtctagaagaagctcaccaccataggaggccatggataagagcttggattatggttcagcccactaatccaagatcaagtccaagattctccactaagtgtgcgtag

SEQ ID NO: 8298 - DNA, 465 bp, Glycine max
  Peptide Sequence Number=SeqID_99983
atggatcaagttcagcatcaagccttcaacaaggtatatgggaagatctgggatctgacaatgatagaagtgtctgttgaagccatcgcatctctcactcaatactacgaccaatcactcagatgcttcacttttggggactttcagttagcaccaaccatagaggagtttgaagggatcttacgatgccgactaggagggaggaagccttacgttttttttggattctatccttctatggcaagaatagcaaaactggtcaagatctccaaacaagagctagaacgaatgaagcaaaataggaatggtgtggcaaggataccaaggaagcgcttggaggagaaggcggaagctctggccagccaaggagaatgggcatcattcatcaacgtatcagctttgctagtgtttggaacgatgtgtttgtcccctacaaggtcatcacatgtgttccaaaaagggtaa

SEQ ID NO: 8299 - DNA, 907 bp, Glycine max
  Peptide Sequence Number=SeqID_99984
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgttaattccaccagcgggttatgaaggttggaagattgagactgtaggtgacgatattgcttggattaaaccaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 8300 - DNA, 240 bp, Glycine max
  Peptide Sequence Number=SeqID_99985
atggaagcccagatgctggacttcataaggctgctcagctttgataacttgctatccccatctcattatcaaacaaatttcttgatgcaagctccattggagcttgtaggcctaggatcttcttcattaatggatttttttgcttcttggaagataaatggcagcggaatggagaaggaagagagagaggagacgccacttcaaggagaagatgagtctagaagaagctcaccaccatag

SEQ ID NO: 8301 - DNA, 189 bp, Glycine max
  Peptide Sequence Number=SeqID_99986
ctttcgaagaagttacggaaactcacggagtgcgcaaaaacacctcttttcgatttccgccacactacggaatttcacggatcgcgtaagcctttgatttccgacacgtctcgggacttcatttattgtgcaacaaaggatgccaagtatctcaaagcggctaaccaaaggttgcatgtcatcaagtaa

SEQ ID NO: 8302 - DNA, 997 bp, Glycine max
  Peptide Sequence Number=SeqID_99987
gattgatgcaaacagcctcaatgcctttttagaaacacctgtggtgcttgctgagggtgaacctttatctgcttactcaagatactgtaggatgcctactgacattaaggaaattgagactgctttgtgcatacccggccgagggtttattttaaatgctgaaggtcaccctaggaagattctcataaaagatctaaccactcttgctcaggtctggagtgttctctcatacttcaacctggctccgacttcccactcctcgaatttgactgtggatagagctaagttaatctttggcctagttactcagctggacatgaatgtcagagctctcatctctggacagatcacatcaatggcccagtctaactcctctagactcgagttccctgctcttatcacagctttatgtaggtccagaggagtcgcttccgacagcttggtctttgaacgtttgagcccggtcattagtttggcctacataaggaaaaactattggaacccggatgatccaacaattattattaggggggccagaagaccaagggcaaggccagctgaggctccttgtacatcagcagctcctcctccagctcgtatgacagcatttcgaagccatgcttcgaagcatacatcaggggcagattattttactgcaaagcctacagctgatcttgctgctcaggtaccccatcacccagaggatgagtcatcagagtcttccactcctgagcccttgatcaggaagaggagggtagttgtaacccaggaagctgcaaccacctctgaaaagtctcttgaagctactccagagccttcggcaccagtggcagataccacttctctgcagcaggcagctgacccttccacgcctgaggatcaaaccaccccagtccagtctccgaatgcctctccagtagctactcttgtacttcatttgttggaagagaaagaggctcagacacaggacacccaggaccaatcacaggacttttaa

SEQ ID NO: 8303 - DNA, 1065 bp, Glycine max
  misc_feature (925)..(925): n is a, c, g, or t
  Peptide Sequence Number=SeqID_99988
atggcagagccatcgaagaagagaaagggatcatcctccaccgccgttgctgctgcccatcgccgccacggaccctctgaagcatccacagcacctattcatccttctttgtcatctccaagatcatctacattgttttcatccgatgatcagcgtctacagtacctttctcagttttcttctagaatcatcttagaccctaagtatctagacgtcgaattctttaatgatgaaatgtttgattgctatcaagtgtttcaaaattctggccttgttaatttcatgtcattaaaattgccatattatcctgaacttgtaaaggtcttctactgcaatttaaaaattcaagattctgaggtgcatggtattcctatggtcattgatcagtcattgttcttttctttgactcatttacccagtcaaggtgcaccttttgagggcaccattgttgatgactggaaatttgattattcgagtcatgatgctcgctgtatggtctgcaatgatcaggctgaaatgaccggtagattgctggccgggtcattaacatttgataatcgcatcatgcactatataattgttcgaattttgcttcctcggtcttcaaatttagcacaggcctctgaggaggatttgattcttatgtgggcttttcttaccggtcgtcaaatcgactgggcccatttggttcggtaccgaatgcataaggcattacgagccaatgcacctctcccttatccatatttgattactctgcttttgcgtcattttcaaattccacttgatgatgaaccatttgttcaagtcaagcgttcctttgcaattggtgctggtgccgtgacttcctttgggtaccataaagatcggaatggtcaatggctgaagaaggatgcactccctcctcaagatgaacgtactccttcanctcctcctcagcataaagattcagcactcctaaatgaagtccttaccaaattacgaggtcttcgttcttatgttggtgaacgtttcgactcattgggatacacgctttgccggcatggatatccacctcacacaagttga

SEQ ID NO: 8304 - DNA, 771 bp, Glycine max
  Peptide Sequence Number=SeqID_99989
gttatgctagcattctttgactttggcaatgaggagctcagcaagatccctgtctgggttaaactcagaaatcttcctctggagctttggaatcctcaagccttagggaaaatcctgtccaaaattggttcgaccattcgatctgaccattttaatgcttctaaggggtttatttcttttgctagagctttagttgaggttaatgcttctttggagttcatcgatgaaatgattgggcaccgcctcactaattgtaaaactgtcactacgaataagcctgttctcatcacagcctgccccaccttggatcagccacaagtgggtgattcagcaatgcccccacataccaatacagcaggcccctctgataatccaaagaatgtccagactaatatgcctgtccctcctcacagaaaacatgttctgattgccaatcatgttcctgtccttcagaattcttcttacctcaaagaaacagggaacactgagtttggtgatcctatagaagaggggtttgttcagggtcggggaggcttcctcccgtccgaatccatgatcattgcctcttggaacatcagaggctttaatttgcctctgaagcatcatgcgatgcaaagcttcctttgctgcaaggaagttaacgtcatggctgtgttggaaactaagttgaataaggtttcaattgaggaaatcatgataagaaagtttggtgactggcacttcacccataacttcgcttctcataatgctggcagaattcttatcctctag

SEQ ID NO: 8305 - DNA, 908 bp, Glycine max
  Peptide Sequence Number=SeqID_99990
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagcatctatcgcggcgtgccccacaccagcccggggcgcccccggcagttgaaggtgccgctggcggtggtgcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 8306 - DNA, 504 bp, Glycine max
  Peptide Sequence Number=SeqID_99991
atgaagcacttcactgacaccctcatcagtgccaacataggaacaaaagctggtaccgggccccccctcgaggtcgacggtatcgataagcttgatgcaccaccgccagcggcaccttcaactgccgggggcgccccgggctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 8307 - DNA, 504 bp, Glycine max
  Peptide Sequence Number=SeqID_99992
atggaggccatgaaagagaaaatgaccacaatgatggaagccatgatgagtatgagaaaaatgatggaggtcaacatggcgacagtcgttgccgcaagtgccgccactgagatagaccaggctcacctatcaggcttcaatcaagtaaatcctcctgcctcggatatggttcaaaacaagcatttcttcccacaatacggcttgcctcccaactatacgccacccaatgttgcacacgctcccgatgagaatgttgacaactctgcacccatacccgttgagagccaaaaaccccaaactgatcatgcacatgtctctcaaaccatgggggagacatatgaagtaccccaccacaatctagccgactttgagccttgcctcggatatgccattcaggggcaagcagttgggggtgtagccctgccaaacactttggagggccctcaatttcgcccacaaccacaacccttgcattttgcggaggggagagtccctcctgctatg

SEQ ID NO: 8308 - DNA, 282 bp, Glycine max
  Peptide Sequence Number=SeqID_99993
atgccatccactatttgcaggggtcgtgcccacaagacgcccaatggacccggagaagtccaacagggccctggggtttccaggtcgggttacgggcctctggatcgcacccgcaagacacccaatggacccggaaaagtccaacagggtcttgggttctacgaagcgtccgttgcccctaacaaggtcattaggccccccattaatcgggctttcatcaagaagtactgcacccccaggcaggcacagggcgagacaccacaacagcctggggatggctga

SEQ ID NO: 8309 - DNA, 75 bp, Glycine max
  Peptide Sequence Number=SeqID_99994
atgggtgttaagtacctcaaagcggtcaagcaaaagttgcaagctatcaaacaatggtccccagacgaaattagg

SEQ ID NO: 8310 - DNA, 402 bp, Glycine max
  Peptide Sequence Number=SeqID_99995
atggtgggatacatgtcttcgagttttgcagatttggtgtttacaggcgagaggatcaaggtaggcctaagaaggggaaaatttgaccatgctgcttctacaagttctggcaataggaggcttggggcaggtggagcaaagaaaaaagagggagatgccctcgtcatgaccgcagcacccacatggccaagctccccacaaacccctcacaaccccatgtatcaatactccctacaccaatataattacttggccaatattgactctccccttgcccaacgcccttccgatcgagaatgcctaatcaaccacaaagacctccctaacatcacccacaaaatccattccctacacagcctagaccaagtgcaaatcccaactccaatacaaacaccaacctaa

SEQ ID NO: 8311 - DNA, 689 bp, Glycine max
  Peptide Sequence Number=SeqID_99996
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgacctgacctggtcaaactcattccatcgctactaccaccaccatcaccattccacctccactgccaccatcgttactgttattattccacccaccaccgtcgtcccaccattgaaaccaccactatcgccaccatcaccaccaccgccactcccaccttgctacttctacaaccaccattattttatagtagagcaagataagataaaatgcttgactcagggtaccgagctcgaattcgtaatcatggtcatagctgtttcctgtgtgaaattgttatccgctcacaattccacacaacatacgagccggaagcataaagtgtaa

SEQ ID NO: 8312 - DNA, 258 bp, Glycine max
  Peptide Sequence Number=SeqID_99997
atgtctatcggggaaggagaaggaagcactgggttcaacaaaaatagaagaaaatcactcaaagtgtatcaatctcacacagttttcttccgagggcgaggattgacattctcaccttgggtcaaggtttatgataagttgggattttggctcaaggcttgtagaacggctggtcatgatatatgtcagggtttggccagcggttcggggataaaggggatgtcctacattatttccatgatacacatgcaacaatga

SEQ ID NO: 8313 - DNA, 378 bp, Glycine max
  Peptide Sequence Number=SeqID_99998
atgcatgtggctaaactgatttctgatgccatccactatttgcagggatcgtgcccacaaggcacccagtggacttggagaagttcaatagggccctggggttttcagctctggttacgggcatctatcagtcctacagggtgcccgttcccctcagcaaggtcacgccatcatgacatagggatcgtgcccgcaagacacccagtggatccaaagaagtccaatagggtcctggggtttccagctctgattacgagcctctgtcaattttacggagtgcctgtcacccccaacaaggtcattaggccccgcattaaccaggcttccatcaagaagtactgcgcccccaggcaggcgcagggcaagacaccacagtag

SEQ ID NO: 8314 - DNA, 144 bp, Glycine max
  Peptide Sequence Number=SeqID_99999
atgtgtgcttgtcatggagaagcctcgtggcattccattgagcattgtaggggcctgaagcgtaaggtgcaaggtctaattgatgcaggctggctgaaatttgaggagaatcacgtgattttcaagtttgtaccattattgtaa

SEQ ID NO: 8315 - DNA, 330 bp, Glycine max
  Peptide Sequence Number=SeqID_100000
atggtggaaggtctttataggctgaagatgcttcctcttaagcctctaaaggagtatgatcctagttctatcacagtttcgattcctgctacttctgttcctgctgtttttgctaaatcaccaattgatcatcctattgatgaacttgctaacactgttattgatcctgatactacacgaagagtcactcagacacctagaagtggattaagcacgcatccaccactaagcacaacttcagtgcgacagaagaatctgattcttctgcgtgctaagcgtgctgaagctgcgcttagcggtggatgcacgcttagtccactgatgagctaa

SEQ ID NO: 8316 - DNA, 144 bp, Glycine max
  Peptide Sequence Number=SeqID_100001
atgagtgaaatagagaaggtgcaacaacagatgaaggccaacatggaggccatgaaagagaaaatggccacaatgatggaagtcatgatgagtatttattgccgcaagtaccgccacagaagtggacccgactcacccatctag

SEQ ID NO: 8317 - DNA, 327 bp, Glycine max
  Peptide Sequence Number=SeqID_100002
atggggggggggggagttgcctgtgcacaacagggtgacctcgatacttgctgcttagttttccggagtgtgagtgttgcatggacacacccaagctatttcctaatgaatggtaccacattgcatttgagagttgagggagtggtggctggacggaataatcgtgcaatagctgatgctctccaagccctagctcaagctatggggaatcaaaataggggagaagctgttggagctgctgagtatcaaggttggatcgcttctaatgaaacaattcacctgttttcaatggaggatataaccctgacgatgctcaaaattggataa

SEQ ID NO: 8318 - DNA, 1557 bp, Glycine max
  Peptide Sequence Number=SeqID_100003
atggtcattcgcaccttcgccatccagaaacaatcaagtctgatgccatgcggagaccatcatggtcatccgttcttttttatgtttccaagatatagcagtctcctttgccacccagagacaatcaagtccgatggtgtgcggagacaattatggttagctacttctttacattttaaagacgacaatgtcttcagtcattgcatgctttcaaatggcgacaatgatcttcatttacatttcgaagatgaccatgtcttcagtcattgcatgctttcaaaaggcgacaatgaccctcatttacatttcgaagatgacaatgtcttcagtcattgcatgctttcaaaaggcgacaatgaccttcatctacatttcaaagacgacaatatcttcagtcgttgcatgctttcaaaaggcgaaaatgaccctcatttacatttcgaagacgacaatgtcttcagtcattgcatgctttcaaaaggtgacaatgaccctcatttacatgtcgaagacgacaatgtcttcagtcattgcatgctttcgaaaggaaataatgacctttatcttcaatttgaagacaacaatgtcttcagtcattgcatgctttcaaaaggcaacaatgaccctcatttacatgtcgaagaccacaatgtcttcagtcattgcatgcttttgaaaggcgacaatggccttcatccatatgtcgaagaccacaatgcctttagtcattgcatgctttcaaaaggtgacaatgacccttatttacatttcgaacacgacaatgtcttcagtcattgcatgctttcaaaaggcgacaatgatcttcatttacatttcgaagatgaccatgtcttcagtcattgcatgctttcaaaaggcgacaatggccctcatttatatttcaaagacgacattgtcttcagtcattgcatgctttcaaaaggcgacaatgaccttcatctacatttcaatgacgacaatatcttcagtcgttgcatgctttcaaaaggcgataatgacccttatttacatgtcaaagacgacaatgtcttcagtcattgcatgctttcaaaaggcgacaatgatctttatttatatttcgaagatgaccatgtcttcagtcattgtatgctttcaaaaggcgacaatgaccctcatttacatgtcgaagacgacaatgtcttcagtcattgcatgctttcgaaaggcgacagtgaccttcatctacattttgaagacaacaatgtctttagtcattgcatgctttcaaaaggcaacaatgaccctcatttacatgtagaagaccacaatgtcttcagtcattgcatgcttttgaaaggcgacaatgaccttcatcgatatgtcgaagaccacaatgtctttagtcattgcatgctttcaaaaggtgacaatgacccttatttacatttcgaacacgacaatgtcttcagtcattgcatgctttcaaaaggcgacgatgaccttcatttacgctttcgaagacaacgatgtcttcatctcaaagacttcaatgtcatttgtccttgtacttcatag

SEQ ID NO: 8319 - DNA, 624 bp, Glycine max
  Peptide Sequence Number=SeqID_100004
atgactttaaataaatggcttaagcacgtcaaaagggggtatagaaagcgaatgaaaatgagaataaaaatacatgaaacaaaatgtggaccaccatggcaaaataggggaggagcttgccacccagctcgcccaagcgagctcaactcgcccaggcgagcaaggttgcttcatccagaagtaatagccttctggagaaaggatctggaaggcccaactttcgaagaagttacggaaactcacgaattgcgcaaaacacctcttttcgatttctgtcacattacggaattttcacgaatcgcgttgaaggtgatgggcgaaaagaaagagaagtttgtatttataagtagaagagaaagacaaatcgtcaaaacaataaaaaagcctcacacagggaattgcattagttatggaaacaaagagaaaatgagggaaagtgttgaagaacatgtcaacgcattaaatggtgcggaacttgaaaagataaatggaatggcttttcaaatcaaacccgatgtgaggaacttaataaaaggtcatggcaaggcaactcgaaaacaatcaatgaaaagttggactaaaccacagaacgagaaaagacatactcaaataaaaacatattga

SEQ ID NO: 8320 - DNA, 217 bp, Glycine max
  Peptide Sequence Number=SeqID_100005
caatccaggaatggatcattggaaagcagccaaaacggttatgaggtatttgaagataacaaagtattatatgctcacatacaagaggggacaaatttccatagaacacttagggacaaactccatgatagcatatcctcttactaagggacttccacccaaggtctttcatgagcatgttgctcacatgggtgttttacagttcgagaaatctttg

SEQ ID NO: 8321 - DNA, 708 bp, Glycine max
  Peptide Sequence Number=SeqID_100006
agggttgcacggcttcgcctacagaggactacacgtcctcaccttcagagggttgcacgccctcatcttcagaggactacacgtcctctccttcagagggctacacgccctcaccttcagaggattacacgtcctttccttcagaggacttcacgtcctcaccttcagagggctacacgcctttgccttcatagggctacatgccttcaccttcagaggactacacgtcctcgccttcagagggctacacaccctcaccttcagaggactacacgactacacgtcctcaccatgaaagggctacacgccatcactttcggagggctacacgccctcgccatcagagggctgcacgcactcaccttcagaggactacacatcctcaccatcagagggctgcacacccacactttcagaggactacacgtcctcaccatcagagggctgcacgccctcacctacagaggactacacgtcctcaccttccgagggttgcacgccttcgcctacagaggactacacgtcctcaccttcagagggctgcacgccctcatcttcagaggactacacgtcctctccttcagagggctacacgccctcaccttcagaggattacacgtcatttccttcagaggacttcacgtcctcaccttcagagggctacacgcctttgccttggtagggctacacgccttcaccttcagatga

SEQ ID NO: 8322 - DNA, 372 bp, Glycine max
  Peptide Sequence Number=SeqID_100007
atggataaagttgatatctttgtccctcatcctctcacaaacgcatgtttgcttattcaactttcaccggaatgtgggtgtaagccattgatctgtttgctcaagcaacctgtgctcctgagtgttgacttccaagaccgttcaatcagagattactcgtcttgcacgttggtgggggtgccggataacccttcccttgtgttcaggaatcctctacaacaagagacctcacggtctcttaatcccttttcagaaataagaagaagagaagaagaggtctctcgtaaaagagatagattgtacaatgaagaccaatcaaaattccttattgagatgcaagtggttgaccaaggaatctttttgagaggataa

SEQ ID NO: 8323 - DNA, 243 bp, Glycine max
  Peptide Sequence Number=SeqID_100008
atgcctgactcaaaatctacctttcaccctgctcttgctgtatccaacatcaagaatcatgtcccaatcattcttgaaatggaaaatgtccaatacgcgacatgggctgaacttttcaaaattcatgcacgatcccatagggtaattgatcatataattcctccgcaggatggcaagcagaaggcaccaccaacggaggaggagacagaactctggttgacactagacgccaccgttctataa

SEQ ID NO: 8324 - DNA, 186 bp, Glycine max
  Peptide Sequence Number=SeqID_100009
atggagcttattcagaatatggctgcaagtgatcatgcaatcttgcatgatcgcactcaaattcccacaaagagaagcctgttggagctttcctctcaagatgcattactggcacaaaataagttgctatctaagcagcttgagacattgaccgaaacattgagtaagttgcctaatcaattgcag

SEQ ID NO: 8325 - DNA, 158 bp, Glycine max
  Peptide Sequence Number=SeqID_100010
atgatgcagagaagcagtacacacacagcagaaagcaaaataatgctcagagatgagaaggtgcagaggtttgagtgcgaaggtagcaacccaagggtctttgcgcttagcgcgagcaagctcggcttagcgcgtgaagatatggcgcttagcgcaag

SEQ ID NO: 8326 - DNA, 204 bp, Glycine max
  Peptide Sequence Number=SeqID_100011
atgcacgctgatctcgtgctaagcgcaacggttgtcttaaggcaggctcaacgcatcaagcgccaagctcacatccacttactcgcgctaagcgtgaaaaagaggctaagtcatgaagcgctagaagtgatagttgagcttagctcatcagttgggctaagtgcgcatccacggctaagcatagcgtcaacgcacttagcatga

SEQ ID NO: 8327 - DNA, 693 bp, Glycine max
  Peptide Sequence Number=SeqID_100012
atggtgcttgctgaaggtgaatctttgcccgcctactcaaaatactgcaggatgcctactgacattagagaaattgaggttgcattatgcatacccaaccgagggtttattctaaatgctgaaggccacctggggaagatccttagaaaagatctaaccacccttgctcaggtctggagtgttctatcctactccaacctggctccgacctcccacaaatcggatctggctgtggatcgagctaggttaatctttggcctagttactcagctggacatgaatgtcagagccctcatttttgggcagattacttctatcgctaagtctaactcctcaagactcgggtttcctgctcttatcacagctttatgcaggaccaaaggagttgcctccgacaatcttgtctttgaacgtctgagcccggtcattaatttggcctacataaggaagaattgttggaaccctgatgatccaacaattattattaggggggccagaagaccaagggcaaggccagctgaggctccttctacatcaacaactcctcatctagcttctacatcagcagctcctcctccagcttgtattgcagcagctccttctaccctaccacctgcagattttcaacgtttcgaagccatgcttcaaagcatacatcaggggcagattattttgctgcaaagtctccagctg

SEQ ID NO: 8328 - DNA, 228 bp, Glycine max
  Peptide Sequence Number=SeqID_100013
atgtcggctgaaaaatgtcagtcgggactacatgatgaggacttgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgaattgtatcatggcccaaatggaggaggactaa

SEQ ID NO: 8329 - DNA, 144 bp, Glycine max
  Peptide Sequence Number=SeqID_100014
atggaagtagtttattatatgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 8330 - DNA, 105 bp, Glycine max
  Peptide Sequence Number=SeqID_100015
atggcgatagtagcacctgatgaggcagttgatgatggttatgtagcaattgctgacaagttggagaggctattgaacctgaggatcctgacagaaggaacataa

SEQ ID NO: 8331 - DNA, 444 bp, Glycine max
  Peptide Sequence Number=SeqID_100016
atggatcgattattcacaatgatactggggtttacttccaaacttcgactccggtgcccattcaagtaccaaacaactgtgattttgcaagccgaaaaatcagaatacacaatacccttcagctatccgacaaacaatttttggatgaaattcactaccgaaaaccattcacccatacagttattatgcaccattggaagaacaccagatggagtaataaacttatttcaactcactatgccccatactcatgacacgatcctgtattacaacgggaaatggaacatgccactgcagaacaaatttgttggatgcgcgttcataggaaaaaatcctaagaaatttcaaattccttcaacatgtaccatcgatgaactaaaggatttaataaagcaagttgcacctaaagggatttcccctcttggaattcacgaatcaccaacg

SEQ ID NO: 8332 - DNA, 898 bp, Glycine max
  Peptide Sequence Number=SeqID_100017
agggctgtacctcttcaccttcaaagggctgcacgccctcgccatcagagggctgcacgccctcgccttcagagggctacacatactcaccatcataggactacacgtcctctactttagagggctacacgccctcaccttcagaggacaacatgtcctcaccatcgaaggactacacctcctcgccattagagggctgcatgccctcgccttcatagggctacatatcctcaccatcagaaggctgcacgtcctcgccttcagaggactacacgtcctcgccaagagagggctgcacgccctcaccttcagaggactacacgtcctcaccttcagaggactgcacgtcctcaccttcagagggttgcacgccctcaccaacagaggattgcacggcccagccttcagagggctacacggcctacatgccctcacctttagaggactagaattcctcaccctcagaggaaaagacgtcctcgccttcaaaggggtgcacgccctcgcctttagagggctgcacgtcctccccttcagagggatgcacgccctcgccatcagagggctgcacgccctcgccttcataggacaacacgtcctcacctttagagggcgacacgccttcgccttcagaggactacacgtccttgccatcagagtactaaacgtcctcgccatcagagggctgcacgccctcgccttcagaggactgcgtgtcctcaccatcagaggactacacctcctcgccatcagagggctgcatgccctcgccttcaaagggctacaaatcctcaccatgaaggctacacgtcctcgccttcagaggactacacgtcctcgcctttcagaggactacacgtcctcgccaacagagggccacacgccctcaccttcatag

SEQ ID NO: 8333 - DNA, 195 bp, Glycine max
  Peptide Sequence Number=SeqID_100018
atgattatgaggggtcaagacatttatagtagtcaagaggagactaatttttccccttcctctagtggaaatgaagatgaagtaaggggtgaagagtctagtgaggaagtctacccccatgaagaaggtgacctcataatggttagaaggctccttggagtgaatcttgttgcaattgttgtagcacaagattag

SEQ ID NO: 8334 - DNA, 561 bp, Glycine max
  Peptide Sequence Number=SeqID_100019
atgcactatataattgttagaattttgcttccccggtcttcaaatttagcacaagcctctgaggaggatttgattctgatgtgggcttttctctcacgtcgtcagatcgactgggcccatttggttcggtaccgaatgcataaggcattacaggccaatgcacctctacctcacccacagttgataactttgtttctgcgtcattttcaaattccgcttgatgatgaaccatttgttcaagtcaagcgttcctttgcaattggtgctggtgccgtgacttcctttggttaccgtaaggatcggaatgatcaatggctgaagaaagacgcactccctcctcaagatgagcgtactccttcacctcctcctcaacgagaagattcagcactcatgaatgaagtccttaccgaattacgaggtattcgttcttatgttggtgaacgtttcgactcattggatacacgttttgccggcatggatattcacctcacacaacttgaagaggatgtaggttacattcgtcagagttttgatcttccaccgccacttccaccttcttag

SEQ ID NO: 8335 - DNA, 597 bp, Glycine max
  Peptide Sequence Number=SeqID_100020
atgtacgactaccacgagaaagaaagatcccctgatctcgaaagtatattggcagactttatgacataccaagctagctctaagggttactattattctctgcaacagcagggaactcaatttgaaagggactattcttctgcagattatcaaaaggagtcacaatggcaacctgattatcacaatgaagaagaaggagttcttaatctggatgatttgttaatgcaattcagggatacggtagagtcaatgcaacaagcctttagaaggactgaaactcatattagtaagttggtagatgacatgactaacgcggtggccagaaaagtggaagagcgtgcagagattgaaatacatcaagaaagcattcttcaagttacctcaatccatcatcaattgaccaatgaagaagaagagcatgaagtctccagcaccccggaatatccctgcttggccactgttggctatgttggaaggaaagataaaggaagattggaactcagtgtggagaatcaaaaaatctcttttgacctctttgaagccatgaaacactcagatgtaggtgatgcctgtttcgaggaagaagaggtggagtag

SEQ ID NO: 8336 - DNA, 185 bp, Glycine max
  Peptide Sequence Number=SeqID_100021
atgactgaaggaatgaggtcccggcggcgccttcacaccttcgatgttgaagtgtcggccaggctcagagggaaggaagaggttgcaatggtggtgccggcgacggggaggctgctggagaggagggtggctatcggtgtccgtgaaggtgaaggggctggagagggagggtggtttacgggatg

SEQ ID NO: 8337 - DNA, 234 bp, Glycine max
  Peptide Sequence Number=SeqID_100022
atgtggaatgacatcgccaatggaactagcgatatcagtgtagatatcgccagtggagatgacgattttggtgtgacaagttctcgccactctcactggcgacttggccttcaggtgtgcacgtgcttcgaggagacagctaagggacgcaggctatgcatggcaggaagcaggctatgctggcaggaggcacgggtgaacaggaaggtctcgccaacacatggtgcgagatga

SEQ ID NO: 8338 - DNA, 423 bp, Glycine max
  Peptide Sequence Number=SeqID_100023
atggcggtatcattggcgtggcaacacgtggatgaagcaaccaggatgaatggcgagacagctgccacttggatgccgccagtcgaagtagcgagacatccatggaagcctccagtcgtagcagcgagacccgtgacatggacactgtctcgccagttccaatgtcgacacagggtattggatagaagactccaagaggcttgggctagagctactaaagaaggccctagggttctcatgaaccttaggcttctcaaggaagcttctcaaggagcatcctctccaagcttcttatccaaggctcatcttggtggtgaagctcattcttccatggcttattccctactcaaagatccagcctccatagaagctccacaagcaagcttccatcaagtggtatcagagcacaagagcttcaagcag

SEQ ID NO: 8339 - DNA, 321 bp, Glycine max
  Peptide Sequence Number=SeqID_100024
atgcagaatccaaaaaatgtgagtgccatcaccttgaggtctggcaagcaaattcaagtgcctccaccagtaacaacacctgcacctgaacctatcaagcttcattctacacctgaaaaagaggatgagatagttgcaaaaaagagaaagcttccagatcatgagggagctaacaaaaattttcatgcaggtggaccttcttcgagtagttctgacttgaagcaccctcctatccctcttccattcccacctagagcaattccaaacaaaaagatggaagaagtggacaataagatcttggagaccttcacgaaagtagag

SEQ ID NO: 8340 - DNA, 567 bp, Glycine max
  Peptide Sequence Number=SeqID_100025
atggttcatgatgacactagaacagttccccatgcaaacactctgaatgatgaaatcaaggaatatctggattgcatatacatttctccatgtgaatctacttggaggatctttggttttccaatacatggtagaaaaccttctatagagaggctacagtttcatcttccaagacaacatagcgttctctaccaagaccatgatgatattgatgatctcctctctaacccaagcatttctaaatcaaaatttatagcttggatgaatgcaaaccaagcttttgttgaaggtaccatgaacaaacttgaacaagtgtgggaaaaaacttggcattggttaagtgatgatattctatatagtcatcgcaaatcaacaagcactccgggattacatattgatgactgcaacctaatgaatcaggtattgcttgaagttgaacggctgttacaagtcaatcaaagatcacttaaagactatccttgcatgccatatcctgagaatgcaaatttactaacacatgcagacaatggccttattttgtttgagctgaatttcaacaatgaataa

SEQ ID NO: 8341 - DNA, 192 bp, Glycine max
  Peptide Sequence Number=SeqID_100026
atgcatgaacagtgcttggcaatcaattcatggggctccggacttgatggtggaggatgcatgaatagcgctagatttgatggtggaggatgtatgaacagcgctaggcaatcaattcatggggctctggacttgatggtggaggatgcacgaacaacgctaggcaatcaattcgtcgggctccggacttga

SEQ ID NO: 8342 - DNA, 231 bp, Glycine max
  Peptide Sequence Number=SeqID_100027
atgtcaaatcataaaagcactgagttagcactgaagaaccttgaggtccaggtgggacaattggccaagcagatagcagacaagtcatccaacagttttgtggcaaatatagaacaaaatcccaagaaggaatgcaaagttgtgatgacaaggagtaaaagttttgtggaggatgaggatgaggatagtgttgtgcacaaggagaaagcagttgaaaaagaaaggtactga

SEQ ID NO: 8343 - DNA, 110 bp, Glycine max
  Peptide Sequence Number=SeqID_100028
atggctctgagaaagctttccacaaagaggtctaggaaggacgctgcggctgaagggactagtgccattcccgagttcgacaatcatcatttcaggagcgctgagcaccg

SEQ ID NO: 8344 - DNA, 249 bp, Glycine max
  Peptide Sequence Number=SeqID_100029
atggggaattggaaaagaggatttttgtcatcctttggggggggggggggggggggggggggaaaaagaatctgctgccaaacgatgccacgaaacatttatgcagttatcttcaacggcacaaaaacaaatatgaggcaccagctaggcaagcaaacaggccgatgccgaaaccgtgcaagtgctaatagatctattgattttgcaaaggcattagcagtgggatctaagaaagctcttccgcattga

SEQ ID NO: 8345 - DNA, 330 bp, Glycine max
  Peptide Sequence Number=SeqID_100030
atgatacgcggagataccttacagttatccgcacccttttgtcatccagaggcggcaggcccgatgacaagcagagaccaagtttggtcattctgcacccttgtatcatccagaggcggcgggcccgatgatacgcggagatacagagaccaagtttggtcattctgcacccttgtatcatccagaggcggcgggcccgatgatacgcggagataccttacggttatccgcacccttttgtcatccagaggcggcgagcccgatgacaagcagagaccaagtttggtcattctgcacccttgtatcatccagaggcggcgggcccgatga

SEQ ID NO: 8346 - DNA, 570 bp, Glycine max
  Peptide Sequence Number=SeqID_100031
atgaccgaccctctcgatgagtcgatctcttgctttctcataagggtgaaccctttggtactagtaccctcaccttcagaggactacacgtcctcgccttcaaagggtcacgtaccttcaccttcagaggactacacgtcctcgccttcagaggactacacgtcctcgccttcagaggactacacgtcctcgccttcagaggacttcacgtcctcacctttaaaggactacatgtccgcaccttcagaggaccacacgtcctcgccttcaaagggtcatgtaccttcaacttcagaggactacacgtcctcaccgtcaaagggtcatgactacacgtcctcgcctttagaggactacacgtcctcgccatcagaggactacatgtcccccattttcaaagggggacatgccctcacctttagaggattgcacatcctcgccatcataggattacacttcctcgccttcaaaaggcgacacgtcctgaacttcagagggctacacgccctcgcctttagagggctacgcgtcctcactttcagtgggcttcatatccacaccttaagataa

SEQ ID NO: 8347 - DNA, 426 bp, Glycine max
  Peptide Sequence Number=SeqID_100032
atgaggattcttttgataggccaaggttcaaaaaattctaaggttgtgtctcaatgggggcttttatcgtgggagcccgatcttgatatctggggtaaaacaaatttgggtgtcaaggtgtcggtctcaggccgaacttccatattattccacaaggcacgcgcgacaatgatgatttcgaaacaacgtgcaaaattagtcatggccacagccaggtgggcactcaagcatcccatttacggcattgtgatactacggtcgggaatttacacaaacagaccgaacgtttcccaattatgttctttcatcagttcaatgaattcatccattcttatttcggacgacgttcctaaatggaaaactccacacgactctggaatttcaaaaaaaacactattgacaacaacgaaacaagtactaacgtaa

SEQ ID NO: 8348 - DNA, 144 bp, Glycine max
  Peptide Sequence Number=SeqID_100033
atgactgcagtaataatgtcatctccttcaaccagtttgtcaaggactccaacaacttctcaatcaagagttcaaaaacgaactcatcaggcaaagagatgttttcagtcttcaagtcttccagcagcttgtggtattcgttga

SEQ ID NO: 8349 - DNA, 168 bp, Glycine max
  Peptide Sequence Number=SeqID_100034
atgactaagaaaaagattgcacctctcgcatacaagagggggaaaactgccaggaaaccacattacaagcgaaacctcaaagagagttgggcttcgtcctcaaaaggaaacaacaccagaaaatctagccttccatggattcaaacagaaaacgcaaatgaaacatga

SEQ ID NO: 8350 - DNA, 332 bp, Glycine max
  Peptide Sequence Number=SeqID_100035
tcaaggaaatgagagaagtcaacaaggtcgaggtagaggttgaggtcgcggatgaggacaggttggatgtggcaatagaagatgaggttcaaatttcatcaatagcaattacgagaaagaaaaaagctcaacaagagaacgtggaagaggctatagaagcacaagttgaggaggagactaactatgtggagcaaaaagatgggaagtttgaaacagttctcctagcacatggaggtaataaaggtaaccaagaaaacacatggtacctggagactggtgcaagcaaccatatgtgtggaaaaagaagcatgttcgtggatcttgatgagtca

SEQ ID NO: 8351 - DNA, 552 bp, Glycine max
  Peptide Sequence Number=SeqID_100036
atggggaccaccacgggaacttaccggttgaagaccgaagaacgacgaagaacaaatgacgaacgacgaagaacggttgaaaatcttcgcgaaatcacccacggaaacattacggaagcgcctcggcttggattttcttcacggaaacaatttccctcactaatttcaagtgaatacgaagtgccaagaaggctgaacccttttgcttcttcactcctccctctatttataggaaaattggggaggagcttgccacctagctcgcccaggcgagccaggttgcttccttcagaagcaaccgccttctggaggaagtatctggaaggcccaagtgggtctggttgctatttgcaccccttttttactaaatacacccccttgccttttttggtgattcttttccgtaacgttacgaaactttacgaaatttgtaacgatacttgttttctttccgtaaggttacggaaccttacgggtaatgtaattactccttttttagctttcgggaatgttacggaaactcacagattgcgcaacaacacttccttttga

SEQ ID NO: 8352 - DNA, 519 bp, Glycine max
  Peptide Sequence Number=SeqID_100037
atggtggagagtctctattgcgtattagtaatcatccccaattccatgaacttcaagaagtggaagaggaagacgttcaaatccccccagcaaaggggaagagctatagatctaatgcagactgttgtgaacggaagttattactactaccctgggagaatttggttagacaccgatggaaatcctattcaagcccatggagggggcattatatatgataaaagatcaagaacatactattggtatggtgaatataaagatgggcctacctaccaaattcacaagaaaggagctgctcggaacaatatgtcaataagatttgtgttgagtaacctgattgcaaaagcagtgtggatagcaaggtcaatgtctggagctaacaagaagatgattgaggcactagctgctaggaagaaggaagagtatctgaagaaggaagagtacccgcaacaatttaagatgaactgccataagttccattttcaaagctttcatccaatatatgcatgttttcaataa

SEQ ID NO: 8353 - DNA, 420 bp, Glycine max
  Peptide Sequence Number=SeqID_100038
atggagatgagtatgattgatgctgccagtggtggagcccttggtgatatgactcctgctgaggctaggaatttgattgagaagatggcttccaacacccaacaatttagtgcaagaaatgatgctattgtccttagaggagtccatgaggtggccacagattcatcttcatctgttgaaaataaaaagcttgagggaaaacttgatgccttggtcaacctagtaactcagcttgccatgaatcagaaacctgcatctgcacctgttgtaagagtttgtggtctatgttcttctgcagatcactatagagatctctatccttctttgcagcaatttggagtcaatgagcaacttgaagcttatgatgcaaacatttataatagaccccctcagcagccaaaaccaacaacagcagaataa

SEQ ID NO: 8354 - DNA, 210 bp, Glycine max
  Peptide Sequence Number=SeqID_100039
atgtgtgcacaagaaatggctccgaaaaagctttccgcgaagagatctaggagggacgtcgcggctgaagggcccagtgccgcccccgagtttgatagccaccgtttcaggagcgtcgagcaccagcagcgcttcgaggccatcaaaggatggtcattccacagaaagagtcgcatccagcttagggacgatgagtacacgaatttttag

SEQ ID NO: 8355 - DNA, 177 bp, Glycine max
  Peptide Sequence Number=SeqID_100040
gaagaagaagaaccacaagtgatgcaagctccattggagcttgtaggcctaggatcttcttcatcaatggattcctttgcttcttggaagataaatggcagcataatggagaaggaagagagagaggagacgccacttcaaggagaagatgagtctagaagaagctcaccaccatag

SEQ ID NO: 8356 - DNA, 267 bp, Glycine max
  Peptide Sequence Number=SeqID_100041
atggggaggaagcaactgggcggcaagctcctccacgtttttgaaaatggtttcggggcttccgcggcttccgtatacttccgtaaatttccgaaacttggaaaaatcgagtcgaagtgcttccgtaacgcttccgtaagcgattctgtggaaattcttcatcgttcttcgtcgttcttcaccgttcttcatccgttcttcgttcgttcttcgttcttcaacggttttcttttcttcccttttgacgtgcttaagccatttatttaa

SEQ ID NO: 8357 - DNA, 519 bp, Glycine max
  Peptide Sequence Number=SeqID_100042
atgccgcctaccaggcaccctcgagacccagataagtctaacagggccctggattttccagcattaatcacggatctctgccagtcgttcggggttcctgtcacacctagtaaggtgattcgaccgccgatcacccgggctttcatagaaaagtattgcatgcctagacaggcgcagggtggcgacccgcaggccccagacgcaccaccgctacctcatcaggttgatccagctgggtcatttgacacggagcgatatttacagcatttggttcgccaacaggcagccaaccacagggcgcacgtgcagacccatgactgtctctaccagctcagcctcagcctgcagagccagggtttcgctccttttccatgccctactccggatcagttcagggcagaggtcgcatggcccggagattggcctgaggcccaagtaggggaggcgcccgcagaggctcccgacgatgcagatgaggcctgcatggacgaggagatgatagatttactcgatttctag

SEQ ID NO: 8358 - DNA, 339 bp, Glycine max
  Peptide Sequence Number=SeqID_100043
atgctcaaccgaattaccgtccagctcccggtcgaggggctgctcttctggaaactctccggccgcgaggcgatgtccgagtcgttcgccctgacgctgaccctgcttggcacggatgcgcgcattgaccgcagcaaactgctgggccagccggttacggtgacaatcccgacgcagaacctgctcacctcccgctatatcaacggtaaggtcacgcgcgtggcggtgagtgccgttgagctgtcggggacccgctacgcggtgtaccagctgacggtggagccggacctgtggccgatgaagcgcgaccgtaacctgcgcatcttccaggggcagacg

SEQ ID NO: 8359 - DNA, 1191 bp, Glycine max
  Peptide Sequence Number=SeqID_100044
atggcagcccaagtggcaccccgaatgacggaaagggagatgataatagtgatagtagacacgataccagtattctactatgaaaagatggtgggctatacgccttcaagctctgctgatttagttttcaccggtgaaaggatcgaagtgggtctgaaaagaggcaaatttgatcatcctgcttggacgaatgagaaaactggggcaaatgaagagggtgagaatgagggagaaacccatgttgcgttctggaataatggggctcgccacattgttcccattctctggatattcatgcctaaaagtgcacccgacaagaaatggctccgaaaaagctttccacaaagaggtctagaaaagacaccactggagaaggctccagtgctacccaaccagctgacacagactttgacaggcactgattctggagtggacgatgaataccccgacttccaggaggagctagctcgcaggcgttgggcacctctcgcgacccccatggccaagtttgacccagacatagtcctggaattttatgccaacgcttggcccaccgaggagggagtccaggacatacgccctcaaccaatttttgggccacccactgatgttggaagagggtcagtagtgcgagccatcgcccagtttctatgcacaccagggcaagatttcgcccgaactgctgcaaagagacgggtgcggatcatgcgcaccagcatgaccactctaacccagatatggatgacgttgttgctcagcaacatcctacccagcgaccacaactctgacttgcccctactgaagtgtcagctagtgtatgccatcctcgcacagatgagcattcatgtggctcaattgatagctgatgccaactacatatttgcagggatggctccctcgaggtattccctggacccggagaagtccaacagggccctggggcttccagctctgattacaggtctcttccaattctacaaagtgcttgttaccctcagccatgtcatcccgcctcccatcaccagagccttcatcgagaagtactgcacacgcagacagccacaggacggagtgccccagcagcaggcgacagatgcagccaaccaccagggacaaggtcaaggctccactcctttcatatgccctactccagagcagtttggagcaatgatcgcatggcctcgagactag

SEQ ID NO: 8360 - DNA, 237 bp, Glycine max
  Peptide Sequence Number=SeqID_100045
atggaggaatatccatctgtggaagcaatgccttccaaggttattttgatgatgccaaagaatcaagagttaagcaaagtttcaagcaaagattcaagaatcaagtttcaagtttcaagattcaagattcaagattcaagaatcaagaatcaagtttcaagaatcaagaatcaagaatcaagattcaagactcaagattcaagaatcaagagaagactcaatcaagataagtattaa

SEQ ID NO: 8361 - DNA, 627 bp, Glycine max
  Peptide Sequence Number=SeqID_100046
atgccctctgggggaaaggaaaccatattctatcccttagctagaatttctaagatagtcaaaatctcgacacaggaattagaacgcggaaagcaagtcgaaaatggggtggttggggtaccaaggaaatgtttggaagaaaaggcgagagtcttggcgagtcaaggcgaatgggccccgttcatggacatcctgacacttttgatcttgggggtggtcctctttccaaatgtggatgggttggtggactgggcagcaattgatgcttttctcgccttttacaaccacaaggaaagctcggttgtcgctatcttagccgatctatacgacacattcgaccgaagatgtgagaagaacaatgcaaggatcgtttgctgggattacaatcctgtcctcgctataagacaacttggttaccctatgagaggggcaccattagaggaaggcctcatgccttttattacacgaggtttcaatagcaccaacgcgggggtgcttcagaggatccacaaggcatgggaaatgtcgcaaagaaaggataaggaacttagggggagtagcaacgggcccatcggcggttaccgtaggtggttgaagcctacgcacaagatctggattggctcctga

SEQ ID NO: 8362 - DNA, 213 bp, Glycine max
  Peptide Sequence Number=SeqID_100047
atgtcggctcggcggctcctcaccagaatcttactccctgcaccctgctactgtcattctgctcccacgaacaaggaacataggcaaacattgatgcaatcctaccccgcaagggcattgggtagaagactccaagtagattgggctagagatccaagggaaggccctagggttctcatgagccttaggatagatttcgagcccatgtgctaa

SEQ ID NO: 8363 - DNA, 539 bp, Glycine max
  Peptide Sequence Number=SeqID_100048
aataccatacaacttcctgcgttctatcatacacaatgggcaccaaactatcatgagtttgttcatctcagatacaatggagccatttatgaaatacgagtcaaacaacacaaagataaagtgtatttagcagatggactccaaaacttccggaaagatttgaaaatctacgagtcaaccaacatcaatttttttgcatgtgaccatcactctatttttgacatacatttcataccaccactggagcggcaaacttgtggcaggcagaggcattcatccagaaagcacatctggactcttcaacttactcaggaaatgctggatgatcctgaacccctgaaactcccccattgtacagaagttcctcttaaagcttgcggtaaccacatgacaatcttaaggcgacatggccccccactgcaatggaaagttgaaaccctgaatcttgctattggtggaaaatgtgttgtccaaccatggtatgattttcttgaagaaatggattttgatgatggagatgaaatttctatttactatag

SEQ ID NO: 8364 - DNA, 424 bp, Glycine max
  Peptide Sequence Number=SeqID_100049
gttcaggctctaattttatgactgcctatgaggattgtcaatctccaactaatcagcctgtaatcaacactgaaggatattctgatcttggtgatcaactcatccaatgtagccaatattctggaattcagagccatattgtttcaggtttaagtcacatgctcgatcaacacaattctcatgctaaaagttttagaatggccagggatagattggcaggtgatcaagccaataatatcaaattgcaactaatagctgctcgaggaaaagatggtcgtgtatataatatgcctaatgttccagaaattgctgcacttattgttggcgattttcatccaggctcaaaaagagatattattgttgaaactcaaaatggagaattacaaagaatccatgaacttcatgctagctatccaccactaca

SEQ ID NO: 8365 - DNA, 138 bp, Glycine max
  Peptide Sequence Number=SeqID_100050
atgtgggtgggtcggtttgctcttaccttgaatgggagtcaagaacttccccgattgttagccaaggccaaggcgatggcagacacctactccgcccccgaagagatccatgggcttctcggctattaccttgactag

SEQ ID NO: 8366 - DNA, 297 bp, Glycine max
  Peptide Sequence Number=SeqID_100051
atggcggtgccattaggtgcaatggcgtgtttatatggtggaatttctgccttctgccatgttccggcatccgccaataataacactgcccgctatagagtttttggctccagccgctacgtgctgctatccaggattcaaactatgaatcaagaaataagtttatgttgttttttaaaattttccagaggggtgatgttgaaacatgaaagcaggatttccacatgtaatatacagtctccattctacaatgggaatgggattgaggaggtagataaaatgcaaattcatgattag

SEQ ID NO: 8367 - DNA, 204 bp, Glycine max
  Peptide Sequence Number=SeqID_100052
atgcacaagggaccgacagtccgaaaagcatacttcggatctccgtattaccgaacatgggggcatactcagacgaaaagttgtatggtccatttcatttcaagacagcttggccggagcagcatcattggtagtaccaatcccgggaagccttcccagcactccctcaatggtaaggacttgggccaagggggccttcattag

SEQ ID NO: 8368 - DNA, 237 bp, Glycine max
  Peptide Sequence Number=SeqID_100053
atgatgacaacaaaagatgatgacaaaagtgatgaacaaaaagctcaagagaatcaaagaacatccatctcaagagaatcaagaacaagtcaaagagttcaagaatcaagaagaattcaagactcaagaagaaagcctacaaacaagaatcaagattcaagatctcaagaatcaagatcgagattcaagactcaagattcaagaatgaagaaaagaatcaatcaagataagtattaa

SEQ ID NO: 8369 - DNA, 516 bp, Glycine max
  Peptide Sequence Number=SeqID_100054
atgtcctcacctttagagcgaactacacgtcctgaccttcagagggcaacacgccttcaccttaaaaggcctacacgccctcgccttcagagggctacacaccctcaccttcagaggactactcgtccctgccttcaaaggactacacgtcctcactttcagaggactacacgtcctcaccttaagagtgctacacacccttaccatcagaggactacacgtccccgacttcaaagggctacacgtcctctcctttacaggactacacgtcctcaccttcagaaggctacacgtcctcgccttcacaggggtagatgccctcaccttcagagtactacacgtcctcctttcaaggactaccacgccctcgctttcgtggggctacacgcctcccttcagaggacaacatgctcgccttcagagaactacatggccttaccttcagagggtacatgccctcaccttaaaaggactacaggtcctcgccttcagagggctacacaccctcgcctttag

SEQ ID NO: 8370 - DNA, 381 bp, Glycine max
  Peptide Sequence Number=SeqID_100055
atggaccttccggtttcccgtgacaaaagacgagaccaacatacaacgcaggtatcatctccttcgaaacgacatattgcggcagtagggactaccagcaacaatatgttatcaaagagaaaaactctagatgagggttcactattatcaagcatgttgaagacccagcatgaccacagattcagctccactccttatgttcccatagacccgggtatagggcctccttttcaactcaacgtgtgtgctaaaaagtccccagtggagtcgccaactgtcgcaacctacccttcagcaggagggcgacacgagactcacgggtgtgtcttccaagggagaaagggtgtttccctcactcctacgtatcctcaattgcgatga

SEQ ID NO: 8371 - DNA, 819 bp, Glycine max
  Peptide Sequence Number=SeqID_100056
atggcatctaagaaaaggaaggctccttctacaccttcccaaatcagatttgacagatcaagatttcactctcaagaggcttggaagctgttaccagaaaggaacgtggtagtttattacactaagtttgacgagttcaaggaggaactcgagagaagacacaaggatgaggagttcactgattttactgacgacaacataaatgttgctattgtgaaggaattttacactaacctctatgaccccgaggataaatcacctaagcaggtgagggtgagaggtcacttagtgaaatttgatgaggatactttgaacacattcctgaagacccctgcaattctggaagagtggaaaaatttgtttgcttattccaggtttgcactcttgaggcctgatcctcaagagttggccgctaagctctgtatcccagggaggggatttgagctaaatgcggatggtcagccgttgaagatattaaggaagaacatgaccattttagctcagacatggagcgttctttccttctctaacctgattcctacctcccacacatttgatgtcaccttagacagagccaaattaatttacggcatcattatgaagatggatatgaatgtagggtacctcatctcccaccagatctctattactgcacaacatgattcttccagaattggattccctgccttgatcacagctctatgcaaggctagaggagtccaatcagattctagatccctggagagcctgagccccaccattaacttggcatacatcaagaagaactggtggatcttgatgatccaacagtgtcattaa

SEQ ID NO: 8372 - DNA, 240 bp, Glycine max
  Peptide Sequence Number=SeqID_100057
atggcaactcagacaaaaaaaggatataccattggaagactcttatgggtgccaccaaccacatgggaatttttttatttaagaatgatgcttggtagctgcaaaggacctacttcatttgaggatattagaactgttgcaaatatccaatatgcaacatatagagaaacatgttttgccatggggtttttacaagatgatagagaatatgttgaagcaatcaaagaggctaaggactag

SEQ ID NO: 8373 - DNA, 964 bp, Glycine max
  Peptide Sequence Number=SeqID_100058
ccgaactgtaatcattgtgatcaaaaggaaagaatgcgttttacggtgcccttaccaaacacgtgccaaagctagagtgatgagtgaaatagaggaggtgcaagagcagatgaaggccgacatggaggccatgaaagagcaaatgaccacaatgatggaagccgtgatgagtatgagaaaaatgatggaggtcaacacggctacagtcgttgttgcaagtactaccactgggttggacccgactcacccatctagcatcaagcaagcaagtcatccagtcccggatatgaacaagcattccttcccaccatatggcttgtctcccaactatacaccacccaatgttgtacacactcataacttcgctcccatacccattgagagccaacaaccccaatttggtcaggcacatgtctctcaacccatggaggagacacatgaagcaccccgagaccataatctagtcaacttcgagcctcacctcggatatgccgctgaggggcaggcgttttgcagcgtacccttgacaaacactttagggggccctcagtatcgcccacaaccacaaaccttgcattttgaggtgggaagagccccttctgctatggtggaaagggagagatttgatcatatagaggagaggctgagggctattgaaggaggcggagattatgcctttgctgacatggcagaactatgcctagtgcccgacgtcgttatccctccgaagttcaaggaaagtcttactggggcagccgtcatctggtatactaatctggaaccttcccgagtccattcttggaaggacctaatgggatctggaagctcaagtagcgcccctaatgatggagagggagatgataacaatgatagtggacatgtactggtgttctactatgaaaagatggtgggttacatgccttcaagctttaccgatttagttttcgccgatgaaaggatcgaa

SEQ ID NO: 8374 - DNA, 273 bp, Glycine max
  Peptide Sequence Number=SeqID_100059
atgtcttgcgtgatgcccgtgcgggcccatggcctcaaatcctcgtggatccaacggaagtttgtggggcatgttccggtgaggttgtatgcggtgcagttcaacggggctattggcttccggatggagactgtgaaaggactcgtgccatatggcgtggtgctttgtgctgatttggaagatgatgcaccggaaaacatacgctacacgtacaccacgtgccacacaatgaccacaaatattcaaacaaaccatgcatgcctcatcaaataa

SEQ ID NO: 8375 - DNA, 1281 bp, Glycine max
  Peptide Sequence Number=SeqID_100060
atgaatttgcaaaatcgcgaggcgatcggccaacttatcagcgtgcttcaccgccgccattccgatatcgtgagggctatttctatttatgatgctaaaaaccggctgttcgttacctctaacttccagctcgatccgcgggaaatacagctcccgcgcggcgtgcccttccctcgccgactgagcgtcacccgccacggcgacatcatggtgctgcgcacgcctattgtgtcagaaagctatctgcccgatgagtcgccggaaagcgatgctaaaatgccggacaatatgctcggctatgtggcgctggagctcgaccttaaatctgtgcgcctgcagcagtacaaagagatatttatctcaagcgtcatgatgctgttttgtatcggcattgcgctgattttcggctggcgcctgatgcgcgacgtgaccggaccgattcgtaatatggtcaacaccgttgaccgcatccgccgcggccagttggatagccgcgttgaaggttttatgctcggcgagttggatatgctgaaaaacggcattaactcgatggcgatgtcgctggcggcctaccacgaggagatgcagcacaatgtcgatcaggcgacctcggatctgcgcgaaacgctggagcagatggagattcagaacgtcgagctggatctggcgaaaaagcgcgcccaggaggccgcgcgcatcaagtccgaattcctggccaacatgtcgcacgagctgcgcaccccgctcaacggcgtaatcggcttcacccgccagatgctgaaaaccgatttgagcgcgacccagaccgactatttgcagaccatcgaacgctcggccaacaacctgctgaccatcatcaacgacgtgctggacttctccaagctggaggccggcaagctggtgctggagcatattccgttcgccctgcgtgaaacgctggacgaagtggtggtgctgctggcgcccagcgcccacgataaggggctggaactgacgctggatgtgcacaacgacgtgccggagcaggtgatcggcgactcgctgcgcctgcagcaaatcatcaccaacctgctgggcaacgccatcaagttcaccgaaaccggcaatatcgatattcgcgtcgagctgcgcaaacggctggatcgccgggtggaagtggaagtgcagatccacgacaccggcatcggcatctccgaacgccagcagtcgcagctgttccaggcgtttcgtcaggcagacgccagcatctcccgccgccacggcggcaccgggctggggctg

SEQ ID NO: 8376 - DNA, 616 bp, Glycine max
  Peptide Sequence Number=SeqID_100061
gcgaatggctacacagccaaactctcctccgcctcctcctctttctactggtgtagcatcgcattcgccgtcaccaccattgaagcggactagaaaggtctcacgcctaagatcattggcgactagacaagttggggcagagagacccctggtccatgtggatcctgctactggcaaagcagacggtccccacagcaagaaattcataacatatttaggaatcgttgctcgtgataagactgtgggggagcggtggagacagtttaagtctgatttgacgtcgaaatgggcacttgcaactgaaaaggatagtgtcaatgacactgatgtgcgaaaaaaagcacaagccatccaaaaacaaaacactgcccctcgcgtgatgtctcgtgggggttatgaatatttagaaaaaaagttgatggatgagaaaagaaagaaaaaactagaggaagctactcaatctggaagcactgacaccgtcattgatcctccatctcccatcaaacgacacctgaagtggaagcttgctcgcaccaagaaaactggtgacatgacatctgaggcagcaaaggaaattcctgacaagattgatgcgcttgaggagcaggcctcatag

SEQ ID NO: 8377 - DNA, 315 bp, Glycine max
  Peptide Sequence Number=SeqID_100062
atgataattatgaaaggcaccaacagacagataggttgggattctatatctggagaagatcattctatttcactcttgagaggagaagtttttcaagccttggctacctttgatcatgataaaacacagcaaaaagcattacgccgctttcagattttgttagatggcagaaatacttctctgcctccagccaacattagaaggattccagatcaagatattatttatgtactagcaggaataagcaatgaaggcagtgaaactgcttggagatggttgaagtcttgggccaggcagaacttgttatgcccatag

SEQ ID NO: 8378 - DNA, 148 bp, Glycine max
  Peptide Sequence Number=SeqID_100063
atgaagccttgcttgaagctttgcttctacagtatctctttgggaaatatatcaccaaattcatgtaagagttcttggacctttgggggtaaggtctcaaatgtaggaattgtggcagtgctaagggatgtttcccttgataggagaa

SEQ ID NO: 8379 - DNA, 1143 bp, Glycine max
  Peptide Sequence Number=SeqID_100064
atggactatgaaggcctcaaaagaatattgaaagagataaaaaaaacaacaagcaagctacacacaataggtccttgcatcacaggctcagacttgaaagggcattcagtggaatacacttgcaagaccaactttcagaagttcgatgaagaaggaggagaggttgaggcaagactctttcagaagcttgatgaagagctcaacaaggtcaatgcattttacaaggatcaggtggaagcagcccagcatgaagtaacccttttgagtaaacaaatggaggccttggttgcactaagggtaaaggtgaaaagtccagatacagagaccatggatgaaagtcatcaacaaaaagattctatggttggacctgaagataatcctcttcaacaggccaatagaaatactcattatgaggagcaagcagaagaaaacaataattacatcacaaaagatcccttggaaatcctacagcacgtaaaggttgataatgttcctcaatctccaatatcaacaattaaaaaagcttttactgattccagtgataatgaattgagcttcagcaaagaagagctgagaaaagttaaagagcaactgagacttgtgtttgttgagttctatcagaaactcctccatctcaaagattacagttttatgaacctctcagcattttccaagatcatgaagaagtacgaaaagcatacatcaagggcagcatttgcagcatacatgacagtagtggataactcctatgtgggcagttctgatgaggttgcacagcaaacaccaacaaccgtgacagagaatgaagcaaccgaggtaaccaagattgaggaaactaccccagaacaaccagctacccgggttactaccaccgaagaaccaaaggaagaaaccaccaaagaagcaaaagaggaagaagccccagttgagactaatgaggcaacagaagtgatagaggaagtgaagcctgaggtagaagagaacccagcaccagagagaacagaagaagaagaagtgaaagaggagactaaagaaaccgaatcagcaccagtggaggaacagaagcaagaggagaacaaaccagctgaaaccgttgaggaaaccaaaacagaacaagtttctgttgagaagactgaagcttaa

SEQ ID NO: 8380 - DNA, 975 bp, Glycine max
  Peptide Sequence Number=SeqID_100065
atgcctacacccggggaagtgtccaactgggactcttcccgtttcacatccgagaccgcttggcatagataccaggtcaactttcagctccggaacatccttctggagaggaatgtagagcttgcaccagggatgattgatgtcgctctggtgaaggagttttactccaacttatatgatccagaggaccacagtccgaagttctacagggttcaagggcaggtcatgcggtttgatgcaaagacgattaacgacttcctcaacacccctgtcatcctggcagatggagaggattatccagcctactctcagtacctccgcactcctccagatcatgatgccatcctctccgttttgtgtacttcaaggggacgatttgttctgaatgttgatgggcccgactcatatggcttggtgatgatgatggacctggacttgggtagcctcatttctcttcagatcagtcagatcgccaagtccagcacttctaggctcgggttcccaacgttgatcacagcgctgtgtcagattcagggggttgtctctgataccctgatttttgagtcactcagttctatgatcaaccttgcttacattaagaagaactgctggaacctcgctgatccatctatcacatttccaaggacctaccgcacatgcatcagggcttcaacatcggcatcagaggcttctcttcctccccagcccccttctcagccttcttaccaaggatcgcggcctccacttgcatccacctcagcacccctagacatgcatggacagatgcttaggtccctataccaggaggcttatggtcagcaggtcacctggccaggagaccaaccctccactgacaggggggaggagccttctagagccgctactgaggatcttgtagttgatgaggacctcattgctaacttgcctagagctaattggggcccatgggcagacttggacggaggcggcacatga

SEQ ID NO: 8381 - DNA, 267 bp, Glycine max
  Peptide Sequence Number=SeqID_100066
atggtgaccaaaggttggagctttgttggagcttcaatggtggaggaagaagaagagaatggcaacgtagaaatttccaggatgtcacacagctcgcccaggcgagctaggttgcttcctccagaagcaaccgccttctggaggcacatcctggaaggcccaagtggacctggttgctatttgaaccccatttttactaaacacacccccgtgccttttttcagtgattctttttccgtaaagttacgaaaacttcgaatttcataa

SEQ ID NO: 8382 - DNA, 808 bp, Glycine max
  Peptide Sequence Number=SeqID_100067
gcgcgcgaccacggtcttgccgttggtgccggtgacgccgacgatgggaatgcggccggcgtcgccttcgggaaacaggtgatcgacgatggcgcggccgaccgggcgcggggtgccgtcggccggcttcacggtgctcagcaagccgttgggctcggcgtgactgacgggcgccgcctggtcgatgtcaaggtctcatgccggcgcggatcaggttcgaccggaatgtccagcgcccacgcggcgccgacggcggccgctggggtgcacgttctcgtgacgtctggaaggcgaccgttgccgcctgggctgcaagcggaatcgcggcgacatcggccaggcgctcttcgtgggcgccctgggcgagctcgatgccgccgcggccgaatccacgccgcaccggctgttgagcgggtgggcggccggctcgcccgcggcccatttccgaccaccagcagcggatgcgttgcccagcaagcgttcgacgatgacggctgcccgtcgaccgtcgacctgggtgcggaaccacttgaactgcgttccgtttcattgatgtcgaagtcgccgagatggttgccgtcgtacgagttggtgaccaccacctggcagcgagtcctcgtagcggcctggccgaggatcacgccgctgtcgttcgctgtcgatgaccagccggctcttgcggtcatcaccggcacgcgcgtgccggagcagttccttggccttcgctgcagccagcctggtgcgcttgcccgacaggtgcagaacgcgcgcgaccaggcgcgcgaccacggtcttgccgttggtgccg

SEQ ID NO: 8383 - DNA, 324 bp, Glycine max
  Peptide Sequence Number=SeqID_100068
atgcacacacaaagtttcacaattccacactttcctaaaataggcctaactcacaaaaacagtccccagtggagtcgccaactctcgcaacctaccctttttcaggcgagcgaggcgaggctcacgggtgagtcttccaaaggaggaaaatgcgcagagtcgccaccaacgtttatttgtggaaaacgtcggaaaaaccgaaggaaaccggtcatgaagaatattccaaattcgggagttgtatttacatttgaggaaggtcgacaaaagcggggctcttgctcctacgtaccctccctcgaagaagaaatcagacctacgtag

SEQ ID NO: 8384 - DNA, 564 bp, Glycine max
  Peptide Sequence Number=SeqID_100069
atggttattgaccaatccctcttctatgatttgacccaattgtccagtgacggtgtaccatttgaaggtgcactggacgatgattggaagtttgatttttctgtgcatgatgcccgccggttggtttgcaccaaccaagcggatatgaccgaaaggcttcttgccggttcattggctcttgaaagccgcatccttcactatcttattgctcgcattgcgattaatgctcctttaccatatccacatttagtcacccttttccttcaacatttcaacatccctcttgattttgaaccttatgttccaatcaagagatctttcttaatcagtgctgctgtggttgcgtcctttggttaccgcaaagagcgtaatggctcttgggcaaaaaagggtgctcaaccaaatgatgatgaaggacaaataccagttgaaggagactcttctctccttcaaagtattttggacaggtttgatggactccaaacctatgttggtgagaggtttgatgctttggaacaacaagtggacatgcgatttgatgcaatggactcaaggatcacaaag

SEQ ID NO: 8385 - DNA, 516 bp, Glycine max
  Peptide Sequence Number=SeqID_100070
atgacagccatcacttccggagcgctaaacaccatagcatttcgaggccatcaaaggatggtcattccaccgggagagacgcgtccagctcagttgatcgctgatgccatttatctatttgtagagaagtactgtacagctagacaggcacagggtggcgaccctcaggccccagaggcaccgccgccacctcctcaggatgacccagctgggccatttgacacggagcggtatttacggcatttggttcgccagcaggcggccaaccacagggcgcacgtgcagactcatgactctctctaccaacttagcctcagcctgcagagccagggttttgcttcttttccatgccttactccggatcagttcagggcggaggtcgcatggcctggagattggcctgaggcccaggcaggggaggcacccgcagaggctcccggcgaggcagatgaggcccgcgaggacgaggagatgaccgatttgcttgatttcttgggagggagcggagccatatga

SEQ ID NO: 8386 - DNA, 282 bp, Glycine max
  Peptide Sequence Number=SeqID_100071
atgatgataacaaaagatgatgacaaaggtgatgacaaaaagctcaaaggtcaatcaaagaatgagttcaagatattcaagatagaatcaagcacttcaagattcaagaggaaagttgatttcaagaatcaagaatcaagattcaagagatcaagatttcaagaatcaagattcaagagattaagatttcaagaatcaagaatcaagagatcaagattcaagactcaagattcaagaatcaagagaaggcttaatcaagataagtatgaaaaggttttctaa

SEQ ID NO: 8387 - DNA, 339 bp, Glycine max
  Peptide Sequence Number=SeqID_100072
atggagaatatgccttcctttgagaaaggcagtttgcctttcatcaataatgtgaggcaaaacaagagccagcctattagcaaggactttagatactattttataagcacaccctataagagagatgggtcgataatcattaatagattgtgggttaatggtcttggggataagggctatgaaggatgcattgcttcctttggggaatgtgccatttatgaagaattcatccataaacttgataaaatcaggctcatgaatccaccccccatcaatgcacaggccttgaaaagcatttaccctccttctatgattgatgattctgtggaaataggatga

SEQ ID NO: 8388 - DNA, 234 bp, Glycine max
  Peptide Sequence Number=SeqID_100073
atgactatcaattcatggggctccggacttgatggtggaggacgcatgaacagcgctaggcaatcaattcgtggggctccagactcgatggcaatcaattcgtggggctccggactcgatggtggaggatgcatgaatgaaaatcaattcatggggctccggataagatttgatggtggaggatgcacgaacaacgctaggcaatcaattcgtggggctctggataagatttga

SEQ ID NO: 8389 - DNA, 635 bp, Glycine max
  Peptide Sequence Number=SeqID_100074
atgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtgaaggaaatcattttatctactaatagcggacaaattggagtattaccaaatcatgcgcctattgccacagccgtagatataggtattttgagaatacgtcttcttaaagaccaatggttaacgatggctctgatgggcggttttgctagaataaacaataatgagatcactgttttagtaaatgatgcggaaaagggtagtgacattgatccacagaagcacagcaaactcttgaaatag

SEQ ID NO: 8390 - DNA, 357 bp, Glycine max
  Peptide Sequence Number=SeqID_100075
atgaagagagaatctcctctatccctgcattacaaattgtttgaggggacacatgtcccagacattgtctcgacatcagggaaagctgctgcttcaggtgctgtatccaaggatgccttgattgctgaactcaaggacacatgcaaggtgctggaagcaaccatcaaagccaccacaaagaagaaaatggagctggaacggctgatcgaaagactcacagacaatggcattgatgatggtgaagcagctgaggaagaagaagcagctgaggaagaagaagacgttgctgaggaagaagaagaagcagcagaggatacagaatcagatgatgatgatgattctgaagccaccccatga

SEQ ID NO: 8391 - DNA, 585 bp, Glycine max
  Peptide Sequence Number=SeqID_100076
atggaagccaaagagattgaagccaggctttgtattgcctgcaaggggtttattctgaatgttgagggccatccatggaaactccttagaaaggatctgactacactagcccagacatggagtgtcttctcttactccaacttagctctcacatcccacacctcagatttgaacatggacagagccaggttagcttatggcttggtaacccacatagatatgaacatcgacgccttgatctcaggtcaaatctcttatattgctcagagtaactcctctagggtcagatttccagccttgatcactgccctctatagagctagaggagttacctctgatagtctgacttatgagagcctgagcccggccattaacttggtctacattaagaaaaactgttggaatatggatgatctgacagttaacttcagatgggcaaggaaggcaagggctcggccagctgatgttccttcttcttctactccaccagctccttccacttctactacttctacaccaactcctccaggcccatctagcctggactttcaacactttgagtccatgcttcagagtctttattag

SEQ ID NO: 8392 - DNA, 261 bp, Glycine max
  Peptide Sequence Number=SeqID_100077
atggggaagaggaagctagagttaggttttgaagaccagaaaattgattttgacttgtttgttgaaaataagcctgctctagaacacaatgtttgcttgcaagtaatgggagaaggtcaagaggttttgaagattagtcctttcgccaagcgcctgtttctcgctaagcgcataattattcatgcgctaagccacaagtttcaagtgcttagcgcacaaccctggcatctgaggctgattaattccactaagctagccaag

SEQ ID NO: 8393 - DNA, 588 bp, Glycine max
  Peptide Sequence Number=SeqID_100078
atgacccagctggcaccgtcgctgatcctgcactccaacggttacggcccggcggtcgacaagctggagcgcattgcgccgacgatgggctttgacctcaacagcggcgatggcaaaccgttcaccaccgcgcgcacatcgctgcatgcgctggctgcccggcttggccttgaagcgcaggcacaggcccatttgcactgggtggatggtgaagtggctgccgcgcgtgagcggttacgtccgtgggcgcagcgtccgctgctgctgatgtcgctgatggatccgcgtcacgccattaccttcggtaaaggcagcctgttcctcgaggtgatggagcagcttggcctgcgcaatgcctggcagggcgaaaccaacttctggggcagtgcggtggtcgggctggagcggctgccggaggtcggtgacgttgaggtgatctgcttcgatcacgataacgaacgcgatatgcagcaggtgacgcaaagcgcactgtggcaggcgctcccgtttgtccgctccggccgtttccggcgggtgccggcggtgtggtactacggtgccacttactcagccatcaaatttattcgc

SEQ ID NO: 8394 - DNA, 236 bp, Glycine max
  Peptide Sequence Number=SeqID_100079
atggccaagttcgatctagacatagtcctcgaattttacgccaatgcttggccaacagaggagggcgtgcatgatatgaggtcctgggtgaggggtcagtggatcctgtttgatgcagatgctatcgggcagctcctgggatatcctttagtgctggaagagggccaggagtgcgagtatggatcgaattcctgcagcccgggggatccactagttctagagcggccgccaccgcg

SEQ ID NO: 8395 - DNA, 144 bp, Glycine max
  Peptide Sequence Number=SeqID_100080
gaaatggctccgaagaaactctccacgaagaggtctagaagagacgccgtagaagaagggtccagtgctgcccccgagtttgatagtcatcgtttccagagcgccgagcaccagcagcatttcgaggccatcaaaggatggtag

SEQ ID NO: 8396 - DNA, 521 bp, Glycine max
  Peptide Sequence Number=SeqID_100081
aactcgttaagcacgcttaccgcgctaagcaagttcatcctttgaggatgaaccctcatcctcttgctgaactacctatggaatcaagaaaaagagctagaacagaggacatcccttcgtcatccactccaactcctctccggcaagagttagctcacaataggccaatcatatctatggagcattttcttgagcaagtagcctggcctgaagctcaacttccattggtgagacccaatgaggctgctctgcctgagcccacacctgtgcaggtgaattcagagccagctaacccacaatctccagtggtgaatccacctttttcgcctgagcttgaagcagttcccccatctcctcctctgattgtcatttttgatgcatcatcagatgaagcagctgcccctcctgattcaccagctgcagaaatagttgacccctctgtttccccaattggaggaattgctaatctttctaattcatcatcaggaaaagctattgctctcaccgattccccattttaa

SEQ ID NO: 8397 - DNA, 853 bp, Glycine max
  Peptide Sequence Number=SeqID_100082
tcctcaccgccgaacagggcaagaccctgccggacgccgaaggcgatgtgttccgcggcctggaagtggtcgagcacgccgccgccatcggcaacctgcagctgggcgagctggccaacaacgtggccaatggcgtggatacctacacgatcatgcagccgctgggcgtgtgcgccggcatcaccccgttcaacttcccggcgatgatcccgctgtggatgttcccgatggccatcgccaccggcaacaccttcattctcaagccgtccgagcaggacccgatggtcaccatgcgcctggtcgagcttgccctggaagccggcattccgaagggcgtgctgaacgtcgtccacggtggcgaggaagtggtcaacgcgatctgcgaccacccggacatcaaggctgtttcgttcgtgggttccacccaagcgtcggcacccacgtctacaaccgcgcctcgctggccggcaagcgcgtgcagtgcatgatgggcgccaagaaccacgctgtggtgctgccggacgccaacaaggaacagaccctcaatgcgatggtcggtgctgccttcggcgccgctggccagcgctgcatggccgcctccaccctggtgctggtcggtgaagcacgcaactgggtgcaggatctggtgaccaaggccaagaccctgaaggtcagcggcggcaccgtggccggcaccgatgtcggcccggtcatttcctgcagcgcccgcgagcgcgtggaaggcctgatcgcctcgggcgtggagcagggcgccaagctggtgctcgatggccgcaagccgcaggtcgatggcttcgagaagggcaacttcgtcggcccgaccatcttgccg

SEQ ID NO: 8398 - DNA, 210 bp, Glycine max
  Peptide Sequence Number=SeqID_100083
atgctgtgccttggtgtgggtagctcaccgtctaagcccatcaacgactaccagcctatgcatctagaatttccggatgaggacatcatgaccttgttcgaagaggaggtagaggatgaagataaggacaaatggattctgtggtttgacgacgtgtctatcgcactaggccatggagtgggggcagttttggtacctgttagtcggtga

SEQ ID NO: 8399 - DNA, 192 bp, Glycine max
  Peptide Sequence Number=SeqID_100084
atgagcgcagagtttcagttagcgaggaagcggatgagcgcccaatggtgtaaccgcctctccaaggggatgagcctatactttaattcatgtgccaggacagggttcctgaagaaggacttacagaaggaggaagaagagtgtcgagatggcatgaggatagtgatatcatccaagttctatataggatga

SEQ ID NO: 8400 - DNA, 435 bp, Glycine max
  Peptide Sequence Number=SeqID_100085
atgcatagatctcccacagacaatttagttcctctagacttagaaattgaagctacattgagaagggacagggccgagaggagaaggaaacttctgcaagacataacagttgcatccattcttgaggaaaaaactcatttttctgattcattatcacctgattcaccatcatcaagggaatccgctactcaattgcctgaaaccactatcatggcagatgagcagcaccagaggatcacccttgaggattattcaagcaactcagtatcgcaattctttactagcattgcacgtcctgaagagaggccaagaggtggcttcactcatttaaggaaatacttcccagagtccaagactgcggaaaggaaagttgcaatctcttcatttcatcagttccctgatgaatctctgagtgaagcattgggagaggtttag

SEQ ID NO: 8401 - DNA, 256 bp, Glycine max
  Peptide Sequence Number=SeqID_100086
atggaactccaacgtctcaatcaaaatgaagaaaccgacaaaaggaaaagaagcatagcactcaaagcctcttcctcaatgcaagaagaagaagaagaagaagaatatgatgatgaagaggacttctcactctttgtgaagaaatttcataaattcgtcaaaaatagaagaatggagagaagccataatttcaacaatggcaaaagatctcaagatgtttctcctacacttaaatgctacaagtgtaatcaacctg

SEQ ID NO: 8402 - DNA, 396 bp, Glycine max
  Peptide Sequence Number=SeqID_100087
atgtcttccaaggttattttgatgataccaaagaatcaagagttaagcaagttccaaagaatcaggagtcaaaaagcttcaagaattaagtttcaaagaatcaagattcaagaatcaagtttcaagtttcaagattcaagattcaagaatcaagattcaagactaaagattcaagaatcaagagaagaatcaatcaagataagtattaaaaaaagggtacatctacttggggaatgttatgctaagaaccagagagggtacatctcttatggatcagttcaagtggagggtacatccacttggtttttcaaagagaacaagggagagtacatcccttgtggatctttggcttgtaaaggattttacaaggttgaaaagaaatctcaagaaccgtag

SEQ ID NO: 8403 - DNA, 531 bp, Glycine max
  Peptide Sequence Number=SeqID_100088
cagagagaatcattgagccagtgtcacatggtcccacatcagagcgtgaattcccagcacaagagtttaacattcttcagtcaagtgttgaaaatcggggcataggaaaacgaagggagcctgttgaagcggaacaatattcccaacaaatgatggagcgtggtcatggaatgtattacacgccagtaacatttttcgaatatccttcacagatgtatcagtatccttttgtaggtcatcatactgatacttctgagagctcacattcgttcggtggtgttgcgaaaacacaacctcatttttcatggcccactatgactccttcacagcagcacgatgcccccatggcaacacctaacgccccatttgctccgcaatggaatgtacccagagcaatacctaatatgggcgacttattaggtgttgatttgcgtcaggagttttctgcagaggctgagcaagcagaagtggggagacaacgcagcggcagaagaaatcctgatcgtcaagcgcgaagatgggatcaaccat

SEQ ID NO: 8404 - DNA, 846 bp, Glycine max
  Peptide Sequence Number=SeqID_100089
atgattaagtccattgatcgagtgttcagttgtaatcgacgatcctggacttatatccgcatttgtggagaggtggcacagggagaccagcaccttccaccttccaatagagagttgatgatcacactagatgatgtgtcgtcactcttccatctccctatcagtggcaccttccacagcttcgaggctctttccgtggacgaggcggtatttttgttgatggagttgcttgaggtgtccggtgaggaggctagagccgagacagtacgagggcgcggggcatattgttggatctatgagcattttccgagtgtgcatcagtacgtcatcgatgatgcgtatgaggagacgtcccctcgttcctcctggtggctgacgatgaaggctcatacaaagggaattacaggagcgtcgtaccaggcacgttgtgatgctttgacggtcacagacatgtgctggttgcctcacagtgaccatcgagggggtcagctcagatggggtcctatggtggtcacagttcgaccagagagggtgctttgccagtttggatacattcaaagcatccctccgccgtctgttagcgcttcattgtcatatgatgatatagattacaggtggatgcatttctcggacaatgtagtagctgtgggtgacctttgtgtagtgcctgggcaggtatcggcggattacatggagtggttttctcagatatctcactcattcatgataccgacccaggcaggtgaacagcccagacatgcacctgccccagaccatgaggactacatgcagccggacatcccacagttccagtggcatttgaccccgctcgacatgcagtggtaa

SEQ ID NO: 8405 - DNA, 171 bp, Glycine max
  Peptide Sequence Number=SeqID_100090
atgtttttaaagttaccttatacaagaggcttcttgacatggtttcaagtaactctaaagagtaaacttcgggaaattgcataccctgatcaaaactctatgtgtcctcctccagaaaaggtcaacactaaaggtgcacagaagaaaccggtgaacagaaaccgaagataa

SEQ ID NO: 8406 - DNA, 1213 bp, Glycine max
  Peptide Sequence Number=SeqID_100091
gtcaagagcctaggaatcaccagtttaaaagagctaaggcagttgatgggtcagctccagcggcaagtttttcgtaaagcttacggtaaaatctgggacctagccatgctatcacccatggtggaagaatttgaagagatcctaggatgtcttctagggggaaggagaccatacctcttctcagggttctatccctcattagctagaatttccaagatagaccaaatctcggcgcaggaattagaccacaggaagcaagtcgaaaatggggtggttggaataccgagaaaatatttggaggctaaagcaagaatcttggcagcgatcgacgcttttcttgcctatcataaccacaaggaaagtccggttgtcgctatgctagtcgacctatatgacaccttcgaccgaagatgtgagaagagcagatttgcaaatgttcccttgatagggacaaggggttgcatcagttacaatcccgttcttgctataaggcaacttggctaccctatgagggtcaccactagaggaagagctcgcgcctgtcatttcatgaggacagaactcagaggcagtaacaatgggcccatcggtggctaccgtaagtggttgaaagcccacgtgcaaggtttggattggctcccgagtttgagaaccactaaaagggaggaagttgaggcaccggaggaagacgaagaggtgcaggcccttagggcagaactcgagcaagcccaaatagtcaaagaaaggttcaaatcagcagcttttaagatccgaaaggagaatgccaaactaagaggtataaatatagctaccaccaaggccttggaacaagagaccaagagggctcgcaaggaagagcatggccgtaacaaatttcatggagccttgtggggcaggaacagtgagctcaagcttcgaagggaagagagagaccaatcacgagcacatagcatggtcttgaaagaagagttagccgcttgctcaaggtacaaaaggaacttgtctcagcgtttatgcaagacagagaccaacatgttagctattgtcagcaaataccaagaagagctaaatctagccatggcccacgagcataaagtggcagacgagtatgcccaagtgtacgcggaaaaggaggctagaggaagggtgattgactcgttacatcaagaggcaacaatatggatggaccggtttgctcttaccttgaacgaga

SEQ ID NO: 8407 - DNA, 84 bp, Glycine max
  Peptide Sequence Number=SeqID_100092
atggagaaaaatgaagaaacaacaatggaagagaagcttgattgtggagcttctatggaggctggatctttgagcttcaatgag

SEQ ID NO: 8408 - DNA, 357 bp, Glycine max
  Peptide Sequence Number=SeqID_100093
atggttcttagagatggagaatatataagtgaatccgatgttgaagaggaagaagagagtgagtacatagaggaagaggagactccagagggagatttgttgatgattagccgattacttggtggtcaattgaagcctatggaggagagccaaagagaaaacatctttcacactagatgtttaatcaatggcaagcaaagatccacaagggatgtaccctcccttgttctctttgaaaccctagtggatgtaccctccactagaactgatccacaagagatgtaccctctcttgttcttagtcaaacccaagtaccctctacttgtaccacaaaggatgtaccccccaatgtgttaa

SEQ ID NO: 8409 - DNA, 699 bp, Glycine max
  Peptide Sequence Number=SeqID_100094
atgcgttcatgggtgaggggtcagtggattccctttgacacggatgctctcagccagttccggggtgacccactagttttggaggaaggccagcagtgtgagttcagccagaggaggaacagggccgacgggttcgacgaggaggccattgtccagctgttatgcacaccgggacaggatttcacccggaccgttgcaaggaggcgggtgcggatcatgcacaccagcatgaccactttgacccagacgtggatgacatttctgctcagcaatgtcttgcctaacgatcataattctgatctccctctatcaaagtgccagttagtgtacgccatcctaacacagatgagcgtccacgtggcccaggtatgccaccccaccaggcaccctctggacccggataagtctaacagggcccctaggccgatcacccgggccttcatcgagaagtactgtacgcctaggcaggcgcagggtgatgcacatcaggccacagacgctcagccaccacctcatcaggccgatcccgctggatcactaggcatggagcattatctacagcacttggttcgccagcaggcggccaaccaccgggggcagatgcagatacatgagtgtctctaccggtttagcctcagtcacccccgggtagggtttcgctccttttgcatgccgtactccagagcagtttggggctga

SEQ ID NO: 8410 - DNA, 87 bp, Glycine max
  Peptide Sequence Number=SeqID_100095
atgactcctcagccctcatgcatgaagttctttcggagttacgaggcctccgcacctatgttggcatggatacccgcatcttcatag

SEQ ID NO: 8411 - DNA, 399 bp, Glycine max
  Peptide Sequence Number=SeqID_100096
atggaaaaacgccagcaacgcggcctttttacggtttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 8412 - DNA, 402 bp, Glycine max
  Peptide Sequence Number=SeqID_100097
atggatttgaggcttttagtcctcacgttggtttcacaccttgcgttaatttgtgatcgcccgagcccttccgctcagttcatgggatcccccaagcgcttaattagaattgaacctgaaccaactttccctaaattttctgcgtttgaaaacattcatgcatacgcatacgcatacgcatgtaaaacaggggcaggatcaccttgggctaccttctggagggagacaaaacatgaacggcagaaaccaatcaaggtacttaaggatgaacgcaagcggggatggggtcacgaccgaccgatcgttgcccttctctttgcgaaacaagcagggaatgtcgctgcaaggcagccccgtatcctttgtattttgcagctttctgttgctatttgtttgttttaa

SEQ ID NO: 8413 - DNA, 295 bp, Glycine max
  Peptide Sequence Number=SeqID_100098
atggtcctaggcaaaccatggagtctcacaacttccttgaaaaagagttttgagatgtgggaagcatcatccaccttgtggcatggtataaagtgtgccatcttgctaaacctatccaccaccacaaagatagagtctacacctctttgggttctaggaagcccaaggacaaagtccatactaatgtctacccaaggtgcagatggatgggtaaggggtctctctatcccaaagtggcccatgagcccaccctcatggctctctttcacaagtaatttcctaatggatccttggg

SEQ ID NO: 8414 - DNA, 1002 bp, Glycine max
  Peptide Sequence Number=SeqID_100099
atgacctcactggctcagacttggagtgttcttccttactccaacttgatccctacctcccacacttctgacatcacactagaccgggccaagttgatttatggcattatcatgaagatggacatgaatctgggctacctcatctcccaccagatttctatcattgcccagcatgactcctctaggcttggatttccagccttaatcgtagctttgtgtaaagctagaggagtcgcaccagattccaaatctttggagagtcttagccctgccattaacttggcatatataaagaataactgttggaatctagatgatccaacagtggcatttagagggccaaggaaggccaggggtaagagatctgaggcttctcctacttcagtagcaccagatacttctgctccttcttcatctactttaccagatcctttagcaccatccacttcgactccacatcttccacagtttccagttcagctcccagcttcttctgctcctgcatcagatttattgtttactccagagatgcttcactccatgatgcagagcctccacagaggacaggttattcttatgcagagttttcagagtgtaggcctgccttctattatgcctatggaggatttccatgcacaggtggcctggccaagagttcagccttctccttctggaggggatggggcctccgcagcccaggaacctaactctactgagctagtggaggagctcacagaggagcaggcagtagaggagccagttttagcagaggatgaactcactccttttgagcccttttcatttgctacagatacatctatggctcaggaggaggagacttctccagatcccatgccagagccattccctacacctatatctgaggacaccatgccttcagcaccagccatggagccagagcaacccattcttcaggacatactagctgttccagtgctggatttaaaagaagacgagccacaggatgagcaggatgtttaa

SEQ ID NO: 8415 - DNA, 270 bp, Glycine max
  Peptide Sequence Number=SeqID_100100
atgaataaagttctttcagaattacgagacctccacacctatgttggcgaatgctttgattcattggatggtcgctttgaaggaatggatacccgcatcactcagcttgaagaggatgaattaaattgtcatcatcaaaaagggggagattgtagaagcaaagactttgactttcatgttttgatgatgccatgtgatcatgcgcttctcaagtttaattcaagacaaaaatccaagaaattcaagatacatcatcaagaagatttctag

SEQ ID NO: 8416 - DNA, 204 bp, Glycine max
  Peptide Sequence Number=SeqID_100101
tacgggactaagttgttgtgctatcacgaggaatcggggtacaagaacttagttgtgtatgtgtgtcttaatgcgttcttggttgagcttagtcttacaagaggaatctgcggacgaggcttgatcaagactaggctaggctatcatgaggaatcgaggtctagcagtccaggagacagcataggaacgcatgagcattgttaa

SEQ ID NO: 8417 - DNA, 354 bp, Glycine max
  Peptide Sequence Number=SeqID_100102
atgaatttgacgaggaggccattgcccaactgttatgcataccgggtcaggattttgcccggaccgctgccgggagacgggtgcggatcttgtggcatggagcggtatttacaacacttggttcaccagcaggcgcccaaccatagggggcagggtttcactccttttgcgtgccctactccagatcagttcagggctgaggttgcatggcccggagattggcctgaggcccaggcaggggaggcgcccgtagaggctcccagcgatgcagagaaggcccgcatggatgaggagatgacaaatttacttggtttcttgggggggagtggagccacatcaccaagggatccctag

SEQ ID NO: 8418 - DNA, 936 bp, Glycine max
  Peptide Sequence Number=SeqID_100103
atgatccgaaggaactcatttgcttcttcagcagatattttctttctattgaagtcttcctctcccttagcaaatctcgcagccgagatcgcctcatctagaatcgggtttgccttgtcgctttcttccatgcccaccttcgcctttcccttcatgtccttggaccgcaccaacgggttgggtgccgcgaagattcacccactacgggtcatactactcgtgccagagatgttagtaaccttggcagaggataggtttttgaggggcgtacctccatgggaccgtcttggcactcttgtaaggggaaagggcaggcttcttacccaggataggctggaagcctcagggcttttgggtggcagcatctctggtgaagtggatcaccaatggtttaggcttgctcgggcttttgtcagccaattgcatgcacaaatgttgctcccccttgcttccaccaccaacttcaaaccaaccttgatccattatcccttgcagcaaatcctctgccacagggcatacctctacatcgggcgccgcccctgggtgtaccaagcaggtatccccctcacccccgtcaaagaaaatgatgcccgcctcgcacaacaccttcaatataaacctcctaaaggttaccacatctttcatttgcttcggcctctgaggtccacactcctccaccgcattaaccgctggtcctccataactggcaaaagggtttgtctttacatttggactgtcctcttggaatatcaaccaacctgcatcgatcaaactttggaccttatgtctgaagggcacacattgttctatcgagtgccccaggacacctctatgataagcgcatgtcgcgttggggttgtaccatcaagggaaaggagactgaaaaatcttcctgggggtcactaccaccatttggttggcgatcaaagatggtag

SEQ ID NO: 8419 - DNA, 591 bp, Glycine max
  Peptide Sequence Number=SeqID_100104
atgggtgaccaagaggaggtacaggaacagatgagagccgacatgtcggctttgaaagagcaaatggcttccatgatggatgccatgctaggaatgaggcaactaatggagaaaaatgcggccaccgctgccgctgttagttcggctgtcgaagaagacccaactctcccagctattgcgcaccaccctatcccaaacgtggtaggacaggaaagaagcacactagggcacatcagcaacccccatctgggatacaaccaagtggcttacccttatggattgccacctaattacataccaccagtcatacgtgatgacgcagatcatgtccctccccccatccttgaaggggagcctcttcaacagtcggacgaggtccacgaggatcgtcgagagcatgctgtcgcaacgtgcccttttgcgggcgggcgacgcgtgactcgcgggaagcgtgttccacgaaaggaatacgcgcggagtcgccaccaacgtttatttgaggaaaacgtcggaaaaaccggaaaagatgtgatctacgaacttttaagtgaaaggctcgggagttgtatttacgcacggggaaggtattag

SEQ ID NO: 8420 - DNA, 984 bp, Glycine max
  Peptide Sequence Number=SeqID_100105
atgggttgggtgcgtagcgccaaaggccacgatatcgatgcgcagggactgagctacaaagccggcgatagctggaaagcgtcggtgaaaggcaagagcaaccagccggtggtgtttattgataccaccgggcgcagctacgccatcgacccgattacgctgccttccgcccgcggccagggcgagccggtcaccggtaaagtgacgctgccgccgggcgccagcgtagaacatatgctgatggaggcagacgatcagaggctgctgatggcctccgatgccggctacggtttcgtctgtaccttcaacgacctggtggcgcgcaaccgcgccggtaaggcgctgattacgctgccggagaacgcgcatgtgatgccgccgctggtcattgaagacgatgccgatatgctgttggcgattacccatgccggacgcatgctgatgttcccggtgagcgatctgccgcagctgtcgaaaggcaaaggcaacaagattatcaacattccgtcggcggaagccgcctccggccaggatggtctggcgcacctgtttgtcctgccgccgcagagcacgctaactatccacgtcggcaagcgtaagatcaaactgcgtccggaagagctgcaaaaagtcaccggcgagcgcggccgtcgcggttcgctgatgcgtggcctgcagaaaatcgaccgcgtggagatcgactccccgcgccgcgcctcagctggcgacagcgaagatctttactgcttgttcagcccgcgcaaccctaagcacgtcgcgacgtttggtcatctgtttggccgcctgtccccggtatttggcctgaaagtcgaactgcgtaagcctgcggacgcggaaagctacggcaatgcgatctacatcgctaaccaccagaacaactatgatatggtgacagcgtcgaacatcgtgcagccgccgacggttaccgtggctttactggctgacgggcaacctgctgattga

SEQ ID NO: 8421 - DNA, 459 bp, Glycine max
  Peptide Sequence Number=SeqID_100106
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacggcggaagcccgtctgatagcgctctgtgcgcgtactccgaaagggactcgggttaaattcctgaaccgggacgtggcggctgacggcaacgttagggagtccggagac

SEQ ID NO: 8422 - DNA, 222 bp, Glycine max
  Peptide Sequence Number=SeqID_100107
atggcgagggcgtgtaaccctctaaaggtgaggacatgcagtcctctgatggcgagggcgtgttgccctctgaaggtgaggacatgcagtcctctgaaagtgaggacacacagtcctcttaagattgactgcccttttgaaaaaggtgataattcatgcaacctcatcctatctttttgcaaatctctccgagaactccctcagagtgtatgttctttttga

SEQ ID NO: 8423 - DNA, 381 bp, Glycine max
  Peptide Sequence Number=SeqID_100108
atgacgggaaagggagttagagtttgtcaaaaggtaacaattgtcaaacttatagatttgaagaagatagataatgaggctacattgagggtggagaggtcaaaaacaaaatctgtgtcattgcctttggtttctactcaacaccaaatggatacaaacactcttggtgttgatccaaaaaagagaaagacatcatctgtagaaaatgtctttaatttgcaagttagagagacacttgatcatgaaattgctaggatgttttactcttcggggctgccttttcatttagcaagaaatcctcattataggaaggcatttgcctatgctgccaacaatcagatcagtggttaccaacctccagagagtggacctatgttttaa

SEQ ID NO: 8424 - DNA, 675 bp, Glycine max
  Peptide Sequence Number=SeqID_100109
atgagtgcaagcagtttggtagcagaggcagtatggaaggaaattgagtctacacactcagcaatcctggatgttaccgaaaagtgcatacaaatgctgctaatgcagccacaattgcaatcacaatgtggttgcagaaacccaatgttccttcatgttctggttgcaattatgggtgtggcctgttttttaaaaccttgctttaaattattgactcatgacccaagaccctcttactttcatgtcacagtgaatgatgatcaactttggactttgcatttcttgtttggcaagaactttgagggagccactagaattgtcgaccaaagaggtgttagcaagatatctgctcaccccagtggaaggtttatctttcagggtttgcattacaacattgagagggtaaaaggttgttggacaactttggttgtcctctttgattctaggagaatatttgagataaatgttacaggggaatcccgaagaaaagaccagtatctgtgttttgctgaaaatttttgcgcttgttattcgttcttctatgatgttgtcaacagaggagaacaactttgttgtaaacatcaactagctgcaagacttgctgcatctttgggatcttatgttgaagttaaggtgtctgatgaggagctagctgtgctactgtccaaagtatag

SEQ ID NO: 8425 - DNA, 2034 bp, Glycine max
  Peptide Sequence Number=SeqID_100110
atgggaaattccttggtcttcttattgttcctcatcacattgttgtttgtgggcaatgttcaatgcaacccaaactacagagaagcattggctaaatccttattgtttttccaagggcagaggtcaggaaggcttccttctgaccaacaaatcaaatggagatccaattctggtctctttgatggtcgccttgccaatgtggatttaagtggagggtactatgatgcaggagacaatgtgaaattcaactttccaatggcctacaccaccagcatgctgtcatgggccacaattgaatatgggaagagaatgggaccccaaataaaagaggcaagagctgcaattcgttgggccacagactacctcctaaagtgtgccacatccacacctggtaggctctatgttggtgttggagacccaaatgtggaccacaaatgctgggagaggccagaggacatggacactgtcagaactgtctattgggtctctcccaataaccctggctctgatgtggctgctgaaaccgctgctgcacttgctgctgcatctattgttttcagaaggcttgacccaacatactctaacaagttgttaagaactgcccaacaggtctaccactttgctttgcagtatcaaggttcttatagtcattcacttggatcagctgtttgcccattttattgctcatattccggtttcaaggatgagctgttgtggggagctgcatggcttttcagagcaacaaatgctgtttcctactataatttggtgaagtccttgggagctgatgatcaaccagatatcttcagctgggacaacaaatatgctggtgcacacgtccttctctccaggagagcattgctgaatggtgataagaattttgatcaatacaagcaagaagctgagaattttatgtgcaagatccttcccaactctccctcttcaagtacacaatatacacaagggggactcatgtacaagcttcctgaaagcaacctccagtatgtgacatctataacattcttgctcacaacctattcaaagtatatgtcagctaaaaagcacacatttaactgcggcaatgtcttggtcactccaaacaccttaaggagcattgctaagagacaggttgactacatattaggtgcaaacccaataagaatgtcttacatggtaggctatggtccatactttcccaagagaattcaccacagaggatcttccttgccttcaatagcagctcatccacaaagcatagggtgtgatggaggtttcaacccatttttccattcgatgaatcctaatcctaacatattggttggagccatagtcggaggtccaaaccaaaatgacggatttccagatgaccgcagtgattacagtcattctgagcctgcaacttacatcaatgctgcttttgttggacctttggcatactttgccgggtttgtcattagcacttcttcttttcacactgccgctgcaacaatggcttcagagaagaaactttcgaacccaatgagggagataaaagtgcagaagctcgttctcaatatctctgttggcgagagtggagatcgtctcaccagagccgccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggttaaggaatatgaacttctcagaaggaatttcagtgatactggttgcttcggctttggtattcaggagcatatcgatttgggaatcaagtatgatccttcaactggtatttatggaatggatttctttgttgttctggagcgtcctggctatcgtgttggacgtcgccgcaggtgcaagtcccgggttggaattcagcaccgtgtcacaaaggaggatgctatgaagtggttccaggtgaaatatgagggagtgatccttaacaagtcccaggcaattgtttag

SEQ ID NO: 8426 - DNA, 369 bp, Glycine max
  Peptide Sequence Number=SeqID_100111
atgcaggtagatgaagaagaatcagtagcacctgaagcagtactagcaactagagaaggggagcgaaatggcaagacaatttctgaagctcaactggtagaggaggcaacttgggaggcatcagagacagagacagagacgatcaaagagaagttcccttctctctgctttgaggaaaatgctgaaattagagagggtgatattgatgggaacccagttcctatggttcttggacagactacaagtgagaaagctcttaaggtctacaccaagaggcccaaggccaaaaataatgacaattctaatgcgtattataatgaagctgagcaccctaagaaggaaatcactgaagcgaatgaggaacagtga

SEQ ID NO: 8427 - DNA, 2466 bp, Glycine max
  Peptide Sequence Number=SeqID_100112
atggggaatgcatcagttttaggtcaaagtgggcttgaacatgctagccccctggctaccggtggaatattttcaaatggaggtgccgatgtgaacggatgggcatcacgatttcaatcagaatcctcttcaacacaaagctggctgagtccacaaggtagctcatctggtattattgttaaaaagacggtcagagtagatattcctgtggacgcatatcctaattttaactttgttggtcgcctcctaggccctagaggaaattctctaaagcgtgtagaagcaagtaccgagtgtcgtgtcttgatcaggggccgaggtagcattaaggatccagctagggaggaaatgatgagagggaaacctgggtatgaacatctgaatgaacctctccacattctagttgaggcagaattacctgttgaaatagtagatgctcgtttgatgcaagcacgtgacatacttgaagatttgctcaaaccggtggatgaatctcaggatttctacaagaagcagcaacttcgggagttagcaatgctgaatggcactcttcgcgaggagggttctcccatggtgagagggcttttggagcttgtgttaattttctacatcatcacttaccatgccacaggtgatgctgtcaacgaatgccctgatctgcgatcggggcactggcatcatagtgccagttctaacttgttctatgtgcagtgtgtttacattgagtttgggggaggtttaaagatggtagcacgtagtaaaggtccaattgagtttgggcaatgtagtaatgatgagattagagagaggaggtccgatgttgagaactcagaagacgagaggcggccgtcgagaattgggaacttgaagaagaaggcgatgaatgcgtcatctagattcactcattctcttaagaaaagagggaaaaggaaaatcgattatcgggttccgtccatgtccattgaggatgtaagagatgcgcgggaggagactgccgtccacgaattgcgccagaaacttgttgagaggggatctttacctcctaggcatgatgactatcatacattgttaaggtttcttaaagctagggacttaaacattgagaagacagttcagatgtgggaagaaatgcttacttggcgaaaggaatatggaactgataccatccttgaggattttgaatttggagagctggaagaagtattgcagtattatcctcaagggtaccatggagttgataaggaaggtaggccagtctacattgagagacttgggaaagcccatccaagccgcctaatgcacgccaccacaatagatcgatatttgaaataccacgtccaggagttcgagaggaccctgcaggagaaatttccagcatgctccatagcagcaaagagacggatttcttcaacaacaacaatattggatgtacagggcttgggaatgaaaaatttctcacgtactgctgcaaatctcttgtctgctgtgacaaaaatagatagcagttactatcctgagacattacatcacatgtatgttgtcaatgctggttctggctttaagaagatgctttggcctgctgcacagaagtttcttgattccaaaaccattgcgaagatacagattcttgattctaagtctttatataaattactggaagtcatcgactctagtcagttgccagactttctgggtggttcttgtacatgtgctgcagaaggtggatgtcttcggtctaacaagggtccatggaatgatcctgacatcatgaaggaacgaagcagtgatacatcaacagccgaatcagggtctgatatgaatgattactcctctcccaacagacacaggagctgtccttgtcctcatttagccccagttcatgaagaagttaaagcaccagatctcaatggctactacagttgtgatgatagtgctctagcagttgagaaagtgattgaaagtgatcactttcaccttaatcgagagcagccattgcaaactaatgatatagggaatgttgcttgtagaacagattcaggagcaactgttgaaacagcttctgaaagagattatgttcttccatgtgtacaacgtcttcagagactagaaaaagtctttgaggaacttaacaacaagcctgacggtatgcctcaggaaaaggagcaaatgcttatggattccatggatagaattaaatctgttgagtttgaccttgagaagaccaagagggtgctacatgctgcagtgatgaagcagcttgagattgttgaattgctggagaacttgaagaaatcaaactgccgagattattcttgcagcaaagaagcctgttctgttgagtcatctaaacgttcagcaacagaagtccttggcaccacagaagatatttccatcaaagagaagacttcgtgcaacctcacacctagattggaccataggaagcatgaggcaacggagttttggtag

SEQ ID NO: 8428 - DNA, 1512 bp, Glycine max
  Peptide Sequence Number=SeqID_100113
atggagatgggttatcttgcagtgtttctgacactgcttctttcaatctcatgtgttgattctaccttggttgagaagaaattcacacagtgcatgttaataaccagagttgatggcaattctgaagccattgagaaaatgctcttcagatcatcctcctcactatatacacaaatcttggaatcattggagcaaaatcctagatggctgaattcttcaaggaagcctctcctcattctaacacctttccatgaatcagaaattcaagcagccattctatgcagcaaagaacttgggctgcagattagaatcagaagtggtggccatgattatgaagggttatcatatctttgtaaggccccatttgtgatggttgacctaatcaacatacgttccatcgaaattaaccttgatgacgaaacaacttgggttcaggctggggcatcaataggtgaactttactacaaaatttctaaagcaagtaaagtgcacggattcccggcaggaacctgtccaagtgtagggatagggggacacataagtggagggggggttggtaccatgttcaggaaacatggcctagcagcagacaatgttgttgatgcttacctcatagatgcaaatgggaagattcatgatagaaaatcaatgggagaagatgttttctgggctataagaggaggtagtgctactagttttggagtcattcttgcatggaaaatcaggttggttagagttccacctattcttacagggttcaacattcatagaacactggaggaaggagccagcaagctcattcacaggtggcaacacatagcacatgaattgcatgaggatcttttcattagaatagttgctcaaaatagtggtgacaaatcaaaaacattccaagcaacctttgaatctctcttccttggaggaatagacaggttgatcccactgatgaatgcgagtttcccggaattgggattgcaggccgaagactgcactgaaatgagctggattcaatcagttttgttcttttctggatacaacaaaggggactctccagaagtcttgctcaacagaactaccacatataaaagctccttcaaggccaagtctgactttgtaaaagagccaataccaaaaactggtttagaaggaatttggaaaatgcttcaagaagaagaaacgttagccttgctgttaatggaaccatatggtggtagaatgaatgaaatttcagaatctgaaatcccttttccccacaggaagggaaacttgtacaacatacaatacttggtcaagtgggaagtgaatagcaatgaagcatccaagaaacatctacattgggctaaaagggtctatagatacatgactccgtatgtctcaaagtctccaagagctgcctatttcaactataaggatcttgatttaggcaaaaacaagcatcacaacacaagctactcaaaagctacaatgaacagagtattcctctcctacacacccatccttcttagttcttaa

SEQ ID NO: 8429 - DNA, 808 bp, Glycine max
  Peptide Sequence Number=SeqID_100114
atgtcggagagcgatcagcgtcgtcttctcggggcttccgaggatgacgtggagtctggagggtcggaattggctttggcggtcgtcaatggcagcagtggcaacaacaacaacaacaacaaaggttttagggatttgttaaggttgtcgggtcaccgacacagtttgaagcgcattgagaaagaagaagatagagatagagacagggataggggtatagatagagatagaagagatcaaaatcggcatctccacgatgtggatcttgattcttctgttgatgtgcttggggacagtgcacctcctgaatgggcgttgcttcttattggttgcctcattggactcaccactgggctatttgtggcacttttcaataaagggacaaatgtggctgcaactgcagttgctaagagtccgaaaaccttgacgttgtggtcaaaatctcggttgagaaaccttgataaagacttacacaagtgcagtaaggagagtacatcagatggaggctatcctagtgttgaaggtgctgcctggcttcgtattcagagattggctgatacatggcatcgaatccttttaatacctgtcactggaggagtcattgttggcatgatgtgtggaatctttccaacaataaaggctatccaggctgcagttactttaggtactgggtgttcattgggtcctgaaggtcctagtgttgatattgggaagtcatgtgccaatggattctcactaatgatggaacacgacagagaaaggaaaatagcacttgttgcggctggtgcagcagctggtatttcttcag

SEQ ID NO: 8430 - DNA, 969 bp, Glycine max
  Peptide Sequence Number=SeqID_100115
atggaaaaagcgtcatcttctaatgaggtaaggacactagttttagttggacgtactggcaatggcaaaagtgcaacgggaaatagtgttcttggaaggagagcattcaagtcaaggacaagttcttctggtgtaacaagtgtgtgtgaattgcaaagaactattatgaaagatggatcgattgttaatgttattgacaccccaggactatttgctggaactgattctgctgggaaggaaatagtcaaatgtattgatatggctaaagatggaattcatgccattcttatggtgttctctgttagaactcgcttttctgaagaggaacaagctacttttcttaccttgcaagcattgtttggacaccaaattgttgactacatgattgtggtcttcacaggaggggatgatctagaagctaatgaagagacacttgatgattatttaggttgcgagtgtccacaacctcttaaggatattctgaccctgtgtggcaatcgtaaagtgctttttgataataagactaaggatgaaaaaaaacgattaggacaagttcaagaacttctcaatgttgtgaacatgattatatcacataatggtggacgaccatttacaaatgagttgtttatagaattgaaggagaaagcaacaatacgagataaccaacaaaaaatggttgactccatgggaggatattcaaaagcagaaacgttggggattaaaatgcaaatgcagcaaaaatatgatgatgagctaaaacgaattactaatatggttgaatcaaagttgaaggaagaaagtgcaaaccttttgaaaagtttggaggaagagagagttgctagacttaaagctgaggaaaattatagatcgattcaaattacatcgaataatgaaattcagaaactcaaatgggatcttgaggtggcaaataagagaccacccactaggcgtggttgtgtcataatgtga

SEQ ID NO: 8431 - DNA, 486 bp, Glycine max
  Peptide Sequence Number=SeqID_100116
atggataacacagaagctgaagagcaatttgcttcagagatgctgaggccgaaactcaaagaattggaggaggctgttcaacctaagatttcccctgtccaagactatgccagttttactcttcaggttctttctggtccttttctgcaacaaaaggatttttttaaatgtggatatgagtgctttgatagaagcaaaaggcaggaagaagtaaacaattgtgtcaataattgcattgatcttcttactaaagcgaaaaaaactttggataatgagatggaaatgtttgaggagaagatgaagatgagtacatcattgatggtgtgtctacaaaagcatggggaagctaagctccagcagaaagctggtgctgcgcttgatttggtttcctgtcttgaccagtcaatccaggaaaacatcaagtttctgccacatattaacaagctgaaagctgcctttggaattagtgacgatagctcctcgtag

SEQ ID NO: 8432 - DNA, 663 bp, Glycine max
  Peptide Sequence Number=SeqID_100117
atggcttccaaacctcgcactgtagaagagatcttcaaggactatagcgcccgaagaatcgctattattcgtgcactcactcatgatgttgataaactttacgggctctgtgatccaggaaaggagaatttgtgcctctatggacatccgaataaggcttgggaagtaactctgccatcagaggaagttccaccagagctccctgagccaactcttggaatcaattttgctagggatgatgtgagtcgcagggattggatttctttggttgctgtgcatagtgattcgtggttgctttctgtggccttttaccttggaattcgtcttaaccacaatgaaagaaaacgcttatttggtttaatcaacattcttcccaccatttttcaagttgtgaccgacaataaaccaattaaggacaatcctactatggatagtggaagcaaattttggggaagcactgaggtagcagcagttcgaaatgagcatattgaaatattttgtggaagttgtggtggaaattacaacaaagatgaattttggatcggctgtgatatttgtgagtggtggtaccatggaaagtgtattatgatgacccctacaaaggctgagaccctaaagcactataaatgtgcatcatgcagcttaaggagaggcaggttatag

SEQ ID NO: 8433 - DNA, 543 bp, Glycine max
  Peptide Sequence Number=SeqID_100118
atgggtgcaacttatatagatcaactagttctacttgatgaagctcccaaaggcatggatcacttcttgttagcggatgccatggatgatgggacatggctcagactatgcttggctgtgatggtggctgcattattttggcatgcccactccaagttaagagttgaacaatgggacttgtgcgaggaccataatcaggtgaacttcttgggacatgtgatatctcaagaagggattgttgcatatctcatcaagggacaaccatttgttttagataaaagatgtgagagaagttttcaagagctcaaagagaggttgacttctacaccaatgctagttattcttgaagcattagggagttttgagaccgtctcttacgacggttgtccgcaacaaaacaccgtagtagtaataggaccattctacgacggttctcaggagacaaccgtcgtagaacacgattatgtctacgacggtgctgtcctcatggtcgtcgtagtctttcgttacttctacaacggggctgtccgacagccgtgttag

SEQ ID NO: 8434 - DNA, 2796 bp, Glycine max
  Peptide Sequence Number=SeqID_100119
atgggtaatgttttgccatacaaagctgtgaatctagcaaactggctggttgtcgaaggatggatgcaagaaccctctctctttgatggaattgtcaacaaagatctcttggatggaactcaagtgcaacttaagtccacaaagttcaacaagtatctcacttctgaaaatgggggtggagctgatgttgtagccaaccgaggttctgcttctggttgggaaacattcaagctgtggaggatcagtgactcatccttcaacttgagagtgttcaacaagaaatttgttgggctggaaaatcatgggggtggaaacaaaattatatcagtttcagactcacctagccaaccggaaacatttgagattataaggaataataatgaccccttcaaaattagaatcaaagcatcaaatggtcggtttttacaggttcgatcggagacattagtgactgcagattatgaaggcacaaattgggatgaaagtgacccatcagtctttcgtatgaatattgtaccagacaccaccttacaaggagagtaccaacttactaatggttatggtcctgatagagctcctcaagtcatgagggatcactggaatacatacataaccgaagatgatttcagattcatgtctgcaaatggcttaaatgcagtgagaatacctgttggatggtggatagctaaagatccgaatcctcctaagccttttgttggaggatcattggcagcattggacaatgctttcatttgggcacaaaaccatgggatgaatgtgatcatagacttgcatgcagctgaaggttcacagaatggaaatgaccacagtggcgcaagagatggatatacagaatggggagattcatacataccaaacacagtccaagtcatagacttcttagcagaaagatatggtaccagaccaaacttaggagccatagagctgatgagtgggccacgaggtgtgaatctagagagccttaagaagtattacaaggaagcttatgatgctgtcagaaagcacaactcaagtgcttatgtgatcatgtcaaatccattggatgcagattctaaagtgcttctctcatttgtgcaagactttgacagagtagtcattgatgtgcattactataatcttttttcaagcgatttcaaccgcatgaatgttcaacaaaatattgacgtcataagaaatggacgagcctcagatcttagtgtcgtctcttcctcaaatgctctgagttttgtaggggagtggactggtgcgtggagcatacaaggtgcgtctaaggaagacctcaaaaggattaacgaatggagcctcagatggatgatccaaaacggttacatatgcctctcatgtcctcaaaatttgccatacaaagctgtgaatctaggaaactggcttgttgttgaagggtggatgcaagaaccctctctctttgatggaattgtcaacaatgacctcttggatggaactcaagtgcaacttaagtccacaaagttcaacaagtatctcacttctgaaaatgggggtggagctgatgttgtagccaaccgaggttctgcttctggttgggaaacattcaagctgtggaggatcagtgactcatccttcaacttgagagtgttcaacaagaaatttgttgggctggaaaatcatgggggtggaaacaaaattatatcagtttcagactcacctagccaaccagaaacatttgagattataagggataataatgaccccttcaaaattagaatcaaagcatcaaatggtctgtttttacaggttcgatcggagacatcagtgactgcagattatcacggcacaaattgggatgaaagtgacccatcagtctttcgtatgactattgtaccaggcaccaccttgcaaggagagtaccaacttactaatggttatggtcctgatagagctcctcaagtcatgaaggaccattggagaacatacataactgaagatgatttcagattcatgtcagaaaatggcttaaatgcagtgagaatacctgttggatggtggatagctaaagatccaaaccctcctaagccttttgttggtggatcattggaagcattggacaatgctttcatttgggcacaaaaccatgggataaaagtgatcatagacttgcatgcagctgaaggttcacagaataggtttgaacacagtggaactagagatggagaaatagaatggggagattcatacataccaaacacagtccaagtcatagacttcttagcagaaagatatggtaacaaaccaaacttaggaggaatagagctaatgaatgagccatttggtgtgaatctagagagccttaagaagtattacaaagaagcatatgatgctgtgaggaagcacaactcaagtgcttatgtgatcatgtcaaacccattggatgcagattctaaagtgcttctctcatttgtcaaagactttgacagagtagtcattgatgtgcattactacaatcttttttggaacggtttcgacagcatgactgttcaagaaaatattgacttcataagaaatgaacgtgtctctaatcttggtggcgtctcttccacaaatgctctgagttttgtaggggagtggactggtgagtgggctgtaaaaggtgcgactaaggaagactaccaaaggtatgcccaagcacagctaggtgtgtattctcgtgcaacttttggatgggcatattggtcctacaagtgtaggttcaatgaatggagcatgaagtggatgatccaaaacggtcgcataaagctctag

SEQ ID NO: 8435 - DNA, 285 bp, Glycine max
  Peptide Sequence Number=SeqID_100120
atgtcatccacctccgactatgctgctcctcctcccttttttctccttcctccaccccaacgggcaaatgcctccgtcgagactccattaactcctgcttctccaggttcgaagtcaaacgcatgcattcatgtttgttgttccgttgttgatgagtttggtggaaaggctttgtgtcctccactaggagaatgtcctctagatccacgcggtagcgatagagaggacacatggaattcgcatccagccatgtgtccacacacttcatgtggagcacccgcttga

SEQ ID NO: 8436 - DNA, 886 bp, Glycine max
  Peptide Sequence Number=SeqID_100121
atggctcagcactgctctcacaaaccttcaaacgttcccaacaacaatgtttctgagatgataaggagcagcttggccatcaacatggacttcattgaacaacatcacaagaaagagaaaccagaagctgcgtttccaagttggttttcgacgcatgagaggaaactgttacagtcttcaacgataaaggcacacattgctgtggcgaaagatggttcggggaatttcaagactgtgcaagatgctctcaatgctgcggcaaaggggaaagagaaaacaagatttgtgatacatgtcaagaaaggagtaaataccataatcaccagtgccagaagtgttcaagatggttataccacctatagctcagcaactgctgggatagatggccttcacttcatcgcacgcgacatcactttccaaaacactgccggtcctcacaaggcgtggcatgatgggttaccaagacaccctcatggctcatgcacagcgccaattttatggccaatgttacaccttcatatttgcccgagaactttccaaaatactgaaatttcgatccacaactctcaaatccgggccgcaccagacctcaggtccgttgttgacaaatacaacactttcttgggtaggccttggcaacaaaactctagagttgtgcaactgcctgagtttgctcaagacacactttattatggagagtaccaaaattatggacctggagcatccactaggaatagggagttgctacgtgcacccaacattattgctggggcacccagcaaacaaactcacagacaacttccggaagaacgtcatccggaatgtttccggaagaagcttcttccggaagaattccattgtcttccggaagaagcttcttccggaa

SEQ ID NO: 8437 - DNA, 1587 bp, Glycine max
  Peptide Sequence Number=SeqID_100122
atggccaaaagtcttggcctaatcattgtcttcatatccttgctttctctgtcttccccaaccctttcaagcattttctccaataccgttgatttttggtgcaaccaaaccccacatcctcaaacatgcaagcattttgtcacaataaatagtcatcgtcttcaagatggtatcccaaaaagtgcatttcaatttaaaaacttcatccttcaaattgcaatggaccaatcagtgaaagctcaaattcacatcatgtggttgggctcaaaatgtagaagcaagcaagaaaaagcagcgtggtcagattgtacaaccctctatcaagacaccatcaacatcctcaaccaagcacttaaccctaccaaacaaagcacaagctatgatctccaaacatggcttagcacagccttaaccaacattgacacgtgccaaaccgggttccacgagcttggtgttggcaacaatgttctatccctcattcccaacaagaatgtctcagagatcataagcgacttcttggctctaaacaatgcttcctcatttattcctccaaaaaagacttacaaaaatggcttaccaagatggttaccacccaatgataggaagcttctagagtcatcaccaccatcgttatcaccagattttgtggtggctaaagatggttcgggggattttaagaccatcaaagaagctttgaaagcaattcccaagagaaatgaggccaagaggtttgtgatatatgttaagcgtgggatttacaatgaaaacattgagattgggaattctatgaagaatattatgttgtatggtgatggtacaaggctcaccatcatttctggtagccgaagtgttggaggaggttctaccacttttaattcggccacggttgctgtgacaggagatgggttcatagcacgtggcatcacattccgcaacacagcaggcccagaaaaccaccaagcagtggcactgcgttgtggtgctgacctctctgtattctatcgctgtgcatttgaaggctaccaagacactctctatgtccactcccaaaggcaattttacaaggaatgcaacatttatggcactgtggacttcatctttggcaatgccgctgtggttttccaatcctgcaatatatatgcaagaaggccaatgcagaaacagaaaaatgctataacagcacaaggtagaacagatcctaatcaaaacactgggatttgcattcaaaactcgcgtgtcatggctgctgaagacctagttcctgtgctgagttccttcaaaaccttcttgggcaggccatggagggaatattcaaggaccgtgttcttgcaaacttaccttgatttgttggtagaccctgcagggtggttggagtggaaaggcgattttgccctccacactttgtattatggagagtacaagaaccttggtcctaggggttccacaagaggtagagtgaaatggggtggttaccatgccataacaagtgcaaccgaagcatccaaattcacagttgagaattttattgctgggaaatcatggttaccagccacagggattcctttcttatttggactcgatgattaa

SEQ ID NO: 8438 - DNA, 1482 bp, Glycine max
  Peptide Sequence Number=SeqID_100123
atgtcaatagacgagttgttctccaagttccagttcttatgggtcttatctctgtattgctattctaacctaacagaggtgcctgactctgtagccaatcttaaacatctctgttcattagacctttcccatactaacatagaaaaactacctgaatcaacatgttcactctacaacttgcaaatactaaagctgaatcattgtgcacatttgaaggagctgccatcgaatttgcataaactcaataatttgcgttgccttgaatttataaatactggcgttagaaaggtatcagcgcatttgggaaaaccgaagaatcttcaagtattgatgagttcgtttgatgttggcaaaagtaaggagctaaatattcagcagttaaggagaactaaatctccatggaaggctatcaattgttggttatccgataattcattatggaatgtggtgtccttaagtttgaaaaactgtcaatcttgccaatgtttgccttcccttggacttttgccatcactcaaggaacttacgattgaaaggtttgacaggattatgggtattgatgctgatttttatgggagcagctcttcttcgtttacatccttggaaacattgaagttttccgatatgaaagaatgggaaaaatgggaatgtcaagttgtgactggtgcttttccacctcttcaacatctttctataaagggcaactgccagtgcatttttgaaaacagcacggaagcatggttccttgaattgattaggcaaatgatatctcttacttcttctcttgaacgcttgtatgttatttcttgcccaaatatgaatattcccatgagtggttgccatgatttctttatatcattgatgatcattgacggctgtgactctctaacgatctttccgctagatttcttcccaacactcagtaaacttcatctcagcgggtgtcttagtctacagaggatttcacataggcacacacataataatctcaaggagttggaaatttgggagtgccctcaattagaatctttgcccgaacgcatgcacatcctccttccatctcttgacgagctactgatagcagattgtccaaaacttgagtcattccctcacggaggattgccatcaaatcttaaagagatgtatctccataattgtttcaaactgatcacttctctgaaaggagctttgagagacaattcttcactggaaaccttaaatattggtaaactggatgtggagtctttccctgatgaagatcttaaaaaactggactacaagggtctctgccacctctcatctctcgaaaggttgcttcttgaagactgccccagcctccaatgcttaccagaggagggtcttcccatatccatttcatatttggaaatttggaactgtctgttgctcaaacagagttgccagaaaccagaaggcatagacaggggaaagattgctcatattgaaaaagtcattatagggtag

SEQ ID NO: 8439 - DNA, 2253 bp, Glycine max
  Peptide Sequence Number=SeqID_100124
atggctcaactcaatcaaaacagcaagtttgatccattttctaagattcctgaacttccaggcatgaattactattcttccaaaggttttgttcttttcgaatctaaaaaatcatcttacaacaaactattggaagcattaaaggaagaaagtgtttgcatggttggactagttagaataggaggcttgggaaaaactgctttggcgaaagaggtgggtaaggaagctgaaaagttaaaattgtttgagaagattgtcattgcaacagtctctgaaactccaaatatcagaagcatccaagcacaaatttctgatcaattgggtttgaagttagaagaggaatcagacataggtaaagcacgaagactatcagagagattaagtgaaggcacaacttttctaatcttggatgatgtgggggaaaacctagactttgaatctttaggtattccaatcaatgaaaacaagaagggttgtggagtacttcagatcacttggaagagagaagtgtgcacttctatgcaatgccaatgtactgttgagctcaatctcttaactggtgaagaagcttggactttgttcaaattgtatgcaaaaataactgatgattccacttatgctttgaaaggtgtggcaacaaaaattgtggatgaatgtaaaggattgcctattgcaattgtgacagtgggaagcacgttaagggaaaaaactttaaaagactggaagttagctttgtcaagactacaagattccaaaccactggttattccaaaaggcctaagaagtcctaacgcctttcttcaattaagttatgataatttgaaagatgaattagccaagtcctttttcttgttgtgttccatatttccagaggattatgaaattgatttggaagatttatttcgatttggaaggggactaagaataactgggacttttgaaacaatagaggaagctagggaggagatgcttctggctgttggcatccttatggattcttgtttgttgctacatgcagggaatgaaaaggtgaaaatgcatgacatggttcgtgatgtagctttgtggatagcatctgaaaggggccaagcaattttggcaagcactgcaaaggatctgagagcggtgataaaagatgaaaccataaaagataagagagcaatctccttatgggatttgaaaaatggtcaactttctaatggtaatcatatgaattgtccaacactcaaaattctcttgcttcattcttcaataattggatttgaagtatcaaatgagtttcgtttctgggggccaaaaagatgcacttcatcactgccacaatcaactgagtcattaaaaaatctccacaatttgtgctcaaggagttgtaaattaggcgatatctccattttggaaaacctacaagcacttgagattcttgacttacgatgctcttgttttgatgaattgcctaatggaattgtagaattaaagaaattgaaggttctggatttgtacaactgtaggattaaggaaaataatgcttacgagatggtcttaattaatgctcctgctaaaagttttataccattagcaatcaaggatctccttttaggagcagagtgccttcgtttgaggaaccttcagggaggttacaaaagtgtaattccattcatggatcaacaaggcagtaatctagttgattgtcttaaggcactgataatatatgaatgcacgatgctaacgtctcttcacgccatccatgctccaaactctagagctactggagaagctaatagtagaagaattcaaagccatacctctttgaagctccccaaactaaagactcttcctattgatggatgtgaaaggttggaatatatattccccttgtgttttgcacgagggttagtgagtttggaagagctagatattctatgcagctgcaagttgaagtatgtatttggcactgaaaaggaacatcatctttcaatgtaccaacaccagagtcactatgagactaatattgacataaatctgctcaactttgatgatctctttttgagttcataccagaacttgttgatatttggcctaaatattgctgtccacgtttaccaaattttgaaaagcttatcctgctatgagtgtccaagtttgtctagctcttctatgcgtaaggtgataattgattcagatctccagaaagacacgattgcaatgatgaagatcaaagaaccaccaatgagaatatacgctgagggttgctaa

SEQ ID NO: 8440 - DNA, 1266 bp, Glycine max
  Peptide Sequence Number=SeqID_100125
atggaagaaggttcagagacaggaaagtggggatggatgaaaaggaggagagcaatgagggaagagctgaagaaggtgggtactatagcagctccaatggtggttgcaagtgtgttgcaatatcttttgcaagtggtgtccttggtaatggttggccatcttaaccagctctctctttcaactgttgctattgcaacctctctcaccaatgtttctgggtttagtgttttgtcagggatggctggtggattggaaactttaggtggccaagctttcggggcagggcaatatgaaaaatttggacaatatacttacactgccgtaatctccctttctttgatttgtttcccaatcacaattctatggactttcatggacaaaatattaacactcttaggccaagacccaacaatttcccttgaagctcacccagagtttgatttctcccatgattctaacctctgccatagctttgtgcttccacggagcaacatgtattcctctgcttgtgagaaaacacgcatccctttctccaagaatgctttggttggtgttggagacttctttcgctttgctgtcccagcagcagtcatggtttgtcttaaatggtgggcctgcgagatacttgttttgctagccggactttttccaaatccaaagttggagacatcagtcctatctatatgcttgacaatctctacattacatttcaccataccttatgggtttggggctgctgctagcactagagtttcgaatgaattaggagctgggaatccacaagcagttcgtgtggctgtttcagcaacgatgttccttgcagtcacagagggtctaattgtaagtgcaacactattcggctgcagacatatcttgggttatgcctatagcgatgatcgtatggttgttcattacgtggctgttatgacccctctgctttgtctctctatttttactgacagcttacaaggagttctttcaggggttgctagaggaagtgggtggcaacatctaggagcctatgtcaatctgggagcattttatctggtaggaattcctgtaggtatcgtacttggctttgttgcacatttaagagcaaagggcctctggattggaatagtcactggctccattgtccaatcgattctcctttcccttgttactgctcttaccaactggaagaaacaggcaatgatggcaagggagagaatctttgatgttaaaccaccagacgaaaatgaatcaaatcacatgacgagtgcttaa

SEQ ID NO: 8441 - DNA, 1023 bp, Glycine max
  Peptide Sequence Number=SeqID_100126
aattcagtaacgaaacagctaagccttgtatcacatggtgaggttggtctcaatctcaagcctagggggaaagggttgtatttggaattggctgttcacaagtgcatggaatgtgggcagccattacctgaaagctatacacctcctgctgatgaaccttggatgactgggatctttggatgcactggagatcgggaaaattgcttgacaggactgttttgtccttgtgttttatttgggcgcaatgtagaaaccttgcatgaagaaactccttggactggaccatgcgtttgtcatgccatttttgttgagggtggcattgctctggcaactgcaactgcaatctttaatggtttcattgacccagggacatcatttctcatttttgagggcttattttttacttggtggatgtgtggcatttatactggtcaggttcgacaaaacttacagaagaagtatcacttgcagcacagggagatgaaaggaaggctttctgacagtattttctctgagacaaccattgtaaatgctcctcccgttcaagagatgaagtctactgatgacaaggaacatcctgaaacctcttcttctgctaatagcaatgagcatactggtttggaattgcagttcatcgccgtggacgcggatgcgaagatttcaatcgccgagaagcaaggcgtggtggccgagttgctgaaatcggccgcaccagagaaagatccagtgctgatcgaggccgcgctggcaagcctagtggcgatttcggtgccgaagcggaacaaactgaagatggtgaacctcggagcggtgaaggcgatgaagaggctgttgaaggaggcgaatttgggcgcggtggagaaggtgctgaaagagaatgagaatggaagagtggacgacaatgagaatggaaaactgagggtagaagaaaattttattgatttagggttgttcaagctagtccaattaaaatgtgacacgtcagcaaagaaagtgggaaaacaatgttttcaaagacagtaa

SEQ ID NO: 8442 - DNA, 384 bp, Glycine max
  Peptide Sequence Number=SeqID_100127
atggaatcttctactgcttgtcttttacaagtaatccttaaggcagttaggcctctgagtgatccttataggtctgctagtgggtactatgatattggggttgctatcattatccaccgctggaaaatcaaccttgtcctcaaggttgaagagggacttcaaaccatggctccaaggaggctttctaaaggaggatcattgcacgagaagaaagagttgagggttggaggattgtgtcttgaagcaacaactgagattgagagcaagggttggatgagtgaagatagacttgggatgaaagctagcacaatttgcaaatccatggtaccaaacaagcttaacagacggtcctgggtactcacaaaatcaaccctaagggattga

SEQ ID NO: 8443 - DNA, 876 bp, Glycine max
  Peptide Sequence Number=SeqID_100128
atgagggaggctgagagtaactacatagcaacacgagtgcccactctccaattcaaattcaatcaattaagaaccctagctagggtcatggcagaggatagtccttattcttctcctcctccaacatcattagctaatgctcctttgggtttcgagtgtgatcttcttagtgaaccatcttcaggacatattttctcgcgttggctcccaatccaccaagtcgccgtcatcgacagccaaagcaatggtaagtccagtgtcctcgaagcactcatcgactgcgtctttctcccacgtgacaatgaaatttgcacgcgcctgcccctcgtcctacagctcgtccaaaccaaggtcaccaacaacgacgatgatgagtacgacaagttcctccacctcctcagccgcaaattccacgacttctccgagattcgcagggaaattcaggcttcagagaagaaactttcgaacccaatgagggagataaaagtgcagaagctcgtcctcaatatctctgttggcgagagtggagatcgtctcaccagagcctccaaggtgttggaacaacttagtggccaaaccccagtgttttccaaagcaaggtacactgttcgttcctttgggattagaagaaatgagaagattgcatgctatgtcactgtcagaggtgacaaggcaatgcaacttttggagagtggtttgaaggtgaaggaatatgaacttctcagaaggaacttcagtgatactggttgcttcggctttggtattcaggagcatattgatttgggaatcaacgacctggctatcgtgttggacgtcgccgaagatgcaagtcccgtgttggaattcagcaccgagtcacaaaggaggatgctatga

SEQ ID NO: 8444 - DNA, 2094 bp, Glycine max
  Peptide Sequence Number=SeqID_100129
atggatccactaaaagagcctcctcttgtgactgcaaacacagttctttccattctagccatagattaccctgctgaaaaggtgtcatgttatgtatctgatgatggtgcagcaatgttaacatttgaggctttatctgaaacctctgaatttgccaagaaatgggttcctttctgtaagaagtttaacattgagccaagggctcctgaacggtactttgctgagaagataaacttcctagatgataaggtgcagccatcatttgtgaaagagagaagagcaatgaagagagaatatgaagagtttagagttcgaatcaatactctagttgctaagtctaggaaggtcccagaagaagggtggacaatgcaagatggaacaccatggcctggaaataatgttcgtgatcacccaggaatgatacaggtttttcttggagagactgggggatgtgacatggatggcaaagaattaccacgcttggtatatgtttctagagaaaagaggccaaaattcaatcaccaaaaaaaggcaggagcattgaatgcattggtgagagtgtctgctgtgctttcaaatgcgccttttgtgttgaacttggactataatcattgcatcaacaatagcaaggttgtaagagaggcaatgtgtttcatgatggacccattattaggaaaaggggcctcctatgttcagttctcacagagatttgatggtattgctagtgatgagcaatatgccaatcaaacaaatggattcattgatattaacatgaaaggcttggatggtatacaaggacctacatatattgggacaggatgtgtttttaggaggcaagcactctatggttttgattctccaagaaaaaagaagcctccaaccaagacatgcaattgttggcccaagtggtgctgttttggatgttgttttatgggaaagaggaagaagaagaagttgaagaaacccaagtttgagataacggagaccagtcatagaaaagtacattctgaatcatctatagtggaaggcaaagaagatgaaacatcagctcacctttcaaatccaaagtttgtgaagaaatatggacaatctccaattttcattgcatctattcaattggtggatggtgagacactcaaacatggaaaccttgcttctcaacttacagaagcaatacatgtcattagttgtggctatgaagagaaaacagaatggggaaaagaggttgggtggatctatggttcagttacagaagatatattgacaggttttaaaatgcattgtcatggatggagatctatatattgtactcctagaagacctggatttaaagtatctaccccaagaaacctttctaatggtttgcaacaagtctttcaatgggcccttggatccattgagatattcatgagcaaacattgccctctttggtatggatatggaggaggactaaagtggttgcaacgaatttcttacataaatgccatagtatatccatggacatcaatacctttggtggtatattgtaccctacctgctatctgcttgctcactgggaaatttatcattcctgagctcagtaatgcagctggcatgtggtttgtgtctcttttcttttgcattttcaccacaagtgtgttagaaatgagatggagtggtgttacagttgatgaatggtggagaaatgaacaattttgggtgattggaggggtttcagcacattttcttgcagtgtttctagggatgtttaaggtcttggcaggtgtaaaaacaaacttcattgtggcatcaaaagtagatgacaaggagcattctaacatgtttgctttgaagtggaccactttactaatcataccaacaacattgttggtactaaacataattgctgtagttgctggagtctcatatgcaataaacaatggctttgagtcttgggggcctctactaggtaggcataacaggactcctaccattgttcttgtatgggcaatccttcttgcctctttcttttctgtcttgtgggtgaagattgatccatttttacccaagtcagatgggcccattctagaggaatgtggattggattgcaattag

SEQ ID NO: 8445 - DNA, 1956 bp, Glycine max
  Peptide Sequence Number=SeqID_100130
atggctttgagggttatagcgatttcggcggtttctacagtattaagctttgtgggtctgcagttttgcacagacttgtctttggataaacttacatcagatggactgatcggctggaatttaattcacttggacaatgccagccaagacattgagttgcctttgggtttgtacaccaccatagggctactggtgaattgcatgatcaatgtatttatccttctcaatctttgcctcaaggctgtgtttttcacggagttatatgcttctgaaactcgtaaactggttgaacgtttcattaattatgtcatttacaaggggatgtttctaccattgattgtgccaccaacaatttatcaagcaggtctttggtcaacttggttgaccgtgctttgttctttgaagatgtttcaagctttggctagagatcgtttggaacggctgaatgcatctccgtctgctacaccctggacatatcttcgagtatattcagcattgttatttgttttcatggttgatgttctctggataaggttttgtctgacaatatatcaagcacatgggtcctctatgtatctgttattattctttgagcctttcagtatttgttttgagaccctacaggctattttggtacatggatttcagttgcttgacatatggttgcatcattcagcttgcaatagcagtgatttccgaacacctaaactgcttgacatgttaactgcaggttcattgttggaattgaagggaattctcattcggaacttgggatttttattagacatggcaacattttttatggcacttggccattacttgtatatatggcggcttcatggcatggctttccatctaatagatgcattgctatttctaaatatacgtgcattgcttagtgcaataataaatcgcataaaaggctttatcaggctaaggatagctctaggaacacttcatgcagctcttcctgatgcaacaactgaggagctaagagcatatgatgatgaatgtgctatttgtagagaaccaatggccaaggctaaaaggctaaactgcaatcatctcttccatcttgcatgtttgagatcttggttggatcaaggcctggctgagatgtatacttgtccaacatgccgaaagccactttttgcgggtgtgcctggaaatgaaacaaactctgatgcggggacgatatctagtgatgagcaacttgcacggcaaataagtgctggattggatcggccaaactctgctaggcataccatgcctacaggattctatccaaatcagacactaaacactcctgaaggtgttccttggaggggtgcagggctggactcaggttggttgcattcttggccaaatcaaggtgttgatggggccggtccatctactgctatcagaacagttggattaggaagagttcaaatgatgatgcggcatcttgcatctgttggagaaacctatgctcagactaccttagaagataccgcgtggaacctttggcccattaatccctctcaggcttctgcaagtggttcaaccattcctccccctggtggaagattgcctgaaagaactggtagtttacatttaaggactgcttcacagtcttctaatgataatgttgcaaatatacttgccatggctgagactgttcgggaggttctacctcatattccagatgacatgatattccagaattgctatgataaaaacacgatattcacaagcaaacttcggctactgatatttgatgaatatcagtgtacaaggaagatatataatagattacactctgatatgggaaaaacaaagataagagatagaacaggagctatgatggtgtgtaaaccttcctacttcaatgcccggaaaccatatcaaatgacttcctgcactccctcccttgcctcacatataccattcaaccttatccttctgctcatgtga

SEQ ID NO: 8446 - DNA, 1365 bp, Glycine max
  Peptide Sequence Number=SeqID_100131
atggagttgaactacttaataagctggaagctggataggaatcgagatgcagttgcaccaaaacagaaagagcttcttcaatatgttgaaggggctacgagtgaaaacaatgaggttatgctggcagggtgtcattatcgtcaagctaaaaacacctttaggaatttggtaaatgggacattggaggtattgtcaatgatttttctgtttgttagtccttttttcttggattattatggttttgcaagagagcatattggagctaaaactgagtacgattttggaagggtgagagttcacggtgaaagatcacttggaaacaatagaagggcacgtttcaatgcattatatcaagttccaaaatattgtgacatcaacaaaattaaggggaagtttgatggcaaaactgtcatcattacaattccaacgattccagggaaagttcctaagaaagaaacacaaccaactgaacaagaaccacccaaagaaccatcacaagaagcagaatcaaatccagaggaagaaaaagaaggtactcctccttcagatgataatcaagaaagtaaagaagaggctggccatgcgacttcaacttcaaacccaccaaatgcctcacaagaagagtctatggatcaaaagggtcaagagggaattccccaaaaagctacacttaacaaagttgaaagtgaaaaacatgttggtcaagaggcttcttcaacttcaacgccaccaaaagacacacaagagtctaaggctcaaaagggtcaagaaggaattcccacaaaagttgataatagtaaaagtcaagttggtcatgagggttcaacttcaaccccatcacaagacccacaagagtctatacctcaaaagggtcaagaagcaattcccccaaatgctacaccaacaacaaatgccaagcttcaaggagaggaaaagtttgaaggggaaattgatgaaaatgtggaaaagcaaaaggttcttggaaaggaagaaactaaagaccattccgagaagcctttggaatcaggaaagccacctgagaaggctgtggtggatgattcccccaaaaaagaaggcaaagaagaaagtaaagggttggccgcatttgaaggagagatgcgaagggaaataaatgggaaaattagcaatgatgttggaagaaagagtgataagaaggccaagcctgactcaacaataagggcaacaattaaggaagtgactgcttctgcttctcaagctatgactagtctagcaaagaagttcaatgaagaagataaacaaaggatagcatacatgggtacagcagttcttgcggtggcactaggagtttatgctacctacaagcttcgttcacgtgtgccatag

SEQ ID NO: 8447 - DNA, 786 bp, Glycine max
  Peptide Sequence Number=SeqID_100132
atgtcacctccaccattttccccccctctctctatttcccttctctttgtcttcctgttagcaccattactcttagctcaatctccaccttctccttctccttcttcttcttcttcttcttctgttgcctgcaaaggcacactatatccaaaactctgccgttccattctctcagccattcgttcatccccttcagacccttatggctatggcaagttctccataaaacaaagcctcaaacaggcaagaaaactagccaaagtctttgaggactttctccaacgccaccaaaaatcaccttccctcaaccatgctgagactgcatcacttggtgactgcagagacctaaaccagctcaatgtggactacttggcgtccatatccgaggagctcaaatccgcaagctcctcagactccgaactcatcgagaaaatcgagagctacctcagtgccgtggccaccaaccactacacttgctatgatgggttggttgtgaccaaaagcaacattgccaatgcacttgccgtgccactcaaggatgtgacacagttgtatagtgtgtcacttgggttggtcactgaggctcttgacaaaaacctaaggaggaataagacccgcaagcatggtctccccaccaagaccttcaaggttaggcaaccactagagaagctcatcaaggttagcatcactgatttacttttatttgcatgggagacggacatatcttcaatgggtttttcgtccattcagtcatctgaaccaagcgcagaaaacatgattcattga

SEQ ID NO: 8448 - DNA, 2376 bp, Glycine max
  Peptide Sequence Number=SeqID_100133
atggattctatggatgatcacaacatgactattgatctcttggacacttcaatgagaaccattgaagaagaaggaatgattgaagaagaaggaatgattgaagaagaagaagatgaagatgaagaagaagaagatgatgacgatgatgataatggacaaaaacaagtgttaacgatcgaggaacttgaaacgaggatgtggagagaccggatgctgctgaggaaacttaaggatgagagaaaggagaaagaacaagggcaaacagtggagatgatgaagaagaaggccttgactcgtgcacaagacattgtgctgaagaacatgctcaagatgatggaggtttgtgatgtaaggggttttgtttatggcataattcctgataaggggaagccagtgagtggtgcttctgataaccttcgtggttggtggaaggaaagggttaagtttgatcgtaatggtcctgctgcaatgctgaggtatgatgaagaaactgggtttgacgacctgcgtaatgaattcagtggagacccatcatcagcataccgtttgagtgatctcccagacacaaccctagggtcactcttgtcatgtctgatgcagcactgtgatccccctcagaggaggtaccctctagacaagaatgttcccccaccctggtggcccaccgggcttgagatctggtggcccgagctgggctttgctgtcgacccaggcccacctccctacaggaagccccatgacctcaagaaggtatggaagcagtgcgtgctgaccgcagtgatcaagcacatctcccctgacatcaccaagatcaaaaacatggtgcggctttcgaggacccttcaggacaagctcactgccaaggagactgctatttggagtgctgttgtgaaacgtgaagaaacccttgctagaagattgcaccctcatttgttcccagccaaaccaattatcagaaggcctcatcatgcgattcgtggttatgatattgaaggaagtggtgctcgtgctaggaactttcttgggggccaaagtagtcataacccaccaccaacttccaatgttgctgctcatagtaataatagtatgcttctagcaagtggaactgctagaagttttcttggtggccaaagtagtcataatccacaaccaacaagcaatgttggtaatggtggtgctagaaatttctttggggggcaaaattatccaccacttactagcaatgttgatagtggtgatggtagaagttttctgggagggcaaaataatccaccgccaataactagcaatgtggctaatggtattaacaataataatagcatggttacaatgaacaatggcattgttttgccaccagatcatggtgctaataagagaaaggaagttcaaggcatcacaattcctcatgatacctattcctgccatagctctcagtgcccttatcatgaaaccagctttggattcagtgacatgaatgtgaggaacaatcatcagctggcatgcatatacaataatggcaacaacaacaacaacaacattgtgcaagtggttggtggcggtggtggaggctcaagctcttcacagcttggacctggaaaccctaaaaacaatgttaatgtggctcttggtcaatctatgcacattgctgcaccagttgtgaatcagactcagactcagaatcttactattggtcaacctaggcatagtgctgcaccagctgtgaataatcaaaaccagactcttaatgtgatcagtgacaacaataattctggagaaatagggtcaaatggttcgatgcacaacatgaatgttgttgttcctctaggaaaccaaaaccagcagcaggtgcaaaatgttcttcagcctcaggtggtggacagcaacaatttctatggtggtggaagggtttctttggacaagaataataataatctctttggcaacaacagcatgaatattaatagtgttcctcctcttctagtatgccaaaacatgcagcaggtgcaaagtgttcagcctcaggttatggacaagaatttctttgttggtggaagggtttctctggacaagaataataataatctctttgacaacaacatgaacacttttccccttctaggaagccaaaacatgcagcaggtgcaaaatgttcatgagcctcaggttatggacaagagtactttctttggtgaaagggttggtggtggttacaagctgaataatgctgatcaagtgcatggagatttttcaacatcaacatcaatggatccttcttcctatgatcaatgggatgcaactaataattcccaatctgattttatggactctcctttgttggcagcaccgagccaggatttcctttggctatacaattaa

SEQ ID NO: 8449 - DNA, 1059 bp, Glycine max
  Peptide Sequence Number=SeqID_100134
atggaagaggggacatttgaacaaccatctttggagaaacactattatgggaactgtcctggttgtaaggtggatcaagccaaagagctgagaaaggatgtttccattagaaatctttcttatatttggatggcagtgttatgtggcaccaatcccattcaacagagttctattactgctccacatgatatgcatcctcaaagggctttgacatccatattttggggaatgctatctgatcgctatggtagaaaacctgttataatttcagggattattactgttgtcattttcaacacattatttggtcttagcacgaatctttggatggctattagcatgagatttcttcttggaagtttaaatggattacttggaccaataaaggcttatgctgctgaaattttcagagaagagaagcaagctctaggactctcaaactttgttgctgcttggggagtaggactagtcattggccctgcattgggaggttatttggctcagccagtgttgaaatacccacatatgtttccaaaggattccttttgggataggtttccatatttcttgccgtgctttataatatcagcttttgcgtttgcatcaggaattgcttgcatttggcttccagagacccttcacaaccacaaaagtagcagtgagtccactaacagtgttgaagctttggaaatggaaagcaatgagactaacaacgataagatgatatctgcatcattgcaagagacccttcacaaccacaatggtggtagcattgagtccactatcaatgtcaaagctttggaaattggaagcaatgaagcaaacaaagacaagacgattcaaaaagataaaagcatcttccaaaattggcccttaatgtcatccatcattgtttactgtgttttttcactacatgatgttgcttaccaagaggtagtgttcttacttaatgatttttctattttgactctctctcttacttatactaatttactatccatttaccattctaggttttctcattgtgggctctcagtcccagaagattgggtggtctga

SEQ ID NO: 8450 - DNA, 2568 bp, Glycine max
  Peptide Sequence Number=SeqID_100135
atggattctatggatgatcacaacatgactattgatctcttggacacttcaatgagaaccgttgaagaagaatcgattgaagaagaaggaatgattgaagaagaagaagatgatgatcataatcggcaaaaacaagtattaacgattgaggaactcgagaagaggatgtggagagaccagatactgctgaagaaacttaaggatgagagaaaggagaaagaacaagggcaaacagtggagatgatgaagaagaaggccttgactcgtgcacaagacattgtgctgaagaacatgctcaagatgatggaggtttgtgatgtaaggggttttgtttatggcataattcctgataaggggaagccagtgagtggtgcttctgataaccttcgtggttggtggaaggaaagggttaagtttgatcgtaatggtcctgctgcaatgttgaggtatgatgaagaaactgggtttgacgacctaggtaatgaattcaggggagacccatcatcagcctaccgtttgagtgatctcccagacacaaccctagggtcactcttgtcatgtctgatgcagcactgtgatccccctcagaggaggtaccctctggacaagggtgttcccccaccctggtggcccactgggtttgagatctggtggcccgagctaggctttgctgctgacccaggcccacctccctacaggaagccccatgacctcaagaaggtatggaagctgtgcgtgctgaccgcagtgatcaagcacatctcccctgacatcaccaagatcaagaacatagtgcggctttcgaggacccttcaggacaagctcactgccaaggagactgctatttggagtgctgttgtgaaacgtgaagaaacccttgctagaagattgcaccctcatttgttcccagcccaaccaattatcagaaggcctcatcatgagattcgtggttatgatattgaaggaagtggtgctcgtgctaggaactttcttgggggccaaagtagtcataacccaccaccaacttccaatgttgctgctcatagtaataatagtatgcttctagcaagtggaactgctagaaattttcttggtggcctaagtagtcataatccacaaccaacaagcaatgttggtaatggtggtgctagaaatttcattggcgggcaaaattatccgccccttaatagcaatgttgataatggtgatggtagaagttttctgggagggcaaaataatccaccaccaataactagcaattttgctaatggtattagcaatgataatagcatggttacaatgaacaatggcattgttttgccaccagatcatggtgctaacaagagaaaggaagttcaaggcatcccaattcctcatgagacctattcctgtcatagccctcagtgcccttataatgaaaccagctttggattcagtgacatgaatgtgaggaacaatcatcagctggcatgcatatacaataatgacaacaacaaccacaacaacgctgtgcaagtggttggtggtgatggtggaggctcaagctcttcacagcttggacgtggaaatcctaaaaacaatgttaatgtggctcttggtcaatctatgcacacttctgcaccagttgtgaatcagtctcagactcagaatcttcctattggtcaacctatgaacatttcagcaccagttgtgagtcaaaatcaggctcttactattggtcaacctatgaacatttcagcaccagttgtgagtcaaaatcagtctcttactactattggtcaacctatgaacatttcagcacctgttgtgagtcaaaatcagtctcttactattggtcaacctatgagcatttcagcaccagttgcgagtcaaaatcagtctcttactattggtcaaccaccagctgtgaataatcaaaaccagactcttaatgtgatcagtgacaacaataattctggagaaatagggtcaaatggtttgatgcacaacatgaatgttgttgttcctctaggaaaccaaaaccagcagcaggtgcaaaatgttcttcagcctcaggtggtggacagcaacaatttctttggtggtggaagggtttctttggacaagaataataataatctctttggcaacaacaacatgaatattaatagtgttcctcctcttctagcaagccaaaacatgcagcagatgcaaagtgttcagcctcaggttatggacaagaatttctatgttggtggaagggtttctctggacaagaataataataatctctttgacaacaacatgaacaattttccccctctagaaagccaaaacatgcaacagttgcaaaatgttcatgagcctcaggttatggacaagagtactttctttggtgaaaggattggtggtggttacaagctgaataatgctgatcaagtgcatggagatttttcaacattaacatcaatggatccttcttcctatgatcaatgggatgcaacaaataattcccaatctgattttatggactctcctttgttgacagcaccgttgacagcaccgagccaggatttcctttggctataa

SEQ ID NO: 8451 - DNA, 189 bp, Glycine max
  Peptide Sequence Number=SeqID_100136
atgtcccccgtttccattttggtgcatcctagctcggccaagggagtgcaatgcccttcacttgtgcatcatgcggaaacagaccagaaacagatcaccatgtttttgttggctgctgcaacattgaagcagtttgggagaaagcttccttatggcacatcatcaatactgttcgcaacacgtagataa

SEQ ID NO: 8452 - DNA, 1167 bp, Glycine max
  Peptide Sequence Number=SeqID_100137
atgacagaagagactaatattggagaaccacttttaaagaaacagtactatgagaactgccctggttgcaaggttgatagagccaaggagctggaaaaggatgtctccattcgaaatctcgtccatatatggattgtggtgttgtgcggtgctcttcctgtttcttctctctatcctttcctttatttcatggtgaaggattttaatattgcagaaggggaggaagatatcagtgcctatgctggctatattgggtctgcattcatgcttggtagatgtttgacatctatgttgtggggaatgatagctgatcgctatggtagaaaacctgttgtgattataagtgttatttctgttgtcattttcaacatactattcggccttagtacaagtttttggatggctgttattacaagactttttcttggatgtttaaatggtgtgatgggcacaatcaaggctttttcttctgaaatatttcgagaagaatatcaacctctgggactctcaaccgtctctgctgcttggggagtaggtttagcacttggcccagcattgggaggttatttggctcagccagtagaaaaatacccatatttattttcaaagggttccttttgggataggtttccctacttcttgccctgcttggttatatcaacttttgcattttccgttgcaattgcttgcatttggcttccggagacaaatcataaccacaatcctgaagctttagaaatcagaagtagggcccccgacaaagacaaggtggtccaaaacaatgaaagtgtcttccgaaattggcctttaatgtcatctatcattgtttattgtgttttttcacttcatgacaatgcttattctgaggttttctcattatgggctgtcagtcctcgatggttgggaggtttaaactttacaaccaacagtgttggtaatgttttagtagtttcagcaaaaagaaaagatatatcaaaaaagggatacaaagtaaaatcacatcaccttccacacccgactactggagatcatctattcccatccaatgacagaaaaattttctgtgtattaaatgcttcccaaacttcctcacaatccttccactcacagcccatcaaaatttgctccttgattattaactgccttaaaatctccacccaccattaa

SEQ ID NO: 8453 - DNA, 2046 bp, Glycine max
  Peptide Sequence Number=SeqID_100138
atgatgcagagtgatagtagcagtagaagaagcgtaaagagaggagacatagtgtgggtcagagtccacttccctcacaaatggcaccccgcactcgttctctcttcccgcgacaacctcggcgtccaagtcaccttctccttctccccaaacgacgccgtttcagtttcacccgccacaacctacttcgtcgagtccgaggttgtccccttcgaggaagctttcccttccctcatcacccgccgcaacgttgacgcgccgccgcttcactccgcgctccgcctgttgggccagagggtcctttccgggctgcggtgccactgcctaacgggccgggcccaggcccaacaacaatcggcccgcgagttcgacccggttggggtcttgggttttgttttggacgccgcggtttcgccgtgggtggaatccccgcgtttcgcacacgccgttagagttgttgctcaggttcacgcttttcgaaggtattcttctatgcagcacaagaaaatttacaaacagaataaagaaacaggtgatgataatgtgaagctgcttctaatttcatctttgagtcagacggtgcacaaagttactcaagaatctgttgccttggaacccaaggaaaaatgtcagatcatatccaaaaatggggagaaaaacaaagctattggtgctataaaaagattgaactcaacagttccagtttgggaaggaaattctgcacacttgtttaagaataaacatctgattatttcacagaatcttgtgcactctcctgctttagatccactttacatggtgcgagaaagcctaaaatctgcaaggctgagccttctgggattcaaaaatagatcagaccagggcatagttgatatctgctttgaagacttttctactatgagtagaactcacatctcagttccttccaattttataattcatttgagaaactacattgataaaagaaaagacaatgtactggggctttgctggagattgcctgacaaagaaaccaccgttatatatcttaacagggggaaaagaaggcgactagataataaaccagcttcatgtaatgattttcctcaaattagtgaagttcaagaaagtgaaagggatggagatatctcaaaacataccactcctaggatctcagacattaagatgcttgaaccagaaggaagtatccagaaaggccatgaggcctcaacatgcgtttgtgaaactaatatgaacttcactgaggaggttcagaaagtggattcaaaaagaatgcattgcttgcattctgatgagtgtgagattgatgctaatgcagcaaaagttaaaggtacgttggaatctgactcatctgtttaccctgaaaggatgcaaattagttgcaatagtgttacaacacctctcaagtcgaaaaggtctgcaagaacagaattatcttctggggattgtttggtggagggtaaggatcgctaccaaagtgttgcttcttgttcaatattcaattcaaatgttggacagctatcaaatacatatgtccccttttatcgtaaatctttgatcatgaagttccccaagaatttcaacctaccatccaaggaacagttagtaaagaagtttagtgtatttggctcagtagattcgtatagaacaagggtcttttgctatgctggctcagctctggtgtcttttttacaagaagctgatgcagttgctgcatttaaatatgccaaaaagaaggccttgtttgataaggctaatgtccggttttggcttgacccatttgagcacagaagaagaggattcaacccatcaacaaataaacaaacaggaccaccactgaaatcttgtttgaaatattccaattccttgagtagggaaaacaggaagaagcatcgcagagtaagatttataatatctgctcctgtgcccccatcaacaagtaaacaaacaggaccaccactgaaatcttgtttgaaaaattccaattccttgtgtaaggaaaacaagaagaaacatcgcagagtaagatttacaatagaaacttag

SEQ ID NO: 8454 - DNA, 2470 bp, Glycine max
  Peptide Sequence Number=SeqID_100139
ggttcttgtcaccaaccaactacattttctccctcaggtggataaaatcattctggttagtgaaggaatgattaaggagcagggaacctttgaggagttatcaaaaagtgggcctctatttcagaaactaatggaaaatgcagggaaaatggaacaagcagataataatgaagatagagaaagtcatggcacagataacgatttacccatgaataatgaagcaattgaggaattaccaagtgatgcaagctatgagaaaaaaggaaaattacgaaaatcagtacttattaagaaagaagagcgggagacaggcgtggttagttggaaagttgtaatgcggtacaaatctgcactgggaggactgtgggtagtttccatactattttcttgctatacattaacagaagttcttcgaatttcaagtagcacatggttaagtgtgtggacatctcaagattccactgcagattatgatccaacgtattttcttttgatctatgcacttttctcatttggacaggtatctgtggcacttgcaaactcttattggttgatcatttgtagtcttcgtgctgccaaaaatttgcacgatgcaatgctagataaaatcctccgggctcctatggtattcttccaaactaatccggttggccgcataattaataggtttgcaaaagatacgggagatatagataccaatgtttttaatttggtgaacatgtttttggggcaagtctggcaactactttcgacatttgttcttataggcaccgtgagcaccatatccctgtgggctataatgccacttctgatcttcttttatgcagcttatctatattaccagagcacagctcgagaggtaaagcgcatggattccattacaagatctcctgtttatgcacattttggtgaatcactgaacggtttgtcaagcattcgtgcatataaagcatatgacagaatggcacacattaatggaaaattcatggataaaaacatcagattcactcttgtgaatatcagctcaaatcgttggctaaccataaggctagaaacattaggaggcctgatgatttggttgatagcaacatctgctgtcttgcagaatgcaagagctgcaaaccaggcaatgtttgcatctacaatgggtttacttctcagttatactttgaacataacaaatctcttgagtggtgtcctcagacaagcaagtagagctgaaaacagtttaaattctgttgagcgtgtcgacacatacataaatttagaaactgaggctcccggtgtaattgagacacatcgtccaccaccaggatggccaacatcaggatcaattgagtttgaggatgttgttctgagataccggccagaacttcctccagtgttgcatggattgtcctttacagtacctccaactgagaagatagggatagttggaagaactggtgcaggaaaatctagcatgcttaacgcactattccggattgtggagctacaaaaaggaaaaatcattattgatggttgtgatatttctacattcggattagaagatgttcgaaaagttcttactatcataccacaatctccagttcttttctctggaactgttcgtttcaatcttgatccatttaatgaacacaatgatgctgacctatggcaagctttagaaagggcgcatttgaaggatgtaataagaagaaatacgtttggtctagatgctaaggtttcagagggaggagacaattttagtgttggacagaggcaactgttaagtctagctagagcattgctacgaagatcaaaggttcttgtcctggatgaagctactgctgctgtagatgttagaactgatgcacttatacagaaaactatcagacaagaatttcagtcctgcacaatgctcatcattgcacacagactaaatacaatcatcgactgcaatcagattctgctgctagatgctggccgggttcttgaatatagttcaccagaggagctcttacaaaacgaaggaactgctttctacaagatggttcaaagtactggacctgaaaatgctcagtatttatgtagcctagtatttggaaagacagagaataactctaatgaatataacaaggagttggaacaccatgtgagacaattagcttcttctcactggacttcttctactcagtttgccatagcttctaccctttcttcattacaccagcaccttcaagagccaagtagtgaagaaaataaagatatccttcataaaacaacggctgcagttacaacacttcaagaagttctagtggggaagcatgatgaagacatagaagagacactgtataaataccatattcctacagatagatggtggtctactctctataaagttattgaaggtctttctcttttgaagaggttgcctctagacaacattcaacaactagaacttgattttgaagggagatcttttgactaa

SEQ ID NO: 8455 - DNA, 1119 bp, Glycine max
  Peptide Sequence Number=SeqID_100140
atggggtttcagccattgaattggtactgccggccagcagagaacagcatttgggcaaaagcagtggatagtgcttttgggtcctatacaccttgtgcaatcaacactcttgttatctccatttccaatttggttcttgtgggtttgtgcttgtatcggatatggcttatcacttgcaatgctaaagctcagaggttttgtttgagttcgaattgctatagctatcttatgggaatgttggctgcttattgtgctgttcaacctattttgagattgttaactggaaattcagctttcaacctgaatggcgaaaccgaatttgctccagttgagataactacactgatcgttgaagcgcttacttggagctcaatgataactctcatcctcttggaaacaaaggtgttgtttggtaccttactttttgtttacattccggatttggttccttattctggtcatacaacaatgcaagctgagctacctgaccatggtgaatatgaacctctttgtggagatgatcaagtagcaaatgcaaatgtctcattgcaacgtttggaggaactgttcttagctgaggagcgaaatttaaaacaaaatccacctattgaaccaggacttccagccatctcaattgagaatggatacttttcatgggatcgtaaggaagagaaaccgacattatcagatatcaatgtggaaataccagttggcagcttagttgcaatcattggcggtactggagaaggcaaaacatcacttatttcagcgatgattggagagttacctcctttagccaatggaaatgctacaatcagaggcactgttgcttatgttcctcagatttcatggatttacaatgccacagttcgtgaaaacatattatttggatcaaaatttgaatatgaacaatatcggaaggtcattgatatgactgctctacagcatgatctcaacttactacctggacgtgattttacagagatcggagaaagaggagtcaatattagtggtggtcaaaagcaaagagtttccatagctagggctgtatactcaaattcggatatatatatatttgatgatcctttgagtgctcttgatgctcatattgctcaagag

SEQ ID NO: 8456 - DNA, 265 bp, Glycine max
  Peptide Sequence Number=SeqID_100141
atggcaacaaaagcactcattaccatccaaagttttcttggcttcatgaccgtcttcaccatggcaagtgcacaatccccaaactacatgaatgatgactgccacaactcaacaacacaacaagccctaaccctaacataccaaaccaaccttcacaacaccctcttgtggctgtcttctgatgctgccacaagcaaaggatacaatcacaccaccacaggaaatggcacagttgatgctgtatatggcctctatgattgcaggg

SEQ ID NO: 8457 - DNA, 456 bp, Glycine max
  Peptide Sequence Number=SeqID_100142
atggctccagaatatgccatggaaggcttgttttcagtgaagtccgatgttttcagctttgtgttcttttgccagagatcattagtggaaaaaggatcaataaattccatctttcagaccgtggccaaagccttctcatatatgcatgttcctaaatcctactatacacttgcatggaacatctggtgtgaaaacaaaggtctggaattgatggatccgttaatagaaaaatcatgtgtaagtagtgaagttctgaagtgtatgcacattggactattgtgtgtacaagaagatgcagcagatagaccaacaatgtcaagtgttgttcatatgcttgcaagtgacaacgtgactgtcccaagcccgacacgccctgcattttctgttggaaggtttgccattgaacgaaggtcatcatcacctaacactatggtcattactctgtctatgaagtaa

SEQ ID NO: 8458 - DNA, 270 bp, Glycine max
  Peptide Sequence Number=SeqID_100143
atggttgatctccttggtggcgctggccagctagattgtacttggaatttcatccaagacatgcctatcaaaccagggatttctgttctaggtgcgatgttgggtgcttgcaaaatccataaaaatgtagaattgggagagaaggctgcagacaaactatttgagttagacccaaatgagggagggtatcatgtgttgcttgccaacatatatgcctctaattcaacgtgggataaagtagccaaggtgagaacagccatggaagattag

SEQ ID NO: 8459 - DNA, 126 bp, Glycine max
  Peptide Sequence Number=SeqID_100144
atgcatccacctgcaattggagaactcaacgctgccgccaaaaatgaatcagaaccagagatgaagttggaacgggttaccctcaacggaatggtgttcacggcttcgcaatctcagcagtgtcag

SEQ ID NO: 8460 - DNA, 1911 bp, Glycine max
  Peptide Sequence Number=SeqID_100145
atgaacgacatcatcgcgtgtgctgctgctgcagctaactcttctcttccaacctctgtgttgggtgttcttcactttctccactcccgaggaagatcctcctcttgtgttcacactccctctgaacttctaagggactttgccacaagagagttcaatgcgtttctgtggctatgtctcgttgctgtcaccacccttttgctcagaagactcttcaatctctttaggctgtggcatagggccaaaaccattcctgggccaccctctccctctttctttggacactgcaagcttttttcccggcaaaatttcaccttcactgacgtgttgtcagaatcccatcaaaagtatggacctattgttaagctgtggttaggtcctactcagctgttggtgtccgttacggatccagcactaattcaagagatgcttataaaggccaaggataagttgccttttaccggaaaagtgtttcatcttgcctttggggaatcaagcctctttgccccttcctttgaaaaggtgcaaaagagaagggaactattggcaaatgaattacatgaaagattgttgaagagtgacgatgtgattcctatgaaggttgcagacttcataacagataaaatagaaaacatcagaaccaaacgaggtatcaattctaggttggtttctcagcatatggctttcacaataatgggagccacattctttggagatggcttcttggcttcgccaaaggctgcaatatatgaggaactgtttatgatgattgctaaagatgcttgcttttgggcctcctataatgtaactcctttttggagacatgaattttggaggtatcaatgcttatgcacaaagttgaaatgcttaactcaagacatccttcaacattttagaaaaggctgcaaactatttggccaaactgaccaagatgtacgaaatgaaagttccaacaaagaaacgaagtcagcagatggtgcacaatgctgttctggtgatgacttccaagattactttttctttcgtgatcttaaggatcatcaagatggtaaagaagaaccttgtgggaacatcatgcgtgtgatatttcatggatgtcaaactacatctgctttaatcaccaatgtattgactaggcttgtcatgcatctggaaatacaggataaggtttattcggagattagcattgtaggaagaaacccatcaaaatatgagcatgaagatgtttataggatgcctttgttattggctacaatttatgaatctgcacgccttctgcccactggtccaatgctgcagaggtgttctttgaaacatgacttgtgctttgcaactggtttaaccatacctgctggagctgtactggttgtacctgtcgaattggtacacaaggatgactctagttgggggagtgatgcaagtgattttaatccttaccattttttgtcaacgggtacaaaaggatcagaattgaggggtttattgtctcttaataaccatagggtccgaggcttaaccaaaaatcacaaaagatctgtaaagaaagttgtgaaaggttctactgaagacctttctattacaggagtcagttcatgtgtactaaatgatccaaatgaaaatgcagcatttcttccttttggatctggtacacgtgcttgcattggacagaaattcatcatccaacttgttgcctcagtgttggcatcattgctaaaaaaatatgagaaaatgaaacatataaaaaggaatggagatgaggaaatggacaaggaaagtaactgtatgaatgcaaagtggtcggtgttacggcttaactcgggatcagatgaggactcaaacacaaccttgaagaataatcttcatcagcatcatcctaactcacagatattatttgtgaaaagggaccagtga

SEQ ID NO: 8461 - DNA, 456 bp, Glycine max
  Peptide Sequence Number=SeqID_100146
atggagatggagaatcttattagagcagaatgtgatatggcagggactcttatctttcagtacggaagtcagtgccaccttcactgcaccaaactcccttctaactcctttgtcgacgctttcgatcttcaccaccgcacgaatttgagttgttattgccgccacagcttactaatgccgacacacaaacacacctcgcaattcctcgtcggtgatgaggggatcgacgccgtcagggaaaagctcatgcttgatctcaagaccgaggccaataggatgaaggatgcgacacaattctcggcaaggagtgaggacgtggaatttgcggacgcgacatgctctagtggtcggagacgagtgaggattgacgagaggaagggcggtggcaaggggttgtcgttatcaccattgaggatgaagttacagatattgagaaggttgttgttgaggttttaa

SEQ ID NO: 8462 - DNA, 246 bp, Glycine max
  Peptide Sequence Number=SeqID_100147
atggatgaggcctctttgcacgtagaaatattcaaggagacatgcttcatgcggatcaagttgatccgcatgaagcttcgttcatgcctaacactaatgcggatcatctctcacactaacgcggatcatctcattgcggatcaagttgtttactacggaccaactaaagggctatgcggatcatctacggctaacctatgtctattgcggaacaacgaaaaggctatgcagatcatctacacctaa

SEQ ID NO: 8463 - DNA, 2226 bp, Glycine max
  Peptide Sequence Number=SeqID_100148
atggtgagagagatagagagggagatggcgagagagacagacgcggggccagagagagtgatggtgaatggatacgagtcgtgtccaaaaaagatagacggtgggagcgaggtagtaaggatcctaggcgaagctttgccggcaccaagccggtgcaacaactcaaccatacacgcactacttggagagagttcagacgtttcaaccttttacttcacgaggtttcctgaggatgctactgagagggacctctggtttcatttcaaaaaatggggggatgttagggagctctttatttctaagaagagaaacaaaatgggcaggaggtacggcttcgtgaggttcaagggggtttccgacgtccgtgcactagagaggcaactagataaccttgtagtgggaggcctgaagatatacgtgaatatcccgaaatacgcaagagaaacggggagaccggtgtctagaaaaacagagcccaatctccaggaggtgggtagcagtcaacgcccgataccacctcaatcagcaccttttcagcaaagggtccctgcgccgtcgtacgcaaatgtcctgcgcagagatacaaggctcacaaagcaaacgcgaaatgcagatcaggcaagcttcggtcaagaatggtctcaatcatcagtttacatcgacaccgtggttggagctaaaccgtggttttccgaggcgtgggtggggcgtttaaagcatatatccagcttcgacaaagttgacgatgagttatcctgggaactaggagcagaaatagttcccaagtatttaggggacgatatgatcctactccttggactttcagattccaaagcggaagaaatggtcaatgaagaatctcagcgtggaacgacgccattttattctctggagaaatggaatcaaaatatcagaacgggtcacagattaatttgggtcctctgttgggggattcctttgatggcgtgggatactgcaaacattcgcaagatcgtagctgcgataggtgacctggtggaggtggatgatgatgtggaggagctccgtcggctggaccgggcgagggtgcttatcagaaccccatggaggcccgcaattcagcacacggtgaaccttgatatcggcggggaggtttatcaggtccacatagttgaagaagcaacgcataactccggaaagtgttcctgttctggtcgtagcaacttcggctcatcggaggaaatctcctcgttcgacggcgacaccgacgacactaccttgaatgatgagggaccgccggaaattgacaaagaaccacctggggtcgacggaaacttcgtcaccgtgggacaggttaggggtaactcacttttacccggtggacaaacccccaatggtcagaatccaggtgctgaaccagtggataataaccacggtacctgctgcgctgccaatcagcaaggtgaatcagtatcgggagctctaaatggaaagttttcagagacgagccccattgtagagatagcggaggactgcgagaaaaaggaaatagccacagatgtcaggaagtcagacgtcgggatgagggagaagcagaataaggcagacggtcctcaccatttggataaagttgaccatttaggaagggggcagacaatagatgagagagatttcatagggtcacagctggcaacaccctatgacttgtgcaatacaggtgtcacctgtggagagcacgtgaaccttgacgaaggcaacgtttcccctgcctcacgtgatgttagtattgggcctttgaagtcgggcctagcaaataccacgaaaactaatgctgatttttcacaactctggcctagcccgactaaaaagccatctgaaactcctggaacatggaaggtttactctagaggcaggtggtgcaaaaagaaaatgtttctaaatagtgtggactgcaatctaccggaagaaaatgacacgagtagcttggctgttgataatgggcctatgaacctgggcttattaaatagcacaattgcagcaccccagcaagctaaagtagcatcagatacttcccccatgtctgattcagtccaccttcaggaggctgaacaccattggagtgtggtacagaatttgggaatgacctgcgacctgaaccatgatagcatcattgaaagtttccgggccatggagaacagagataagaaagaggcagagaagctgggtaatagaattcgtgcctcatga

SEQ ID NO: 8464 - DNA, 789 bp, Glycine max
  Peptide Sequence Number=SeqID_100149
atggacacgcagattgcacgtgatcatcttcagtacttcctaccaaatttccaacaccaatacggactgcgatcgcctgggcggagcagcgcggtcgccaccgtcgtcgccgcggttccggcacggtcggagcaagagcagaggctggggttcgtcgaaggagagcaattccatggagaagttggtctttattcttatgtcggcagttttcagaaggcgagtataaagaacggtgtcgttcttgtacacaagcgtgctcctcccggttctgtttataggagtcctcagctctttcaaaacttgtggcctctcatggaggctgataatggaactacactcaatgtgttgatgaaagcatggactaaaaacgagcttagagagtggaagccctgtgccaacgcaagtcttcctgaaacagaattgccaaagtcaaatgggttccttataattgaagcaaatggtggattgaatcagcaacgcttgtcgatatgtgatgcagttgctgtggctggactactaaatgcaactcttcttattcctatatttcatttaaatagtgtatggcgagactcaagcaattttggtgacattttcaatgaaaatttcttcatacaatcacttggaaatcgtgtgcatgtggtgagagaactccctgatgacatacttcaacgatttgacaataacataagtaatattgtcaatcttagagtaaaaggttggtccagttcagctcactatcttcagaaggtccttcctcagcttttgaaaatggggtgtgtgcctatgtag

SEQ ID NO: 8465 - DNA, 231 bp, Glycine max
  Peptide Sequence Number=SeqID_100150
atggtggagggtgcgttgggttgcggtggtggtggcggcgatcggggttccgacaacttcgatgacgccagagatgacgatggacattgccttctcaatgacacggtgctcgcaacgtctccattcgcaccttcctctctcgctcgaccttcaaggccctggccctcaaacaccccgtgtcgttttcattcccaactcctatttcaaatcggattttcctttgaggagtga

SEQ ID NO: 8466 - DNA, 138 bp, Glycine max
  Peptide Sequence Number=SeqID_100151
atgggggagggatgttgtacgcagccttacccttgcatatgcaaagaggctgtttccggattcgaacccatgaccaacaagtcaccaaggcacaactttaccgctgtaccagggctcgccctcatgcaacttcctgca

SEQ ID NO: 8467 - DNA, 1658 bp, Glycine max
  Peptide Sequence Number=SeqID_100152
atgcagaaactgctacgcccttcttcttctccggtcgccatcctctctatctccgtcaccgtggctactccctttctctcgttgccccccaaagtttcaaacttggtaccaatgtcagcagcgttcacttcttcttccctcaatccccaactttcttattctcgctatttggctctctctaccaacacttgctctgtctgcaggtgtctcagtctaacccactcccacaccaggaacaacaacaagacccttcttcttcttaacccctctagaaacctctccttacattcggcttcagaaggctccttcatcacccaacatgaccctgttgaggacgcaaaagagaagaagccctttaacttcaggctcaataggaggcaaaagggttcttcttcttcctccccagctccgtcaaatcctgatttgctggccatccccggtgtgggtcccagaaatttcagaaagctcgttcagaaaggcatcgctggtgttgcgcaactcaagcaactctacaaggataagttctttggaaaatctagtgacaagatggttgagtatctacagagttccgttggaataatccacaagaaccatgctgaaagtataactactttcattaaaaagagtgttgacgacgacgaggagaagttggaagacaattcctcctcctctgtgcagaagaagcgcttaacattctgtgttgagggtaatatcagtgttggcaagactactttccttcagagaatagcaaacgaaacaattgaattgcgtgatcttgttgaggtggttcctgaacccattagcaagtggcaggatgttggacctgatcacttcaacattttggatgctttttacgccgaaccgcaaaggtatgcctacaccttccagaactatgtgtttgtcacaagggtcatgcaggaaagagagtcatctgttggaatcaagcctcttcgtttgatggagaggagcgttttcagtgacaggatggcttatgctcttttatctcactgttcgatgaaggtttttgtacgagctgtccatgaagctaactggatgaatgggatggagatcagtatctatgactcgtggtttgatcctgtagtatcctccttgcctggacttattcctgatggttttatctatcttagggcaagtcctgatacttgccataagagaatgatgttaagaaaaagagcagaagaaggtggagtcagccttgactatctccgtgaccttcatgaaaagcacgaaagctggttatttccctcccaaagtggtaaccatggagtattatcagtcaatcagctgcctcatcatattgacaactctttacaccctgatataagagaccgtgttttttatctggagggtggtcacatgcattcaagcattcagaaggttcctgctttggttttggactgtgaacccaatattgatttcagcaaggatattgaagcgaagaggcaatatgcacgccaagttgcagaattttttgaatttgtgaagaaaaggaacgaggtttcatccaaggaaggaagtagccaagcccaaccacaggtgctgctacctcatgagggtggcctgtggctaccagatggaaagccttttccccaggaagccctcaaatctttggacttcagacgagcagcgtcgttcat

SEQ ID NO: 8468 - DNA, 396 bp, Glycine max
  Peptide Sequence Number=SeqID_100153
atggaggttattcttgtttggagaatagttacggaagtggaaataagatttacgctaactgactgtaacatccactcagttcagtcggggatgatgcaggttggctacattgttatgagagaaccttctactggagctaggacaaatttgttgagaatgaaaggtgctgaggttgttggtgtctatcatccactgattgatgaaaatcttgtgaaagttttgcacaggaggaacaaaaaggtgtatgcctggacagttgatgatgtagaatccatgcaaaaggtgttgtttgaacatgttgatgctattgttacgagcaacccgacttttcttcaacgcctaatgcaagatatcaaaacacaatgtcttgaagagggttattcattaccacgctaa

SEQ ID NO: 8469 - DNA, 1473 bp, Glycine max
  Peptide Sequence Number=SeqID_100154
atggcggagaagcacttgcgggagctccttaaagaggatcaagaacccttccttctgaaacactacatttgggagcgtcgcaggcagctcaaaagaccttccccaaacagccctttacaacaacaactgaaaaagaaaaactcaaacttcccacttaacaaatgcttcctcacttccctacaaaacgccacaaaatccccactcttattgtctccaaagaatagtacttctcccctcctcagaccctccaacgccaaaaccgcgtcgctcctcctcgaagccgccctcagaatccacaacaaaaacgcgaaaccgaagaagcccaaaccaaacagcgccttgggcatcttcggctcgctcttcaagaaactaaccaaccgaaagagggaaacattagagggtgttcttgttaaggttaaagacagcgacgacgatgttgttgtggtgggatcctgtgaggtcgggttcagttgttcctgcaacggaaggccaagcagtgctgtgtggtcggagagcaacgaggataaatcgttggacttggaatcttctagtagtggccactcatttgatgactctgttgctgaagagattgagtttctcaacaaacgcaaacatgttacggattctgcttgttttgacgacgatgatgatcacggcttcttctgtgaaagcccgttccgtttctccctccaacgcagccccggctactccggccgccacaccccggatttttcttcgccggctgcgtctccatgtcgccgcaaaactgaggacaaaaaaattaatggtgctgatggcgtcaacaaattccaatcaggggaagaagaggaagataaggaacagtgcagtccagtatctgttttagacccacccttcgatgacgatgatgatgggcatgatgatgaccatgaaggggatggttttgatttggactgtagctatgccaatgtacaaagaactaagcagcatctactaaacagacttcgtagattcgagaaacttgccgagttagatccggtagaacttgagaagagaatgctggatcaagaccgcgagtacaaaacatttactgaagaggacgatgattgtgaagacggcgacagcgaaacagcatgcaaagaaaatgctctgagaggagaattaatgtttgaaatcctctgccattcaagtgttgaagacacacaacagcaaactccagaagacctcaagaggctggtctatgatctcatcaaggaggaagagagggaagttaataattcttcagacatggtgataagaagggttcttaggaggctagaattgtggaaagaagtggagtccaacactattgatatgatgatagaagaggacttctctagagagcaatgcaggtggaagaaaaatgctgagcacacaagtgagctagctgtggaacttgaacttgctatcttttgctttctagtggaggagctttcagaggaactagtgtgttaa

SEQ ID NO: 8470 - DNA, 627 bp, Glycine max
  Peptide Sequence Number=SeqID_100155
atggtgtctcctcaagggaggaatacatggaaagttgatgatctcgtgccttatatggagaaaataatgattttatccgaagagcaagagagaatcactgagcttgcatcacatggtctagcgcgtcaatttccagcacaagagtttcacattcttcagtcaagtgttgaaactcaggacataggcagacgaagggaggccgttgaagcggaagaatattcccagcaaatggcggagcgtggccatggaatgtattacacgccacaaatatttgctcagtatccttttgaaggtcatcacattgatacttctgcaagcgaacattcgttcggtggtgttgcggaaacacatcctaatttttcatggccgactataaccccttcacagcaatgtcatggcccaattccaacacctaataccccattaggtacacaatggaatgtaccgggaccaatacctaatgtgggtgacttattaggtgttgatttgtgtcacgaattttctgctaaggctgaccaagtagaagcggggagacatcggggcagaagaaatcctgatcgccaagcacaaagatgggatcgaccatgtggcacttcctcacgtcatcagggacatcatagtgaatga

SEQ ID NO: 8471 - DNA, 294 bp, Glycine max
  Peptide Sequence Number=SeqID_100156
atggcaaacacgaaaattgaagaagaaagggcagcacacgggaggggaaaggagaagttcatgaacttggggaggagaagtgagaaaaactgcaaccctagcccctgcaaccctactccatcagaacactgcaaccctattccagttggcctgaaggtgtctcgccaatggcagcagcgagaccccctccacatcaactgtctcgccattggtgatggcggcatccatgcatgcacgccacgacacttatgtggtatgtcacatcgtcaaacttttgatttactcggtctatag

SEQ ID NO: 8472 - DNA, 289 bp, Glycine max
  Peptide Sequence Number=SeqID_100157
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatcggactgcgatgcggatgaaccggaagctggttacg

SEQ ID NO: 8473 - DNA, 261 bp, Glycine max
  Peptide Sequence Number=SeqID_100158
atggaaccagaatacttggacaagaatcctttcaaagcaaccgccaaaaagttgcaactggcagcattcttagcaagctcaaaatctaaagagagtcttactcagaatctcaaagaagttctccaactacttcaacaggaagtggaagaagaaccttcaaagaaggaagctgaatcatccgagactaatgatgaccaagaagatgatccattctaccagaatgaagatgactgttttggtatatcattagacgacgattaa

SEQ ID NO: 8474 - DNA, 809 bp, Glycine max
  Peptide Sequence Number=SeqID_100159
ctgctgtccgccgtgccgaataccagcgcccggccctgctttccgccctgcagcattgctacccggaatgttcgatctacgatcgctccgacgttgcggtacgtaaaaaagaaggcctgccgctggcgcagggcccggtatttggcgatctgccgccggaactgctgccgatcaccgaacacggcatgaagctgctggtggacattcagcaggggcacaaaaccggtttctacctcgaccagcgcgacagccgcctggcggcgcgcaattactccgccggccgtcgggtgctgaactgcttctcctacaccggcgccttcgccgtttccgctttgatgggcggttgcgcgcaggtgatcagcgtggatacctcgcaggcggcgctggatatcgccaaacagaacgtcgagctcaataagctggatctgaacaaagcggagttcgttcgcgatgacgtgttccagctgctgcgcaactaccgcactcaaggcgaaaaattcgatctgatcatcatggatccgccgaaattcgtcgagaacaagaatcagttggccagcgcctgccgcggctacaaagacatcaacatgctggcgctgcagctgctgaatccgggcggcattctgctcagcttctcctgctccggcctgatgccgaccgacctgttccagaaaattttggccgacgccgctgtagatgccggacgtgatgtacaatttatagagcagttccgacaggctgccgatcacccggtgatcgccacataccctgaggggctgtatctgaaaggattcgcttgtcgggtgatgtaa

SEQ ID NO: 8475 - DNA, 216 bp, Glycine max
  Peptide Sequence Number=SeqID_100160
atggtggaggatgcacgaacagcgctaggcaatcaattcgtggggctccggactcgatggtggaggatgcatgaatggcaatcaattcatggggctccagactcaatgtgctatgcaatcaattcctggggctccggacttgatggtggaggatgcatgaacagcgctaggcaatcaattcgtggggctccggacttgatggtggaggatgcatga

SEQ ID NO: 8476 - DNA, 324 bp, Glycine max
  Peptide Sequence Number=SeqID_100161
atgccaccaaggaagctctccgcaaagagatctaggagggacgccgcggccgaaggaaccagcaccgctcctgagtttgacaaccatcgtttcaagagcgcagggcaccagcagcgtttcaaggccatcaaaggatggtcgttccaccgagagagacgcgtccagctcaaggacgatgagtacacagattttcaggaagtgatagttcgccgacgttgggcgtcgctggtcactcccatggctaagtttgaccactgctcggcccacggaggagggcatgcgggacatgcggtcatgtttaaggggccagtggattccttttga

SEQ ID NO: 8477 - DNA, 1152 bp, Glycine max
  Peptide Sequence Number=SeqID_100162
atggccaatcaaggagactgggtcccgtttatggatgtgttagctttgctaattttcggggttgtcctctttccaaatgtggatggtttggtagacctagcagcaatcgacgctttccttgcctaccaccatagcaaggaaagtccggtggtagctgtcttggcagatctgtttgacacatttgaccgaaggtgcgaaaagagtagcgcacggatcatctgttgcttacccgccctctgtgtttggttggtttcgcacttgttccgacaagacacaagacatccatgtccgcacctgagccatcgctcgtgtactgaaaagaggagaatagattgggaccggctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatgggctgaaagttcatatacgagaattttgaagcaccggaagaggacgaaagaagtccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagagctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagtttgtctcagcgtttatgcgagacagagaccaacatgttagctatcatcgccaagtaccaagaagagttaggtctagccacggcccacgagcatagaatcgcggatgagtatgcccaa

SEQ ID NO: 8478 - DNA, 1791 bp, Glycine max
  Peptide Sequence Number=SeqID_100163
atgcgcaatcttggcctggcggcgcggtttgtctctggctacctgatccagctcaaggctgatgttgaggcactggatggaccgagtggcaccgataaggactttaccgacctacatgcgtggacggaggtctttattcctggcgctggctgggtggggctggacccgacgtctggcttgatggctggcgaaggacatatcccactagcgtgtaccgcattgccatcttcagcagcccctgtgacaggctttaccgatgtggcagaggtgacgtttagtcatgaaatgaaggtcacccgtatccatgaagatccgcgtgtgaccaagccatatagtgaaaaggattggcaggcaattcttaagctgggtgagcaggtagacaaacagctcaccaaaatggatgtgcggctgacacaagggggggagccaacatttgtctccatcgatgacatggatggcgcacagtggaatactgctgccttgggtgaacataaacgcaagttggcgggtgagctggcgttacgtttgaaagatcacttcgcgcctcatggattcttgcactatggccaggggaagtggtatccaggtgagccgttgccgcggtgggccatcaatatttactggcggccagatggtaaaccagtatggcgggacgccagcctgttctcggcggaaggccttggggatggttacggtattaagcaggcgcaggtgtttgccacccacttggcggatatcttgggttttcccaaggcgtgtgtgatgcctgcctatgaagatgtcatgagtctggcacagcaggagcagcaactgcctgccaatattgatccactcaaagccgacttgaaggatgcagccgagcgcaagcggctggctagcctgctcagtcaggggctggggcaggtagtggggtacatcatgccgcttaagccagacgaaagccgcagtgctggtgaatggttgaccagcaaatggccgttacggcgtgagcacttatacctgttggggggtgattcgccaatgggcttgcgcttgcccttgtcttcactgccctggcaattgcctgccgacattgagccggagtttgcccccgacacgtttgcagaaaaaacagctttggatgagaccaagacgcccacagtgagggtgaagcatcagacgacccaacctactgcacgcgaagtgatacatactgcattgtgcgttcaggtcaggcagggccggttatacgtattcatgccaccagtgacccggctggaagattacctggatttgctgagcgcgattgaacagacggccagtgatctcaaattgaaattatggttggaaggctataccccgccccgtgacagccgcctgaaattgctcagcgtgacgccggatcctggcgtgattgaggtgaatatccatccggcaaaaagctggaaagagctggttgcgaatgtcggtacgttgtatgaagaggcgcgtttatgccgcctggcaacagaaaaattcatgctggatggccgtcataccggtaccggtggcgggaatcatgtgaccctgggaggtgagacggcagcagacagcccgatgctacgacgccctgatgtactgcgtagcctgattacttactggcaaaatcacccgtccctatcctacctgttttctggcactttcattggacccactagccaggctccgcgtgtcgatgaggcgcgtgacgataacctgtatgagctggagattgccttccagcaaatggagaaaatgctgtctgccggaaaagaaagccagcagccctggctg

SEQ ID NO: 8479 - DNA, 390 bp, Glycine max
  Peptide Sequence Number=SeqID_100164
atgactacttctaatcaaaactccaatccagcgcgcgaactcgccaaatcgtttgaccctaaatccatcgaaagccaatggtatgccttctgggaaagcaaaggcttttatgccgcaggcctgaaccctgacgtccaggataacttctgcatcttgctgccaccgccaaacgtcactggcaccttgcatatgggtcatggttttaaccagaccattatggatgccctgacccgctaccaccgtatgcgtggtgacaataccctgtggcaacctggtactgaccacgccggtattgcgacacagattgtggtagaacgtcagctggatgcgcaaggcgtgagtcgccatgatttaggtcgcgaaaaatttctggaaaaagtgtgggaatga

SEQ ID NO: 8480 - DNA, 726 bp, Glycine max
  Peptide Sequence Number=SeqID_100165
atgaagcaaactcggaatggcttagtggccctgccgcggaaatacttggaaggcaaggcaagggacatggcaacccaagagaagtgggtcctgtttccggatatactagctttcctgatctttgggtttgtcctctttccgaatgtggatagtttggtggacctagccgcaattgatgctttccttgcatatcaccatagcaaggagagtcctgtggtggctatcttggcagacttatttgatacctttgaccgaaggcgcgagaagaacagcgcacggattatctgttgcttacccgctctctgtgtgtggttggtttcgcacctattccaacaagacataagacacccgtgtctgcttcaaagttattgctcgtgcgtcgaaaaaagaagagtcgattgggaccaacacttggctgggataggaggcagcacaattaattggtttcctcgatggaaggaaggaaaggagggagttcttttctcatgtggggactaccctaatgttccgttgatagggacgaggggttgtgttaactataatcccgcacttgccataagacaactagggtaccccatgaggggagcgccaacggaagagagcctctcgcctttccttgtgagagatttcagcgtgcaaagtctcaaggttatacaaagagtccacaaggcgtggagaattccgttgaggaaagacatgttggacaagtggcctcagatatcttaa

SEQ ID NO: 8481 - DNA, 282 bp, Glycine max
  Peptide Sequence Number=SeqID_100166
cgagcatctgctaagcgcaacactcctgggctaagcgcgaggaagactctggaagaagatgagttgtacagcggtcctaagtgcgctaagcgcatgagcacgaacaaggccacctatttaagcctgaaatcagattttgtgaagagagtttggactgggattcagagctttgcatccatagggtttctagagagagaaaggtctaagttccagagagtgttgagagatttttgctgtgtgaagatctgcagagaccagagcttgaagcaggagccgatttga

SEQ ID NO: 8482 - DNA, 144 bp, Glycine max
  misc_feature (74)..(74): n is a, c, g, or t
  Peptide Sequence Number=SeqID_100167
atgggaagagatcccaagaagtttctcctacacttaaatgctataagtgcaatcaatcagagaaggagatcaancttctatccaaggactatgagagcgatgagaacatctctcaagaagattaagcaaaaagcaaaagtctga

SEQ ID NO: 8483 - DNA, 647 bp, Glycine max
  Peptide Sequence Number=SeqID_100168
atgggtaaagcaaaagaggtgcaagagaaggtgaaggcctacatggaggccatgaaagaaaaaatggccacaatgatggaggccatgatgagcatgaagaggataatggaagccaatgcggttacaattgccgctaccagcactgttgctaaggtgaacccgatgcccccatctggcctcaaccaaatgaatcatccaaccttagacatggttggcaaagatttgggaagtagggatggcccccatgatgtgcaaaatcaaaacaagcacgccttcccgccatatggcctgcctcccaactatacaccacccaatgtggcatacactcccaatgaggatacacatgaaattccccaccacaatctagctgacttcgagccttgcctcggatatgccactgaagggcaagcagttggtggtatacccctacaaaaccctttggagggccctcagtatcacccacaactacacctcttgcattccacgacaagtaaaaaccctcatgctatgggaaagctggatcatctagaggaaaggctcagggccattgaaggaggtgaagattatgcctttgctaacctagaagagttgttcctagtacccaatatcatcacccctctcaagttcaaggtgctggactttgacaa

SEQ ID NO: 8484 - DNA, 585 bp, Glycine max
  Peptide Sequence Number=SeqID_100169
gctaagtgcgccctgtgcgctaagcctgagtgtcttcctgttgaggctgagctaagcgccagcatatggcatctaagaagaggaaagctccttctacccctacccaggccagatttaatagatccagagtttgacaagttcaaggaggaactcaagagaagacattgggatgagaagctgactgatttttctgatagcagtatagacatcgctgttgtgaaggaattttatgccaacctctatgaccctgaggataaatcacctaagcaggagttggctgctaagctttgtatcccatggaggggattcgagcgtaatgctgatgggcatcctttgaagattttgaggaagaacatgaccatgctctctcagacatggagtgttccttctttttctaacatcattcctaccttccacacatctgatgtgactttggatagagccaaattgatttatgggattattatgaagatggacatgaacctagtgatgcaatcctaccccgcaagggcattggatagaaaactccaagtagattgggccagagatgcaagagaaggccctagggttcttatgagccttagg

SEQ ID NO: 8485 - DNA, 324 bp, Glycine max
  Peptide Sequence Number=SeqID_100170
atggaggataagtcatctgagaccaccatcccatatccaattataatagaagaagaggcagaggagacacaggtgagacaagtagttgctgccacacctgagcgatcccttgaggctacttcagacccttctacacagggggaggacataccctcacctcaacccgcagtagacccctccactcctcttctagagatgtcagaggacccgactacatcattcctggctatggacacttctcctccagctactctagtattgcatctgacggataaggaggatgttcagacacaagacacccaggaccagtcacaggaattctga

SEQ ID NO: 8486 - DNA, 310 bp, Glycine max
  Peptide Sequence Number=SeqID_100171
ggcgaggctcacgggtgcgctttccaaaggaggaaagatgcgcggagtcaccaccaacgtttatttgtggaaaaaccgaaggaaaccggtcaaaatgaaaattctaagttcgggagttgtatttacgcttgaggaaagtattagcacctctcacgtcgacaaaagcggggcttttgctcctacgtaccctcctttggagaggaaatcagacctacgtagttctttcttatgcgtgaatcaagtgattctttttactttgaaaggtgatcattttaaggcgttggaccttaaaaatgatccattttacttg

SEQ ID NO: 8487 - DNA, 411 bp, Glycine max
  Peptide Sequence Number=SeqID_100172
atggccccgaggaaacttgcctcaaagagatccaggaaggataaagcggccgaaggaaccagttctgctcccgagtatgacagtcaccgctttaggagcgctgaacaccagcagcgcttcgaggccatcaaaggagggcgtgcgagatatgaggtcctagatgctattggccagttcctgggataccctttagtgctggaagagggccaggagtgcgagtatggccagaggaggaaccggtccgatgggttcgatgaggaggccatcgcccagttgctatgtataccggggcaggattttgcccggactgctgccgggagacgggtgcggatcatgcgcaccaacatgaccactctgactcagatctggatgactttgctgcatcagcaacatccagcccagcgaccataa

SEQ ID NO: 8488 - DNA, 135 bp, Glycine max
  Peptide Sequence Number=SeqID_100173
atggagaaatctgaaaagaaaagaaagcgtacatcacatgggatgacaatgatatggaatcttctgaacgattccagaaacatgacagagataaacctctgtctaatggctaaaagttatgaaagcgatgaagag

SEQ ID NO: 8489 - DNA, 474 bp, Glycine max
  Peptide Sequence Number=SeqID_100174
atggcacacgagaccgccttttgttgccataactcaagagccggtagcccgcggagataccttacggttatccgcccccctttgccattcggacacagtcgtgttcaatggcaagcagagaccaagtttggtcattctgcacacatgatacgcggagataccttacggttatccgccccccctttgccattcagacacagtcgtgttcaatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccccctttgccattcagacacagtcgtgttcgatggcaagcagagaccaagtttggtcattctgcacacatgatacgcggagataccttacg

SEQ ID NO: 8490 - DNA, 1044 bp, Glycine max
  Peptide Sequence Number=SeqID_100175
atgggttctgtcttgatccctattgtaaacaaaccaacggagggtccgtgtcgccttcttaaaaacttgcgttggggcatttcgctacccctagacgtcgtatctaagaaggggacaaattccccggactcccgcattcctagattgcatctgtgtcatatgcattccatcatgcattcatccatcccacccatgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaaaaggagaatagattgggaccagctcttggccgggataggaggtagaacaatcagttggttcctccgatggaaggaaggaaaagaaggagtccttttctcatgtggaagatacccaaacattccgctggtaggaacgaggggttgtattaactag

SEQ ID NO: 8491 - DNA, 150 bp, Glycine max
  Peptide Sequence Number=SeqID_100176
atggtgttgaaccaagcacatgtttttaaggaaaggaaaaaatgcgctttacggcgcccttaccgaatgtgtgctagagttagagtaatgagtgaaatagaggaggtgcaagagcagatgaaggccaacatggaggccatgaaagactaa

SEQ ID NO: 8492 - DNA, 2250 bp, Glycine max
  Peptide Sequence Number=SeqID_100177
atggctgctgcctccaagaaagatcatgaaagtgatccatatgctcaacattcacagcacgggtggacagctttgcatacagctgttatgactgacgatgttgaattggttaaggttattcttgctgctggtgttgatgtgaacattcgtaatgtgcacaatggcattcctcttcacatagccttagctaggggtgctaagtcatgtgttgaactacttctatgtactggggcagattgtaatttgcaggatgatgatggtaacactgctctccatatagcagcagaaacagcaaaaatgatacgtgaaaatcttgattggctcattgtatgcttgggaatcctaatgctgattggcaagactctaggtgacatcttggatgtccttccccgagaatggatatcagaagatatgatggaggcactcatgaagaaaggagtttgtctctctcctacaatatttgaattgggagactgggtgaagtttagaaaaacttccataactccaacaaatgggtgggaaggtgatcggcagaagcaggtgggctttgtgcagagagttccagacaaagataatctcattgtttcattttgttctggagagtattatagtgttttggccaatgaagttgtaaaagtcgttctattagacaggggacaacatgtgcagcttaaagaggatgtaaaaaagccaagggatttctatgatcctttaaaatatctaaatagattggagaggtcatatttggatccaattgcaagtctcgtgacagcattggaacagtattatgtgttgatgatgatcatccgagttggatttcctggacaatccagaggatggaaagctgatccagaagagatggaacgtgttcaagaattcaagattggagattgggttcgcattcgtccttttcttacatctacaaagtacggattaggatctgtgacactggaaagcatcggcattgtatattgtatcagaccagatagtagtctgttaatagaactgagttatcttccaacctcatggcattgtgaaccggaagaggttgagcatgtagttccttttaggattggtgatcagatatgcgtgaagagatctgttgcagaacctagatatgcttggggaggtgagacacatcatagtgttggaaaaataagagagattgagggtgatggtctcttaataatagatataccaaaccgagttgttccatggcaagcagatccatcagacatggagaaggtggaagattttaaggtggatggaaattgggtcagagttaaagcttcagtgtctgctccaagatatgggtgggaggatgttacaagaaacagtattggagtaattcataacttggaggaggatggcgatatgggtattgccttttgcttcaggaatgagctttttcctttctcagtcactgatggtgagaaagttccacgttttgaggtggggcaagaaattcgtgtgatgccatctgttaaccagccacggctcggatggttaaacgaatcaccctctacttttggaaaaacagcaagaattgatttggatggtgcactcaatgtaggtaggcaaagcttgtggaaagtttctcctggggatgtggaacaacttccaggatttgaagttggtgattgggtttgctcaaaaccgagcccgggaagcagatcaagcagtgacttgaatggtgttagtagtataactgttgtgcatagtgttcaggattctggaaccggtttggtggaaccaaggtggggttggaaaggatctcggcctgaatctcaatgtgttttaaccggcattcatgctgatggagaagtgaaggcggcattctttggtttgccaggattgtggagaggagaccctgcagacctggaaattgaacagatgtttatgttgccttttgtggagagcaagaaaggtggcattggaacgatacaagccatcaatgctgatggaaagcttcgaatatacacgccagagggatcaaaagcatggatgttggacccatcagaagtggagatggtggaagagaaggggttctgcattggagattgggttaaggtcaaagcatttagtttcaaccccaacccaccattggggagagcatgggaaatggaacaggttaggccatttgaagtgggagacaatgttaggatcaaagatggattggtgaccccacggtggggatgggaaatggtgacacattccaaccctgctgatgttgtccttgatgaaaattga

SEQ ID NO: 8493 - DNA, 201 bp, Glycine max
  Peptide Sequence Number=SeqID_100178
atggaggataccaatgagttgttgcacctcttggtggatgctatgaataggggattgcgtgatgccaatggtcggatgaagtggtttcgaaaccagtataacatgatgtcaacccttatgcgcaacaactctagctttggatgggacccaattggaaaaactttcactgctcatgaggatgtatggaaagattacttaaag

SEQ ID NO: 8494 - DNA, 141 bp, Glycine max
  Peptide Sequence Number=SeqID_100179
atgttgctgggtgcacctagcatgtccccatattaccaagcatctggtcgtcacgattttgactgtaatttcggccacactggactcgtcatatacaccgatcctgctatctttaaaagtttgcatgtgaaaattgtctag

SEQ ID NO: 8495 - DNA, 345 bp, Glycine max
  Peptide Sequence Number=SeqID_100180
atgttggaatggttttctcctttggcatggtggcgtatgaagctgaaacaaattctagatgttgaaagacaaagagggatttcagaagatcacatagagaatttagtttctattgtgattattcaccgtctttatttcatggaacggggacaactctggtctagaaatgaagctcaagtctggggaacctttgaagcatatcccttgaaagaaagttatcgtcatcagctagcaaggcatctttgtgagatcaataattactcatacaaaactgtagatccaaatctgccaagttcatctcataggccaaaagaaaagattgggaagactataatgctcaattaa

SEQ ID NO: 8496 - DNA, 662 bp, Glycine max
  Peptide Sequence Number=SeqID_100181
atgaagaagtccgagctctaaaattagagttagggaaggcaagactcgccaaggagaagttcaagtcagttgctacacacatccggaaagagtgcaccgagttacaagaggaaaacgcagccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctagctatcatagggcaatacaaggaagaattgaaccagtccatggcccatgaacaaaagctagtggaggactttgcacaagtgtatgccgaaaaagaagcaagagggagggtgattgatgcgttgcatcaagaagcgactatgtggatggataggttcgccttgaccttgaatggaagtcaagacctcccgcgtctgttagccaaagcaaaagccatggccgaagtgtgtactgcccccaaggagattcatgggctaatcaattactgtcagcacatgatagatttgatggctcatataattaggaatcgttag

SEQ ID NO: 8497 - DNA, 339 bp, Glycine max
  Peptide Sequence Number=SeqID_100182
atgcaaatcattcattttggtgtccgtgatgccatgaggatgtgtcacatggtcgatcccatcttcgagcttggtgatcaagatttcttctgccctgattcgaccatgaaaaatgaggatgtgtttccgcaacaccaccgaacgaatgctcgcttgcagaagtatcagtgtgatgaccctaaaaaggttactaatacatctgtgtcggatactgagcaaatgtttgtggcgtgtaatacattccatggccacgctccgccatttgttgggaatattcttccgcttcaacagcctcctttcgtttgcctatgccctgagtttcaacacttgactgaataa

SEQ ID NO: 8498 - DNA, 363 bp, Glycine max
  Peptide Sequence Number=SeqID_100183
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttactgtttgttgaagctggattgcttccggaggaagcaacccagctcgcctgggcgagctgggcggcaacctcctccccctttttcctataa

SEQ ID NO: 8499 - DNA, 333 bp, Glycine max
  Peptide Sequence Number=SeqID_100184
atggcacatagtgtttttgctaatgatattcaacaattgtatgatgctactcagaaattggtcattcttaaacaaactgatcatgacatggttgcctatgtttcaaaagcccaatctgtagtggaagagttaaaattatcattggaagccgataaacttgaagacataaagatgaaacttgctaatctatatacggtgttggtactacgtgagatgcatccagattttgatcatattcgtgaccaagtcttaattggccaaaaaagggacgaggtgatcgtggaaatcgaggaggatgagctggaagaggaggtcgccctcaatgttcttact

SEQ ID NO: 8500 - DNA, 507 bp, Glycine max
  Peptide Sequence Number=SeqID_100185
gatgtgcgcaagaaggcacaggccatccagaagcagaatactgccccccacgttttgtctcgtggggtttatgattatttggagcaaaagctcctggctgagaagacgaagaagaagctggaggaagctgcacagtcaagaagcattgatggcgtcatcgacccttcatcctcggtcagacgccacgtgaagtggaagatgacccgcacgaagaagacaggggatatgacgactgaggctgcaaaggaaatcactgagaagattgacacacagggattgttcgttcccaatggacatcaggatgttcttaccgctgctattggacgtccagagcaccctggacgtgtccgtgctactggagccggtgtcaccatcaagcaatactttggatcggctcaacggacatcccgcagcgcttcctccctgcctcttgacgaattgcagcagctgacccagcaaatcagggaccagctagaggagtctatcatagagaaagtgacgaggtag

SEQ ID NO: 8501 - DNA, 222 bp, Glycine max
  Peptide Sequence Number=SeqID_100186
atgtcaatctccccctgtggaagtatcagttggatcgcgcccacaagacacccaatagacccgaaggagtccaacaaggccctagggtttccagctctgattacgagcctctgtcagttctatggagtgcccgtcgcccccagtagggtcacaggcccctataacagggatttcatcaagaagtactacgcccttaggcaagcgcagggcgaggcatcatag

SEQ ID NO: 8502 - DNA, 345 bp, Glycine max
  misc_feature (246)..(246): n is a, c, g, or t
  Peptide Sequence Number=SeqID_100187
atgaccacaatgatggaggccatgatgagcatgaagaagataatagaggtcaatgcggatgcagttgctgctaccagtgtttttgctgaggtggacccgactccctcatctagcctcaaccaaataaatcgtccaacctcagatagtgtaggtcacgggggcaaggaattgggaagtacggatgacccccattttgtgcaagtgcaaaacaagcatgccttcccgccatatggcttgcctcccaantatgcaccaaccaatgtggtacacactcccgatgagaatgccaataactccaatcccatacctattgagagccaacaaacccaagctgatcatgcacat

SEQ ID NO: 8503 - DNA, 369 bp, Glycine max
  Peptide Sequence Number=SeqID_100188
atgtcattgcctagcgctgttcatgtgttctccattatcaagtgcgaagcttcaggtgactgggaagcacgttattctgttgttttccagatcggttccttcgccaaagacgagagtcgtcatcacggaaaggcagggcggatgaaatcattgtcctatctttgctttcctcttatctacgatgagaggcttgcgcgatccgtgaaattccataatgtggcggaagtcgaaaagaggtgtttttgcgcaatctgtgagggggtgcaaatagcaaccaggcccacttgggccctccagaagattcctccagaaggctgttgcttctggaggaagcaaccttgctcgcctgggcgagctgagctcgcctgg

SEQ ID NO: 8504 - DNA, 216 bp, Glycine max
  Peptide Sequence Number=SeqID_100189
atgatccatgactttatagggatcgaaaggacttccttggaaaatcagattgttcctatggtgccaaatagaactagtcaaggcgatccaccatccaccccttatgtcctgatttacaggatccccaaagccttcacaaaattgagtaaagtggcactttgggtgacttggaaggggacctactacccggatccatctctaggattcccatcataa

SEQ ID NO: 8505 - DNA, 351 bp, Glycine max
  Peptide Sequence Number=SeqID_100190
gtcttggagaggatcaataacaatgcctataggttggacctcccaaaagagtatggagtcaacaccacttttaatatttctgatgtaattccttttgcaggtagagctgatattgaggaggaggaaccaatagatttgagatcaaatcttgttcaagggggaggggatgatgcaatcctttctaggaaggtaccagttaccatagccatgagcaagaggctccaagaagattgggctagagctgctaaagaaggccctagggttctcatgaaccttagggaatctactcaaggaagtttctcaaggaagcttttcaaggaggcttctcaaggaggtggacttagttattag

SEQ ID NO: 8506 - DNA, 252 bp, Glycine max
  Peptide Sequence Number=SeqID_100191
atgacaaggaaggtggaattggtgtcggggatgctccagtggctccgggacgaggtgttcgagttgccgcagcggaagtggatgaacccttgcgcttcctggatgattaggccatttgatgaagttattgaagattttgatcgaatgttgaactgggtttttggaaagattgattgcactggtattatcacacctaataggtatatggtcaagaaggattccatggttagagagttattacttcatccataa

SEQ ID NO: 8507 - DNA, 579 bp, Glycine max
  Peptide Sequence Number=SeqID_100192
gtagttgtatctctgccaaaaccacctctgaagcccgatccggaggtcgatgatccgctttatcaggttagatgggatgccaccatgttcggggtcattaatccaaatttccccctgcatctcactgaaacatgtatgcgagtagggaattctgatatctatggattcctcgagccacagtccattcagaggtctgggcaatcgcagtttgaatctgaaagttacataaagagttggatgcagagttcacaacgcgatgtctatcttggagcctacctaaatgggccagacaactaccttaaggggattattaatagtgctatcaagggtcgtgatgatgctccacagcctaaatcaaaggcttatgctaggtggattgtcgtcaagtgtaatagacaaaaaggaactattgagtgcggctactatgtcatgcgctggatgtccaccatcattttaggaacttttagaaataattgggaagcgtattttaacgatcctagaccattggagccagagagattaaaaacattgcggatccagtgggcacagttttatctccgaattagagatcaggcctag

SEQ ID NO: 8508 - DNA, 282 bp, Glycine max
  Peptide Sequence Number=SeqID_100193
atgggatcaagtcaaacgccttcgcttaaaaagaggttctatcaagtcaaggtcaagagcctaaggatcaccagtctaaaagagttagggcagttgatgggtcagctccaacgacaagcctttcgcaaagctttcagtaaaatctgggacctagccatggcagaggtctccacagaggccattgcctccctcgcccaatattatgatcagccattgaagatgcttcacttttggggacttctagctgtcacccatggtggaagaattttgaagagatcctag

SEQ ID NO: 8509 - DNA, 599 bp, Glycine max
  Peptide Sequence Number=SeqID_100194
atgagttatcattcatctagtgttaatagtgagggtactagtcataaggaccctctatctagaatcttacatgagttgagttccctcaagttatggaaagaaaaactagaaagaaaagaaaaaggaaaagagagggtagaaataaatcaagatgagagggaacaaataaggaaagaagaaagaaggaaaatactaaaagagttaagaaaagaaaaatatgcctcctatagtaatcatgactcttgcaaaagcctaagtgaagaactttgtgactattatgaaggaaggcataggtcacatcttagacctcactccaataggagagaaaaggaaagaaatcctcaagaggctaacattaacctctcatacttccatgggaaggacaatgtagaggcttacttagattgggaaataagggtaaagcaacaacttagaaggaagtctacttcaaaatcttatcgctctcactcatatccaaagaaagaccaaggtcaaggcatcttaggggcggcaccttctaagcccccagatgataagggaaagacaatagaaaagcaaccccctaaggctaatatgcaagagaagactagctgtataaa

SEQ ID NO: 8510 - DNA, 306 bp, Glycine max
  Peptide Sequence Number=SeqID_100195
atgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggagcacgcatcccgcaagtcacgcgtcgccctcccgccgaaggttacggaaacttacgaatttcgtaacgatacttgttttctttccgtaatgttacagaaccttgcggattacataatcatcccctttttgacttacggaatgttacggaacctcatttaa

SEQ ID NO: 8511 - DNA, 299 bp, Glycine max
  Peptide Sequence Number=SeqID_100196
atgaccgaccctctcgatgagtcgatctcttgctttctcataggggtgaacccttgggtactagtaccctcacctccagaggactacatgtcctcgcctttagagggccgcacgcccttgcctttagaggactacacgtcctcgccttcagaggactttacgtcttcaccttcagaggactacacgtcctcgccttcaaagggtcatgtaccttcaccttcagaggactacacgtcctcgccttcaaagggtcatgtacccttcactttcagaggactacacgtcctcgccttcaaaag

SEQ ID NO: 8512 - DNA, 309 bp, Glycine max
  Peptide Sequence Number=SeqID_100197
atggcttttggggcttccgggactcccgtaatacaacaacaacaacaacgccttatcccactagagtctaccggtcttctctctacatgtccaaaccacctaagtctattttccaccatcttctctacaataggcgctactccaaccctctctctaatagcttcgtttctaattttatcctgtcgagtcttactacacatccaccgcaacatcctcatctccgctacacctactttattctcatgttggctcttgaccgcccaacattctgttccgtacaaaatcgccggtcttaccgcagtccgataa

SEQ ID NO: 8513 - DNA, 393 bp, Glycine max
  Peptide Sequence Number=SeqID_100198
atggcctctggtaatcgattaccaatgctgtgtaatcgattaccaggcctagagatgggatcaggaacgttttatgttctgaagctgtgtaactcgagtttggtctctggtaatcgattaccaatgttgtgtaatcgattaccagaggagaaaagccttgaggcacaccttttatttgcatgtagtggttatgggacgctttatgttgctactgtagttagatctctcgtgaaagagtctacccctttcttttcttccttgcagatcgtgatggcagcgcagttcatccatgaccgagtggagatggagtgcctagagggagtttgggagacccttgaaggcaatgcaaggtgccgattccgtggcacgatccgactcacggctacttcgttg

SEQ ID NO: 8514 - DNA, 396 bp, Glycine max
  Peptide Sequence Number=SeqID_100199
atgcaagaaaaaagaaacatcgaaaagcctgcctccagatctgcatctcgatgttttgtggtggcgcggtctagatctcccgttgtagtgcaaaaattgcccattgaaatttctgacgacgaggactttattgacatcctctcccgcccatccagccatcggcttccttcgccgcctcggattgtctctcaaaagagtggctcacttcttgcctccgcgaactccagaccatcgttacaaccttcaaacacctcgacgtcacggcaaaagccaaacggtgaattaggcaatttctctttgcagaaatgcctgcagtctcaccattggagctggcgggataggcttgatgggactgcacctaaggaggttcacgtgttcaggctttcacgtgtttag

SEQ ID NO: 8515 - DNA, 909 bp, Glycine max
  Peptide Sequence Number=SeqID_100200
atgatgtggtatgatgagaggattaacaaagacagacaaataaaaaacccaaagtttgcattatgttgtagtgatgaaaaaatacaactacctgtgttacaagatgctccacaatcgttgaggcaactactctttgatactaacgactctcaagctaagaacttccagcaaaacattcgatcatataatgtaatgtttgcattcacatcacccggtctccaacttgacacaaggtataatacaaaaagagggtctcctacattccacgtacatggtcaaggtcatcatcttattggaagcctcctacctttggcaaataagtcaccaaagtttgcacaactatatatttatgatacagacaacaaagttaacaacaggctttcgcaaaacccgcagtcagatggaagattatacaatttgccaaatactgttgaagttgctgctttgattgttggtgacgagcacacaggctgcaatcaaggaacaattaagctcaaacaatactgcatgcaaggagattgtttcagcaataggttgttgatggttactcaactcagagttgacaaatacatcaatttgaatgcttgtaataatgcccctgaaacacttggcaacgaaaaaggtaagagagttatactacccagctcctttgttggtagtcaaaggtatatggaacaattatattttgatggcatggcaatttgtggccatatcggatttctagacctatttttgacattaacgtgtaatccagcatggcctgaaatacaaagaaaggttaggaaatccaatctcacacctcatgactgccctgatgttgtctcaaggatatttaaaatgaagttaaatcaattgatgaatgatctcaaacgtggacatgtctttggtcctattctgggatgtaagtaa

SEQ ID NO: 8516 - DNA, 810 bp, Glycine max
  Peptide Sequence Number=SeqID_100201
atggcaagagatagattgcaagatggtcaagtggataatatcaagttgaaattgattgcaaatcatgaaaaagatggtcgtacatataatgtacctactgttccagaagttgcagcgctaattgtaggcgattttgatgcaaattcaaaaagggatattattattgaaactcagcatggacaattacaaaggatccatgaattacattgtagctatctagctctacaataccctctcctatttccttacggggaagatggatatagacctaatatcctacatagcagtgcaccagatgaaaggctttctcacatcagaaacaaccaaaaaaaacttcgagttgacaagttttgcagcttacaacagtcattggatgatggaagcacgaaaggcctaaataaagatgaaattgatcaaattatagcagcagagataccttcacagcaagatcatccagaactgcattcattagtaaaaaaccatatggttcatggcccatgtggaacttcgaatcctagatctccatgcatgaaagaaggcaactgcagtcatttctatcctaaaatattccagtcgcatactgttttagatgcagatggttatccggtctaccgtagaagaaacaatggtcacacaattgagaaaaatggtgttataattgataacaagttgtcgcaacatgcccttttgcgggcgagcgaaggcgaggctcacgggtgcgctatccaaaggaggaaagatgcgcgaagtcgccaccaacgtttatttgtggaaaacgtcggaaaaaccgaaggaaaccggtcaaaatga

SEQ ID NO: 8517 - DNA, 219 bp, Glycine max
  Peptide Sequence Number=SeqID_100202
atgagctcggaggtgcaagcggtgcgctcaacgagtttgactctcactcaacgcacctatacaggtcatcttcttccaagttcttctatgtgcttagccaatcatgctgcgcctagcggatcatgcgctaagccagaagaggatggctcagcgaactgcaaaaatcaacttcaccaaacttgcttattttacctgaaattgaaatggaaaggttattaa

SEQ ID NO: 8518 - DNA, 453 bp, Glycine max
  Peptide Sequence Number=SeqID_100203
atgcacccatgcgcaatcaaggcacctttgttacctagacttatttatgtgtacttccaaggtgtatttgctacctacatcacatgcacttccttggctaaatttacatacatgcatactcaaagcatcttggccaccaaaaattgcacacgtgcacattctggtatttctaatacctatgcatatacaaactttgtgatgaatcttggctatctacacaacaaggatatatgtggggcaattactctagccctttcgaaacagaatgcatgtcccaaaaaaaatagaaaatatgtgcaaaccaaattgccccatgggttgtttccctacgaaaatcacgcgctaatgccattgaggcatttcaccgaacacttggtgggcgcgcgtttaggcatcaatagcaagagaacggggacaatgtggcatgtcccattgcttcaaaatgcattatag

SEQ ID NO: 8519 - DNA, 432 bp, Glycine max
  Peptide Sequence Number=SeqID_100204
atgacggtgaaaacctcggacacatgcagctcccggagacggtcacagcttgtctgtaagcggatgccgggagcagacaagcccgtcagggcgcgtcagcgggtgttgtcgggtgtcggggctggcttaactatgcggcatcagagcagatttgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccccttcagtaa

SEQ ID NO: 8520 - DNA, 243 bp, Glycine max
  Peptide Sequence Number=SeqID_100205
atgcgacttagaactgcatctagagacgttgtccctattaacttagaaattgaagctacttgtcggtgtaacaacgctgcaagaagaagaagggaacaagacacagaaggaagcagttacacctcacctcctctttctccacatcacactgaaatggacggggaaccggcacaaagagtcacactagaggacttttctaataccgccactcctcagttcttcacgagtattgcaaggccggag

SEQ ID NO: 8521 - DNA, 249 bp, Glycine max
  Peptide Sequence Number=SeqID_100206
atgacttatgtgtcacaccctaatttcgtccggggactatcattcatggatattttgattctcgctagccgaattgagctattcgacaccagttattgtgcaagccgaaagatcattcgatgttttggtcaaggatgcggaaaatacccaaggggaggggaaaaaggtcatttcaggcatttttctgggccttggctcactcaggctagcctctggctcgcctgggtgagccaaggtagtttagagtga

SEQ ID NO: 8522 - DNA, 216 bp, Glycine max
  Peptide Sequence Number=SeqID_100207
atgtcttccaaggttattttgatgatgccaaagaatcaagatttaagcaaagtttcaagcaaagattcaagattcaaatttcaagtttcaagattcaagaatcaagtttcaagaatcaagaataatcaagatcaagattcaagacccaagattcaagaatcaagagaagactcaatcaagataactactaaaaagttttttcaaaacattgagtag

SEQ ID NO: 8523 - DNA, 357 bp, Glycine max
  Peptide Sequence Number=SeqID_100208
atggagaacaacgatggtttgtggtggctaatggtggctatgggtgatggagaaagtgcttgggactttataaatgtctttggaagaaagaaagaagaagaaataacgtttttcctaagctacacggaagcaaaggctgaacttctagcagactatagacatctgcttaaagatcccaacggtcagatcatggaaaattgtcttttgaagttgcagaccaaatttcgagaagatctaacggttaacgaaggctgggtagcgtttttaccaagggtgttacagaacatgcagtttcagcaggagactagagcctcaattcagagtttaacaaatcagatggggcagatggccatctag

SEQ ID NO: 8524 - DNA, 267 bp, Glycine max
  Peptide Sequence Number=SeqID_100209
atgaaattcagtaatatatttgcaaggaaaagactgattgacgctaattttattttgcaccaaacaaaaggaaaccatttcctaactacagtgttaggggtcacgtgcaactccttgagtggagctaggtcaccctacgagactgtggtggcaactacagaatctccaagagaagcaatgacaaaaaaagatgcaaagataatggcggatagggtacctgggaatggccactttgatgacggcgacggaggacatcagtgtaggtga

SEQ ID NO: 8525 - DNA, 183 bp, Glycine max
  Peptide Sequence Number=SeqID_100210
atgacattaggtgctgaattcaatgtggaaagcttaacatgtagagattggaacacatcatctttaagaaaccctttaggtgcaagaaagaaaaggactacctatataagcatgaagtttagccgcttcaagaagctgggacttggctttgatatgcttatgaaggatagggacacaggctag

SEQ ID NO: 8526 - DNA, 207 bp, Glycine max
  Peptide Sequence Number=SeqID_100211
atgtaccctcccttgttctctttaataaaattaagagcgatgttaagcattatatttgggatgacccctatttgtggaagttgcagtgaccaggttattaggagatgcattccagaccatgagattgactctatcctgcaattctgtcattcttccgcaccaggtggcccatcttggcatacagaggacagctcgcaaggtgcttga

SEQ ID NO: 8527 - DNA, 606 bp, Glycine max
  Peptide Sequence Number=SeqID_100212
atgcagacctccatgcataccctgcaaaacaagctggaatcaagcgttgaagaaattccagatctcagaaatgaaattatgaaagccaaacaggaagcgatttctgatggtttgacaggcctgatgaaccgcaagggatttgatacggccttgcaccaatgcctggatacagtggccaatgacgaaacttgcctagtgattgccgacatcgactttttcaagcgcgtcaatgacagttacggccatttatttggtgataaagtgattcaggccgtggcccggattttaaaaacggtttcaggcaacctgtataccgctgcacgttatggcggggaagagtttgtactgttattgccgcataccagtgtagacattgccaaagagattgcagaatcagtacgccgtcaggtcgcggccatcagcattaaaaacaatgtgacacaacggctgatttccaacatcacgatttcactgggtgtcacgtcttaccagccgggcgaatctgtggatagtttcatcacgcgtgcggatcaggcgctttacacctcaaaagcacatggccgcaaccaggtcaccatgattaccgaagcgctggctgccgcctga

SEQ ID NO: 8528 - DNA, 1578 bp, Glycine max
  Peptide Sequence Number=SeqID_100213
atgcagatcctgttggctaacccgcgcggtttttgcgccggcgttgaccgcgctatcagcattgtcgaaaacgcgctgacgctgtacggcgcgccgatctacgttcgtcacgaagttgtccataaccgctacgtcgtcgatagcctgcgccagcgtggggcgatttttatcgaacagattagcgaagtgccggacggcgcgatcctgattttctccgcccacggggtttcgcaggcagtacgcaacgaagcgaagagtcgtgacctgacggttttcgacgctacctgcccgctggtaactaaagtccatatggaagtcgcccgcgccagccgccgcggcgaagagtcgattctgattggccacgccgggcatccggaagttgaaggcaccatgggccagtacaataaccccgaagggggcatgtatctggttgagtcgccggaggatgtgctgacgctggaagtgaaaaacgatgcccgactgtcgtttatgacccagaccacgctctccgtcgatgatacttctgacgttatcgacgcgctgcgcgagcgcttcccgaaaatcgtcggcccgcgtaaagacgatatttgctacgccaccaccaccgctgatgtggtgctggtggtcggttcgaaaaactcctcgaactccaatcgcctggctgaactggcgcagcggatggggaaagcggcctatcttatcgacgatgccaccgatatccaggaacaatgggttaagtctgctgcctgcgttggggtaacggcgggcgcgtcggccccggatatcctggtgcagaatgtgattgcccgtctgcaggagctgggcggcggcgaagcggtgccgttggaaggccgtgaagagaatatcgttttcgaggtgccgaaagagctgcgtgtagataaaaccatgcgcttaccgattattctcgacaccgatccgggtattgacgatgcggcggcgatcgccgccgcgctcttctcgccacagttggatttgcaattaatgaccacggtggcgggcaacgtctcggtggaaaagacgacccgcaacgcgctgcaactgctgcatttctggaatgccgatgtaccgctggcgcaaggcgcgtcgatgccgctggtacgtccgttgcgcaatgccgcctcggtgcatggcgagtccggcatggagggttatgctttcgtcgaacataaccgtcaaccgctggcaaaaccggcatttcaggcgatccgcgatgcgttgatacacgcgccggaacccgtgaccctggtggccatcggcccgctaaccaacattgccttgctgataacgcagtatcctgagtgcctgtttaatattcgtcgactggtgctgatgggcggctcggccgggcgcggcaactttacccccaacgccgagtttaatatcgccattgatcctgaagccgctgcgaaagtcttccagagcgggctggagattgtgatgtgtgggctggacgtcaccaataaagcgatgctgagtgcggactatctggtcacactgccaacgctcaatcagacaggcaaaatgcttcatgcgttatttagccaggggatcctctag

SEQ ID NO: 8529 - DNA, 204 bp, Glycine max
  Peptide Sequence Number=SeqID_100214
atggactcatctaaagactcaaaaaatgaagttgtaaacttgagtctaatggccaagagttatgaaagcaatgaagaggtatccttgaagaagagttcgcacatagataacggatgctctaaacatatgacggaagatgcatcaaagttcactcatatctctcccaagaaaaagcggacatgtgacttatggcgacaacaataa

SEQ ID NO: 8530 - DNA, 507 bp, Glycine max
  Peptide Sequence Number=SeqID_100215
atggtgaaaccaaaaaatatcttgctaacgttgaagaaacacaatgccaacagttgcaccacgataaagcaaatttacaatgcaagaagtgcatatcgttcttcaataagaggagctgatactgaaatacaacatctgatgaagcttctcgaacgtgatcaatacattcattggcatagattgaagatgaagttgtggtttcatatcgataagaatgtgaaggcgaagtgcaaatctttaatcggtgaaaaaaatgcgtgggactatgtaatggataacttgggtactttggtttattgtccgtctgaacaccagttccatgagtcacttcagaagtttcaagttgcttgttcgccttggctgatgttcattgactatgctaacgacacatggattatcccccacaaggaaaaatttattacaacatggacgaataagctcattgggctctcaaaagagtactacaaaatagcgttggagacctatgtaatgtttgggatgccatga

SEQ ID NO: 8531 - DNA, 222 bp, Glycine max
  Peptide Sequence Number=SeqID_100216
atgttgctaagtagcaacgtcatctatatctgtgcaagagtggttatgttggtgcgcatgatccgcactcgtctctttgtagcggtacgggtgaaatcttgcccccgtatgcatagtagctgtgtgatagcctccctctctggatgtgctcgcacagttggtcaccctccaatatcagggggtagcccaggaactgataaaaggaaactactggccccataa

SEQ ID NO: 8532 - DNA, 258 bp, Glycine max
  Peptide Sequence Number=SeqID_100217
acttatcaaggtaatccttgtggcgtctaccctgacttatcttccttcactggaagtggcgtctacccagacttatcttccttcactggaagtggcgtctaccttgacttatcttccttcaccggaagtggcgtctaccctgacttatcttctttcacgggaatggcgtctaccctgacttatcttatttcaccggaagtggcgtctaccctgacttatcttccttcatcggaagtggcgtcatccaattctccgtag

SEQ ID NO: 8533 - DNA, 408 bp, Glycine max
  Peptide Sequence Number=SeqID_100218
atgggtcctgaaggcaatcttcagaatgtcctcaaaacttcactcggatctgatggtctaacactaggtaccaaatctatagaaaactctatctctcactctggcggtaaatcggatacatcctcaagaaaaagcttttggaaattctctaacaatagggaggtcacccatagaaacattggtctctacttccagtttaacaagaaatggttggaagataaccacttcatacccatattaacatcaatttggctcaaagctccattggagcttgtaggcctaggatcttcttcatcaatggattcctttgcttcttggaagatgaatggcagcagaatggagaaggaagagagagaggagacgccacttcaaggagaagatgagtctagaagaggctcaccactatag

SEQ ID NO: 8534 - DNA, 210 bp, Glycine max
  Peptide Sequence Number=SeqID_100219
atggcggggtgtttcagaacctaccagaggatactggtgagaaaggggaataaagatgaactgggtaaaacaataggaagagaacaggagaaacctcccaagtctcaaattggttgtgagaatgggtccaaattctctaattggccgaatgagagagaagtgagatggaagggttttggagaaagccacgagctgatctggaaaatgtga

SEQ ID NO: 8535 - DNA, 387 bp, Glycine max
  Peptide Sequence Number=SeqID_100220
atggagagaagtatgatagatgctgccagtggtggagcccttggagacatgacccctgttgaagccagaaatttaattgagaagatggcttccaactcccaacagtttagcgccagaaatgatgttatagtcattagaggagtgcatgaggtagccacaaactcatctgcatcatctgaaactaagaagcttgaagatggaggaatcaccctaatctcagatggtctagccctaaacaacaacaacagcaacctgctccttccttccaaaatgatgttggtccaagtagaccatatgttcctcctccagtgcaacaacaagaacaacaacaacaacatcaacagagacaacaatccactactgaggcccctcctcaaccttcattga

SEQ ID NO: 8536 - DNA, 143 bp, Glycine max
  Peptide Sequence Number=SeqID_100221
gtcttccggaagtagtttccggaagaacttcttccggaattggccttcgccacttccggaagaccccggaattggccttcgtaacttccggaagaccttcttccggaagtggtcattccggaccttcctccttctgtgcctaa

SEQ ID NO: 8537 - DNA, 389 bp, Glycine max
  Peptide Sequence Number=SeqID_100222
gtcctgtcataccctaatttcgtccggggacctttgctcgatgacgtgcgaccattctttggtcctcgtgaggtgcttatgatgagaatcatgaaacaggccaaatacagtctaaaggcccaagtggagaaggacgaaggcccaagtggagaaggacaaagcccccgagtggagaaggatgaaggcccaagtaatccttgtggcgtctacccagacttatcttccttcactggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgcccc

SEQ ID NO: 8538 - DNA, 204 bp, Glycine max
  Peptide Sequence Number=SeqID_100223
atgttttattttaatgtagcgttcaacactctgtccaatgagcattcatccggtttttttaccctaaacttgcccaggctagcatctagctcgcctgggccaagaaaaagcttaagccctaagcaagctacttacctaggcgagctgatgacttcaagccttagcaagaagctcacatgggcaagcttcccctgcaccaaatag

SEQ ID NO: 8539 - DNA, 192 bp, Glycine max
  Peptide Sequence Number=SeqID_100224
atggagcgacaacttactgtctacaattacaatggtggttcttgctatggatgcctctttccaactccaccacctagaacaacatgccaaagttgtgttaagggtggagttctaggagtagtgttactactcaatgctagtttctgtgacatttacatgaacaatgccaaccataagactaaattcttttga

SEQ ID NO: 8540 - DNA, 123 bp, Glycine max
  Peptide Sequence Number=SeqID_100225
gtgttagttactgatgtcgtggctattgaaccttgtggagagggtcgacaaagcaattttggagtagctcctggccttgctaaatgtgtattatgggggacttcacctggtggccactcgtga

SEQ ID NO: 8541 - DNA, 402 bp, Glycine max
  misc_feature (379)..(379): n is a, c, g, or t
  Peptide Sequence Number=SeqID_100226
atgactaaggtggacgacaacaacacagcacttaggctacgtcgcacaaggccgcgaccctcaacgagggcgagaagcgcccccaccagttcaaatcgaggcccttacctttttcaaagaggaggactcactattggaggcatctcgatgagtatccttagattagaaattgcctatcaagatgacctcctgatccatgatgggtcaatcgagcccctaaagtcactaccacccagatcgatggcagaatcagacaaaaaagaagatattatggtggacaggagtacctttggaagttggaggaagaagaagggaaaatcgaaagccagaaagcacaagaggaagcaaggaaataagaagacaatgaacagtgacccanaatctaatgtccactccatttaa

SEQ ID NO: 8542 - DNA, 369 bp, Glycine max
  Peptide Sequence Number=SeqID_100227
atgacttcaagtcaaagtttggtgaaatctgattacgaaggaggtgatccaccacaaatggacgagacgaatatgaagaggagggcattgaaccgtgaatatgcaagacaatcgcggttgagaaagcataagcgattggaggatttgaccaacgaagtcaacatgttgcaaagtgcaaacaagaagttggtagagagcatcaaggctaaggaggaagcatatgctgagacagaagttgataacaacatcttgagagcgcaaaccgtggaattgactgatcgattgcgctttttgcactctatcattcaggttgcggaaaaggccaaagggttatctgttaatgtaaagattccaaatcttaagccgtag

SEQ ID NO: 8543 - DNA, 586 bp, Glycine max
  Peptide Sequence Number=SeqID_100228
atgcagtcccagtttgaatcccagatgcaatctcagggacttgcactgcctccagagcatatggttggtccctcaggtccttgtgccagcacaaaggagagttgtgttgatccctcaaggaacgatcctgggacgggtgactcagacaagtgcaggttgtacatcgaagcaaatcctccccgcctggttgccctaggaagagtttatgagggatcaacaattcacaacattcctttgttgcctggtcaagtgaaggttggtgttcaagaggttaaagatgcacaggctcccgttcctatacccactgatgaggttaccttagtggggcaggcacttaacattttccttgcttggctgacacatctcgtgaagcctttatcagaacatgcagctatttctccagcaaaacctccacaaaggtcggatcctgaggtcgatgattcactatatttgatgacattgaccatccaagagcttttcttgaagcctttccaggttaattgggatgctaccatgttcggggtctttaatccagacttcctgttgtacataaagcacgaagatctctccgaaatctcacacggtg

SEQ ID NO: 8544 - DNA, 1227 bp, Glycine max
  Peptide Sequence Number=SeqID_100229
atggtgcacactttcaggttcaagatgaatttaagcactatcttgattgcagggtctatgtttgtctgtccattcactaggtatgtgtctcccccagaagcatgttggaaaatttttgcattcccaatgcacggacattcaccggcagttgaacgcctttatttccaccttgaaaatcaacagccagtttactggacagatagtcaacaaattggtgcagttctatcaaagagcacaatcaaagaatcaatgttcacagcctggatgcattctaacaaaatatacccttatggacgggatcttacttatcctcaatatgtgtcaaaatttgtttatgttgcatgcaaaagatgctggcaaccaagaaaacaaggaaatacaataggcatgttcatatgggtcccaccttcaagtggcgaattgttttacctcagaatgatgctttcctctgctaaagatccacagtcttacaaagacattagaacagttgataatgtggtgtatgatacatttaggaaagcatgctttgcaaaaggatttctaggaagtgatcaagaatttattagtgctttacgagaggctaacaatgaacaaaagtctattgttgataccattatccgtgttgttgacactcaatcagggggagtttacttcctgtatagatatggtggaactggcaagacgtttgtctggaaaacattatcatctgctatacggtccaatggtggtattgtttgtacagttgcttcaagtgggattgcatcattactattgcctggtggcagcgacttggctgaattattgaaaattacaaaactgatagtgtgggatgaagctccaatgtgtcacaaatttacttttgaggcactcgataaaagccttaaagacatcatgcacaacaatcaaccttttggaggaaaggtgattgttttttgtggtgatttccgtcaaatactacctattgttccaagagacataggtgatggaaaacttggacaacctaatgatggatgttgcgaaatcaccatcccagatgagttccttataaaggactatactgatcctatccaggcaattcttgcttgtggggcttctatggaggctggatctttgagcttcaatgagcttggagaggatgcttcaatggaggaaaagaaagagggagaggaagagagaggggggagcacgaaattgaaggaagaaaaagggagagaagttgaactttga

SEQ ID NO: 8545 - DNA, 447 bp, Glycine max
  Peptide Sequence Number=SeqID_100230
atgtggatgacgttgctgctcagcaatgtcttgcctagtgatcataactccgatctccctctgccgaagtgtcagctggtgtatgccatcctgacacggatgagcgttcacgtggctcagctgattgctgacgccatctatttgtttgcaggtatgccacccaccaggcaccatctagacccggataagtctaacagggccttggggtttccggcattgatcacgggcctctgccagtcattcggggttcccgtcacccctagtaaggtgatccgatcgctgatcacccgggctttcattgagaagtattgcacgcctagacaggccgatcccgctgggtcactaggcatggagcgttatctacaacgcttggttcaccagcaggcggctaaccaccgagggcaggggcagggtttcgctccttttgcgtgccctactccagagtag

SEQ ID NO: 8546 - DNA, 237 bp, Glycine max
  Peptide Sequence Number=SeqID_100231
atgaagctatcagacttagtattttctcattttcactggccggagaggccaagagctggctccactcattcaaaggtcacaggttgtaccatttccccactgaagcaaacactcaagaaattcatttcatggggaatcaggagaggcaagggtatactcaaagaggattttcaggcttccatcaaggtccttataatcagcaaggacagtggaggacacacactagcaaccagttga

SEQ ID NO: 8547 - DNA, 515 bp, Glycine max
  Peptide Sequence Number=SeqID_100232
atggtcattctgtgccctttgtcattcaggagcagcaagtcgagtgataaacgcgcagagacaaattatggtcattctgcacaccttttcgccatcctgaggcgatcgtgtccgatggcacgcaaagacaaattatggtcattctgcgcctttccatccaggcccgatcgtgtccgatggcacgcagagacaaattatggtcattctgcgccttgtgtcaaccaagaggaacgaattcggcagtatcaggatgatgttggccgttcggtgctgatcattttcaaaatttttgcaggttccgctggcggggagattgaccggccgaatgggaccatctgtttgttgggatgcgacccttgcttgaccactttgaggtacttgacacccatcgttaggcaatccgtaaagttccgtaacattccggaagccaaagaagggatgattgcgggggtacaaatagcaatcaggcccacttggaccttccaggatcttccaacagaaggcggtgccttctg

SEQ ID NO: 8548 - DNA, 228 bp, Glycine max
  Peptide Sequence Number=SeqID_100233
atggggctccgaaaaagggtagcgactggagaattgcacttagtcatcattaagcatggctccaaactcgtgggtggaggatgcatgaaggaaaacgcaattcatgggggtcggaaaaagggtaaagaaaggagaattgctctaagcaatcactacgcatggctccaaatcacgtgggtggggatgcatgaaagaaaacaaaattcatggggctccgaaaaagggtag

SEQ ID NO: 8549 - DNA, 444 bp, Glycine max
  Peptide Sequence Number=SeqID_100234
atggccagaacacgaggtttaggtcgtgcgataggtagagttgtaggcagagatagacctgctgatgaggatgctgctgatgttcctgagaggcgtaggcctactgcctcagcccgtaggctacgcgttcatcagatgactgcagagggacgtgatatggctgaggacgtcgctgacatgactgatgatgtccctgagcagcctacggaggcacctgagatgcgtgtggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaaggtgacactgattgggaggccagtgcctgagattgaagggatg

SEQ ID NO: 8550 - DNA, 189 bp, Glycine max
  Peptide Sequence Number=SeqID_100235
gtaatccttgtggcgtctacccagacttatcttccttaaccggaagtggcgtctacccagacttatcttccttcaccggaagtggcgtctaccctgacttatcttccttcaccggaagtggcgtcatccaaaccttcgtagcctgtatcaaacgatccgcctcgaaagattcacatcaggcgtcacccg

SEQ ID NO: 8551 - DNA, 345 bp, Glycine max
  Peptide Sequence Number=SeqID_100236
atgcaaaagaatgcacatgcaaatgcatgtacctcaggtaaagccagaatgtatagaaaaggtatcctgcaaaaaagaaaagaaaaggctcagcctgacagatcacatgaggcaagtatagattccactctgaaagatatacaatgtcatggctattctgacttaggtgatcaggccatggaatgtagacattgcaatgcaaaaatgtggtatgatgaaagaatttcaaaagatagaaatacaacaagtccaaaattcaccttatgttgtggagatggaaaagttgagcttccgttattacaaaatccactgaaatatctggaacgtcttctgtttgatggttaa

SEQ ID NO: 8552 - DNA, 375 bp, Glycine max
  Peptide Sequence Number=SeqID_100237
atgtaccctctaactggtaccacaaaaggatgtaccctccaatgggttaagaccaagatctctgggcgggagaagggggacacaaaagaattcaggcggttagtccttcgttcttttggaaaagggagaagagagacacaaaaagaattcaggcagttagtccttggcgaattctatttggcaaagggagaagagatgaaaagaatgaatagcacaagttttcaaggttcagaaaatcagaaaactttggaaagcttttggcacaaagaagatgaagaagttcaaagagattcaaggcttgtaaaggatttcataagattgattggaaaagtgttcaagatacttgaaatgcaaaacaaagtcttgcttttatag

SEQ ID NO: 8553 - DNA, 78 bp, Glycine max
  Peptide Sequence Number=SeqID_100238
atgttggtggcgactctgcgcgtattcctttcgtggaacacgcctcccgcgagttactcgtcaccctcccgccgaagg

SEQ ID NO: 8554 - DNA, 213 bp, Glycine max
  Peptide Sequence Number=SeqID_100239
atggtagccataacccctgccagggttcctcaacctccatttttccgaggatacgactcaaacacaacatgtgcatatcatggaggagatccgggacattccattgagcactgtatgaccttgaagcgtaagcgacctgtgcttctgagtgttgacttccaagatcgttcgatcagatattactcgtcttgcatgttggtgggggtgtcgtaa

SEQ ID NO: 8555 - DNA, 306 bp, Glycine max
  Peptide Sequence Number=SeqID_100240
atgaaccacttcttccggaaagttcccgaaagaggtttttcgggagtcttccggaagaagggttcttccggaagacgtttggttacttccggaaactttccggaaaatgttctttcggaacttccggaagaacccctaacgggtcttccggaagaacccctaacggtgcataacaaaaccaaagctaagaagaaggccacctacctcgaaagcaaatgggtccaagggctgttggagaagctcgcggagaagaagcttgtcggggaagagagaagagaagaagcttttgcgaaagagactcagtga

SEQ ID NO: 8556 - DNA, 321 bp, Glycine max
  Peptide Sequence Number=SeqID_100241
atgttaaccgataaaagcaaagaggaccgtttaaggcgttggaccttaaaacggtttttagtgatttttcggacaaaacttgatttgaaaaagggggaggaggttgccgcccagctcgcccaggcgaccttagctcgcctagaagcattacgggtgtcccgagagccccggaatcccatttttcaacaaaatggggggtgtggtggccacctagctcgcccaggcgagctaggttgcttcaaccttaagcaagaaattgcccagaaacctctagaagggcccagattcaaaaattactatttgcaccccccattttactaa

SEQ ID NO: 8557 - DNA, 282 bp, Glycine max
  Peptide Sequence Number=SeqID_100242
atgctgcaggtagactctagaggacccctcaggaaggccgacggtcccaacaagaagaaattaagaacatatttagggattgtcgctcgtcataaggtcgacgtgacatacgagacttggaaagaagtccctgctactcataaggattttatatggaaggatatgcaggctgaatttgatatccctaaagcatctgacggtaggacaaagaagaaaatacttcaaactatcggggagcagtggagacagtttaaatctgatttgacaaggaaatggggatga

SEQ ID NO: 8558 - DNA, 231 bp, Glycine max
  Peptide Sequence Number=SeqID_100243
atggcagcagaatggagaaggaagacagagaggaaatgccacttcaaggagaagatgagtctagaagaagctcaccaccatagaaagccatggataaaagcttggaggaagaaggagatgaatgaaaggagaggaaaagaagagcacgaaattttatgctctaaaagagctctgaaatctgaacccactaatccaagatcaagtccaagattctccactaagtgtgcttag

SEQ ID NO: 8559 - DNA, 156 bp, Glycine max
  Peptide Sequence Number=SeqID_100244
atggctcgcttagcgtgcattagtgaatttcagcttagcgcgcgtcttttcactcagtggatggactcaagtgattcttcctcgcgctcagccgcaagagtggtgcgctcagcggatggctcgataagccagcagattggcttagcgagcggatga

SEQ ID NO: 8560 - DNA, 1057 bp, Glycine max
  Peptide Sequence Number=SeqID_100245
cgctgtacatcagcagcgcttagaaaccatcaagggatggtcatttctccgggagcgacgcgtccagctcagggatgacgagtatactgatttccaggaggagataggtcgccggcggtgggcatcactagttacccccatggccaaatttgatccagacatagtcctcgaattttatgccaatgcttggccaacagaggagggcgtgcgtgacatgaggtcctgggtgagggatcagtggatcccgtttgatgcagatgctatcggccagctcctgggatatccattggtgctggaagagggccaggagtgcgagtatggccagaggaggaaccggtctgatgggttcgatgaggaggccatcgcccagttgttatatataccggggcaggattttgcccggactgctgcagggaggcgagtgcgaattatgcgcaccaacatgaccaccttgactcagatatggatgactttgctgctcagcaacatcctgcccaccgaccataattccgacctccccctgccgaagtgtcagctggtgtacgccatcctgacgcggatgagcatccatgtggctcagttaatcgctgatgtcatctatatttttgcaggtatgcgcctaccaggcaccctttggatccagataagtccaacagggcctggatttcccgcgctgatcacaggactctgccagtcgtttggagtccccgttgcactaccaaaggtgattcggccgcccatcacccgggcttttattgagaagtactgcacccagagacaggctcagggggatgctccacaggccgcaggcgcgccaccaccacctcatcaggctggcccggctgggtcattgacatggagcagtatttacggcatttggttcgccagcaggcggccaaccaccgggcacatggcagaggtcgcatggcccggggattggcccgaggcccaagcaggagaggcgcccccagaggctcccggcgatggagaggaggcccacgaggacgaggagatggccgatttgcttgacttcttgggaaggagtggagctacatga

SEQ ID NO: 8561 - DNA, 243 bp, Glycine max
  Peptide Sequence Number=SeqID_100246
atgaactcactaagccgacatgccgcgcttagcgagttctgttgcttagttagttcagaatttatttttctcttggattggttaactgctactcgtgctagtgctttgtatgtgagttattatcatggtactcaacgcatgcaactaagaaagcgatgcagactttccctcttttttgtgactttgacgatgaaaaagaatgcaagacatgagtcacgacacggtggaagtatgcatgagtga

SEQ ID NO: 8562 - DNA, 288 bp, Glycine max
  Peptide Sequence Number=SeqID_100247
atgaatgttactttcagattattacttttagtacttgagaatcaagtaattattctacttcctttggactatgagccaagtgctaaagcacttgtcttcttaggactggatgttgagacaataaattgggtgaggaaaatcttggagaagtcatcaaaagaatggatagagtggttaggaagtctattgaaccagtccaatgttgttgctgccacactgccaacaaacatcttgcatttgatcatgttggacacactattatcaacactaggcactgttagtcgatga

SEQ ID NO: 8563 - DNA, 192 bp, Glycine max
  Peptide Sequence Number=SeqID_100248
atggtggcccgagtgatgttggggaatggttacgagcccggaatgggtttaggtaaggacaacaatggcagaaccagcctgataagcgccagaggaaaccgtgggaagtttgggttaggctataaacccacacaagcggacataaggaaaagcgttgcaggaaggaagagcggagttgcgcctaggctttag

SEQ ID NO: 8564 - DNA, 422 bp, Glycine max
  Peptide Sequence Number=SeqID_100249
gtcggaggtatagtcctcaagcctacccttatggtttgcctccagacttcactccccgtaccgctccggatgatttgaaccaagcccttaccttcgaggggaaactccctccttatgccgactatcccctgcaagaagatgatgaaggagatgcccatctaggccctctgcttcccctcaaagatccggccccccatgaattgccccaaccaaacatagtccgccatgtcccgtcttcacccgcacccgtaaaagaatccgttccctttgcaaaagataagggaaagattgatttacttgaagagaggctaagagcggtagagggcctcggcaactacccgttctcagatttagtggatctatgtctagtacctgacatcgtcatccctcccaagttcaaagtaccagattttgataaataa

SEQ ID NO: 8565 - DNA, 663 bp, Glycine max
  Peptide Sequence Number=SeqID_100250
atggcgagtcaagaagagtggatcccgtttgcgaatatactagctttgctaatctttggggttgtcctctttccgaatgtggacggtttggtggacctagccgcaattgatgctttccttgcatatcaccatagcaaggagagcccggtggaaggaaaggagggagttctcttctcatgtggggactacccaaacgttcaattgatagggacgaggggttgtattaactataatcccgcacttgccataagacagttagggtaccccatgaggggagcaccgacggaagagagcctctcgcctttccttgtgagagatttcggcgcgcaaagtctcaagattgtacaaagagtccacaaggtgtgggaaagcccgttaaggaaagataaagaacttaggggcatccgtaatggcatcatcggtggttatcatgaatggctaagagttcgtacacgagggttagattggctctccaagttgaaaattatcaacgaggagaacttcgaagctccggaagaggatgaagaagtccaagctctaaaatcagagctaggaaaggcaagactcgccaaagaaaaattcaagtcagtcgctatagacatctggaaagagtgtgccgagttacaagaggaaaatgcggctaccacaagagccctcaaatga

SEQ ID NO: 8566 - DNA, 497 bp, Glycine max
  Peptide Sequence Number=SeqID_100251
gggagaagcttgccgcccagctcgcccaggcgagcaaggttgcttcctccagaagcaacagccttctggaggaatcttctggagggcccaaatcgcgatggcagcacagttgatccatgatcgcgtggtgatggagtgcctagagggtgtttgggagaccctcgaaggcaatgagaggtgccgattccgtggcatagttcgactcactgctacttcactagtacatctagagcaacatgcacgcacacttcagcagcctgtggagtggatactacctacgcctactccatatcgactagttgagcctgttcaattgatagaggtgtcatcctctgaagaggacccagaggagttacctcttgaacctgctatggatgcccctgacttaccagaggatggtgaggacccgctccctgatgttgattctccagaggatattatgtcagcatctgaggcagactctacagaggagagtggccttggagggacatcgaata

SEQ ID NO: 8567 - DNA, 321 bp, Glycine max
  Peptide Sequence Number=SeqID_100252
gacagagagcttaggggaagcagtaatgggatcatcggcggctatcataagtggctgagagtccggacacaaggattggattggctcccaaatctaaagattgtgagagacaatgaggttaaagcttcggaagaaagtgatgaggtacaagccctaaaggcaaagcttgaaagagcccgggtagtcaaagagaagttcaagttcatagccatcaaagggctttatagggcagcaatagtgagctcaaactccgaagaggtgaaaggaatcatcacgggtcaaaggcatgatctggaaggacgagctaaaggcttgccttag

SEQ ID NO: 8568 - DNA, 201 bp, Glycine max
  Peptide Sequence Number=SeqID_100253
atggcagaaatcaaccaaggtaagacgatgaccggtcatgattggccgcatattgtttgtctcctacttgcagaaacttcccccccccccccttcattcaaaagagaggactcacgaaggcttgcggtttttgctccctcaagccacttttggttgccttttgctttcatttttggtgtttctactcactccaacaagtaa

SEQ ID NO: 8569 - DNA, 720 bp, Glycine max
  Peptide Sequence Number=SeqID_100254
gtaagatcgtttagccctttgaaggtgaggaagtgttgtcctctgaaggtgagggcgcgtaacgctctgaaggtgagggcgcgcagtcctctgaaggtgatggcgtgcaaccctctgaaggcgatgacgtgcaatcctctgaaggtaagagcgtgtagcactctgaacgtgaggacgtgttgtcctcttaaggtaaggtcgtgtagccctctgaaggtgaggctgcgtagccctctgaaggttaggacgtgcggtcctcagagggtgagggcgtgcaacactctaaaggtgaggatgtgcaatcctatgaaggtgagggcgtgcaaccctctaaaggcgaggacgtgtagttctctgaaggtgtgggcgtccaaccctctgaaggcgaggacgtgtagtcctctaaaggaaagagcgtgtagccaactcaaggtgaggacgtgtcgtcctctaaaggtgagtgcgcgtagccccctgaagatgaggacgtgcaatccttttaaggggaggggttgcaaccctctgaaggcgaggacatgtagtcctctgaaggtgagggtgcgtagccctctaaaggtgaggacctgcagtcctctgaaggtgagggtgtgtaaccctctaaaggcgaggacttgtagtcctcttaagctaagagcgtgtagccctctgaaggtgagggcgcgtagacctctgaaggtgtggacgtgcagtcctctgaag

SEQ ID NO: 8570 - DNA, 351 bp, Glycine max
  Peptide Sequence Number=SeqID_100255
atgccgttggtcaacctagtaacccagcttgccatgaatcagaaatctacacctgatgcaagagtctgtggtctatgttcttctgtagatcatcatttagatctttgtccttctttgcaacaacctagagtcaatgagcaacctgaagcttatgctgcaaacatttataatagaccttcacagcagcaaaaccagcaacagcaaaataattatgacctttcaagcaacagatacaatccaggttggaggaatcatccaaatttgagatggacaagtcctccacaacaacaacaacctgtccctccttttcagaatgtcgctagttcaagaagccgtatgttcctcctctaa

SEQ ID NO: 8571 - DNA, 564 bp, Glycine max
  Peptide Sequence Number=SeqID_100256
atgaaggaacaaatgacctccatgatagaggccatgatgagtatgggaaggatgatggaggacaacgcggccgcagttgccaccaccagcgccgccgcgaaggcggatccatctcacccatccggcataaaccaaacaagtcgtccaatcccagacatggtagtgcatgtgcccaacgagaacgccaaccactctgttcccgttctccttgaaagccagcaacccgagttggggcatgctccctttgctcaacctatgggagaggcccgtgaagagcctcgggaccacgctctgggcgagttcgaaccttaccctgcatatgctgttgagggaccagcgtttggtggcatgcctcagcccaatacctcaggggcccctcagcatcgtctgctgcaacccttacatttcttagtggggagactaccttctgccatggaagaaaaagagaaacttgatcttacagaggaaagattgagggccattgatgggattagtgattacccatttgccgacatgacagagctatgcttagtgcctgacatcgtcatccctcccaagttcaag

SEQ ID NO: 8572 - DNA, 531 bp, Glycine max
  Peptide Sequence Number=SeqID_100257
atggcagaaccatcgaagaagagaaagggatcatcctccaccaccgctgctgctgcccatcgccgccacggaccatccggagcacccacaacacctattcatccctctttgtcatctccaagatcatccacattgttttcatctgatgatcagcgtctacggtacctttctcagttttcttctagaatcatcttagaccctaagtacctagacgtagaattctttaatgatgaaacgtttgattgctatcaagatggcattattatttctgagatgcatggtattcctatggtcattgatcagtcattgtttttttctttaactaatttacccagtcaaggtgcaccttttgagggcaccattgttgatgactggaaatttgattattcgagtcatgatgctcgttgtatggtctgcaatgatcaagctgaaatgaccggtagattgctggtcgggtcattaacatttgataatcgcatcatgcactatataattgttagaattttgcttcctcatggtcttcaaatttag

SEQ ID NO: 8573 - DNA, 270 bp, Glycine max
  Peptide Sequence Number=SeqID_100258
atggccaaaatacaaggcccaaaaaaaggaaaaacctattccaatatttacaaagaagagtggactcaaccttggcccatgggctcagaaatttaccctaagattcatgagaaccctaaggccttctttagcagctctagcccaatcctcttggagtcttctatccaatacccttggggggtaggattgcatcatcccctcccccttggaaaggatttgacctcaaatcctgaggttcttgatactctggcctccttctgcttgatgtaa

SEQ ID NO: 8574 - DNA, 180 bp, Glycine max
  Peptide Sequence Number=SeqID_100259
atgtatatagatggcatggaatttgcttttcaaatgcaagaaatggctccgaggaagctttccacaaagagatctaggaaggacgccgcgaccgaagggactagtgccgctcccgagttcgatagccatcgtttctggagcgctgagcaccagcagcgtttcgaagatatcaagggatag

SEQ ID NO: 8575 - DNA, 423 bp, Glycine max
  Peptide Sequence Number=SeqID_100260
ggtacatcctttgtggtacaagtagagggtacatctacttgggttgttgtgactgagaacaagagagggtacatctcttgtggatcagttctagtggagggtacatccactaggttgttcaaagagaacaagggagggtacatcccttgtggatctttgcttgagggggagaaacctaacagaatcataagttcaaacttgaatttcactgggaaacttagccttgatgctagtaatggaaacaccgaggtttacatgaatggtcgagagatcatagaacttgaattgagggtactcaagactcgggtctgccaccagatggttcaagatatcaacaacacaggctgtagctatttcccaaagctcggaggattttggaaaatgataaaatattcttatatgataacacaaaaagtgatgtga

SEQ ID NO: 8576 - DNA, 393 bp, Glycine max
  Peptide Sequence Number=SeqID_100261
atgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttataaagggaaatatccgcagggatacaacaacgtattggacctgaatacacaggtccttttggagttcttcaagctctag

SEQ ID NO: 8577 - DNA, 231 bp, Glycine max
  Peptide Sequence Number=SeqID_100262
atggcagaggaagggagaagtaagagagagaggagacgccacttcatggagaagatgagtctagaagaagctcaccaccataggaggccatggataagagcttggaggaagaaggagatgaatgaagggagaggaagagaagagcacgaaattttgtgctctaaaagagctctgaaatctgaacccactaatccaagatcaattccaagattctccactaagtgtgcttag

SEQ ID NO: 8578 - DNA, 219 bp, Glycine max
  Peptide Sequence Number=SeqID_100263
atgtcagctttgaaagaacaaatagcttctatgatggaggccatgctaggaatgaggcaactcatggagaaaaacatggccaccgttgccattgtcagttcggctgccgaagcagacccaactctcctagctaccgtgcaccatcctcccctaaacgcagtaggacgagagaagagtatacaggggcacaacagcaacccccatttgggataccatcgg

SEQ ID NO: 8579 - DNA, 213 bp, Glycine max
  Peptide Sequence Number=SeqID_100264
atggtatttctaactatgaatgtaattgataaacaaacacaccaaacacaacaacatagcaaagtccccagcggagtcgccaactgtcgcaacctacccttcagcgggagggcgacgcgaaggctcacgggtgcgtcttccaagggagaaaggcgcgcggagtcgccaccaacatttattcgaggaaaacgtcggaaaaaccgaaacgtgtag

SEQ ID NO: 8580 - DNA, 306 bp, Glycine max
  Peptide Sequence Number=SeqID_100265
atgagagaggaacccgctcacacgcttcagcagcctgtggagtggatactacctacacctactccatatcgactagtggagtcagttcaagtgatagaggtgtcatcctctgaagaggatcctgaagaggacccagaggagttacctcctgagcctgctatggatgctcttgactttccagaagatgatgaggacccactccctgatgtggattctccagaggatatcatgtcaacatctgaggcagactctatagaggagagcggccctggagggatagcgaatagtgaagactcttcatcgtag

SEQ ID NO: 8581 - DNA, 743 bp, Glycine max
  Peptide Sequence Number=SeqID_100266
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgccattcacaccaa

SEQ ID NO: 8582 - DNA, 96 bp, Glycine max
  Peptide Sequence Number=SeqID_100267
atggctaccccagtgactcttggggcaagtagtccccttgtacttatcgaaatttggcatcttgaacttctgagggatgacgacgttaggaactag

SEQ ID NO: 8583 - DNA, 418 bp, Glycine max
  Peptide Sequence Number=SeqID_100268
atgctacatttgtttgccggcctggatttacataccgggcttttacttttgcttgctctggtttttgtactgttttacgaagcgatcaacggcttccacgacactgcaaacgcagtagcaacggttatctacactcgcgcaatgcgatcgcagcttgcggttgttatggcggcggtatttaacttttttggtgtcctcctgggcggactgagcgttgcgtatgccattgtgcatatgctgccaacggatctgctgcttaacgttagttctggccatggcctcgctatggtgttctcaatgctgcttgctgcaattatctggaacctcggtacctggtatttcggcctgcctgcatccagttctcacactctcatcggcgcgattatcggtatcgggttaaccaatgccctgatgaccg

SEQ ID NO: 8584 - DNA, 456 bp, Glycine max
  Peptide Sequence Number=SeqID_100269
atgagagagattccaagagaacttcattgtcaaatgctctcccaaaagaactcttgggcaaacacttgcaaatccattaagagttcatccatgaatcttcattgtaatatccttctcttcaagagagaattcttcttcaattcttcttattcaaggaaattgattaagggattgagtggaaatcctaagagggttgcttggggactggacataagcacggaatttgccgaaccagccacaaggtccaacatagggaactctaattgtgagggtagtttcctacttctaccttcatctgtgatgcaatcctaccccgcaagggcattggatagaagactccaagtagattgggccagagatccaagggaaggccctagggttctcataagccttaggggggtgtgtagcgaagctctagcttctcatttcaaggaggtgagcttagctattagagag

SEQ ID NO: 8585 - DNA, 270 bp, Glycine max
  Peptide Sequence Number=SeqID_100270
atgttttcctcgaataaatgttggtggcaactctgcgcaccttctttccttggaagacgcacccgtgagccccgcgtcgccctcccgccgaaggagcatgaccatgtagccttatctcccaatattcaggaggagtctaagatagtgctagaagtggtgatggaagcttgcttgtggggcttctatggaggctggatctttgagcttcaatggggtcctttaatggtgattttccaccatggagatgcagcggaagacaaaggaaaatag

SEQ ID NO: 8586 - DNA, 147 bp, Glycine max
  Peptide Sequence Number=SeqID_100271
atggaggagaagcttacttgtggagattctatggaggctggatctttgagcttcaatgaggtccttcaacggttattttccaccatggagatgcagcgaaacgcaaaggagaagaaaagaggggagccaccatccactagggaataa

SEQ ID NO: 8587 - DNA, 318 bp, Glycine max
  Peptide Sequence Number=SeqID_100272
atgtcctatttcctaagtttatactttgtacttactgttaagggcaagtatctcaactgcacggaggacagcagtctttcaaaagatccacttcagagactactttggtgcagttatttgatctatttgggtcattttcaatcttttcacaaagggaggaacctaaaggcaaaatgcacaggcctagtagtcgagtggacctccaatcaatgggggctgaagcatcttgtaatcctccaatactccgtaggaatgcttcttcctcttcaaatattagtgaccttgcttcgcaaaccaatcctacaaattcagacctaa

SEQ ID NO: 8588 - DNA, 135 bp, Glycine max
  Peptide Sequence Number=SeqID_100273
atggcacatacgttacgcaacaattacgctaagactcaattgtatatgcaacatggtgcaatgtcagtgaaaaacctcatcgagtgcctaggagtacatgacaggaaacaccacatgggggttttcaagcattag

SEQ ID NO: 8589 - DNA, 311 bp, Glycine max
  Peptide Sequence Number=SeqID_100274
gcataacaaatggattatcaagagtatcagaggtcatcacacttgtctcgcgtcaatgctcagacaagatcatcgacaactcgacaaacacgtcatagcacagatcatccaaccaattgtcaaaacaaacccaaccgtctccatcaagacgttgattgcagagatcaaaatgttcatgaattataccccatcctacaagaagacatggaagtatactggcacattgttgatagctactgcacaagatgaagctaaccatatcttcccgattgcctacgtcattatagaaggggagacaacttcagcttcat

SEQ ID NO: 8590 - DNA, 372 bp, Glycine max
  Peptide Sequence Number=SeqID_100275
tcgttcggagtccccgtcgcacctagcaaggtgattcggccgcccatcacccgagcttttgttgagaagtattgcacacagagacaggcccagggggatgttccacaggccgcagacgcgccgccacctcatcaggctggtccaaccggatcatttgatacggagcagtatttgcggcatttgggttttacttcttttccgtgccctactccagaccagttcagggcagaggtcgcatggcctggagattggcctgaggcccgggcaggagaggcacctgcagaggcaccagcagaggctcccgacgaggcagatgaggcccgcgaggacgaggagatggccgatttgcttgatttcttaggagggagcggg

SEQ ID NO: 8591 - DNA, 453 bp, Glycine max
  Peptide Sequence Number=SeqID_100276
atggccacaatgatggaggccatgatgagcatgaagaagataatggaagccaatgcggttacaattgtcgctaccagcgctgttgctaaagtgaacccgatgcccccatctgatcacaaccaaatgaatcatccaacctcagatatggtgggcaaagatttgggaactacggacggccccatgatgtgcaaattcaaacgagcacgccttcccgccatatggcttgcctcccaactgtacgccacccaatgtggcacacatgaaatttcccaccaaaatctagccgacttcgagccttacctcggatatgccactgaagggcaagcagttggtggtatacccctgcaaaacactttggagggccctcaatttcgcccccaaccacaacccttgcattccacagcaggctcagggtcattgaaggaggcagagattatgcctttactgacgtag

SEQ ID NO: 8592 - DNA, 406 bp, Glycine max
  Peptide Sequence Number=SeqID_100277
gtcgactctagaggatcccccggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 8593 - DNA, 285 bp, Glycine max
  Peptide Sequence Number=SeqID_100278
atgcctcatgaatcctcctgtgcttatgtcgccggtactcgggaggcctcttatcctgtacatgatagtgttggatgggtcgatgggatgcatgctggggtagcacaacgattccggaaaaagagaactagttgtctattacttgagcaaaaagttcacagcctgggagatgaactactctttgctggaaagaatgtgttgcgctttggtatgggcatcccatcatctaaggcattatatgttgagccatactacttggttggtatccaagatggacccagtcaa

SEQ ID NO: 8594 - DNA, 441 bp, Glycine max
  Peptide Sequence Number=SeqID_100279
atggctaagtttgaccctaaggtagtcctggagttttatgctaatgcttggcccacagaggagggggtgcgagacatgcgttcatgggtgaggggtcagtggattccctttgacgcagatgccctcagccaattcctgggtgacccgctaatgttggaggaaggccaggagtacgagttcagccagagaaggaacaaggccgatgggttcgacgaggaggccattgcccagctgttatgcacaccggggcaggatttcgcctggaccgttgtagggaggcaggtgcagatcatgcgcaccagcatgaccaccttgacccagacatggatgacattgctgctcagcaatgtcttgcctagcgatcataactctgatctccctctgccgcagtatcagttgatgtatgccatcctgacacggatgagcatccacgtggcccag

SEQ ID NO: 8595 - DNA, 369 bp, Glycine max
  Peptide Sequence Number=SeqID_100280
atggctcagtctaactcttctcgcttacacttcccagctttaatcacagccttgtgtagatcaaggggagtgggatctgatgcccttacctcctatgaaaacctaaggttgaccattgacttagcttatatcataaggaactattggaatgcgaatgaccaaacagttaattttccagaggcaaggaagaccaagcttagagcagctgatgttccctctttctttgcaacaataactggcatccctgcatcttctacttcatccccacttccagctttagcagacttatctgcccagagctttgagacttcagatgccaaatttcaaagcttgtttgaaggacaaattctcattatacaaagcttgtag

SEQ ID NO: 8596 - DNA, 216 bp, Glycine max
  Peptide Sequence Number=SeqID_100281
atgctacaatgcgaaaggaatttctctcagctcaaacacgatatcaaaactcccaacggtgagaatgctcggaattgggttgcgaacctagtgctaaaatttcacgacgatccaacgtttgatgggctgcgagaaaaagaaagggttttgggaaaagaagagagaaagaacgaaattgagaggcagaggaggctgaggagtcagtctgaaaaatga

SEQ ID NO: 8597 - DNA, 459 bp, Glycine max
  Peptide Sequence Number=SeqID_100282
atggcgcctaccaggcaccctttggacccggataagtttaacagggccttgggatttcccgctttgatcacaggactctgccagtcgttcggagtccccgtcgcacctagcaaggtgattcggccgcccatcacccgagattttattgagaagtattgcacgcagagacaggcccagggggatgctccgcaggccacagacgcgccgccacctcatcaggctggcccagctggatcatttgatatggagcagtatttacggcatttgagccagggttttacttcttttccgtgccctactccggatcagttcagggtagaggtcgcatggcccggagattggcctgaggcccgggtaggagaggcaccagcagaggctcccgacgatgcggatgaggcccgcgaggacgaggagatgactgatttgcttgatttcttgggagggagcggagccacatga

SEQ ID NO: 8598 - DNA, 309 bp, Glycine max
  Peptide Sequence Number=SeqID_100283
atggaaatgtctccgaagcgttacggaagcgcctcggcttgcattttcttcacggaaacaatttttctcactaatttcaagggaaaagagggaggtggttgccgcccagctcgcctaggcgtgctaggttgcttccaccagaaggccccgccttctgttggaacatcctggaaggcccaagattgcgcaaaaatgcttcctttcaactcccgacatgtcacggaacttcatagattgcctaacgatgggtgtcaagtacctcgaagcggtcaaaattgccccatgtgtggtgtcgcttgtcaatgttag

SEQ ID NO: 8599 - DNA, 165 bp, Glycine max
  Peptide Sequence Number=SeqID_100284
atggataagagcttgaaggtagaagaagatgaagagagggagagggagagatggggcacgaaattttgtgcctcaaatgagatatggttcaagccactaatccaagatcaagtgcaagattctccactaagtgtgcttaggtctcataaggcatgtaaaacatga

SEQ ID NO: 8600 - DNA, 78 bp, Glycine max
  Peptide Sequence Number=SeqID_100285
atgggtgatttcgcgaagattttcaaccgttcttcaacgttcttcgttcgttcttcatcgttcttcggtcttcaaccg

SEQ ID NO: 8601 - DNA, 357 bp, Glycine max
  Peptide Sequence Number=SeqID_100286
atgacaaaagctaaagtttctctcccaagaacaataacaataaaatgggatgaaataactctttccgaaaaatgggttatggataaggccacactgtccgttccccgacccgctccaaccatagagcaaattaagcaagataactccggcaagaaaggatatagattaccttggaaacaagacatcataagtgatccaacaacaaatgtcataacaaactggcaaacaaaggacagtgagttaatcctatcggaattacctcccgcaacacaatatcaattactgaatgtcaaagacagtaacaataaacctgtcatggtcgttccattcaaaacaaaagatgttaacgaggaataa

SEQ ID NO: 8602 - DNA, 630 bp, Glycine max
  Peptide Sequence Number=SeqID_100287
atgattatgaggggccaagacatttatagtagccaagatgaggctactacttcaccttcctctagtgaaagtgaagaagcaaaaggggaaaaatctagtgaagaaatctacccccaagaagaaggacaaccattaatggttaaagagaaatgtaaggaggtaagtgtctcctccaagagtttagctaagaaggaaactcgttttacaataaagacaaacattaaagaaactttccctcttagacaacctccacattttctcttttgtaaaaagagacttgctagcattgccacacctcttgggcttgaggttattcctcaagtaaagaagttgttggatgagggtttggttcgtaagagcttaaatccttgtgctttgttggtgcccaaaatagcaccactcattgagttggtaaggaaccatgttccttcatgggaagatgcccaggaaatgggttttcaaaccttatcttacttcaacataccaaacaccactaagacatatgtttttgttctttttacatgtgttgaggaaaaaagcccagagtttcaagaacctcgggatttgaggtcaattccttttcaagggggagggaatgatgcaatcctaccctgcaagggcattggatag

SEQ ID NO: 8603 - DNA, 283 bp, Glycine max
  Peptide Sequence Number=SeqID_100288
atgaagcgcactttactggcagcagtcatgccattgctgctgggattttctgtggctcaggccgctgaaatctataataaggatggtaacaagctggatctggtcggcaaaattaacgtgtcgcacctgttctccgatgacaccaccaatgatggtgatacctcatcgtatgtccgtatcggttttaagggcgaaaccaaaattaccgataagctgaccggctacggtttctggcaatcgcagttcagcctgcgtaacacggaaggtgccgatgcgcaggccg

SEQ ID NO: 8604 - DNA, 397 bp, Glycine max
  Peptide Sequence Number=SeqID_100289
tggctgttcccagtggcgataagtcgtgtcttaccggcgtgagctatgagaaagctccacgcttcccgaagggagaaaggcggacaggtcatccggtaagcggcagggttggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 8605 - DNA, 267 bp, Glycine max
  Peptide Sequence Number=SeqID_100290
atgtctgcgtctttcggccgagactgcgaaaacgtctcatttgctatccgtaagactcaaagcccgatagcatgcagtgaggaattgtcatctgcaccttccccgaagttgtcagagtctttcggccgagactgtgaaatagtctcatttgctattcgtaagacccaaagcccaatagcatgtagtgacttacgtgtcacctgcacctttcccggagatgtcagcatcttcctggccgagaatgcgaaaaatctcatttgctattga

SEQ ID NO: 8606 - DNA, 600 bp, Glycine max
  Peptide Sequence Number=SeqID_100291
atgctggaatttgttatagctcgtaagacaacggtcaattggcaagtttttcactacgaggttcctgatgctaaaacggatgttctctatctaacaatgctcatgtattcttatgttgtctcctggactgctagaccccgattcctcatgatagcctggcctaatcttgatcaagcctcatcctcagattcctctttacaacaacttagccccatactatcaaggactttagaatcagaccagtttccactgttgaatgaccctaacaaagcttacatctacgtgatcaaggatggtgttgaggagtcaatcctcagagtttgggatgaccttatagattggtacctaggggttagatggagccaaagcttgtacgtgagcaagattgtggaggatggcgtaacaacaacaacaaaagttggtggggagcttcccaagggaggaactgggtggctcattcaggagagcaacaaagaggatctgaaggaggatcttgatgaggacattttctcccctgtggtggggttagtggtgactactatgggattgagtgtttccctttctttagcatatgtatgggtagacctaggttccagataa

SEQ ID NO: 8607 - DNA, 300 bp, Glycine max
  Peptide Sequence Number=SeqID_100292
atgcaacagggacaggcagatatcctcatagctaggttccctgaccctagttatggtgttaaaacgggtttcgttctctaccgaaactgcaaggcaagttggaagattctgcttcggttgaagggtttctctcggtgtggggtcttaacggagaacaacgacggtttgtggtggctaatggtgcttgtgagtgatggagaaagtgcttgggacattagaaatggctttggaagaaagaaaggagaagaaatggtgtttttcctaagctacacgaaagcaaaggctgaaacactcaaatga

SEQ ID NO: 8608 - DNA, 288 bp, Glycine max
  Peptide Sequence Number=SeqID_100293
atgaagatcagaaaattgattttgatttgtttgttgaagacaagcctgctcctgaacccaatgtttgcttacaggagtatatcagccaatctttggatgtttaacataagggtttcaatttcttggaaaaaaggactgaaaaataacttggaaaaatattttctgaaaaatagtcctttcgctaagagcaagcctcgcgctaagcgcatctctgttcatgcactaagttgtgagtctcaagtgcttagtgcccaacccttgcatctgaggctgatttggtccgcttag

SEQ ID NO: 8609 - DNA, 336 bp, Glycine max
  Peptide Sequence Number=SeqID_100294
atggattatcaagagtatcagaggtctgcacacttgtcttgcgccaatgctcaaacaagatcatcgacaacccgacaaacacgtcatagcacagatcatccaaccaattgtcaaaacaaacccaaccgtctccatcaagacgttgattgcagagatcaaaatgttcatgaattatacctcatcctacaagaagacatggttagcaaagcaaagagcgttggagatgattcatggaaactgagaagaatcatatgccaaactgccaaaaattttgggagctttgcaatcttgtgttcccgggactgtggtcactactcaaacagaatccgtgtatga

SEQ ID NO: 8610 - DNA, 1089 bp, Glycine max
  Peptide Sequence Number=SeqID_100295
ggctacacgccctcgcctttagaggactacacgtcctcaccatcacaggactacacgtcctcgcctttcagaggacttcacgtcctcaccttcagaggacttcacgtcctcaccttcagagggttacacatcctcgccttccaaggactgcacgtcctcaccttcagaggactacacgtcctcgccatcaaagggctgcacgccctcaccttcatagggctgcacaccgtcaccttcagagaactacacgtcctcgcctttagaggacttcacgtcctcaccttcaaagggcttcacgccctcgccttcagaggactatatgtcctcgcctttagaggactacacgtcctcgcgatcagaggactacatgtcctcgccttcagagcacttcacgtcctcaccttaagagggttacacaccctcatcttcagaggatttcacgtcctcaccttcagagggttacacaccctcatctgcagaggactctgcgtcctccccttgagagggctacacgccattgccttcagagggttacacagcctcatcttcagaggactatacgtcctccccttgagaggactacatgtcctcgctttcggagggctacacgccctcgcctttagaggactacatgtcctcgccatcagaggactacacgtcctcgccttcagaggacttcacgtcctcaccttccgagggttacacaccctcatctgcagaggactatgcgtccgccccttgagagggctacacgccctcgccttcagagggttacacaccctcatcttcagaggactatacgtcctccccttgagaggacaacacgtcatcgctttcatagggctacacgccctcgcctttagaggactacacgtcctcgcctttagaggacttcacatcctcaccttcagagggttgcacaccctcatcttcagaggacttcacgtcctcacctttagagggttacacaccctcatttgcagaggactatgcgtcctcccctttagagggatacacaccctcgcctttagtgggctacacgccctcgcctttagaggactgcatgccctcaccttcagaggactatag

SEQ ID NO: 8611 - DNA, 267 bp, Glycine max
  Peptide Sequence Number=SeqID_100296
atggcctcagcaaattccttatttccagaagggaattctatcaatagacctccaatctttaatggagaaggttaccactactggaaaacccgaatgcaaatttttattgaggcaatagatctaaatgtctgggaagccatagaaatagggccttatatacccaccaccagtagaaagaattacaatagatgggtttcaaattgtaagagtgctaaggaaatgtgggacactcttcgattaacacatgaaggaaactacggatgttaa

SEQ ID NO: 8612 - DNA, 414 bp, Glycine max
  Peptide Sequence Number=SeqID_100297
atgactttccaagattattttgatgataacaaagaatcaagagttaagcaaagttccaaagaatcaggagtcaaaaagcttcaagaatcaagtttcaaagaatcaagattcaagaataatcaaagaattcaagggactaaccgcctaagaattttttgtcctaacacattggagggtacatcctttgtggcacaagtagagggtacatctacttgggttgttatactgagaacaagagagggtgcatctcttgtggatcaattcaagtggagggtacatccacttggttgttcaaagagaacaagggagggtacatccgttgtggatctttggcttgtaaaggattttacaaggttgaaagaaatctcaagaatcgttggttgtgtggggactggatgtaggcacgagttgtga

SEQ ID NO: 8613 - DNA, 283 bp, Glycine max
  Peptide Sequence Number=SeqID_100298
tgctatcaagggtcttgatgatgctccacagcctaaatcaaaggcttctgctaggtggattgtcgtcaagtgtaatagacaaaaaggaagtactgagtgcggctactatgtgatgcactggatgtccaccatcattttaggaacttttaggaataattgggaagcgtattttaacgatcctagaccattagagccagagagattaaaagcattgcggatccagtggacattatctttagctttagtttactttggtttaacattttttacattttctatgtaa

SEQ ID NO: 8614 - DNA, 712 bp, Glycine max
  Peptide Sequence Number=SeqID_100299
atggagacgcttcagaaggtccgcaaggcatggggggtggtacaaaagaaggacaaagagcttagaggcagtgggccaattggtggctaccgtgagtggttggaagcccatgtgcaaggtttggattggctcccaagtttgagaaccgctaaaagggaggaagttgaggcaccggaggaagacgaagaggtgcaggctcttaggacagaactcgagcaagctcaaacagtcaaagaaaggttcaaatcagtgcctcttaggatccgaaaggagaatgccgaactgagggatgtaaatgtagctaccaccaaggctttggaacaagagaccaagagggctcgtagggaagagcacggccggaacaagttccgaggggctctgtggggtagtaataacgagcttaaactccgaagggaggaaagggaccaatcgcggaccaacatgttagccatcatcaacaagtaccaagaagaactaagtctagccacggcccacgagcatagggtggcggacgagtatgcccaagtgtacgcggaaaaggagactagaggaagggtgatcgactcgttacaccaagaggcaaccatgtggatggaccgatttgctcttaccttgaacgggagtcaagaacttccccgattgctagccaaggccaaagcaatggcggacacctactccgctcccgaggagatccacggacttctcagctatt

SEQ ID NO: 8615 - DNA, 380 bp, Glycine max
  Peptide Sequence Number=SeqID_100300
cggacccggagaagtccaaaagggtcctggggtttccagctctagttacaggcctctgtccgtcctacagggtgcccgtccccccagcaaggggtagcacacacaagacacccagtggacccggaggagcccaacagggtcctggggtctccagctctggttacgggcctctgtcaatcctacaggggatcacgcccgcaagacactctgtgaacccggagaagtccaatagggtcttggagttgccagctctgattacgggcctctgtcggttctacgggggcgaaacaccccagcaacctggggatggcctgcagcgggcaacagacgcaccgccaccacctccagagttcacctcagctcatccacataaaagttag

SEQ ID NO: 8616 - DNA, 285 bp, Glycine max
  Peptide Sequence Number=SeqID_100301
atggaaacacccccaacatccccaccacattcagataatcctctggtggttacttctaggaggactagacaatccaccaggctcagaaggctgactactagaagcttagatcagccacgaccaattgttaacgtcaatcttgccattggaagaggatcagggccccataaagaaaaatttcacaattatctaggggttgttgcacgggaaaaaatttatgttgtccactccaactggaatattgtcccgaacgatctgaagaagctaatttgggaagatattttg

SEQ ID NO: 8617 - DNA, 668 bp, Glycine max
  Peptide Sequence Number=SeqID_100302
atgggtgatcaagaggagacacaggaacagatgaaagccgacatgtcggctctgaaagaacaaatggcctccatgatggaggccatgttaggtatgaagcagctcatggagaagaacgcggccactgccgccgctgtcagttcggctgccgaagcagacccgactctcttggcgactacgcaccatcctcccccaaacatagtaggacggggaagggacgcactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgcccggagggatgtcgagttttatcccccgatccccgaagggccggcaccaggcacgttgccccaacccaacatcgccgcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaa

SEQ ID NO: 8618 - DNA, 96 bp, Glycine max
  Peptide Sequence Number=SeqID_100303
atgatcgtgaaaagtttacgaaagatagtgtgcgaggaatatgttagctatttaggtgtaacttattggaaagtaagacatagtcatgtagatgtg

SEQ ID NO: 8619 - DNA, 207 bp, Glycine max
  Peptide Sequence Number=SeqID_100304
atgatgataacaaaagatgatgacaaaagaattgacaaaaagctcaaagaacaatcaaagaacaactcaagtgaatcaagaacagttcaagataaaaatcaagaagaattcaagactcaagaagaaaatttagagtcaagaattaagattcaagattcaagatctcaagaatcaagatcaagattcaagaatcaagagaaggcttaa

SEQ ID NO: 8620 - DNA, 396 bp, Glycine max
  Peptide Sequence Number=SeqID_100305
atgcaaagcttgcaagaactggctcagcaaaggctaattatgagtgtagagcaattcattgagaagcatgagctagagccagaaaatgatcactcatctaaagccatcatccctggagctgttgatttttcgaaaagaagattagagacaagatccaatgaggctgctcatcctgggccagtgcctgtatcagctgatgcaccatttccaggggtggatccatcttcacctcagcacgcagcagactcttccactcctgtcttagagatacctgagggccagaccataccagttctgactttggacacttctcctccagctactccagtattgcatctgacagatgaggaggatgttcaaacacaggatacccaggaccagtcacaggaattttga

SEQ ID NO: 8621 - DNA, 210 bp, Glycine max
  Peptide Sequence Number=SeqID_100306
atgaagctccatgtggagcttataggccttggatcttcttcatcaatcgagtcctttgcttcttgtagtttaatggcagtagaatggagaaggagaaaaggtgagaggaggagccatccactagggaataatccatggagggaggagcttcactaccaagagagtgccttggataagaagcttagaaaggaagcttcaatggaggaatag

SEQ ID NO: 8622 - DNA, 784 bp, Glycine max
  Peptide Sequence Number=SeqID_100307
atgaggggagcaccgacggaaggaagcatgtctcctttccttgtgagggatctcggcgcacaaaattccaaaactatacaaagaatccataaagcatgggaaaccccgttaaggaaagatcaagagctcagaggcgttcgtaatggcatcattggtgggtaccacgaatggctgaaagttcgcatacgaggtttagattggctcgccaagttaaaagtcgtcagcgaagagattttgaagcaccggaagaggacgaggaagtccaagctctcaaaagcggagttaggaaaggcaaactcgccaaggagaagttcaagttggctgctacacacgttcggaaggagtgtgccgggttacgggaagagatacaattaccgcaagagccttgacgagagaccaagagggctcgcaaggaagagtatggccggaacaaatttcgcggagccctatgggttgcctgttcaaggtccaaaagaagcttgtctcagcgtttatgcgagactggagaccaacatgctagctatcatcgccaagtaccaagaagagttaggtctagccacggcccacgagcatagaatcgcggatgagtatgcccaagtatacgcggaaaaagaggctagaggaagggtgatcgactctttacaccaagaggcaaccatgtggatggatcggtttgcccttaccttgaatgggagtcaagaacttccccgattgttagcccaggccaaggcgatggcagacacctactccgcccccgaagagattcatgggcttctcggctatt

SEQ ID NO: 8623 - DNA, 904 bp, Glycine max
  Peptide Sequence Number=SeqID_100308
atgttgagtatttttaagccggccgcacacatcgcccgtgtgccgagcgataaggtagacccgctctaccgtaagctgcgctggcaaattttcctggggatcttcttcggttacgccgcttactatctggtgcgtaagaacttcaccctggccatgccttacctgatcgaacaaggcttcagccgcggtgacctcggcttcgcgctgtcgggcatttccatcgcctacggcttctccaaattcatcatgggttcggtctccgaccgttccaacccgcgagtgttcctgcctgccggcctgatcctggcggcggcggtgatgttgttcatgggcttcgtgccgtgggccacctccagcatcgccatcatgttcgtcctgctgttcctgtgcggctggttccagggcatgggttggccgccgtgcggccgcaccatggtgcactggtggtcgcagaaagaacgcggcggcatcgtctccatctggaactgcgcccacaacgtgggtggcggcctgccgccgctgctgttcctgctgggcatggcctggttcaacgactggcacgctgcgctgtacatgccggccttcggcgccatcctggtggccctgatcgccttcggcctgatgcgcgacaccccgcaatcctgcggcctgccgccgattgaagagtacaaaaacgactacccggacgactacagcgaaaaagacgaagaagagctgaccgccaaacagatcttcatgcagtacatcctgccgaacaagctgctgtggtacatcgcggtcgccaacgtgttcgtctatctgctgcgttacggcattctggactggtcgccgacctacctgaaagaagtgaagcacttcgcgctggacaagtcttcctgggcctacttcctgtatgaatacgccg

SEQ ID NO: 8624 - DNA, 717 bp, Glycine max
  Peptide Sequence Number=SeqID_100309
agggctgcacgccctcaacttcagaggactacacgtcctcaccataagaggactacatgccttcagagggctgcacgcactcaccttccgaggactacacatcctcgccatcagaggactacacgtcctcgccatcagagggctgcacgccctcgccttcagagggctacgcgtcctcaccttcagagggctacatgcacgccctcagaggactgcacgccctcaccttccgaggactacacgtgctcaccttcagaggactacacgtcctcgccatcagagggctgcatgccttcgcctttagagggctacacatcctcacctttagagggctacgtgcacgccctcagaggactacgcgtcctcactttcagagggctacatgtcctcgccttcagagggctacacgccctcgccttcagaggactacacgtcctcacctttagagggttccacgtcctcgccttcagagggctgaacaccctctcctttagagggctgcacgccctcgctttcagaggactacacgtcctcgccatcagaagactacacgtcatcgcctttagatggctacacgccctcatctttagaggactacacgtcctcacctttagagggttgcacgtcctcgccttcagagggctgcacaccctcttctttagtgggctgcacgccctcgctttcagagggctggacgccctcacctgcaaaggttga

SEQ ID NO: 8625 - DNA, 422 bp, Glycine max
  Peptide Sequence Number=SeqID_100310
atggcggaaccatcaaagaagcgcaagggttcttcgagtagaagccaacgacagtccgaggctcaagatactccaattccttcctccatttcctcctcctcattgttctcattggaagaacaacgtatacggtacacaaaccttttctcctctcgttctatcattgtccctaagttcattgatatggatttcttttctgatgagagtttcaaatgcattcaagcatttcagaactcaaatctcattccctttatgtctttaaaactacctgtgtattctgaattggtaaaagttttttattctaacattgaaattcaagaaagtacctttatttctgaagtctatgggataaagatggtcattgaccaatccctcttctatgatttgacccaattgtctagcgaaggtataccatttgaaag

SEQ ID NO: 8626 - DNA, 215 bp, Glycine max
  Peptide Sequence Number=SeqID_100311
ggatcgcgcctgcaagacacccagtggacccgaagaagtccaacagggtcctaggttctacggtgtgcccatcgcccccagcaagttcatcaggccccctattaaccaggctttcatcaagaagtaccgcgcccccaggcaggcgcatggcgagacaccacggcagcctaaggatggccggcagcgggcaacaaacgcactgtcaccacctctag

SEQ ID NO: 8627 - DNA, 234 bp, Glycine max
  Peptide Sequence Number=SeqID_100312
atgatgcgtgcacctgacctcaactctcaaatgaaatgtggtaccattactcaaggaaatagcctaagcgtgtccacacgatactatcacttaggaaaactaggcagtaagtgtcgaggtcaccctatcgtgcataggcaactccccccccccaacaatgatcagtctgagtctcaagggagttccaaatcgagtgacatgcccccaagtactgttggacaagtggcctcataa

SEQ ID NO: 8628 - DNA, 306 bp, Glycine max
  Peptide Sequence Number=SeqID_100313
atggagaatttcactacgccatctctctggctagcctcccaactcgtgggtgggggatgcgtgagcgaaaacgcaattcatggggctccgaaaaagggtagagaatggagaattgcagtaagcaatcactacccatggctccaaactcgtgggtgggggatgcatgaacgaaaacgcaattcatgggctccgaaaaagggtagagaatggagaattgcactaagcaatccctacgcatggctccaaacttgtgggtgggggatgcatgaacgaaaacgcaattcattgggctccgaaaaagggtag

SEQ ID NO: 8629 - DNA, 1086 bp, Glycine max
  Peptide Sequence Number=SeqID_100314
atggacactggagagaacaagtcgaaagccaactatgcacacaagaggtctggatggaaaccggaaggaaaaccggtagccttgaaccaatcgttgccgacatgggcactccgaagtggcttgattaaagaaattgagattgaggcagattgcaaagtttcgaccatttctcatcacactgatagcagagcccttgctcacgataggttgccatttcctccatcggtacgcgattaccgcagcggcggtctagcattttgtcctcctgtaagcgcgcaagctcgatcacctgagcccggacacgaagtagctcaacaagcaagaagggggaagaccgatagtcctattcgcgagcctctcaaattccgtcaggtattcactcactgtacctgtctgttggagcttaaacagagctccttgtggatcgtcgaaataggacgacacaaatcgcaattcgagggccttcaacatcgccggctaggaagggaagaagccattccgagccatccactagtaccaggacagcgccggtccatccatgtagaaagacgcaaccgtgaggcgctcgtggtccggtatcccttgatagtcgaaaaattgggatattttgaatatctagccaagcgcgtcgtggccgtcaaaccttggcacgtcgagcttcatatggtggcggtgagtgggtggatgcggtggaacgagggaagacgccggagaatgttgaggtactgccatggtggcaaaccgctcaacgagggaatcgaatttggccgtgagcaaggcatggtggagcttgtaacggtggcgaatggtggtggtggcaggtcaggtagtcctctacttcctgaaaagctccttaaatttgtcttcgtcctggactttgactccctcattgggtgcctttgtgtttatattacagcccttgaagtgcactgtgcctctgtgtcttcaatctctgtgaagcagcggcagagaagttttccgacaaaagtgtacaccacagtcatacgccttttttcattccacagtcatcttgttgatcttcatttgccccagcaacttggggttctgcagatttacctttcctag

SEQ ID NO: 8630 - DNA, 249 bp, Glycine max
  Peptide Sequence Number=SeqID_100315
atggtagcctggcccgggacccaatcttctcttcataaggaacacgaaggtcccacagcccaggtacctcagcatataggagaagaggcagaagagacacagcctacagtagaaccctccactcctcttctacagatgccaaaggacccaactacaccagtcctagttgtggacacttctcctcccactactccagtgcttcagctgacagatgaggaggatggtcagacacatgacacacaggactag

SEQ ID NO: 8631 - DNA, 282 bp, Glycine max
  Peptide Sequence Number=SeqID_100316
atggggcttaccaactggtatggcctaataccagagcttttccccaatgttaagtatgttcaagggatcatgaccgggtcgatagtgatttccaaaggaacaaagtacctacctacctacctaatcacattaatggatttgatgaatccaatattggagaaagggcatagcagagttcctgtctattatgagcagcctacaaatattattggacttgttctggatgatttctatggactcaaagtgaaaaatcacatcaatatttccattccccatcattga

SEQ ID NO: 8632 - DNA, 168 bp, Glycine max
  Peptide Sequence Number=SeqID_100317
atgacaccggtaaaccgaaaggcaggaacaggagagcgcacgagggagcctccagggggaaacgcctggggggcggagcctatggaaaaacggctttgccgcggccctctcacttccctgttaagtatcttcctggcatcttccaggaaatctccgccccgttcgtaa

SEQ ID NO: 8633 - DNA, 588 bp, Glycine max
  Peptide Sequence Number=SeqID_100318
atgggttctccacctgcctccactactcctcctcattttcctcctcctccttctcctccttcacctcctcctccttcacctccttcacctcctcctcctcctcctcctacttcggacgcatcggcttcaacgtctgccgtgaagcggacacgcaaagcctcacgtctacgatcgttgtccactagaccacctggtgctatgagaccagtggtgcatgttgatcctgctaccgggaaggtcgacggtccccaaaggaagaaattaagaacatatttggggattgtggcacgtgataaggtggacaccacctacgagaactggaaggaggtccctattgctcagaaggacctgatttgggaggatattcaggcggaatttgatatcccagaggcttctgacagtaggacaaaaaagaagttactacagaccgtgggggagagaaggaggcagtttaaatcagacctcatgaggaaatgggcccttgcaaccgatcaggacggtgtcgaggacactgtctgtgacaaatacggcatcagcaaggaaaagtgggcccagttttgtcagacccgcagagacccttcttgggag

SEQ ID NO: 8634 - DNA, 312 bp, Glycine max
  misc_feature (37)..(37): n is a, c, g, or t
  Peptide Sequence Number=SeqID_100319
atgacagcagagacaagttcggtcttctgtacccttntatcatccagaggcggcgggcccgatgatacgcggagataccttacggcggcgggcccgatgatacgcggagataccttatggttattcgcacccttttgtcatccagaggcggcgggcccgatgacaagcagagaccaaatttggtcattctgcacccttgtatcatccagaggcggcgggcccgatgatacgcggaaatacccgagtggttatccgtataaacattcttttgctatctgtaagacagaacgcttgatagcatgcagagactga

SEQ ID NO: 8635 - DNA, 267 bp, Glycine max
  Peptide Sequence Number=SeqID_100320
atgctccacaggccgcaggcgcgccaccaccacctcatcaggctggccaagctggggcatttgacatggagcagtatttacggcatttggttcgccagcaggcagccaaccaccgggcacatggcagaagtcgcatggcccggagattggcccgaggcccaagcaggagaggcacccccagaagctcccggcgatggagaggaggcccacgaggacgaggagatggccgatttgcttgacttcttgggagggagtggagctacatga

SEQ ID NO: 8636 - DNA, 555 bp, Glycine max
  Peptide Sequence Number=SeqID_100321
atgaatcggccaacgcgcggggagaggcggtttgcgtattgggcgctagcggattgtatactggcttactatgttggctctgatgagggtgtcagtgaattgcttcctgtggggataaaaaaggctgcaccgggaagtgagagggccgcggccaagccgtttttccataggctccgcccccctgacaacatcactaaatctgacgctcaaatcaatggtggcgaaacccgacaggactataaatataccaagcgtttccccctggcggctccctcctgcgctctcctgttcctgcctttcggtttaccggtgtcattccgctgttatggccgcgtttgtctcattccacgcctgacactcagttccggtccgaccgctgcgccttatccggtaactatcgacttgagtcccacccggaaagacatgcaaaagcaccactggcagcaaccactgagagttggtagctcatacaaccttccaaaaaccgccctgctaggaggttttttcgttttcagagctagagattactctcagaccttaacgatctcgagatga

SEQ ID NO: 8637 - DNA, 258 bp, Glycine max
  Peptide Sequence Number=SeqID_100322
atgacaaccaaagttgattgcccaagtttcaagaaaagaatagaaggatctgaaaagaaaacctttaatgataagaaagcaaagaaagcttacatcacttgggaagacaatgatatggattcatccaaagactcagaaaatgaagtcgtgaatctaagtctaatggccaaaaattatgatgaagaggtaacatcttataacaataacttatctatttcctttgatgaacttcaagatgcattcactgatttacattaa

SEQ ID NO: 8638 - DNA, 266 bp, Glycine max
  Peptide Sequence Number=SeqID_100323
gtaaccccgcatctcacttgacttcacgggttaggatgacaaaaggtgcagaggacgatgttagtctccgcgcgtcaacgagctcgtcaggacgacaaaacatgcagaagatcaagttagtctccgagcgtcaatgggctcgtttgccactggggctcatttgccccttgttgacgaaagttgcgggtaaccataaggtgcagaaggacgatgttattctccgctgtcaacgggctcgtttgcccctggatgacgaaagggtgcgg

SEQ ID NO: 8639 - DNA, 401 bp, Glycine max
  Peptide Sequence Number=SeqID_100324
ctaaatcaaaggctcctgctaggtggattgtcgtcaagtgtaatagacaaaaaggaagtactgagtgcagctactatgtgatgcactggatgtccaccatcattttaggaacttttaggaataattgggaagcggttacatgggatgccaccgtgttcggggtctttaatccagacttctcgctctacataaagcacgaagacctctccgaaattgcacacggtggtcaatgtctcagcatatcaatgttacaaatgtggattttcggacactggcagatggtggtcattatgcccaacgaacacctagttgtctggttttattcattgcataacaggccagacaactaccttaaggggattattagcagtgctttaaaaggtcttgatgatgctccatag

SEQ ID NO: 8640 - DNA, 231 bp, Glycine max
  Peptide Sequence Number=SeqID_100325
atggaacgatctgctaactatagtgtcattcccattggcataatttccaactctcctagcctcctacacatggagagtggcatcaagttaaaactggctcccaaatcaatgagagcctttccaatagacaccagaaccaatagagcatggaattatctttcagaaattttgaatagagtggcatctgctacagggcttctccaaagggaattgttttctccaatttcttga

SEQ ID NO: 8641 - DNA, 315 bp, Glycine max
  Peptide Sequence Number=SeqID_100326
atggataaatttgacatctttgtccctcatcctctcgtaattacatctttgcttccactggaatgtgggtgcaagccattggctgtttgctcaagcgacctgtgctcccaaattttgatgcaagctccattggagcttgtaggcctaggatcttcttcatcaatggattcctttgcttcttggaagataaatggcagtggaatggagaaggaagagagagaggagacgccacttcaaggagaagatgagtctagaagaagctcaccaccattggaggccatggataagagcttggaggaagaaggagatgaatga

SEQ ID NO: 8642 - DNA, 635 bp, Glycine max
  Peptide Sequence Number=SeqID_100327
atggcaggagctggtgacaatggtggtgtatatcatcaactggacggatctcagcgcttatttctggacgcgatgactacacaaatgcaacgtttgttgaaccgtaacaaagaagagctctatagacgaatagccaaatcttccttgtttactcttaaacctctatcccctagagaagtgtgtgatgaccaaatcagaatgagagaaaagagagagcaagagaaagaaaatagtgaggcaccacagaggcatatgaaaaagaagaatgatacacccgaggaaaagaaggcgagtgaagtgaggaaagtgttacctgctcatgaaccactcaatctacagaatttaaatgtctttcctaaggagattcctcatggactgccaccttcaagaggcatagaacatcaagatgcacatgccaaagtggaatatgtgaaaatattgtatgaccaagtgaaggtgcaaattgcaaagaagaatgaaagctatgccaagcaagccaacaagaaaaggaaggaagtggtacttgaacccggtgatgatcctggacatttgagggcaaatgttttccaaaaagaagggaatgatgagaatcctgaaattggccaaatacaggctaaaggcccaagtggagaaag

SEQ ID NO: 8643 - DNA, 339 bp, Glycine max
  Peptide Sequence Number=SeqID_100328
atggccgaaaaaactatagaggataaagccacggcaaccgcctccaatacagttagggaagcggggccggtactgcagcccgccttaaatccgggccgagacagaaacacgacagtgtttggtcgaaggtatagtccgcaagcttacccctatggcttgcctccagacttcactccccgtgccgccccggaagatttaagccaagcccctactttcgaggggcaactcccaccttatgacgactatcccgggcaagacgatgaggaaggagatacccatcttggccccctgctccacctcaaagatccgtcacccatgaactaccccaaccgaacatag

SEQ ID NO: 8644 - DNA, 342 bp, Glycine max
  Peptide Sequence Number=SeqID_100329
atggatctcaatggaaaagtccttacaaatgacgataataaggagattcctgacgctgttaatatccttatttttacaatagctcaacactttatcgatgacctgtcactttggaaagatagatatacgagaaatcaatactttaacaagagaacaagatctcttgttcgaggaaatcaattccataccagacccccaggaaaagaaggttttcctggaaaaactgacaaaaactctggaaaccaaacccaggctaaatactttattacaaataataaattcgatgttagcaatatatttgttcacttttggcaagtgcaccggatcgcacaagtagtataa

SEQ ID NO: 8645 - DNA, 105 bp, Glycine max
  Peptide Sequence Number=SeqID_100330
atggagaaggctcaagctacttcaaatatgaaatcatttgttgttggagatgctacggaggtttggatgacgccacttccggtgaaggaagataagtcagggtag

SEQ ID NO: 8646 - DNA, 75 bp, Glycine max
  Peptide Sequence Number=SeqID_100331
atggcgaaagactatgaaagcggagaagagttggaagtggaagttggaagttggaagttggaagttggaagttga

SEQ ID NO: 8647 - DNA, 1074 bp, Glycine max
  Peptide Sequence Number=SeqID_100332
atggcatcaaagaagagaaaggaacctgccacaccttccctggtccgatatgaccgatccaagtttatttctcctgaggcttgggaaaggaacattgatattgtggtacccaggaagatactcccggaaagaaatatggtaacctaccacattgagtttgatgagttcaaggaagaattggagaaaagaaaatggaatgaggagttaaccagttttgatgaaggcagcattgatcccgaggataaatcacctaagcaggtgagggtgagaggccatttggtgaagtttgatgaggacacgctgaataccttcttgaagacccctgtaattatcgtggagggggagacattatcaacttactctagatttgcactcttgaggcctgatcctcaacagttggctgctaagctctgcatcccatggaggggatttgagcttaatgctgatggtcagcctctgaagatcctcaagaagagcatgaccacagtcgctcagacttggagtgttctttcttactctaatttggtccctacctcccacacatctgacatcacactagatcgggccaagttgatctatggcattatcatgaagatggacatgaatctgggctacctcatctctcaccagatttctatcattgcccagcatgactcctctaggcttggatttccaaccttaatcatagctttgtgtaaagttaaaggagtcacatctgattccaggaccttggagagtctcagccctgccattaacttggtgtatataaagaagaactgttggaatctagatgatccaacagtgacattcagagggccaaggaaggccaagggagtccaaccttctccttctagagggggtgaggcctccgcagcccaagagcctgtgccagcagaggagcctatgccagatgcagaggatgagcttgttcctcctgagccatttgtttatgagactgatccagtcgctcaggaggaagcagcagctcaggagcctacttctccagttcatatctctccagtagctacatctgaagacaccatgccatcagtaccagccatggagccagattag

SEQ ID NO: 8648 - DNA, 650 bp, Glycine max
  Peptide Sequence Number=SeqID_100333
atgacatctaagaaaaggaaaactccttctacacctacccaggccagatttgatagatccaggttcacatcccaagaggcttgggagagatatacagacattgtggtgcctcgaaagctactactgaagaggaatgtggtagtttattgcaccgagtttgacgagttcaagaaggaacttgagataagacattgggatgagaagttgactgattttgctgacagtagtatagacattgccattatgaaggaattttacaccaacctctatgaccccgaggataaatcacctaagcaagtgagggtgagaggttacttagtgaaatttgatgaagatactctgaatacatttctgaagaccctggtaattttgaaggagggggagaatttgtgtacttattccaggtttgcactcctgaggtctgatcctcaggagttggctgctaagctttgtatcccagggaggggattcacacttaatgttgatgggcagcctttgaagatactgaggaagaacatgaccactctagctcaaacatggagtgttatttccttttctaagctgattcctacctcccacacatctgatgtgaccttggacagagccaagttcatttgtggtatcattgtgaagatggatatgaatttggg

SEQ ID NO: 8649 - DNA, 381 bp, Glycine max
  Peptide Sequence Number=SeqID_100334
atgaaccacttcttccggaaagttcccggaagaggttttccgggagtcttccggaagacgtttggttacttctggaagaacacttctttcggaaactttccggaaaatgttcttccggaagaacccctaacgggtcttccggaagacactgtcgtcatccttttccgccattttttccggcgtactctaatcttctcccctctcgtcttctaccctaaggttactatcctaaggctgttcgcggagaagacggagaagaagaagcttggctcatggtgtccggaagaagatgaaagcttggctcgcggtgtcacggaggatcaacaggaatggaagaagaaaagaagcagcagtcttccgagaagaggagcgcgtttttaa

SEQ ID NO: 8650 - DNA, 342 bp, Glycine max
  Peptide Sequence Number=SeqID_100335
atgccaaaggtctataggaatgacattacatctagggtgaatgatagtagaacatatggttttggggattatttggtctggtgtgagctggtaaaggccatgtctcacttcaattgtaccaatcttcacacgattgttcgtatcctgcaagctcctgaatctaatatccaggaggtggatgttcgagttataagagatggagatatacctgagtttggtgttgtatcagtggagcatgaggagatggaggcaacctgtttggtctgtgattggttagaagctgtgttcccggatgatggttgttggattaaggcgagtagtgtaacatcccaatttttgtaa

SEQ ID NO: 8651 - DNA, 288 bp, Glycine max
  Peptide Sequence Number=SeqID_100336
atggacgctcattcgtgtcaggatggcatacaccagctgacacttcagcagagggaggtcagagttatgatcgctgggcaagacgttgctgagcagcaacatcatccatatctgagtcaaggtggtcatgttggtgcgcatgatctgcacccgtctcccggcagcggtccgggcaaaatccttacccgcgggtctcccagaaactggctgagggcgtctgtgtcaaaaggaatccactggccccttacccatgaccgcatgtcccgcacaccctcctccgtaggctaa

SEQ ID NO: 8652 - DNA, 867 bp, Glycine max
  Peptide Sequence Number=SeqID_100337
gagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgcaggaacaggagagcgcacgagggagccgccagggggaaacgcctggtatctttatagtcctgtcgggtttcgccaccactgatttgagcgtcagatttcgaaatgtccgccccgttcgtaagccatttccgctcgccgcagtcgaacgaccgagcgtagcgagtcagtgtgcgaggaagcggaatatatcct

SEQ ID NO: 8653 - DNA, 228 bp, Glycine max
  Peptide Sequence Number=SeqID_100338
atgccactagtccttggaaacactggttctggaagcacgagtcaggttaggaaatggaacatgagtagcacaaggagggaagggcagaaacaaaagagcaagagaggtgtcaaaagaaaagtgctgtggggaaataaaagggttaagaagaaggccttagaagttgttagtaaaattgcaaacactgaaccagacacttgtgagcagagggaaacaccagccttgtga

SEQ ID NO: 8654 - DNA, 486 bp, Glycine max
  Peptide Sequence Number=SeqID_100339
atgttgaaaacccctgaagaggaaactgaattgattgagaatatgtctgctagtgatcatgccattttgcgagataaagtgcatcaacccaccaagaaaagcttgttggagttatcatcacaagatgctttgttggcacagaataagttgctctctagaaaacttgaaatcttaacagaaacacttggttgtaccgtttgtggtgaggctcatgaatcaggtcattgcattcctattgaagaacacactaaggaagttcattacatgggaaatcaacagaggcaaggatacaaccaagaaggatttttaggttttcaacaaggtctctacaatcagcaagggcaatggatatcacaccctggcaatcaattcaataaggaccagggtggaccatccaacaagccaccccaacaagggccaaatatttttcagaggaccaccaaactggaggagacatctagctcaatttatggtgggatcctctag

SEQ ID NO: 8655 - DNA, 769 bp, Glycine max
  Peptide Sequence Number=SeqID_100340
ggcaaacgtcgcggctgcgtgcccggctgcttttccgatggcaccgtggcaggtgacccatctcatgccatacgctggtactgcgcccgcagagctgtccgccgcagcacatcacatgggaataaaaggaggattttatgaaaaggatgacgctgctgctgtggctggcgctgagcatccgctgcacgccgctgatcagcccctgagcctgccggcgtggaggggcggctgtcgctgcgactcgataacgtcggctgggagcgcgcaacgctggcgctggcacgcggctggcgaaactcccgtgatcgttagagggcacagcgcacagcagctgaagagaagcagctgcgccgctaaactggcacgcaatttctgtcacgctgcagggctggctgcgacggcattagcgagtgacggtggagtagcgcactggtgctgctgtgcagcgcgcggcgctggcgcgacgatccgttccagcgctggctgccagccagtgtcaggcgccctgctgccgtggaccgcaggtggagctgtcagcgcacattgcaccatcattgaaagtcgcgcgactttgtgggctcggcgtcaggctggagcaccgcacccggcatgtcgtcaccggggcgctgcgcacatccgcagctgctggtgccggactgacgtgacgcgatacgcgcctgcatttgctggcgctgctgttactcgggctggcgtggctactgctgctgcgtccgcaacagcagcaattcagtacgctgcaacagcagct

SEQ ID NO: 8656 - DNA, 276 bp, Glycine max
  Peptide Sequence Number=SeqID_100341
atggtagccataacccccgccaaggttcatcaacctccatttgactccgagtatcacccacaactacgactcgaacgacaagtgcgcttgccatggagaagccctggggcatcaattgagcattgtagggccctgaagttacccaatatcatcacccctcccaagttcaaggtgctggactttgtcaagtacaaggggactacttgccccaagaaccatctaaagatgccacacatggggcaagaaattttgaaagctgttgttagatgtctctaa

SEQ ID NO: 8657 - DNA, 298 bp, Glycine max
  Peptide Sequence Number=SeqID_100342
atggcatcccaaactttgtcaggcaaaattcctcgaatcgctacaggcatatctgtcgcaacctacccttcggcgggagggcgacgcgtgactcgccggatgcgtgttccacgaaaggaatacgcgcggagtcgccaccaacgtttatttgagaaaaacgtcggaaaaaccgaaaaagacccgatctacgaacttttaagtgaaaggctcgggagttgcatttacgcgcggggaagcaagtcggagacccagcatgatcacagattcgcctccactccttatgttcccatgaacccgg

SEQ ID NO: 8658 - DNA, 657 bp, Glycine max
  Peptide Sequence Number=SeqID_100343
atgtgtggtggagctcataattctgggtgttgtatccccaatgaagaaccaacagctcatgcagtcaattacatggggaaccagcccagaaataattttaatgcaggaggatttcccggattccagcatggacaacaatacaaccaacaacaaggacaatggaggaaccaccctgggaatcaattcaatagagaccagggtggattgtccataaggctgcaacaacaagggcctagtctcgacgattgtaaaatgaagctggaagagactctagctcagtttatgcaggtttctatgtctaaccagaagagcacggagtctgccataaagaatctggaagtccaagtggggcagctcgcgaaacagttggaggataggctgtcaagccgctttagtgctaacactgagaaaaatccgaaggaggaatgtaaagctgtcatgacaagaagtagaatggcaatccatgttgatgaaggaaaaactaagaagaaggtggaggaacataaacaacaggcggtgattgagctggcacttgaacccgtttcagactttgttgaacttgaggaagttgtggaagatgaagataaccaggagagagagacccaaataatagatagtcaagaaggaataaagatgaaggaagaacaagaaaaataa

SEQ ID NO: 8659 - DNA, 384 bp, Glycine max
  Peptide Sequence Number=SeqID_100344
atgagagttcgatactcggttcttaccgttttatactacttgcgcgatccagtgcactttccaaaagcgaacattgctcgtgtcaacacaaaggagagttgtgttgatccctcaaggaacgatccatacatgggtgactcagacaaatacgggttgtacattgaagaaaatcctccccgcctggttgccctaggaagactttatgagggatctacaaccgttcacaacatttcttttatgcatgatcaagtcaaggttggtgttgaggaggttagagatgcaaatactctcattcatgtacccactgaagaggttaagctagtggggcaggcacttaacaccttccttgcttggccgacacatcttgtgaagcgtttatcataa

SEQ ID NO: 8660 - DNA, 192 bp, Glycine max
  Peptide Sequence Number=SeqID_100345
atggagatggtgtggatgcagttgtcattttcccattgcagtcatgtgacgggtgtcgtaacctatccttcggcgagagggcgacgcgagactcacgggtgcatcttccaaggaaggaaaacgcgtggagtcgccaccaacgtttatttgaggaaaacgttagaaaaaccaaagaaggtctacggattttaa

SEQ ID NO: 8661 - DNA, 348 bp, Glycine max
  Peptide Sequence Number=SeqID_100346
tatgaagaggaaagagtccccaatcttgacattgtgtttgcagaattcatggcatatcatgctagttctaaagctaatcataatgcaatacaaaagcaggagattcaatgtgccaaagatacaattggatctattcaacgagcatttaaaagtgcaaaaattcaggttggtaagttggtagaagaagtgactcaagctatgaacagaagagaacaagagattgtcgaggttgacactcaggaggagagccctgtgaataagcatgatttagaagaagaagatgaggagaaagcgcaacaatgggaacaatgcttacaaacacacactcaacaagaagataatttccaa

SEQ ID NO: 8662 - DNA, 411 bp, Glycine max
  Peptide Sequence Number=SeqID_100347
atgttgggtcgtactcaggatcgttgtttcaagttgcatggctatcctccaaattataagaagaatggatattcctcagaggtcaagaagcaatctttttcatccactaaaccatcacacaaggttaatcaccaagtgtttgctgatatgcctcaatcacaaccctcttctattgaccttggttcacagtttcaacttactgctcagcaatatagccaattgatgaatcttttacaaagtcatgctaccaatgttgtcattcctcacgatgtttcttcctcaagtattagtgccctactaactaatcctaatttgtccatttctttttcccaaaatgaatttgatatacaggagaagcaagcttgcaagaagatggaagaggggatctcatccaaggcctttatgtcctag

SEQ ID NO: 8663 - DNA, 120 bp, Glycine max
  Peptide Sequence Number=SeqID_100348
atggagaattggcgaacagcgctagggaatgacattcacgggggtccagactcgaaggcaatcatgaagcataacttcaaactcgaaggtggaggacacatgaatagcgccaggcaatga

SEQ ID NO: 8664 - DNA, 579 bp, Glycine max
  Peptide Sequence Number=SeqID_100349
atgacattgaccatcccagagcttttcttgaggccttaccatgttacatgggatgccaccgtgttcggggtctttaatccagacttcccgctctacataaagcacgaagacctctccaaaatcgcacacggtggtcaatgtctcagcatatcagtgttacggttgtggattatgcatatgactgaaacaagtatgcaagcggggaattctgatatctatggattcctcgagccacagtctattcagaggtttgggcaaacgcagtttcagactgaaagttacataaagagttggatgcagggttcaaaacacgatgtctaccttggagcctacttgaatggcggacacaggcagatggtggtcatcgtgcccaaggaacacctagttttctggttttgttcattacataacagtgctttaaaaggtcttgatgatgctccacaacctaaatcaaaggctcctactaggtggattgtcgtcaagtattttaacaatcctagaccattggagccagagagattaaaggcaatgtggatccaatgggaacagtattatcttcgagttagagttcatagctag

SEQ ID NO: 8665 - DNA, 291 bp, Glycine max
  Peptide Sequence Number=SeqID_100350
atgtctcttgccactctctttgggaaacttcaagaacatgaaatggaacttatgagactctatcaacatgaagagaatgacaaaaagaagaaaggaattgcactcaaagcctcatcttcttctattcataaggaaactgacaaagaaaactcaaatgaaaagaacttagaagaagatgatgatttcagtctctttgtgaaaagattcaataaatttttgagaaacaaaggaaatcaaacttcagtccaaagaagaaaggaaaaattcctccttagttccaaaatgctttga

SEQ ID NO: 8666 - DNA, 291 bp, Glycine max
  Peptide Sequence Number=SeqID_100351
atgtggaaaagacagcagatattacattttacacagttcaataaatgcacacacaaagtttcacaattccttaaaataggcctaactcacaaaaactgtccccagtggagtcgccaactgtcgcaacatgcccctatgcgggcgagcgaagcgaggctcacgggtgcgctttccaaaggaggaaagatgcatagagtcgccaccaacgtttatttgtggaaaacgtcgggaaaaccgaaggaaaccggtcaaaatgaaaattctaagttcgggagttgtatttacgtttga

SEQ ID NO: 8667 - DNA, 201 bp, Glycine max
  Peptide Sequence Number=SeqID_100352
atggaggccatgaaagagcaaatggccgcaatgatggatgccatgatgagcatgaagaagataatggaagccaatgcgattgcaattgccgttaccagcattgttgctaaggtgaacccgacgtccccatctggcatcaatgaatcatccaacctcagatatggtaggcaaagatttgggaagtatgggcggcccccatga

SEQ ID NO: 8668 - DNA, 582 bp, Glycine max
  Peptide Sequence Number=SeqID_100353
gtgttccacggcgaactgacccgtcacgaatcacaggtggtgattggcgaactgctaaaagacccgcagctcaactttgtcgcctgcggcctgcaaagcgcatacgtgagcgataaagccccggacgcctttgttgagctgatgtcgaagcactaccatcgtctgcagcgggtaagcgattaccatcgcatcgacgatacgctattcaaattctccctcaacctgccggatagcgatatcccacagcttatcgataaattgcacgtctcgctggatgggatcatgaagccggtcaccagcggctttggctttgtcgatttgattatccccggcctgcataaagccaacggcatcagccgcctgctcaaacgctggaacctttcgccgcagcaatgcgtagcaattggcgacagcggcaatgacgccgaaatgttaaaactggtgaaatatgcttttgctatggccaacgctgccgacagcatcaaagccatcgccggtttcaccaccgatgacaataaccacgacggcgcgttgaaggtgattcaggccgttctcgataagacctcccctttcaacgactga

SEQ ID NO: 8669 - DNA, 1035 bp, Glycine max
  Peptide Sequence Number=SeqID_100354
atggatgcggcaaaaatcatgtgggtcatgtacgagcacccggaaacccacttcgaagaactggcgctgcgctttatggatatccgtaaacgtatctacaagttcccgaaaatgggcgtcaaagccaagatggttgccattaccaccacctccggtaccggttctgaagttaccccgttcgccgtggtaaccgacgatgcaactggacagaaatatccgctggccgactacgcgctgactccggatatggcgattgtcgatgccaacctggtcatggatatgccgaagtccctctgtgccttcggtggtctggatgccgtgactcacgctctggaagcttacgtctccgtactggcttctgagttctccgatggtcaggctctgcaggcgctgaaactgctgaaagagtatctgccggcctcttaccatgaaggttctaagaaccctgtagcccgtgaacgtgtgcacagcgccgccactatcgccggtatcgcgtttgctaacgccttcctcggcgtgtgccactcaatggcgcacaaactgggctcgcagttccacattcctcacggtctggcaaacgccctgctgatcagcaacgttatccgctataacgcgaatgacaacccgaccaagcagaccgcattcagccagtatgaccgtccgcaggcgcgccgtcgctacgctgagatcgcagaccacctgggtctgagcgctccgggcgaccgcactgcggcgaaaatcgagaaactgctggcatggctggaaagcctcaaagctgaactgggtattccgaaatctattcgcgaagccggcgttcaggaagctgatttcctggctcacgttgataagctgtctgaagacgccttcgatgaccagtgcaccggcgctaacccgcgctacccgctgatcgccgagctgaaacagattctgctggatacctactacggtcgtgactttgtagaaggtgaagcggcggctgtgaaaaaagaagcggctccggccaaagctgagaaaaaagcgaaaaaatccgcttaa

SEQ ID NO: 8670 - DNA, 246 bp, Glycine max
  Peptide Sequence Number=SeqID_100355
atggattggcttagcgcacgatggcctcgaggaaatgccatacaggcttcaaaacattctttcagagaggaatgtagagctagcgtcgagcatactgagggtgcagggctagcgcagcagagatcaggccgtggcagtgcaggaacgtcaggtcagcagggtgcagagcaaatcgccatctgtattggcggtttgcgtttcacaggaatcgccaacatggctggcgggctgtgctttgttctttaa

SEQ ID NO: 8671 - DNA, 165 bp, Glycine max
  Peptide Sequence Number=SeqID_100356
atgggtgccaagtacctcgaagcggtcaagcaaaggttgcatgccatcaaacaatggtccccgaacgaaattaggataaaaacgcaccatcttcaaacttgtaccctcatatgcatgacatgggtcctttctttgataggatcccatgtctattgtcatcactaa

SEQ ID NO: 8672 - DNA, 282 bp, Glycine max
  Peptide Sequence Number=SeqID_100357
atgcagagttcaaaatgcgatgtctatcttggagcctacctaaatggtggacactggcagatggtggtcatcctgcccaaggaacacctagttgtctggttttgttcattgcataacaggccagacaactaccttaaggggattattaacagtgctttaaaaggtcttgatgatgctccacagcctaaatcaaaggctcctgctaggtggattgtcgtcaagtattttaacgatcctagaccattggagccagagagattaaaagcgttgcggatccagtag

SEQ ID NO: 8673 - DNA, 1959 bp, Glycine max
  Peptide Sequence Number=SeqID_100358
atggggatatattcaatgccctttgtgggtgttctgctacttttctgtctggtttcatcttcagaggcagaatatttgaagtataaagaccctaaggtgccaccgaatgtcagaatcagtgacttgttgaagaggatgtctctggaagagaagataggtcaaatgacacaaattgaaaggagtgttgctactcctgatgtgatgaagaagtacttcattgggagtgtgctcagtgggggagggagtgttccggcgacaaaggcatctgctgagacctggcagcaaatggtgaatcagctgcaaaaggcagcattgtctactcgccacgggattccgatgatttatggtatagatgcagttcatggacacaacaatgtctataatgctaccatttttcctcacaatgttgggctaggagttaccaggaaagtttatggatatgctagaattgaaagagtaatcatgaagtcacatttgataactttgattggaatgatctgggatcctgtgctcataaagaagattggagaagcaactgcccttgaagttagagctactggaattccatatgtctttgctccgtgtattgcggtctgcagagatccaagatggggacgttgctatgaaagctacagtgaggaccctaagattgttaaaactatgacggaaattatacctggcttgcaaggagatatccctggcaattccattaagggagttccctttgttgctggaaagaacaaggttgcagcctgtgtcaagcactacttgggagatggtggcacaaacaagggtatcaatgagaacaacactctgatcagttacaatggattgcttagcattcacatgccagcatactatgactctatcatcaagggtgtttcaactgtaatggtctcgtactctagctggaatgggatgaaaatgcatgcaaacagaaaacttatcactggttacctcaagaacaaattgcatttcaagggtcttgtcatatcagattggcaaggtattgaccggattacctctcctcctcatgctaactattcatactctgttcaagctagtgtcagtgctggaattgatatgattatggttccctacaactacaccgagttcattgatgaactaacccatcaagtaaagaacaacattatctcaatgagcaggattgatgatgccgtggcaagaatcttaagagtaaaatttgtcatgggcttatttgaaaatccatatgctgatccaagcctggtgaaccaactgggtagcaaggaacatagagagatagcaagggaagctgtacgtaaatctctggtcttgctaaagaatggtaaatcttacaagaaaccacttcttcctcttcccaaaaagtccgcaaaaatactggtagcaggaagtcatgctaacaatttgggttatcaatgtggaggatggacaattacctggcagggacttggtggcaatgatctcacttcaagtacaaccatccttgatgctgtgaaacaaaccgttgatcctaccactgaagttgtcttcaatgaaaatccagataggaactttgtcaagtcgttcaaatttgactatgcccttgttgttgtcggagaacacacttatgctgaaacattcggtgacagtttgaatctgactatagctgatccaggtccaagtaccatcaccaatgtgtgtggggctattcgatgcatagttgttctcgtcactggccgcccagttgtgattaagccatatctatcaaaaatagatgcccttgtagctgcatggcttcccggcactgaaggtcaaggtgttgctgatgttctctacggtgactatgaattcactggcaagctggcaagaacatggttcaagacagttgaccagctcccaatgaatattggtgataaacattatgatcctctatattcatttggttttgggttgacaacaaacatcactaaatattga

SEQ ID NO: 8674 - DNA, 213 bp, Glycine max
  Peptide Sequence Number=SeqID_100359
atggagaattgcacaaagcaatctctccgcatggctccacaatcgaaggaggagagagacatgaaagaaaacgcaattcatagggctccgaaaaagaggttgagaatggagaattgcactaaatcaatcactacgcatggctccaaactcgaaggtggaggacacatgaacgaaaacacaattcatggggctccgaaaaaggttgataattga

SEQ ID NO: 8675 - DNA, 772 bp, Glycine max
  Peptide Sequence Number=SeqID_100360
cagaatagacttagctttggtgaaggagttttatgccaacctttatagctctgaagacccttcaccaaagcaagtcagggtcagaggccacttggtgaggattgatgcagacagcctcaacacattattggagacacatgtgatattagctgagggtgagactttaccagcatattccagatactgcaggttgcccatagattataaagagattgaggctgccttatgtataccaggccgagggtttattttgaactctgagggccatcttgggaagattctcaggaaagatttgatgactcttgctcaggtgtggagtgttctctcatattccaacctggctcctacttcacacacctcagacctgatagtagatagagctaggatgatctttggcctagtctctcagatggacatgaatgtgggagcccttatctctagccagatcacatctatggtccagtctaactcttctagacttgggttccttgctctgatcaccgccctgtgtaaggccagaagggttaattctgacagcttggtttttgagcgcctaagcctagtcatcaacttggcctatatcaggaaaaactgttggaatcttgatgatctaacagtttctatcagaggggccaggagggcaaggacgaggccagttgagcctccttccacttctacagctcctattccagcacgtacctcatcaacttcttctatcccagcttctgcagattttcagcgtcttgaaaccatgcttcagagtatccattag

SEQ ID NO: 8676 - DNA, 330 bp, Glycine max
  Peptide Sequence Number=SeqID_100361
atggcatcagcaatcacctgggccacatggacgctcatccgtgtcaggatggcatacaccaattggcacttagacagagagaggtcggagttgtggttgctaggcaagacattgctgagcagcagattcatccaaatctgggtcagggtagtcatgctagtgcgcataatctgcactcgcctccctacagcggtccgggcgaaatcctgccctggtatgcaaagtagctgggcgatggcttcctcatcgaaaccgtctggccggtccctcctctggctgaattcacactgctggtcctcctccaaaatcaacgggtcgcccaagaactaa

SEQ ID NO: 8677 - DNA, 303 bp, Glycine max
  Peptide Sequence Number=SeqID_100362
acttatcaaggtaatccttgtggcgtctaccctgacttatcttccttcaccggaagtggcgtctacccagacttatcttccttcaccggaagtggcgtctaccctgacttatcttccttcaccggaagtggcgtctacccagacttatcttccttcaccggaagtggcgtctatcctgacttatcttccttcactggaagtggcgtcatccaaacctccgtagcatgtatcaaacgttccgcccctaagattcacatcataacttatgaccatttgaatttctcgaaagattccattgtttaa

SEQ ID NO: 8678 - DNA, 1137 bp, Glycine max
  Peptide Sequence Number=SeqID_100363
atgagtgatttttaccagaacggcgtaattaccaactttcataatctcacccaccgcagcgtggagtcgctggaaaaagagatggtgcgctttgcgcgcaagcgcaaaatggggctgattctgccctcgctgttttccgagctggaaggcccggcgctggataatatcgtcaatgaactggcgaaagtgccctatctggaggagattgtgattggcctcgatcgtgccgatcgcgatcagtttctcttcgcgcgcgaatttttctcgcgcctgccgcagcgccaccgcattttgtggaacgatggcccgcggctgaaagcgctggacgccgagctggataaagagggcctgtcgcccagccagcccggcaaggggcgcaacgtgtggttctgcaccggctacacgctggcctccgaccgctcgcagtgcgtggcgctgcatgactgcgatatcgtgacctatgagcgcggcatgctggcacgtctgctctatccgctggccaacccggcgtttcagtatgaattcgcaaagaaagtctacggccattcggagtatctcgactatctcaccagtttccgctatccgctgtccggcgagtttgccatgcgcacccacgtgctgaacggcatcaaaatccctggcgactgggggctggagattggcgtgctgtcagagatttatcgcaattacaccacgcggcagacctgccaggtggaaatcgcggacaactacgaccataagcatcagccgctggcagaagaggacggcaccggtggcctgaaacgcatgagtaacgatatcgtgcagtcgctgctgcgtaagctggcgacaatgggcgtgccgctcaccagcgactcattccgcgtgctgaaggccacctattatcgcaacgcgctggacatgatggagatctacaaccacgaagccaccatgaacggactgaagtttgatcagcacattgaagaagcggcggtcgagatgttcacccaggcgattctcgacgccggccagtcgttcatcgagcggccaaacgagaaaccgtttatccccagctggagccgcgtgcagtcagcgttccctgatatccggcagcgtatctatcaggcggttgaagaggataacgagggcagagtctaa

SEQ ID NO: 8679 - DNA, 149 bp, Glycine max
  Peptide Sequence Number=SeqID_100364
atgtcggcgaaagggttatcaccaaacccttcgacagcccttaatctctcttcgatgagatcaagtttccctctcccttccactgccggaggtggccctctactgagaaatgcagcggctgcagagggcggggttgaggagctcccgcg

SEQ ID NO: 8680 - DNA, 75 bp, Glycine max
  Peptide Sequence Number=SeqID_100365
atgggtgttaagtacctcgaagtggttaagcaaaggttgcaggctatcaaacaatggtccccggacgaaataagg

SEQ ID NO: 8681 - DNA, 345 bp, Glycine max
  Peptide Sequence Number=SeqID_100366
atgaagaagatccaagacctacaagctccacatggagcaacatcactttatgaggggtcgacaaccgttcacaacatccctttatgccatgatcaagtcaagggagctgtgggaccgacaaaacctccagataggctgaatcatgacgtcgatgatcccttgtatatgatgacattgaccatcccacaaccttttcttaagctgttgcaggttatgtgggatgctaccgtgtttggggtgtttaatgacaacttccccttgcacataaaggatgaaggtccatctaaaatagcacacagtggccaatgtctcagcatctctataatacagatgtgcattctataa

SEQ ID NO: 8682 - DNA, 258 bp, Glycine max
  Peptide Sequence Number=SeqID_100367
atggtgaaagttggaacctcttacgtgccgatcaacgtctcattttcgccaaaagttggcccagggcttccccggtatcaacagggacaccaggatgatgtattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 8683 - DNA, 666 bp, Glycine max
  Peptide Sequence Number=SeqID_100368
atgacaagcagagaccaagtttggtcattctgcacccttgtatcatccagaggcggcgggcccgatgatacgcggaggtgccttacggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaaatttggtcattctgcacccttgtatcatccagaggcggcgggcccgatgatacgcggagataccttacggttatccgcaccctttgtcatccagaggcggcgggcccgatgacaagcagagaccaagttggtcattctgcacccttgtatcatccagaggcggcgggcccgatgatacgcggagataccttacggttattcgcacccttttgtcatccagaggcggcgggcccgatgacaagcagagaccaaatttggtcattctgcacccttgtatcatccagaggcggcgggcccgatgatacgcggagataccttacggttatccgcaccctttgtcatccagaggcggcgggcccgatgacaagcagagaccaagttggtcattctgcacccttgtatcatccagagcggcgggcccgatga

SEQ ID NO: 8684 - DNA, 390 bp, Glycine max
  Peptide Sequence Number=SeqID_100369
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccggggcaggaattcgatctcgcatgtccgattcaggcgcataacatatcgagacgctcgaaattgaacaacggaacctctcgagaaattcaaagtg

SEQ ID NO: 8685 - DNA, 396 bp, Glycine max
  Peptide Sequence Number=SeqID_100370
atgtggatgacattgcagctcatgaatgtcttgcctagtgatcataactccgaccttcctctgtcgaagtgtcagctggtgtatgtcatcctgacacggatgagcgtccatgtggctcagttgattgctgacgccatctatttatttgcaggtatgccacccaccaggcaccctctagacccggataagtctaatagggccctgggatttccggcattgatcacgggcctctgccagtcattcggggttcccatcactcctagtaaggtgatccaatcgccgatcacccgggccttcattgagaagtattgcacgcctaggcaggcgcagggtgatgtacctcaggccgcagacgcaccgccaccacctcatcaggctgatcctgttgggtcataa

SEQ ID NO: 8686 - DNA, 351 bp, Glycine max
  Peptide Sequence Number=SeqID_100371
atgaaacacaactccaaactcgaaagtggaggacacatgaacgaaaacgcaattcatggagctccgaaaaaagggggagaatggaggattgccttgagggtccgcatcttaggcaatcatgaaacacaactccaaactcgaaagtggaggacacatgaacgaaaacgcaataagattcatggagctccgaagaagaggggaaaatggaggattgccttgagggttcgcactcaggcaatcatgaatcacagctccacttttcaaaagtggaggacacatgaacgaaaatgcaattcatcgagctccgaaaaaagggggagaatggaggattgccttgagggttcgcactga

SEQ ID NO: 8687 - DNA, 384 bp, Glycine max
  Peptide Sequence Number=SeqID_100372
atggaacttattgagaatatgggtgctagtgatcatgctattttgcgtgatagaactcatgttcttacaaagagaagcctgttagagctttcttcacaagatgcaattttggcacaaaataagctgctagcaaagcagcttgaatcacttacagagacacttagtaagttgccaactcagttacaagtggctcaacctttccattcagcagttatgcaggttggaggttgcagtatatgtggaggaccgcatgaatctggttgttgcatacccctggatgatgttgcaaaagaagtgaattatatggggaaccagaacagacaaggattccatgcaggcggtttttcaggttaccaacaagggagaaatttcaattcaaattag

SEQ ID NO: 8688 - DNA, 438 bp, Glycine max
  Peptide Sequence Number=SeqID_100373
atgaaaaggattcctccaagaagattgttaagaaggaaaatcattttgcaacaaaatgtgatatcaaaagagcactccttcttaaacaatctttctaccttctcctatcaagggaaacttcccttagcaccgtcatacctcttgagcttgaggaataatcaacatgaaaataaagaaaaaggtatgttttattccattactttccttaactttttaaatagtgatcaagggcttcccatggaccctaagagaataaaggtcattcctgagtggcctactccaccatgtgtaagggaaatttggggcttcaatgaacaaacttttacaaaaggtgttgaggaaaaacttaatgagtttcaagaacctttggatttgagggcgcatccttttcatgggggagggaatgatgcaatcctaccccccgaggacattgcatag

SEQ ID NO: 8689 - DNA, 210 bp, Glycine max
  Peptide Sequence Number=SeqID_100374
ctcaaaaatgatatcgaaattcccaacagtgaaaatgctcgaaattgggttgcgaacgtggtgctcaaattttacgacgatccaacggtgaacgagttcgaaatcgtcattgttctgagacaggtttggtgggctgcaggaaaaaaaaagggttttaaggggagaaaagagaaaaatgaaaatgagggaaagaggaggcacctgacttaa

SEQ ID NO: 8690 - DNA, 150 bp, Glycine max
  Peptide Sequence Number=SeqID_100375
gtggccaaagatcaattaactacgaaagataagatggatgaggaagaaaaacaaaagaaaaagaaggatagtaaggccttgtcgtcaaaggccaaggggaaggaaaaagaggaaaaaaattcctccaagaagattgttgtcataccctaa

SEQ ID NO: 8691 - DNA, 391 bp, Glycine max
  Peptide Sequence Number=SeqID_100376
aacttcaaatgttattgatctttatgaaaaatgcgagagatctaatggcctctctgtgatgttcataaaaaccgatatatctactagtatccgtagttctgttgatcagcatgaaaaggtcaaggatctttctaaggccattgatgatcaatttgttacatctgataaggtccttgccaacacccttataatccagttctcatccttaaagctctatcggataagaggagtacgtgatcacatcatgtgcatgagggatatagtggctcagctaaaagccttggaaattaccatgttaataatggaacagggtgaaagagaatatttgactgctcaaggaaagaaaaagggggatcaagccaagaataaggacaagattcctgctcagccg

SEQ ID NO: 8692 - DNA, 393 bp, Glycine max
  Peptide Sequence Number=SeqID_100377
atgggattcaccttagtagaccttcaaaaggtaggttacaaggacgacccattcattatggcagcgcaagctccacaggtgttttatgtagaagatcccaacgacgttgatgtcagtgacataccacctttcacgaaagacatgtctttgattaatgatgaagaaccacaagataatatgataacaaaaggtgatgacaaaggtgatgacaaaaaactcaaaggtcaatcaaagaatgagttcaagatattcaagatagaatcaagaacatttcaagattcaagaagaaagttgaattcaagaatcaagaatcaagattcaagagatcaagattcaagaatcaagagaaggcctaatcaagataagtatgaacaggttttctcaaaaacttga

SEQ ID NO: 8693 - DNA, 414 bp, Glycine max
  Peptide Sequence Number=SeqID_100378
gaatttaaaatccctgagacaagtcttgggcatcctgattttgagcctcctcctcatctatcagatggaaaaacaagggaatcagagagagcaaccacttctctagataaggaatcagaaagatcagcagcttctctagttggggattcagggggagtagcagcttctccagatggggaatcgaagatgataatcaaaggtggagatgggggaactactttgaaagctggagttgctgcacatgatgtccaacgttatgtcaaggaatcagattgggctgcacaatgcacaaggcaagataaaatgtcaaatgaagaattgaagctgcaggatccacgatgtcggatacgatgtccaggacatcctgcccgaaaatactggacacataaatctgttatatctttaacagattaa

SEQ ID NO: 8694 - DNA, 209 bp, Glycine max
  Peptide Sequence Number=SeqID_100379
gctcatacttagcccatgggcctgaaatctaccctaaggctcatgagaaccctaaggccttcacttgcatctctggcccaatcttcttggagtcttatatccaatgcccttgcggggtaggattgcatcattccctcccccttgaaaaggatttgacctcaaatcccgaggttcttgaaactctgggcttttttcctcaacacttgtaa

SEQ ID NO: 8695 - DNA, 219 bp, Glycine max
  Peptide Sequence Number=SeqID_100380
atgcctataggttggacctcccagaaaagtggagctgatattgaggaggaggaactaacatatttgaggtcaaatcctcttcaaggggaaggggatgatgcaatcctccctaggaagggaccagttactagaaccatgagcaagaggctccaagaagattgggctagagctattgaagaaggccctaggattctcataaacctcatggtagatttctga

SEQ ID NO: 8696 - DNA, 432 bp, Glycine max
  Peptide Sequence Number=SeqID_100381
atgtctctaaagtttccgtattctcctaaattagttagagtcttttacaataatctaaaaattcaggatgatgtcattttttctgaggtgcatcaaataccaattgttgttgatcaatctctattttattctctgactaaactaagcagtcaaggtgttccttttgagggcactctagttgatgattggaaaaatgtctattcttgtcatgatgctcgtaaaatggcattacaggccaatgcacctcttccgaatccgtatcttgtcactctgtttcttcagcattttaatgttcctttagaggatgaaccttttgtcaaatttaaaagatcatttgctattggtgctggtgctgttgcctccttcgaataccggaaggatgaggatggcctatgggtgctaggggtgggaataggccaggccagactttaa

SEQ ID NO: 8697 - DNA, 492 bp, Glycine max
  Peptide Sequence Number=SeqID_100382
atggttgtaatggaacaaaacctaaaggaagctccacaggtggacatggatgccatcaacaggaaaaagcagaaaaggctagctagggccataattgatgaagacaaaggtctcaacagttttggtattgctaagaaaattcaaaagatcatgaatgggaaacaaaagaagacgaggaaaaattctcagaggggagaagaagatgaggaattgatagcaagggaacacataactaagaagaggcatgatgtcaaaacaagagctattaaagccaatcccaagattggtgaaaaagaatggtctatctccttcactggcaacaaagagagtgttgtttcatcttcatttggcaatgagtccattgaaaacactcatgtctctcgtctctgcaaacaatactctgcatctagcaagcgtccacctccaccacccattcacttagagaagtttagaagatctatgcaacaaaaggaaactttaacagatgcttag

SEQ ID NO: 8698 - DNA, 291 bp, Glycine max
  Peptide Sequence Number=SeqID_100383
atggtgatggtggtggtggtggtgatggctaaagggatggagaagcaggggaacaacaccaagattggaaaactgagtggcaatggcattttgcatagagagcctgaactgctcattttcttgcctttgtcactcagtgaagaaggtacatcctttgtggtacaagtagagggtacatctacttgggttgttatactgagaacaagagagggtacatctcttgtggatcggttcaagtggagggttattggaaatctcaagaaccggtggttgcttggggactggatgtag

SEQ ID NO: 8699 - DNA, 369 bp, Glycine max
  Peptide Sequence Number=SeqID_100384
atgtccagcaacatggcggtcgcattggccaagcttcaggaggacaaaattaatgatcgacgtcacggtcctcgattttccccaatcccttccccgacacaacctcattcaccgtcaatttctcccatggggcccttaaaccctcgcatccccttcaagcgattgacaccagaggaaatggcaactcgccgagacaaaggcctctgctaccaatgtgatgacaaatggaccccaggtcatcattgtcgactgcgcctctactcgcttatcacggacgatgacttcgatgtccttgatcagggtgctctacctgagccactcagatgcaatcctcccaaggagggaccccatcaccagagccatggctag

SEQ ID NO: 8700 - DNA, 312 bp, Glycine max
  Peptide Sequence Number=SeqID_100385
atggctgtgccagaagtgtctatctcgatggtgaaggaaagggagaaatcaagggtggctaacacaagcgcctgtgtcatgaggctagtcaagcatagcttggatttcagacaggttcgtagcaacgccgtttgcagacacgatgtggccgaggaggtggatgtggtgggtgatgactcgggttggtgggatagtgtgagatcaatggcagtagaatggagaaggatgaaaggtgattggagatgccacttcaaggagaagatgagtcaagaacaaactcaccaccataggaagccatggataagagcttga

SEQ ID NO: 8701 - DNA, 420 bp, Glycine max
  Peptide Sequence Number=SeqID_100386
atgttgaagattgagacatattatacggaatgtgcaagcacatggccgaaagggtattcggcttcaaaggatatgtcgcgtgctaggtgtcctgtccgaatacttatccagtatactgcccccaagcccttttttggcctcggccaaaaagaagggttttatgctagttacgttgtggatgtgacatttacattgcatgtctcttcaactacttgcgctggatgctcgtccaccaaaggggaatctagtgactttttgacattcctaagtcaattgctagaaaaagtgggtgacaatattgtggctccaactgtagtgcaaccagagacttctacgaaagttgtacctcaacctaagaagcaccctgtgttgaaggagaaatgtttgcctccccctatcatgcttcctagatacacatga

SEQ ID NO: 8702 - DNA, 90 bp, Glycine max
  Peptide Sequence Number=SeqID_100387
atggcagctcgcccaagcgagccaagacttactcctaaagtaactggctcacctagtttggctagcgagaatcaaagcatcagtgaatga

SEQ ID NO: 8703 - DNA, 126 bp, Glycine max
  Peptide Sequence Number=SeqID_100388
atgggcgaggaaaagaaaaaaccagaggaaaacaaagtggaggagaaaaaagcagaggaagaagaaaagaaacaagaagagaaaaaaccagaggaatcaaaagatgacaaggaatccaagaagtaa

SEQ ID NO: 8704 - DNA, 260 bp, Glycine max
  Peptide Sequence Number=SeqID_100389
atggaatggggaagcaacattgcgatgacaaaattgggattgaagaaaaggtgtgtctcacattcacgcgaaaaggttgaagcttatattcaagatggtgttgagaaaatcatgggttacattgaggtttacagtgtgcaaagaaaaccatggcatgaaaaagatggtgtaaagaaaattatggattacattgaggtttacaatgtgcagagaaaatcgtgggcatggaaaaggttgtatgatttacaaaaaaggaaaag

SEQ ID NO: 8705 - DNA, 213 bp, Glycine max
  Peptide Sequence Number=SeqID_100390
atgggtctacgaattttaagaataagggttcgggagttgtttacgtgcgaggaaggttattttgatgatgccaaagaatcaagagttaaggaaagtttcaagcaaagattcaagaatcaagtttcaagtttcaagaatcaagaatcaagaataatcaagatcaagattcaagactcaagattcaagaatcaagagaagactcaatcaagataa

SEQ ID NO: 8706 - DNA, 426 bp, Glycine max
  Peptide Sequence Number=SeqID_100391
atgcacgatagtatagtaaactgtggaagcaatgtctttcaagattattttgatgatgccaaagaatcaagagttaagcaagtttcaaagaatcaagattcaagaataatcaagtttccagaatcaagattcaagaataatcaagatcaagattcaagactcaagattcaagaatcaagagaagactctatcaagataaggtacatcctttgtggcacaagtagagggtacatctacttgggttgttatactgagaacaagagagggaacatctcttgtggatcagttcaagtggagggtgcatccacttggttgttcaaagagaacaagggagggtacatcccttgtggatctttggcttgtaaaggattttacaaggttgaaagaaatctcaagaaccgttggttgcttggggattggatgtag

SEQ ID NO: 8707 - DNA, 1236 bp, Glycine max
  Peptide Sequence Number=SeqID_100392
atgacatatgagcatggttttcacggggatgcttcccaagggactagtgccgctcccgagttcgacagccatcgtttcaggagcgctgagcaccagcagcgtttcgaagccatcaagggatggtccttccatcgagagagacgcgtccagctcagggatgacgagtacacagatttccaggaggagatagcttgccggcgttggacgtcactggtcactcccatggccaagtttgatccggatatagttctcgagttttatgccaatgcttggcctacggaggagggcgtgcgggacatgcggtcatgggtaaggggccagcggattctttttgatgcagacgccctcagccagttcctgggatacccgctagtgttggaggagggccaggagtgcaagtacagtcagagaaggaaccgggccgatggatttgacgaggaggccattgcccagctgctatgcatactaggtcaggattttgcccggaccactgccgggagacgggtgcggatcatgcgcaccaacatgactaccttgacccaaacatggatgatgttgctgctcagcaacatcctgcccagcgatcatagctccgatctcccgctgccgaagtgtcagctggtgtatgtcatcctgacacggatgagcgtccatatggctcagttgatcactgatgccatttatttatttgcaggcatgccgcctaccaggcaccctctagacccagataagtctaacagggccctgggttttccagcattgatcacgggtctctgccagtcgttcgatgttcccgtcacacctagtaaggtgattcgaccgccgatcacccgggccttcatagagaagtattgctcgcctagacaggcgcagggtggcgcaccgcaggccccagacgcactgccgtcacctcatcaggctgatccagctaggtcatttgacacggagcggtatttacggcatttggttcgccagcaggcggccaaccacagggcgcacgtgcagacccatgactgtctctaccagctcagcctcagtctgcagagccagggtttcgctccttttccatgccctactccaaatcagttcagggcagaggtcgcatggcccggagattggcctgaggcccaggcaggggaggcgcccgcaaaggctcccggtgatggagaggaggcccgcatggatgaggagatgacggatttgctcgatttcttgggaggcagcggagccacgtga

SEQ ID NO: 8708 - DNA, 453 bp, Glycine max
  Peptide Sequence Number=SeqID_100393
atgcattaccaaaagaggaaaactctagatgaggcttcactattatcaagcgagttggagacccagcatgaccacagatcaacctccactccctatggctctaaagtcgacaagggtgttgcccttgctcctacgtgtccccaggaaaataccatttggggcaggggaagctcgcccaggcgagctggttgcttcatcctgaaggtatcagttcgcccaggcgagctgctgagagagcacgacttacattggttaaaaaagaccttttatattggttgtcataccctaatttcgtccggggaccatccgttgttgggatgcgaccctcgtttggccacttcgaggtacttggcacccatcgttaggcaattcgtgaagttccgtgacgtgccggaagtcaaaagaaggcattgtagcacaatccgtggagttccacgacatgtcggaaattaa

SEQ ID NO: 8709 - DNA, 507 bp, Glycine max
  Peptide Sequence Number=SeqID_100394
atgtgcacttgccccgctccgtacgcttgtccacatagcgtttccaacgcgcttcccattccaaactgcgcgcaaagtccacaagtgagtaataatgatgccaaggcagaagccggcgatgacggagttttcaatggagatggcggcgagggcgagggtgctgacgtggccggagaagacttgggtgacggcgccgagggagtactggcagacggaggtgaagatggcggggccggcgaggtaccagagcttcttcgactcggcgaagaactctctggcgaagtcgccggcgccggcgatcggagcgatgtcatcggatttcgccgtgaagacgacggcggggtccggtgtgtggtgtcgcggcgtgagaagtggaacaactttataaagaaaaagttccggccttcagagcaggtttttactgttacccaatgtaatgccacactccgtcatcggttcggaaaaggagataaaagtaaaaaggatagggagaaaaatcaatcataa

SEQ ID NO: 8710 - DNA, 153 bp, Glycine max
  Peptide Sequence Number=SeqID_100395
atggtagctcgtggtggccaccggtggttatgggtggtagaaaagaagatctcacttagcgagtttgtctcgctaagagaaaatcaacttttggcgctgagcgtggcctctcacgctaagcgagttaattccttgggttggaattgcgcttag

SEQ ID NO: 8711 - DNA, 846 bp, Glycine max
  Peptide Sequence Number=SeqID_100396
atggctccgaaaaagctttcagccaagaggtctaggaaagatgccgctagagagggttctagtgcgaccccacaggagaggcgagtccaactaagggacggagagtatgctgagtttcaagaggaaattgtccaaaggcaatggactcaacttgtgtcacccatggctaagtacgacccagagatagtcatggaattctatgccaacgcctggcccatggaggagcgagtcagagacaagcgctcctgggtgaggagccagtggatccccttcgatgaggatgccattaatcaatttatgggacatccattggtcttagaggagggccagcgctatgagtttagccagaggaggagtcaggtctcgggcttcaacgaggaggccatcagccaactgatttggatgacattgctgctcagcaacattctccccagcgaccataattcggacctccctctaccgaagggtcagctggtctacgccatcctaactcagggcactagggtttcctgctttgatcacgggcctatgccaattctatggtgtgtcgatccctcccgccaggcttattcggcctcccatcagcagagccttcatagagaaatactgcatgcccaggaaggcacagcagtaggaggagggccaatgcacacttacatgcagcatgtgactagccagcaggcagctaatcacaggggtcaggaccccagtcatttctcgtgccctacccccgagcagttcggggccacagttgcatggcctggagatgagcccgattttgagactggggacgatgagggagctcaggatgatgatatggctgatgtgatgaatttcttcacttga

SEQ ID NO: 8712 - DNA, 333 bp, Glycine max
  Peptide Sequence Number=SeqID_100397
atggaggagaagctggaggcttccttcagaagcaacctactcacccaggcaagctgtggctatcacaagtggctgaaggctagaacacaagagataacttggctcccgaagctaaagatctcaagtgaggaagaggttgaaacccctgaggagagcgaagaggtgcaagccttaaaggtgaaacttgaaagggcgcaagcggtcaaggaaaagttcaagacgacggccatcaaggtcgggaaagagtgcaacaagctgagggacgtcaatgtggccacaaccgaagctttgaaacgggaaacaaagagggcccgaaaggaagaatgggcctga

SEQ ID NO: 8713 - DNA, 1035 bp, Glycine max
  Peptide Sequence Number=SeqID_100398
atgccacagaacttcacggattgtgcaacaatgctttcttttgactttcgacatggcatggaacttcacgaattgcctaacgatgggtgccaagtacctcaaagtggtcaaacgagggtcgcatcccaacaaacagatggtccccggacgaaattagggtatgacagggccctacacccaggtccatgggaacataggaagtggagcctagaagttgtcgatttgcaagagctagggcagcaaatgggtcagctccaacttcaagctttctacaagacatatggaaagatctgggatttggctatgatagaagtgtccgttgaagccattgcatccctcgttcaatattacaaccagccactaaggtgcttcacatttggggactttcaattagtaccgaccattgaagaatttgaagagatcttgggatgcccactaggaggaagaaagcgatatctcttttctgggttacacccctccatggcaagaatggccaaagtggtcaaagtcttggcgcaagaattggaccgagtaaaacaaaataggaatggggtggtcagaataccaaggaagcacttggaggagaaagcgaaggctttggctgatcaaggtgaatgggctttattaattgatgtcttagtgctattggtgttcagagccatcctctttccaaatatggatgggctagtggatatagtggcgatcgacgccttccttgcttatcaccatagcaaggaaagtccggtagttgttgctttggctgatgcctatgacacatttgactggagatgcgagaagagtggcccaaggattgtttgttacacacccggtctttatgtgtggctggtctctcacctctttcgttatgaaagtagacctgtttgtcccctacaaggtcactgcctgtgtgccgagaaagggaaagcaaattgggagcaacttttggctggggttctcgagcgtccccttgatgggaatgaggtgttgtattgtcgcaacctatccttcggtgggagggtgacgcgagagtcacgg

SEQ ID NO: 8714 - DNA, 300 bp, Glycine max
  Peptide Sequence Number=SeqID_100399
atggaatgcctgggggccctccatgataagcacatgttgcattcgagtcgtatcctcagaaaaatggaggttgaggaaccttggctggggctttttcgctgcaaaattcatttcttggttggtgctttggtttgtgctaaaggtggtgtttgggcattaggcgtgtggaatggtagtcacagcaagggtttctccctcatcctcttcattttccccagttttcgcattttgccccttttcagacccacttcgatcctttcaccggtgaagaccaaatctgcaaagtttgaaggtgtgtaa

SEQ ID NO: 8715 - DNA, 216 bp, Glycine max
  Peptide Sequence Number=SeqID_100400
atgtcgcggaacttcacggattgcgtaacgatgggtgtcaagaaggaagtggtacttgagcctggtgatgatcctggacatttgagggcaaatgttttccatgaaggagggaatgatgagaatcctgaaactggccaaatacaggctaaaggcccaagtggagaaggacgaaggcccaagtggagaaggacaaagcccccgagtggagaaggatga

SEQ ID NO: 8716 - DNA, 435 bp, Glycine max
  Peptide Sequence Number=SeqID_100401
atgaccatcgacatgagagaaatttattggcaaacaatcaagcaatgcgaggtcgatgggttcaaaaatcatatttggaaggttcaaaaagatcaatatacaaaatggaaaaaactcaataggacagtacttgaaaggaggcgagcacaaggtgtgtcaccactcactagaaaggttgctggaaaagtctctggctgccggagatttttgccgaaaaagcgggcagcaggcgacagatcaaagtggcaaactggacaaggaaggaattgcgccagaaaagtcatgacacagcagcaagaagtggtaacattcactctggaaagaagaaacacaacagaagaggtgactaattggagttccaaatttttgggaaccttatgcagaacagtgaccagacaagtcacggaggatagtaccgctctgatatcatgttga

SEQ ID NO: 8717 - DNA, 126 bp, Glycine max
  Peptide Sequence Number=SeqID_100402
atggcccttccctcagcgaacatgcacagctcatccttcttccagattcttcctcgcgctcagccaaggagtgttgtgctcagcggatggctcgctaagcctacaggcctgaaattcataaattaa

SEQ ID NO: 8718 - DNA, 186 bp, Glycine max
  Peptide Sequence Number=SeqID_100403
atggaagaaaacataccgcgcgctaagccgagctttcctgagccaagcgcatttcgtcgcggcatccgttgggctaagcgagccccgctcgctaagctcccatacttagtgtattttgtgaactgcatggtgccgcttagtgcaacctatgaggagctgagcgcatatccttgcggcagacgttag

SEQ ID NO: 8719 - DNA, 204 bp, Glycine max
  Peptide Sequence Number=SeqID_100404
atgtcaattgagatatttgaagatgagtacctgaaaggtatcaatgttagcaagaataatctgcacggtcacatcattctagctaagtatgataaaccactcaagcatgattccattggcatgctaagcctatccctcttaagattattgaggccacaaggtccaacaagtggtatcagagcaggattcttgtataaagtttaa

SEQ ID NO: 8720 - DNA, 414 bp, Glycine max
  Peptide Sequence Number=SeqID_100405
atggatgctgagatgagtagagaaacaaatgaagtggaattcatggggttatgtgatactgctaccataaacttagaagaaccaagctctaatacaaaagaaaaaagacaaggttcaacttcttcgggcacacattctcacaagagaaagatgagagaaaaagtaggaataacaacttctttggataaaatggtcgactcttttaaccgaatggtagaaaaaatggatggtaaagttgatgatgaagatattcaagaagtgttacttgaggcagctttgataccaaatcttaatagacaacaatgggctaaaactattaaatggttagttgacgatccaaaacagttagctattgtgaaagcccttccaattcacgaaaagacagattatgttttaacacatcttgcagaatga

SEQ ID NO: 8721 - DNA, 189 bp, Glycine max
  Peptide Sequence Number=SeqID_100406
atgagtgaggtggcagaaagggtcactgttggtgacattgggttctttggaggaagaggggcagtgcatcagaggttggatgctggcaagtctctgacgttagagggtggtggttccgatccctgggtcgtgttggagaaaaaggcatccattgcgagaaggaaagaaagagggaagattgaaccttag

SEQ ID NO: 8722 - DNA, 420 bp, Glycine max
  Peptide Sequence Number=SeqID_100407
atggcacgttcagcatgggagagcaatggcactagtcaaactggtgacttacctttagcagggagagcagctttggcaagagagcaagagcagctttggcaggagagcaggagtagcttttcagtgctcagcaacagcatggaagcgcaaatggggttggcgacattgtacacgatgaattcggttataacagtgttgtatttcaatgaaaaggtatatgaagataatgatggtgtaatatttgaaggcagtaaaaaagccattcagattaaacgtggaattagtttcaatgcgttgaagaaaaaaattggagataaggaaaatatattgccttgcaaatttgtgatgacgaagatgttaaaacgatgctggaaagttttaaacaacaagaccaaatgtcagttctggaattgtacatag

SEQ ID NO: 8723 - DNA, 213 bp, Glycine max
  Peptide Sequence Number=SeqID_100408
atggaaactgctgatgtggagactcttgatgaagagatggttgattggtttattaataccccagaggctaactctgatgataagattgtcgaggcttctaacgctaatgctaaccttgagggatctaaaagggtcgatatactagtttttcatctaaaaggtgcgggtatcattcctcatggtgcgggtatcgtttctcatacctttctttaa

SEQ ID NO: 8724 - DNA, 276 bp, Glycine max
  Peptide Sequence Number=SeqID_100409
atgcattattggatgagaccttctaaagattgttgggatggtcgttttgttgttaatgaagggaagctcatggaaaagtcaaaggataagcctatgtcggtagcctctctttatgccgctagtggggtgataagaaatttttttagaataagtctggaacgtctggtcatcattattgatgatgatgtggagttaaccaactctagtttggtgcctgctaggaagtttgacggtccttttatgtggaggttctcttcaagcgaggagattgattag

SEQ ID NO: 8725 - DNA, 279 bp, Glycine max
  Peptide Sequence Number=SeqID_100410
atggctttagttggagtatgtcactccaaaggttatcgagtcaatcatccaatccatcaagaaagatataaactctttcctcctatagtagagaattgtatttataaaaaaatacgtgttccacatgatttgcagatcatggttagaacacgaggttttggtcgtgctataggtagagttataggtagagatagacaggatgagcatgatgcaattgatgttcccgagaggcgtaggcctactgcatcaactcgtagcacaggttcatcagatgactga

SEQ ID NO: 8726 - DNA, 297 bp, Glycine max
  Peptide Sequence Number=SeqID_100411
atgtcgacccaggcaggtgaccagctcagacatgcacctgccgcagaccatgaggagtacatgcagccggccatcccacaggttccagtggcatttgacctccctccatatgcagtggatgattacgatggctatgaggcgatcgcagaaaggttggagcgtgtgctcaaccttaggatggtcactgcaggcacagagttacaagatattatgcaggattgcctcacgatcgccagagggggtgccagtgcagatggaagtgtcagggctcgacagagacggtgcacagagcattga

SEQ ID NO: 8727 - DNA, 862 bp, Glycine max
  Peptide Sequence Number=SeqID_100412
atggggtatttggatcggggacatgctacgtgcacccagcaatattgttggggcacccagcaaacagtgaatggacaaaattgcccttctgcgatcccttatttcggaaaaacctacttccagaaaaaattccggaagatgtctttccggaaaactttcggaagaaggttctttcggaagaagaaggttcttccggaagaccaccttcttcttccggaagaaggttcttccggaaagaagatgaacagtaaaatggtaaaaacttttttcagaagaacttcgaactaccggaggaagttgttccgaaagaacagttgtgaaattccggaacaacttattccggaagttgtttccggaagaagttattccggaagcagaactatgaatttccggaagtacttcttccgaaagttgatctggcaacttccggaagaagtggttccggaagagatttctggaacaacttcttccggaatttcagtgttgttcttccggaagaagttcttccggaagttaatatgtgaaactccggaagaagtggttccggaaccacttcttccggaattcaatttttggatgtggttatatgataatttgaatgtacttgtgtatgatgcatatgtccttaagatggacgaagatcaatggacgtatgactatacgatgtcacaagaagttcatatggattatgattatgataatgaagaagaatgtggcgtgaatgaaccacatgttgattgttcaaatgcttttaatacatctcaggtatttggtactcgagatgatgttttgcagtgggctcgaacagttgcccatgaaaatggatttgttgcagtgattatgaggtctgacatagataccg

SEQ ID NO: 8728 - DNA, 468 bp, Glycine max
  Peptide Sequence Number=SeqID_100413
atggacaacatctactacgctgccctcatgaacaagttgctatgggatcaaggggtctaccatgttttcaacaaagtggatgatgactcaaagggcaacttaatgatcaaagatacagtggtggccaaacaacaaaggttcaacaaaacaaatctgaaagctatgaaggtagtaataaaggaacataaagctactcgtctcaacataaccctcactcaaaaggaagtaggtccacctgatggcttcaacacttctgagagtgatatcaatccttcacttttccaaccatcacagaagcccaccactcaagaaaacaagaattgtccacgaccatctcttatcaacatatccaagttcaaacctttaagctccacaaggaaagcaatgtggagaccttggaagaagccttctccagaagaagttattagaagaagatttcctattgcattccttaactggaacgagtaa

SEQ ID NO: 8729 - DNA, 582 bp, Glycine max
  Peptide Sequence Number=SeqID_100414
atgcctaagggcaagtttgaggcttgcatcgctcaccttaagaaggatagaacccaacaagtcattgttgatcttgaactatctggcataaaggaaacaaaaaaggaggtggttgtgtccattcattacattgttgcaaaagaacacctccatgagtccactcaagctgagcagtccgatgaagttacttctatccaacaagaggtaattatttactccactagttccaacaattgcaaatacagtcctccaatcaactatgctgcacccactgaggcaatcactaaggaatgcatcaaagagatgctaaatcaagccatgcacaagcaaaaagaagaaactcaagagaggcttgaactctatgttgaacaacaaattccaccaaacctgtctcagaaaaatgacgatcttagactcgttcaccgttggatcgtcgtgaaatttgagtaccactgggagaaaaaggaatcgcatgaagacagtacaagtggaggtttcaatctcttctccttctctctgacgtttgggaattctatcggagcagtcggaggaataactgaaggaatctcagggaaccgctag

SEQ ID NO: 8730 - DNA, 129 bp, Glycine max
  Peptide Sequence Number=SeqID_100415
atgacaaattttgtgagttatcctggagcagaaaattcaactgcattggctactcctcaaggatttcacttaaaacctagtatccaatcacaaagaataaggaaaaaatccttgaataaatacagctaa

SEQ ID NO: 8731 - DNA, 1128 bp, Glycine max
  Peptide Sequence Number=SeqID_100416
atggaattattgaagcgaattgtgctcgacccaaaagaaggtgcaatttggtcaaataattacatgtctgcgatgattatggttagaaccaaaggattgggtcaggctttaggcagaattttaggaagagccttagggagagaagttagtgttgatgcggataaagcccctcaatggcaaatgctcacaacatctgcacgtagacaaagggaagttgcacctgttgctgaggatgttgagcaagtggatcatgcagctaacgatgtccatgaacaacttgaaaaggcagttgacgatgatgtagtcgctgatgccaagggttttccaagcaggccccatgattcatcagttttgatggactatgaacgtcttgagttgaagttgtcctcccgtggaaggaaggtagagaaacttggcaggcctactccaaagattgaaggcttagtggctaacataggattgagtcctctgattgcatgttccttggacattgacgacaggggacttatatctacttttgcgaagaggtggcataaggaaactactagtttccatctttcgtgttggatctacgaccattttcctactgttgcttcttctattattgttaaagattatcatgagaggaaaccatgtgcttgtcgttggaagtctaggaaagcattactagtgtcgacatatcctaagcggttggatagattgatgtctaatgttgaatttgagctaatctctttatttttcaaacatatcatatggggtccatctattgtcatacaccgaccagagagggttgtgcgacagtttgggtatgtgcagaccatatctctatgtataaaggatattgatgatagatggattccattttctaaataccatgcagcggtgggtcagatatgtgttgtgcctggacaatgtgcagcagactacatggagtggttttacatgatatctcattccttcatgagtccaatgcaggctagggatcctcctagacatccacccatggtgcataatgagacatttattgaactagatcctcctcagcagtcggtggccacaacaattatggtagaaccacctgtagttgcacttggtaatgtagacatgcctcgacatgcttgggtataa

SEQ ID NO: 8732 - DNA, 174 bp, Glycine max
  Peptide Sequence Number=SeqID_100417
atgcgcggagttgccaccaacgtttattcgaggaaaacgtcggaaaaaccagaaaggtgtggtctacgaactttaagtgtgaaaggttcgagagttgtatttacacatggggaagggtgtttccctagctcctacgtattcctcaattgtgataaggaaatcagacctacgtag

SEQ ID NO: 8733 - DNA, 225 bp, Glycine max
  Peptide Sequence Number=SeqID_100418
atgcactgctatttggagatgcgtagtccgactaacgttcaggaagtccaaagctcagcccttgcaccagaggaagggaaactccaactccttatatacttcactagccgcatacttcacgacgccgagaagcgctaccaaataatagagaaggtggcgctaacactcattacctcgacccgaggactcaagccctactttcagagttatgaagtggtagtttaa

SEQ ID NO: 8734 - DNA, 1134 bp, Glycine max
  Peptide Sequence Number=SeqID_100419
atggttagaacaagaggtggacctcgtgccttaggtagtggtacaggtagagacatgggtcgggatgaggatgatattgatgttccccggcgtcgtaggcctatcgcttctgcctgtaggcaacaggtgactgaggatattcctgatgtgacagaggatgttcctcatgtggacgaggacattctgactgcggatgtagatgatgcggacgtagctgctgatggtgccgagggatcagctgctgagcatggcaagggattccctgggggaggtgagcatttgcttgctacaccccattgtcacatcatatccggtgaggaggctcgagctgagaccgtacgtgctcatggggcatacgtgcgactgtcatggctccgtgaggtgtatgagagtagatgccaggcccgacgttggattgtagcgacgcgtgcttacctcctccacctggtgggttgtactctttttgctaataagagtgcaacccatgttcatgtggtgcatccggaggcgtttcgagacctaggtcagactgggggctatgcctggggagttgccgcgctagttcacatttctggatatatgagcactttcgcagtgttcatcagtgcatcactgataatgcgtatgctgagactaccctttgtgcctcgaggtacttacgatgaaggcgcacatgaaggggatccagggagcgccttcggatacatcgagaccatccctccaccgtcggttactgcttctttgtcatatgacgagatagacgagaggtggatgcatttcagggaccatttggcacccgcgggtgagatttgtgttgtccccgggcaggtatcagcggactacatggagtggtttttcaagatatctcacctatttgtcacaccgacccacgaaggcgatgagcccaaacagccagctaccccagatgtggatgcatacgtcgagccacatgtcccctggaggttccaattgcagctgatctccccatacattcagtggtttcttgtgaaggttgcgaagcgatcgcataaaggaatagagttacatgatatcatggaagattgcctacggctcgctaagggagaggcctctgatggaagtcttagggcacaacgtagacaacgcataaattaa

SEQ ID NO: 8735 - DNA, 177 bp, Glycine max
  Peptide Sequence Number=SeqID_100420
atggctaacgtgaatgaacttataaaatacataaatgagtgggtgaatccatgtaaggtcttgcaaatcttacaaagcaaaatgaagaaggagaaagatgattggagacactacttcaaggagaagatgagtctagaagaagctcaccaccataggaagccatggataagagcttga

SEQ ID NO: 8736 - DNA, 177 bp, Glycine max
  Peptide Sequence Number=SeqID_100421
atgagatgttccagggacaaagatggcaagcggatagggcttgagcacaacgaggatgtgttgccattaagtcccaagattgatagtggcaaaggcactgacctcaataaagatgttgtggttgccataagagagcaagacacgaagatcttggttttggtggtggctacaatttag

SEQ ID NO: 8737 - DNA, 444 bp, Glycine max
  Peptide Sequence Number=SeqID_100422
atggcacgtgaatgctttttctgcatgaatagtgttgttgcaagcaatgatgggggtgtgtcttcagaagaaggttttagtgctggagatggtgatccccaagatggccaattacggagtgaagatcgagagctgaaggataggcttttacgtaggtttggaagtcacgttggatctttgaaattggaattttcaaagaagaaaaagaggggtaagctgccgaaagacgctaggcaaacactacttcagtggtggaatattcactacaaatggccttaccctacggaaggtgataagattgcactggctaaatcaactggattagaccagaagcaaattaacaactggtttattaatcagagaaagcgctactggaaaccatctgagaacatgccgttctctatggtggatggtctgaccggtcggttccttactgatgaatga

SEQ ID NO: 8738 - DNA, 1166 bp, Glycine max
  Peptide Sequence Number=SeqID_100423
agggttgcatgccctcaccttcagagggctacacgtccttgcctttagagggctccacgtcctcgccttaagagggttgcacgccctcgcctttagaggactacatgtcctcaccttcagagggctacacgccctcgccttcagatggctacatgcccttgccttcagaggactacacatcctcacctttagagggttgcatgccctcgccttcagagagctacacgccctcgccttcagagggctacacgccctcgccttcagaggactacatgtcctccccttcaaaggactacacgtccttgccttcagagagctacatgtcctccctttcaaaggactacacgtcttcgccttcagagggctacacgccgtcgcgttcagagggctacacgcccttaccttcaaaggaggactacacatcctcgccttcagagggctactcgccctcgcctttagaggactacacgtcctcaccttcaaagggctgcacgccctagcctacgtagggctgcacgccctctccttcataggactctacatttgcgccttcaaagaattcaaggctagtagtttgcttttatcagttcctaggccaccccctgatattggagggcggccaactgtgcgagcacaaccagaaagggaggctattgtgcagctactatgcataccggggcaagatttcacccagcgatcacaatgtcaatctccccctgcggaagtatcagttggtctatgccatcatgacatagggatcgcgcccaagacacacccagtggacccggagaagtccaacaggccctggggtttccagctctggttatgggcctctgttagtcctaccgggatcgcgcccacaagacacccagcggactcggagaagtccaacagggtcatggggtttccagctctgagtacgagcctttgtcaattctatggagtgcccgtcgcccccatcaaggtcatcaagccccctattaaccgagtttacatcaagaagtactgcggcccccaggcaggcacagggcgagacaccacagcagcctggggatggccggcatcaggcaatagacgcactgccgccacctccagagcccctcagctcatctacaaaggttggagcgttgcctacaacccgtgggcaaccaagtccaatgccaaag

SEQ ID NO: 8739 - DNA, 144 bp, Glycine max
  Peptide Sequence Number=SeqID_100424
atggggatacaaaagaattctcaggagggagaagggagacacaaaagaattcaggcggttagtcctttgttcttttggaaaaaggagaagagagacacaaaaagaattcaggcggttagtccttggcgaatggggatcctctag

SEQ ID NO: 8740 - DNA, 246 bp, Glycine max
  Peptide Sequence Number=SeqID_100425
atgacatattggcctccgcttatcaatcacactcgaggtgcggataaccgtaaggtgtctccgcaggctaccagctcttgggtcatggtaacagaaagcagtgtggtcgacaaaagcgaggcttttgctcctacgtatcctccaatgaggaagtcagacctacgtagttctggacaacttgtgagacttgaaaaagtctcggtgttttctccactaaaatgcaaacatgctttagcaaagagataa

SEQ ID NO: 8741 - DNA, 219 bp, Glycine max
  Peptide Sequence Number=SeqID_100426
atgctgctgaagaactcgcttagcgagccagattggttaagcacgccttattcgcttagcgaggcagctagtagcccctttaccatctcttatgattccgatgactttgatgatgagttcctaaggaagctagatgaagaaactaccaaacaaagagggaaaaatttaaaagctgaagcacttggcaaagcctttggcagggaaaatgtcaaagtctaa

SEQ ID NO: 8742 - DNA, 717 bp, Glycine max
  Peptide Sequence Number=SeqID_100427
atggaatgtgtattggctgatgtacttagagatcaaaggaatttgggcaacaagggtgacagaggttgggaaaggtcagcattgaatgctgcagccgcagtgttatctacaagcttcaatgttaatgtcacatcagataatgtcaaaaatcgtatcaaattatggagatcatggtatggtatttcgcataaatcggctaaaccgtttcaattcaaggtgcttcaaaattggtatgatatagtggatatatgtgctaaagatagagccaccggtcatggagctgagatagctatggatgctgatgaagtgatgagtagagaaacaaatgaagtggaattcatggggttaggtgctactgccatagatttagaagaaccaagctctaatacaaaaggaaaaagacaaggttcgacttcttctggcacacatcctcacaagagaaagatgggagaagaagaaggaataacagcttctttggataaaatagcgaaatctttcaaccgaatggtggaaaaaatggatggtaaagttgatgatgaagatattcaagaagtattgcgtgaggcagctttcataccagatcttaatagacaacaatgggctatagctattaaatggttagctgacgatccaaagcagttagctattgtgagagcccatccaattcaccaaaagacagattatgttttaacagatctttgtttggaacttgattaa

SEQ ID NO: 8743 - DNA, 1509 bp, Glycine max
  Peptide Sequence Number=SeqID_100428
atggactgtgaccctggacgcaagtttagtgaaacacagcattttgagtgcacatgtgctaagacaactgaaaaacctctctgcaaacccctgactaaggatgatgtatataatgttggcatgataatgctgcaatgtgggttgacagatcaatggccaagctatcctccaggtttccacatccgatgcacaacttctatcaaattcatgcctaatagaatagctccaagattaccactgttggacctatggaagaagaaaggaaaagttcttccccatagcaaggttacgccgaatcaaggttcaaaagacaaggttgccttgtgtccaattccttatgaatggagtaggcactttaccaaggatacggctacaaaatctgttgtgttaaagctaggcattgagtttaatcagaatgacaccatgctcttttactataaagacatgtatgagaactctcacctttcttccacctctgactacgataaggaagaaaactccaaccacatgcatatggtgcaaatcttgcatccaaccaagacgtattatgaagatgcaatgagaagagtcatgatcactatctgggcaaggtttcctacccttcaagaacatccatactcttcttataagaatccttgggttccagtcgatgttattgaacctccactaattgaagttactttacaacctccaccagttgtggatgataccttagccaccattagcacttccagtactcctcgtgagataactcctttgatcacatttgctccaagtggtgtggatgaagaaaggattcaagaactgttgtgccttcaacaggccaacttggaagaaactatggaacgaagattcattgctaaatgcatggagaccaacttgctgatcgagaaaactttggagtcttcactcaaatccttcaacgattttgttctctacaacatgaatctgctgatgcaacaaaggttgccttcatctgtccaacaacagtatgcacccacacctcaaccacctctaccaccaccaaccactattgtgcaacctcatcctgaggttcctgcacccatggttccttcatcagaggctacaatatttgaagatcatatgtctgcaccattgccttcaccatcaaagtcatcacctcctatccctcaaccaccatccactgaaggggagattaatggtagtgccagaagtggcctagagagtacttgttctagccaggagaggcatagagaatacttggttgtaatcaaatgctctgggaggagtagcgatttggcggttgaagatgcgaaggaaggcaccacactaagtaaggttgcgagaatggaaagcgttttagaggacccaactcaacatactgctattgacaacttaatggttcaacagcttgatggaactgttaacgaatggggttggtgcaagcaaaaggggattgcaacagccatagatgtttcaacacatagattgctaaccaagatagcattgctggaatttctcgcatga

SEQ ID NO: 8744 - DNA, 411 bp, Glycine max
  Peptide Sequence Number=SeqID_100429
atggccaagatcatgttgaaggtcgtggttgcaccagaggctattttaaacaccgttaacgccaaggaccagatttacggtgaagttagtaggtcatttgctgtgaggtggaaagacgtacttgaccttttatggaatttcattgacaaggatggaaattttcataccgttgtctacaaccaagatttggacaaaccaaccattgtagctgggtggacaacactaagagatttctatcacctgaccggagatcatcaagtgtcattaacttattatggtgcatctcactccgcacaaaattacctacaacagcctgacaaaggctggactcatttgaatttggaggacattgcagaatgtcggattgtgttcaatcactggagaaagataactaaaattggatctggatga

SEQ ID NO: 8745 - DNA, 640 bp, Glycine max
  Peptide Sequence Number=SeqID_100430
atggcacattgtggaagcggaggaagaaccagagttcctgctgcttcgacgatggaggtcacaatggaggttgtggcagactgcggaggtcacggcagggtgaaggcaagagtgagatgcgcggagatcacagcaggcggggcaaggctcacgggtgcgtcttccgaaggaggaaaatgcgcggagtcgccaccaatgtttatttgtggaaaacgtcagaaaaatcgaaggaaaccagtcatgaagaatattccagattcgggagttgtatttacatttgaggaaggtattagcacctctcacggcgaatcaagcgattcttcttacttggaaggtggtccttttaaggcgttggaccttaaaatgatccatttctacttggtgagaaaaactgagaacaacgaagaacgaacgacgaacaacgaagaacggttgaaaatcttcgcgaaatcaccaacggaaacgaaaatagaggaagagtttgccacccagctcgcccaggcgagccaggttgcttcctccagaagcaaccaccttctggaggaacatcctggaaggcccaaacttgtcactgttgtctcctcctcaccatcgtcgtcgctggggttcgtgaccgctgctggggttcatgatcgctggg

SEQ ID NO: 8746 - DNA, 400 bp, Glycine max
  Peptide Sequence Number=SeqID_100431
atggatgtcacgtgtcaatttttggaggaaagtgtaaaagtgttaattgctactttgaagaagcatcttgttgtgtcatgcaaaaatttgattaagtgtgatgacaatgatggtgttgttgctctggtgatcaatggtgcaaggttaagagaattgagtagaagaaaggcaaaagtcattacccataatgtaggtgttattgtaaaacaacattcagtaattgatctttccctttcgcatgttgaggaggaaaagaataagaagaggaaacatgacgaatctattgatcacgaggtcaattcaaggtctgagccatatcttgtgctaactcaattgtctttccctattctagatggtaatgtaagttggtgtaaggcttttgcatttgaggtgtccgaag

SEQ ID NO: 8747 - DNA, 708 bp, Glycine max
  Peptide Sequence Number=SeqID_100432
gtgccatatgctaatggggatgtcgtgttgcagagggataatgtggaggagatggacaagttggcttacatttgtcctatcctaggaaatgtggacattttggtcaactatatggagcttccttatgaacctgttagtgtgaacgaacctaagaaagaacctaaattaatttgcttgttaatgaacatcgtgatcttaggtccaaatctgtcaatgtacctattgagtgagtcatctgaagctgaacatgatgacattgaagatgatgttgatttggttaatggtaatgagagtgataaattaagtggctttgaaaagaatgttaatgtaataggtgaagtgaatttggatgatgatataaatgaaatatatgttgagagaggtattttgggaaaaccttttgagaggcaaccagatagcaagatcaagtttataaaagggcaattattctcaaatgtatctcattttagggaaatccagagtgatttttctattcaagaaggatttgagttgtatggggggccatttggaggggtattactatctgttgttgagcttgatggaaataaaggcatgtttcatatttcattcacaatggttgagattgaaaatacaaatttgtggaagttttttctcactttgttaagggaatcattgcaatcagttcctgaatggaaggatgactttgttactatcatgtcagattag

SEQ ID NO: 8748 - DNA, 1281 bp, Glycine max
  Peptide Sequence Number=SeqID_100433
atggctcacattccggataagataaaggacatcaatggatctaaagaaacccttaaacttgctatgaggataactaatctttggtttgttgggacgcctgacaagtctgaacaagatgagatggttatagtggactccgatggtgatgaaatccatgttgtttgtaagatggatttgaaggaaaattgtacttatgtcatgcacagttttaaagtcatcaagaatgacggtcagtatagagtttgtgaccaccaatataaattagcatttattggagttactgttgttagccaatctgatttggatggtcttccttttaaaaaattcaaattttctgaattcgccaatgtcattactggccgcttcaaacctgacctgttggttggatcctatccaccctcagtgagtaattctttgaaggcttcaaagttacttattaatcaactggtggttgaaattcaagaattcaagcagaggctttctgaattaggcattaaggttcggtcagttttgacacctcgtggtcaaggcagttcacagctttcaggttctacccaattatcatcaaaggatgcatctttttcaaaggctgaggcaaagagcatttctaagattaacaacatttctgaagaaattgtttgtgttaccattggcacgattaccagaattgttatggaaaatcattcatggtgttatccagcttgcattcaatgccacacaaaaattgatatagacaccgctccgttcacatgcgcatgtggcaaatataatgagcgagttgtgctgaggtatagacttgaggtgatggtcaaccacaaggaggaaagcacaaaatttctactctgggatcgtgaatgtactgacttgattgggcaatcagctgatgaagttaataggctaaaaatagcagatggtgatatcgatttaaatgcttcgctagaagcgcttaataacttgttgggttatgtgcttgcctttaaagtcaaggttcaaccaaagttcaggaatgttgttgttctgaaatactcaagtgacttaagtttgattaacactgtgatggacttactgcctgatgctgaggcatcttccaagatccatattccaatccttgattccaatgatcctccccaacatgaatctcaatccctgtctagaacagcagatcatgatccgcttctcggactccccttaacaccaacaaagcagcagacatccccggaatgtgatgatgaagcaagaagctctcagatttcactcgcgcaactttcatctaacaaataa

SEQ ID NO: 8749 - DNA, 228 bp, Glycine max
  Peptide Sequence Number=SeqID_100434
atggatggtccactatcttcatgtctttctctccatctccactctttgtgcattcttcttcagtgtcatggcctccttgcccaccaccaccatcatggtgtagaagcaagtgtcgtcatcattgtcatggatgaggaatcaaaggtagatgatgccaatgttgctgactatgatgcgacaaaggtggtggaaatcatgaaaggcaaatatcataagaagatggattga

SEQ ID NO: 8750 - DNA, 342 bp, Glycine max
  Peptide Sequence Number=SeqID_100435
atggtcacgttggatgactcagacagtgagaagagtagcagatcagatgatgagcaagccaacatatgtctgatgacaaatatagatggaaaagttgtctctagaatatgtccattggatttaatgatgaaatctgtgcaatttcagttgagcttagctcatcagtgggctaagcatgcatccactgctaagtgcagcttcagcgcgacagaagaatctggcagagcatcaatatcaaggtcgcgcgctaagcacaagatcagtgcgctaagcgcaacatttgtctttagccaggctcagcacacgactggcgctaagctcaaatccagttactcgcgctaa

SEQ ID NO: 8751 - DNA, 1287 bp, Glycine max
  Peptide Sequence Number=SeqID_100436
atggcagaaccatcgaaaaagcggaaagaaacctcgagtcagagtcagcggcattttgggtcacaagaagccccaattcctccctccattccctctggatcattattttcatcagaggaacagcgtacacggtacacaaacctcttttcctctcgttccattgtagacccaaaattcatagatatggagttcttctctaatgagaattttgaatgcttccaagcatttgaaaactccaatcttattccatttatgtctctgaaattacctgtctattatgaattagtcaaagctttttattctaatttagaaatccatgaaggtactctaaactctgaagtttatgggatcaagatggtcattgaccaatccctattttatgatttaaccaaattgcctagtgaaggtgtgccttttgagggtgcactgattgatgaatggaaattcgatttctctatgcatgatgcccgccggttggtttgcaccaaccaagcggatatgaccggaagacttcttgtcggttcattggcttttgaaagtcgcatcctccattaccttatagtttgcattttgcttcctagatcttcaaaccttgcccaagtttctgaagaagatctcattgtcatttgggcctttcataaaggtttacaaatttattgggcacatcttgttagatatcgcatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggctcatgggtaaagaagggtgctagaaatattggtgaagaaggacatgagggagaagattcatctcttctttcgaagattttggaaaggtttgatggtcttcaaacctttgttggtgagaggtttgatactttagaattgcaagtggatatgcgcttcaatgaaatggagtcaaggatgacaaaggttgaagaagatgtatcttacatccgaagtgtcatcatcaaaaagggggagattgtggaagcaaagcttcatgatgaatcaaaaatgattcaaagaacaactcaagtgaatcaaagaacatctcaagtgaatcaagaacaagtcaagagttcaagactcgagaagaaagtctacaatcaagaatcaagattcaagattcaagatctcaagaatcaagatcaagattcaagactcaagattcaagaatga

SEQ ID NO: 8752 - DNA, 636 bp, Glycine max
  Peptide Sequence Number=SeqID_100437
atggcttcctatggtgaagcaaaggactccattgatgaagaagatctaaggcctacaagctccacatggagctacatcactggtgctcgtggatttagtcctctaattaaagatattagcaagaagtatgatttgtccttgatgtttcttcttgagactcatgcaagcaaggaggttgcggctagaagtatccctagattgggatttgatagtcactttgtacaagatgcctacggccattcagatattgtgacgctggttgaaggcctatgggctatcataggtgactttaatattgttttggaggcccttgatcgtactgggatatttggaaaaagcatcaagaagtttctaggcaaaaggaactcctttggttccaaaggtctagatctaaatggctttcgtatggtgacagtaacacgagactttgatgctcttgagaggttagtaattgtgtactattgtaacctttttactgatgatggccctagatctccttcatgtgtcaaaggagcttttccccctctatcagaaagccaactagaagtgttcaagagaaatgtgaatgtggaggatatctataaagctattttcttgatggggaactataaagccccaagtagggatgggttatag

SEQ ID NO: 8753 - DNA, 216 bp, Glycine max
  Peptide Sequence Number=SeqID_100438
atgacgatctcggactcattcaccgtggatcgtcgtgaaatttcagcaccaggtttggaactcatttctgaacattctcaccgttgggaatttcgaaatcatgtcgaagctgagagaaatacacttcgcatcgtagtcttttcttttccagaagaaacccaaagctgtctcggtaaaattatgatctcggatatgttaaccgttggattgccgtaa

SEQ ID NO: 8754 - DNA, 360 bp, Glycine max
  Peptide Sequence Number=SeqID_100439
atggttccagcaagtgtggtgtgcgttgtgccaggtcaggcatcagatcctctaccagatggtcatgctccgcagccccgagtcgtccctcaggccctaaagacagatatccctcacgtgtcggagccaggagcaccatcgacatctgcgaggcccgctgtggaggagcctagacatggagtggaagtttgctatgggattgttgagaggttggagcgccatctgagcctaggggtggtcacgccaggctcatcgacacatgaggtgatcgaagaatgcctcaggatggccaggagtgtcacacaggaccagctagtatatgttaggtctcgacgcaggcgacgcacggatcaggcgtag

SEQ ID NO: 8755 - DNA, 841 bp, Glycine max
  Peptide Sequence Number=SeqID_100440
atgggatcaagtcaaaagccttcacttaaaaagaggttctatcaagtcaaggtcaagagcctagggatcaccagtctaaaagggctagggcagttgataggtcagctccaacgacaagctttttgcaaagcttacggtaaaatctgggacctagccatggtagaagtctccacagagctatcacccatggtggaagaatttgaagagatcctaggatgtcctctagggggaaggaaaccatacctcttctcagggttctatccctcattagctagaatttctaaaatagtccaaatctcggcacaggaattagacagcggaaagcaagtcgaaaatggggtggttggaataccgagaaaatctttggaggcaaaagcaagaatcttggcaggtagaggcgaatgggccccgttcatagacattctcgcactgttgatcttcgaaggagtcctctttccaaatgtggatgggttggtggacctagcagctatcgatgcttttctcgcctatcatgaccgcaaggaaagctcggttgtcgctatactagccgatctatatgacaccttcgaccgaagatgtgagaaaagcagtacgaggattgtttgctgtactctggctctctatgtatggttggttttgcacctttttcgccaagtgaggcatgcttgctcgctagaaagccaccgttcatgcacagagaaaggaggggcaaattgggaccgactcttagcaaacaaagaaggagcgtctgtcaactggttccctcgatggaaagaaggaagaaccggagttcttattttgtgcggaggattcccaaatgttcccttgatggggacaaggg

SEQ ID NO: 8756 - DNA, 388 bp, Glycine max
  Peptide Sequence Number=SeqID_100441
atggtggtgaacttcttcttgactcatcttctccttgaagtggcgtctccaatcatatttctccttctccattccgctgccattgatattcaagaagcaaaggactccactgatgaagaagatccaaggcctacaagctccaatggagctacatcaagtgaaagcgacgatggaggagtgaatataggagcgcgtgagagtgatcaaggattcagagaggaaagggagaatgagaaattttgggaatgggaaattatggtggagcgtggaggaggacacaaatgcttggcggagccggcaaagttggggtcaatggagtctagggttttgaagagggtgcaaaaggaatttgaaactgaaaaaggattggaagggtttgaaattggag

SEQ ID NO: 8757 - DNA, 267 bp, Glycine max
  Peptide Sequence Number=SeqID_100442
atgaaattggtaattgctataacaaaagatcttcctgatgttgaaggagatcgtaagtatcagatatcaacctttgccacaaaattaggagtttggaacattgctttccttggttctggaattttgctggtgaagtatattgtttctgttttggcagcaatttatatgcctcaggtgaatataaactttcaggcgttggttactcgtaccggctcatacaatttttgcaataagcttgatttaccagagaaatggggcagctattga

SEQ ID NO: 8758 - DNA, 411 bp, Glycine max
  Peptide Sequence Number=SeqID_100443
atggattttttgctgccaatcgaaaacttccgatggaaatatccgtcgaaaataatccatgggaaatttccaacagacgatattcgtcgaaaatttccaacggatgatatctgtcaaaaatttcccacggatagcaaaaaatacgtcatcaggagaatgcctctattagtcattatgttcgtgttgtcatctgctgctggtcctactggtggtggtgcttgtgagtcgattaatctttgcagcatcttcagcgcgactggaagatccttgcgtatgctgcatgaagccatcatttctgcatttgaaagtatgagcaaggtctccagtaccataaagatgtcccctatgctttggtccagcagctacaacctaacaccgactcctaagtctttgttcttcaacagtgtctaa

SEQ ID NO: 8759 - DNA, 291 bp, Glycine max
  Peptide Sequence Number=SeqID_100444
atggttgaacctctcgggggatcatcctatggcatccaagatcgtcctcatgggcctaaccttatccttaccctctcagaggcttccatttgtaggcacgaggctttttttcaatgtggtcatatagaaaacacgaggcaacaacatcgcatgcatatcaattgcatctcccaaggtcctgcgagtgttgtgtattgccttttgccacacgttgatggtacaagtctcgtattcaggagaaaggtacatggcacacctttgtctgtcgaaaaatacacctcctcgtcctga

SEQ ID NO: 8760 - DNA, 126 bp, Glycine max
  Peptide Sequence Number=SeqID_100445
atggcacacaccaggcaaagagctttgacaattacaaaggagcgtgtggctacattggctcaagatgacgagatagttctcgttgataccattgctgatgttgagattgatgatgatgagtcatag

SEQ ID NO: 8761 - DNA, 924 bp, Glycine max
  Peptide Sequence Number=SeqID_100446
atggtggtgttgagggtgttggattggaaattgagaagtgttgatgtgttgttattggtattgtcagaggaaaaggctatgtcggggaagaagggagaaattggggttgaagtaggagggtcggagctgggaggggacaaacatggaggagccggaactgtgtatagagatgttcagggaggtgaaggtgtcggtgccaatggtggcgatcatagcaggctccacctgctggaggagccactcaatggtgcgctttggcggaagctttttgctgttctgatggtggtggtggtggtgatggtggtggagatcctcgcctccctccacgattgcatggagaggaagaaaataaactttggtggtgttgtggagttaggagggaatagcttgattgatattgcttgtggcaaagctgcatacgaatcaagtgttgcagccaaggcacaacttgaggtagccaaagccagatatacaacagttgtttcagatttaatagttatgaaagaggagctggaaccattgcacaaagaatatgcttccttagtgactgatagagatgtagctattaagaaaggtgaagaggttgttactgcatcaaaggaagtaaagaagtctgttgaagatttaattgttgaactaattgctacaaaagagtcattggagactacacatgctgcgcatttggaagcagaggaacaaagaataggagcagtcatggcaagagatcaagattctcttaattgggaaaaggaacttaaacaggcagaagaagagctccagagactcaaccagcaaatttcatttgcaaaggaactcaaatctaaattggaaatagcctctactttgctgattgatttaaaagctgaattaactgcttatatggaatcaaagttaaagcaacaaggaggcccaaaagaaccatag

SEQ ID NO: 8762 - DNA, 234 bp, Glycine max
  Peptide Sequence Number=SeqID_100447
atgaccaaagtgaaggcaaaagccatttctaggcttgggaggattgatggggacccggtgttgagagaaacgaggataagggctacgtgggagtacgtgagctcagttgaaggtaggcaacaggggatgatgggtttatatgtgatttgtggatgtggagaattgttttgcaccatcgcccgaccgccacctagtaccacatgtgatgggtaccccataatcctacaagcttga

SEQ ID NO: 8763 - DNA, 1098 bp, Glycine max
  Peptide Sequence Number=SeqID_100448
gaagagctgcgcaagttgaacgccatcagaaatcggcttcagctaatcaacaagcctcctgttaagacaattcagagttcttatggtgatataatagactgtgttgcgtctcatatgcaacatgcttttgatcatcctcaactgaaaggacaaaaaccattggatcctccagagagaccaagagggcataaccaaatggatgatgatttgagtgatagctttcagttatggagtttatcaggtgagtcatgtcctgaaggaacgattccaattagaagaacaacggaagaagacatgttgagagcaaactctgttcgcagatttggaaggaaaaaagtaataaaccgtgtcagaagggacaccagcggcaatggacatgaggggatcagtactacggagcaaaggctagcattaacgtgtgggcaccccttgtggaaaacccatatgaattcagcttgtctcaaatgtgggtcatttctggttcatttggggatgatctcaacaccattgaagctggtgagtccggagctatacggggacagctaccctagattctttacttattggacgactgatgcatatcaagcaactgggtgttacaatttactctgctcaggctttgttcaaacaaacagtaaaattgcaattggagcagcaatctctccaacttcttcatatagtggtggacaatttgatattagcttactcatttggaagcaggatccaaagcatgggaattggtggcttgaatttggatcagggatcctagttgggtactggccatccttcttgttcacccacttaggggatcatgcaagcatgattcaatttggtggagaaatagtgaattcaggttcatcagggtctcacacttccacccaaatgggtagtggacattttgctgaagagggttttgcaaaagcttcatattttaggaacatgcaagttgtggattgggacaacaacttgattcccttgtcaaatttaaaggtcctagcagatcacccgaattgctatgacatacaaggaggggttaataacgcgtgggggaattatttttactacggtggacctggcagaaatgtaaagtgtccctaa

SEQ ID NO: 8764 - DNA, 183 bp, Glycine max
  Peptide Sequence Number=SeqID_100449
atgagcaagagactccaagagaattgggctaaagttgatgaagaaggccttagggttctcaagattggccaagctctagcttttcatctcaaggaggtgagctttgctattagagaggaagttttctcaaagaagcttctcaaggaatttttctcaagaaagcttctcaaggaagctacctag

SEQ ID NO: 8765 - DNA, 534 bp, Glycine max
  Peptide Sequence Number=SeqID_100450
atggctaagaggaacatgatcaagactgtcagggaccatgctatacatctcgacctgcttgcaaaggctcgaggaattactgctgctaaaaattattttgttaatctcccagaatctgctaagaatcatctatgtcatggtgctattctaaactgttactgcaaggaaccgatgattgaaaaggcagaaggttttatggaaaagatgaaggagcttagccttcctttaagttccatgccttacaatagtcttataatgctctatacaaaagtagggcaacctgaaaaggtttcatcactcatacaagaaatgaagactagcaatatcatgctggattcatacacatataatgtttggatgagagctcttgctgccgttaatgatatttctagtgttgaaagggttcatgatgagatgaagctagcatttcctaaaactgcaaacataagctacctgaacatgattcgggtgttggttaactcgaaagatgatggaagcttgcttgagaagcttttatggaggctggatctttga

SEQ ID NO: 8766 - DNA, 969 bp, Glycine max
  Peptide Sequence Number=SeqID_100451
atggcagaatcatcaaagaagcgcaatggatcttcctccaccaccacctctgctggccaccgccgccaaggaacttttggagacccacccgcaccaattcctccctccctttcatctcctcgatcatctacattgttttcttcagatgatcaacgccaaaggtactattctcaattttgcaatagaatcattctagaccctaagtaccttgatcttgatttttttgatggcgaaacatttgattgttaccaagtgtttcaaaattctgctttgactgagtttatgtctctgaaactgccttactttcctgaattatccttgttcttttccttgacaaaactgcccaatcaaggtgttccttttgagggcaccattgttgatgactggaaatttgattattctagtcatgatgctcgccgcatggtctgcaatgaccaggctgacatgacccatagattacttgctgggtcattaacttttgattgtcgcatcatgcattatatcattgttcgtattttgcttccacgatcctcaaaccttgctcaagtctctaaggaggatttgattctgatgtgggcttttcagaccgattgtcagatcgactgggcccatttagtttggtactggatgcataaggcattaccggccaatgcacctctccattatcctcaccttgtcactctttttcttcattatttcaatattcctttagatgatgaaccatttgtcaaggtcaaacgatctttctctattggtgctgtcctcacagaactccgtggtcttcgagcttttgtaggtgaacgatttgatgcattggatactcgccttgatgccatggatgaatgctttgatgggatggatacgaggatcactcgtctccaagatgatatgagcttcattaggcggggagagaacaagggtagaaatcataaacctttaggcataaattccaagcttaaggaggagtaa

SEQ ID NO: 8767 - DNA, 126 bp, Glycine max
  Peptide Sequence Number=SeqID_100452
atgtccccagtggagtcgctaactgtcgcaacctaccctttggcgggagggcgatgcgggactcacagggaaggtattagcaccccatgcatccgtcacaagggacgacaaccttcaatcaagtga

SEQ ID NO: 8768 - DNA, 639 bp, Glycine max
  Peptide Sequence Number=SeqID_100453
atggctaaaaggtcgttaaaagcggaagaaagggaaaccgaaagtgacgagatgaagatgaaagcaagaaaaacaagaaatgaattgaaagtctcggattcgagcacttaccggttgaagacaaaagaacagacgaagaacgatggaaaatcttcacggaatcacccacggaaatgtctcggaagcgttatggaggcacctcagcttgaattttcttcacggaaacatgccaagaaccctttggaacaaccctcttcccctatttataggagaaaaggggaggaggttgccgcccagctcgcccaggcgagcaggtggcttcctctggaaatttctcgatgcaaccctgagttgataagttcacctcctcttgtttcaaatttattagaaaagttacgaaagtattacgaaagcctatcggacttgattttcttcttttttgtccttcctctcaccaatcttaagtggaaaagatttacccagggttacgggaattttacggaagcattaaagaagccccggtggcccgttttcaaaaaaaggagggaggtgcttgccgcccagctcgcccaggtgtgctggttgcttagccaggaaggaagaaaaaatccagaaaactctagatgggcccagatttga

SEQ ID NO: 8769 - DNA, 177 bp, Glycine max
  Peptide Sequence Number=SeqID_100454
atggttgagatagaggaggtgcaacagcggatgaaggccgacattgaggccattaaagagcaaacagccacgatgatggaagccacaatgagcatgaaaaagataatgaaagtcaatgcggttgcggttgccgctaccagcgttgttgctaagagagaagtgagttatcaagaatag

SEQ ID NO: 8770 - DNA, 946 bp, Glycine max
  Peptide Sequence Number=SeqID_100455
gttggatgacttggattctagactatcatcatcttctgaagctgcagttaaaacatgtggatttagtattgataaattaagccatggtggccatggaagcagtactacttctcggtcttttaaaagaagaattagaaagggatccgaaggactgaagtcaattggccgatcacttggattaggggtatctagggcagtgttccctgaagatcttaaagtttcagaaaagaagatatttgaccctcaagacaagtttttgctcacctggaataagctttttgttatatcatgcattttagctgtgtctgttgatccattgtttttttatctccctgtcatcaatgattcatttcactgtcttggtatcgaccgaaagttggcaattacagttaccaccttgaggacattcattgatgctttctatctcgtacacatggccctccaatttcgtactgcttatattgctccatcatctcgtgtttttggacggggtgagcttgtgatagatccagcacagatagccaaacgatacctgcggcggtatttcattgttgattttctatcagtgttgcctttaccacagattgtggtttggagatttctgcagaggtcaaaaggttcagttgtacttgcaacaaagagggcccttctgttcatcattttgcatcagtacattcctagatttttccggatggtaccgttgacttctgaacttaagagaacagctggtgtctttgctgaaactgcatgggcaggggctgcatattatttgctattatttatgcttgctagtcatctgttgaacgcaatgacttttgctggcaaaaggcttgtagtggcaatgggtacaataaaaatttcttgtattgtggcaaccaatacatggaaggttatagtgcctggcagaatagaagtaaagatattcttacatcacagtgctctgtag

SEQ ID NO: 8771 - DNA, 687 bp, Glycine max
  Peptide Sequence Number=SeqID_100456
atggtggctatgatgatgttgagaacactttaccgtgatatctccaagtacaatcaattagagactcaggaggaagttcgggaagagtcagggcaaacttgtccatggagatgttttcaggcctccttcaaactcggatttactctgtatatgctggaactgaaggcagtgactgaggatcctgtaaagaccaacaagatagccaggcagatcccagagcagccttggtacatgaactcagtctttattttattagcaggcatactcccatttggagctgtcttcattgagcttttcttcattctcacatctatctggttgcatcaattttattatatatttgttttcctgttcattgtgttcctcatcctcattgttactcgtgctgagatcacaatagttctctgctacttccagctgtgtagtgaggactaccgttggtggtgggggtcttatctgacttcaggttcctctgcactttaccttctcttgtatgctgcattttacttcacaaggtttgagatcacaaaaccagtttctggagtcttgttttttgggtacatgctgcttctttcatatggtttctttgtggtgcctggaaagcttttagttggaacagggaattgcggtgatccttctgctagacctttggttctcgcatgcagttcaaagttcagaaattgttag

SEQ ID NO: 8772 - DNA, 681 bp, Glycine max
  Peptide Sequence Number=SeqID_100457
atgtcctcgccttcagaggactacacgtcctcgcctcagaggactgcacgtcctcttcttcagagggtacatgcccttgccttcagaggattacgtcctcgcctccagaggactacatgtcctcaccttcagaggaattcacgtcctcaccttcaagggtgcacgaccttcaccttcagagggctacacgccctccagagatacacctcgccttcagaggactacacgcccatcagaggactcacgtcttcacctacagaggactacacgtcctcgccatcagagggctacatgccctcgcctttagtgggacacgccctcgcctttacagaggactacacgctccttcatagaacttcctcgccatcagaggactacacgtcctcgccttcagaggacttcacgtcctcaccttcagaggacgacaccctcatcttcagaggactatacgtcctccccttgagaggactacaccctcgccttcggaggtacatgcccttgcctttagaggactacatgtcccccttttcagagggctacacgccctcgcctttacagggcgacatgtcctcgccttccaggagggctacacactccctcgcctttagagggctacgcgtcctggctttcagagggctccacatctgcaccttaagagaatttaaggtcctctgcccttaa

SEQ ID NO: 8773 - DNA, 756 bp, Glycine max
  Peptide Sequence Number=SeqID_100458
atgggacccctccaaaggcaagccttctgcaaagtgtacggaaagattttagatttgactgcagcggaggtatttacggaagttgttgtatccctcgcccaatactatgacctgccgctgagatgcttcacgtttggggacttccaaatggtacctattgttgaagaatttgaggagatattaggatgccctcttgggggaagaaaaccgtatcttttctccgggtttcttccctccttgagtaagattgcagctgtggtcggagattcgacaagagagttggatcgtatgaagcaaactagaaatggcgtagtgggcctaccgcggaaatacttggaaggcaaggcaagtgatatggcaagtcaagaaaagtgggtcccgtttgcggatatactagctttgctgatctttggggttgtcctctttccgaacgtggacggtttggtatacctagccgcaattgatgctttccttgcatatcaccatagcaaggagggcccagtggtggctatcttggcagacttatttgatacatttgaccgaaggtgcgagaagaacagcgcacgaatcgtctactgcttacccgctctttgtgtgtggttggtttcgcacctattccaacaagacataagacacccgtgtctgtttcaaagttatcgctcgtgcgtcgaaaagagaagagtcgattgggaccaacacttggctgggataggaggaagcaaaatcaattggtttcctcgatggggactaccctaa

SEQ ID NO: 8774 - DNA, 201 bp, Glycine max
  Peptide Sequence Number=SeqID_100459
atgggatgttacacagggaaaacaattttcactgcattcatcaatgctaaatctctgtcggtaacaatgactccagggagtgcatcacgtctcaaaaaatacctcaaaaccgttatagatctcaaacaacattgcttagacattctccctccaaataggcaaaagcagttgaaaatattggtgtcacaccaacaatgtcaa

SEQ ID NO: 8775 - DNA, 123 bp, Glycine max
  Peptide Sequence Number=SeqID_100460
atgggtgcatttttcttagttagaagaatatcttgtgcgagtgaatgttcgcgaggaaaaaatggccccgaggaagcatgcctcaaaaaggtccaggaaggacaaggcggccgaaggaactag

SEQ ID NO: 8776 - DNA, 297 bp, Glycine max
  Peptide Sequence Number=SeqID_100461
atgcggttacctcggtcacgtggctctgcttcctctcaagaaaccgagcaagcctgtcatctcctcatccaaacaggcctcctctgcatcgccgggagctcctgcaggcgtctccccggcctgggcctcgggccaatctccgagccatgcgacctcagccctaaactgatctggagtagggcacgcaaaaggaacgaaaccctggccctactgactgaggctgagctggtagagacactcatgtatctgcacctgcccccggtggttggccacctgttggcgaaccaagtgctgtag

SEQ ID NO: 8777 - DNA, 286 bp, Glycine max
  Peptide Sequence Number=SeqID_100462
atgcttgggaagtctggttgattgtcctttggagcagcagtttgatgaatgcctgatgaaatttgaaatggcttgttcaccttggccaatgtttgttgactatgtgaaacatatggttgcatttgcacttggtgcagtgcaatgtcatagaattgatagtcttttggacaaagtgagggttgtgcaaattgatacgatgaacttgattcaaggggggttaaagcccctcaaggaaaaactacaggaggaaatgggttctgtcaagtgggacacacttattcagcag

SEQ ID NO: 8778 - DNA, 252 bp, Glycine max
  Peptide Sequence Number=SeqID_100463
atgactatttttagtcgacatcgactagtttgtaggccaaagaagagaaggtgcaaaaagctgtttatgaactcgcttagcgaggaagattggctaagcgagccttatccgctgagcgaggcaggttgctcgcttagaggatgggaaaccctagaagaggataagttagagatctgcatgctcaatgcgcagccaactcgcccagcgaggacgttgtctcttctcacgcttagtgcgcccaagctcgcttag

SEQ ID NO: 8779 - DNA, 348 bp, Glycine max
  Peptide Sequence Number=SeqID_100464
atggtcgtcattgtcaatgaggaagcttgtggttacgtgagcatgaactactaccaatatatagatgttgtttatacaaacgagcacatcttaaaagcttactccgcacaatggtggcctcttgggaatgaagcggctattcctccttctgatgacgcatggacacttatccctgacccaactacaattcgtgcgaaaggttggccaaaatcaacaaggataagaaatgagatagattgggttgaaccatctgagcaccgaacaaaatgcagtagatgtggagccgaagggcataacaggcgtcgctgtccaatgcaatctgagcgtgggagttgttcaaatccttga

SEQ ID NO: 8780 - DNA, 165 bp, Glycine max
  Peptide Sequence Number=SeqID_100465
atggaagggttttggagaaagccacgagctgatctggaaaatattttgaaaccagcttttacaataatagctgatcacgagatgaaatgccttttgttattgattcgtggcacacatagtatcaagtacactttaatagctgttacaggaaatcttttacaataa

SEQ ID NO: 8781 - DNA, 843 bp, Glycine max
  Peptide Sequence Number=SeqID_100466
gacttccagctagtgccgactgtgaaagagtttgaagaaatcctgggatgcccactgggaggaaggaagccatatcttttctctaggttctatccttccacgacaagagttgccaaggtagtgaaaatctcagcacaagagttggaccgggcaaatgggctttcttttattgacatcttggcgcttttgatctttggagttttcctctttccgaatatggaagggttagtggacctagcagtgattgacgctttcctcgcctttcatcatggcaaggaaagctcggtcgtcgccattttggccatgtatgacatgttcgaccggggatgtgaaaagagtggcgcaagaattgtttgttgtgcactggctctctatgtgtggctggtttcacacctttttctccaagaaggtaggcccgtctatccgctacaaggtcaccgctcgtgcgccgaaaaaggaaaggcgaattgggaccaactcttggctagcatggaggggcgtctgggttgtattaattataatcacgtcctcgccataagacagcttggctaccctatgagaggagtgccatcagacgaaagcatcacgcctttcatcacacggggtttcagtgaccacaacgcgagggacagagagcttaggggaagcagtaatgggatcatcggcggctatcataagtggctgagagtccgaacacaaggattggattggctcccaaatctaaagactgtgagagacgatgaggttaaagctttggaagaaagtgatgaggtacaagccctaaaggcagagcttgaaagagcctgggtagtcgaagagaagttcaagtccatagccatcaaa

SEQ ID NO: 8782 - DNA, 179 bp, Glycine max
  Peptide Sequence Number=SeqID_100467
atggctctgaaaaagctttccatgaagaggtctaggagagacgccgcggctaaagggaccaatgccgcccccgagtttgatagccaccgtttccggagcgccgagcaccagcagcgcttcgaggccatcaaaggatggtcgttccatagagagaggcgtgtccagctcaaggaggatga

SEQ ID NO: 8783 - DNA, 338 bp, Glycine max
  Peptide Sequence Number=SeqID_100468
atggttttaggggtgaagttgccggaggcattacaatacatggtgtctcctcaagggaggaaaacatgcacatttgatgatctcgtgccttatgtggaaaaaattacaattttatccgaagagcaagagagagtcactgagccagtgtcacatggtcccgcatcagagcgtcaatttcccgcacaacagtttcacatgcttcagtcaagtattgaaactcaggggatagccagaagaagggacactgttgaagcggaagaatattcccaacaaatggcggagcgtggccatggaatgtattacacgccacaaacatttgctgagtatccgacacagat

SEQ ID NO: 8784 - DNA, 768 bp, Glycine max
  Peptide Sequence Number=SeqID_100469
atggccaagttcgatccagaaatagtcctcgaattttatgccaatgcttggccaacagaggagggcgtgcgggatatgaggtcctgggtgaggggtcagtggatcccgttcgatgcagatgctatcggccagctcctgggatatcctttagtgttggatgagggccaggagtgcgagtatggccagaggaggaaccggtctgatgggttcgatgaggaggccatcgcccagttgctatgtataccggggcaagattttgcccggactgctgccgagagacgggtgcggatcatgcgcaccaacatgaccacccttactcagatatggatgactttgctgctcagcaacgtcctgcccaccgatcataattccgacctccccctgccgaagtgtatggtgcctaccaggcaccctctggacccagataagtccaacagggccctaggatttcccgccttgatcacaggactctgccagtcgttcggcgtccctgtcacacctagcaaggtgattcggccgcccatcacccgagcttttatcgagaagtactgcacgcagagacagagtcagggctttacttcttttccatgccctactctggaccagttcagggcagaggtcgcatggcctggagattggcctgaggcccaggcaggagaggcaccagcaggggcaccagcagaggctcccgatgaggcagaggaggcccgcgaggacgaagagatgaccgatttacttgatttcttaggagggagcggagccgcatga

SEQ ID NO: 8785 - DNA, 1059 bp, Glycine max
  Peptide Sequence Number=SeqID_100470
ctccccatcagagggctacacgccctcacccttagaggactacacgtcctcgccatcagaggacttcacgtcctcgtcttcggaggactacacgtcctcaccctcagaggatttcacgtcctcaccctcagaggactacacgtccacgccttcaaagggctagggcaacacgtcctaacctttacagggctagacgcctttaccttcagaggactacacgccttcaccttcacaggactacacgtcctccccatcagagggctacacgccctcaaccttagaggactacacgtcctccccatcagaggacttcacgtcctcgtcttcggaggaccacacgtcctcaccttcagaggatttcacgtcctcaccttcagaggactacacgtccacgccttcaaagggctgtacgacctcgccatcagagggcaacaggccctaacctttagaggactacacgtcctcaccatcagaggactactagtcctcgccttcagaggactacacgtccttgccatcagagggctacatgccttcaccattagaggactacacgtcctcgccataacaagactacatgtcatcacaaatagagggcaacacgccctaagctttagaggactacacgtcttcgccttcagaggactacacgcccttgccatcagagggatacacgccttcaccattagaggactacacgtcctcgccatcacaagactacatgtcctcaccatcagagggcaacacgccctaacctctagcggactacacgtcctcgccttcagaggacttcacgtcctcacctttagagggctaccagccttcacctttagaggactacacgtcctcgcaattagggggctacacgccctcaccttcagaggacttcacgtcctcgccatcagagggcagtacgccctcaccttcagaggactaaacgtcctcgccatgagagggctacacgccatcacccttagaggactacatgtcctcgccatcagaggactacacgtcctcgccatcagagggctaaacgccctcacctttagagcactacac

SEQ ID NO: 8786 - DNA, 664 bp, Glycine max
  Peptide Sequence Number=SeqID_100471
gtacatcatgaattcggttataacagtgttgtatttcaatggaagggtatatgaagaaaatgatagtgtaatatttgaaggcaataaaaaagcgattcagatcaaacgtggaattagtttcaatgcgttgaagaaaaaattggagataagatttttagtgtctggaaaatatgttgcgttgcaaatttgtgatgacgaagatgttgaaaccatgctcgaaagttttcaacaacaagatcaaatatcagttctagaattgtacatagaaaaagatgtggctgatggttctatgtttaattctgcaaattctcttacatcatgtggaaataatttatctaataatgaggtgcaatcgccaagaaattctttagacgaagatgatagtattgacggtatatctgatacagacgatgaagtcaccgacatgattcaaccagtaagaattgttcacccagcagaaggtgtacaaggaattcaaaatccattttggaatgatgctttgcattataataatctcaactggagtcatcttgatgaggaggacatttgtggtttggagatgccatcgagttttaatgttggccaagaattatatgttggcatgaattttggtagtaaagatgcggtcaagaatccagtcaaacaatatgtgatgaaggcatga

SEQ ID NO: 8787 - DNA, 459 bp, Glycine max
  Peptide Sequence Number=SeqID_100472
atggtgaaagttggaacctcttacgtgccgatcaacgtctcattttcgccaaaagttggcccagggcttgcccgtggcttctggtttctatcagctgtccctcctgttcagctacttgacggggtggtgcgtaacggcaaaagcaccgccggacatcagcgctggcaagtggcgcgtcccattcgccattcaggctgcgcaactgttgggaagggcgatcggtgcgggcctcttcgctattacccagctggcgaaagggggatgtgtgcaaggcgattaagttgggtaacgccagggtgtttcccagtcgacgtgcttcatgtaaaacgcacggccagtgaatatgtgaatacgactcactatagggcgaattggagctccaccgcgggaagtgagagggccgcggcaaagccgtttttccataggctccgcccccctgacaagcatcacgaaatctga

SEQ ID NO: 8788 - DNA, 184 bp, Glycine max
  Peptide Sequence Number=SeqID_100473
gggagaagcttgccacccagctcgtccaggcgagctaggttgcttcctccagaagcaaccgccttctggaggaaattttggaagccaaaacttcacgaattgcctaacgatggatgccaagtacctcgaagttgtcaaacgagggtcgcatcccaacaacggatggtccccagacgaaattagg

SEQ ID NO: 8789 - DNA, 275 bp, Glycine max
  Peptide Sequence Number=SeqID_100474
atggaggatgcaacatttgtggaggtgctcatgagtcaggctcatgcatggttcaagatgacgcagccaacaaggtcaactacatgggagctcaaaattgccacagattctaaggctacaaccaaggaggaccgtcgggattcaaccaagggagaaattcacacagggctcaagctgcaaggcccaagtggagaaggacgaaggcccaagtggagaaggatgaaggcccaaatggagaaggatgaaggtccaagtggagaaggacgaaggcccaa

SEQ ID NO: 8790 - DNA, 186 bp, Glycine max
  Peptide Sequence Number=SeqID_100475
atggcttctacaagtggagatgctactccaccatctccaaaaatcacaaggctcatggcggagatgattaaacttggtgatcatatgagaagaatgagttatgacaattatgaaaggatggagagaatgagaaaggagaataaggagagtttgggaagaatacataggagtagagaagctttaagt

SEQ ID NO: 8791 - DNA, 102 bp, Glycine max
  Peptide Sequence Number=SeqID_100476
atggaaaaaatttcaagtgagtgctacaaacatgtttcgcccagcttgcaacacttacttgttggtgatagcctcaaaggcttaacgaattggcctcaataa

SEQ ID NO: 8792 - DNA, 237 bp, Glycine max
  Peptide Sequence Number=SeqID_100477
atggactttaaggtttggaaagaagctgtagaaattgatcttggccatatggatttggacttggcattaaggacgacacaatccatttccactccgaaaacctctaatgaggcaaaaattgagaggtgcgctctattccagagacattttgacactctattccaaagtgcaaagaaaatcctcaaggaaattgtgcaatactttgccaaaaatgaaaatgtggagacatctacatga

SEQ ID NO: 8793 - DNA, 993 bp, Glycine max
  Peptide Sequence Number=SeqID_100478
atgggactacaactgattttcttgctaattgagctgcatttagatttttgcactcagcaggtccatgaatatgcaggtccttcagtcttcaaatcacaacctcctttctcctcaccaaatattaaggatattcatgcccctgcaactgcaccatcaccagcaattctgccaggtcatctggatgtaccctctccttcacctagaatttctcctctaggctcatcgttgaagaagaaaaagactccaccaccagcatatacattgattctgccacctccacctcctaataaggtttgcttgtcgatgacttgcttggagcccttgacatatacagctcctgggtcaccttgtggttgtgtatggccgcttcaggttaaactccatatcaacattgcaatatacaagttttttccgttggtttcagagctagccaaggaaattgcaacaagtgttctgctgaaccatacccaggttcgcattgtgggagctgacgcagctaatcagcaactggagaagatcactgttctcctagacttagtacccaaaggagtaaaatttgatgataccagtgcaattttaatatataagaaactctggtacagggagattctgatagatgcttcagtctttggtgcttatgaagtactctatgttcattctccaggtcttcctccatctccaccttcaactccctcagatgcttctggtatagatgatgggccaaatccaggacatgacaacaatggaatgataatgaaacctttaggagtagatgtcccaaagaagaaaaaagaagggaataatggaagaatgattgttatatttgtgctgtcatcatctgctatacttctgaagccagatacgagcagaggtggaggtatggatcatggtggctatgtaaaggttaaatgcatagcttgtggacatcgaaatgaaaggtttgtgctgctgacagccatgctgctagacctttttcctgttttgtatggatag

SEQ ID NO: 8794 - DNA, 114 bp, Glycine max
  Peptide Sequence Number=SeqID_100479
atgaaagtggcaagtgatgtccttgcagtagagcttttacagaaggtgcacgacttgctgctattggggagttgggaaaagcatgtcctggtggaacgtaagtatggaccttag

SEQ ID NO: 8795 - DNA, 471 bp, Glycine max
  Peptide Sequence Number=SeqID_100480
atgcgatcttgggtgaggggtcagtggatcccattcgatgcggatgccctcagccagttcctgggataccctttagtgctggaggagggccaagagtgcgagtatggccagaggaggaaccgggccgatgggtttgatgaggaggccatcgcccaattactgtgtatggcgtctaccagacaccctctggacccggataagtccaacagggccctgggatttccaactttgatcacaggactctgtcagttgttcggagtccccgtcgcacctagcaaggtgattcggccacccatcacccgggcttttattgagaagtattgcacgcagagacaggcccaggatgatgcaccacaggtcgcagacgcgctgccacctcatcaggctggcccagctgggtcatttgattcggagcagtatttacggcatgtggttcgccagaaggtggccaaccaccgggcgcacgtgtag

SEQ ID NO: 8796 - DNA, 587 bp, Glycine max
  Peptide Sequence Number=SeqID_100481
gcgctggcggactatgccagagccggcaatgcgccgctgcagggcacggcagagcaactgccggcaccgccggctggcgtgcagcagcggcgcatcacgctgacgagcagggcattgtgcagctgtggacggtctcacccaacggtggcgcggcgcgtcagatcacctcactgcgcagcagcattcagtctgctttcagctggcagccggacggcgcagccatcgcctttatctgtgataacagcgtgatgcgttgtgagatcgccagcggacagtgtacgcgccttaccgcgcgcagcgcgcaaccgccgggcggcgacgcggtggctggcttgggtgccagccatcttctcgctctgcagcacgcgttcgcgcggcgaatctttggttttatcgtcgtcggcgcggaagtaatcccacggcagcagcagcgtatccatcactgccgagaagggcagatcgatcagcgccagcggtttaatcgcccagctggtattgtcatcggtcagcatctctgcgctggcgcgcgtgccggggtagtaaccctggctggcaccggtatgcgacatcacgctggagcagcctga

SEQ ID NO: 8797 - DNA, 147 bp, Glycine max
  Peptide Sequence Number=SeqID_100482
atggcggttgcttctggaggaagcaacctggctcgcctgggcgagctgggaggcaagctcctcccctattttcctataaatagagggaggagtgaagaagaaaagggttcatcccttctgaaagtccaagccgaggcacttccgtaa

SEQ ID NO: 8798 - DNA, 384 bp, Glycine max
  Peptide Sequence Number=SeqID_100483
atgaattttgcagcgagaaagcctgtagaattcaccccaattccagtgtcttatgctgacttgctcccatgtctacttgataattcaatggtagccataaccccaaccaaggttcatcaacctccatttttccgagaatacgactcgaacgcaacgtgtgcttatcacggagaagccctggggcgttccattgagcattgtagggctctgaagcgtaaggtacaaggtctaattgatatgggctggctgaaatttgaggagaatcgcgtgattttcaactttcactggaagtgggtgaaagccattggtcagtttgctcaagcgacctatgctcctgagtttgggacttccaagaccgttggtgggggtgccgtaaaacaatga

SEQ ID NO: 8799 - DNA, 504 bp, Glycine max
  Peptide Sequence Number=SeqID_100484
atggttatgggagatttcatcagcagactctccttccccggtagacgcattgtttttcactcaaaaagcatatgctgctctaaatcagttgggaatatttgtctctttgctaaagcatgtttgcattttagtggaagaaaaacaccgagactttttcaagtctcacaagttatccagaactacgtagggtctgagttcctcattggaggatacgtaggagcaagagcctcgcttttgtcgaccacaccgccttttgttgccatgacccaagagttggtagcccgcggagacaccttacggttattcgcacctcgtcattcagtgaccccaagtgtgattgacgagcagaggccaatgtggtcatctgcgccctttccggagatgtcagcatcttccgatggagacttttcaagtctcacaagttatccagaactacgtaggtctgagttcctcattggaggatatgtaggagcaagagccttgcttttgtcggccgccccataa

SEQ ID NO: 8800 - DNA, 255 bp, Glycine max
  Peptide Sequence Number=SeqID_100485
atgaggcctcatctctcagtcctcctgagcgattatcctctccagctctgggggaagccccacatcctcgtcctcttcattctccatccgactcacttcttgctcgaaattgacggtcgggttctagtcggaaaccaggagggcatggtcgtaccaaatctgatctcctcgtggggctccagactcgatggcggaggatgcatgaatgacaagcatttcatggggctccggataagatttgagggtgcaggatag

SEQ ID NO: 8801 - DNA, 330 bp, Glycine max
  misc_feature (322)..(322): n is a, c, g, or t
  Peptide Sequence Number=SeqID_100486
atggcggttttgtggtggctactggtggctgtgggtgatggagaaagtgcttgggacattataaatggttttggaaggaaagaggagaaggaaatgacgaagcattcctcacatgccagacgtcgtatcaaagatctcgacggtcagatcgtggacatctgtcctatgaacctccagaccaaatttcatgaagatccaatggttaacaaaggttgggaagcgtttttaccaagacaacttcatgttgcttccttgagaagcttcattaagaggcttcctcgtggcttctttgagaagttagattcttatctacccacacccntttattaa

SEQ ID NO: 8802 - DNA, 131 bp, Glycine max
  Peptide Sequence Number=SeqID_100487
atggcagaaccatcgaagaagcgcaagggttcttcgagtagaagccaaccacacttcgatgtgcaggatactccaattccttcctccattttctcctcctcattgttctcatcggaagaacaacgtacatg

SEQ ID NO: 8803 - DNA, 123 bp, Glycine max
  Peptide Sequence Number=SeqID_100488
atggaggaaggggatgatgcaatcctccctaggaagggaccagtcactagagccatgagcaaaaggctccaagaggattgggctagagctactaaagaaggctccctcagggtagatttctga

SEQ ID NO: 8804 - DNA, 1074 bp, Glycine max
  Peptide Sequence Number=SeqID_100489
atgcaaaaagagatctacgaacagccgctggcgctgaaaaacaccctggaagggcgtttcagtcatggccaaatcaacctgagcgagctgggcccgcgcgccgacgagctgctggccaaggtgcatcacgtgcagatcatcgcctgcgggacttcttaccactccggtatggtggcgcgctactggtttgaagcgttggccggcgtgccgtgcgacgtcgagatcgcgtccaaattccgttaccgcaaatcggcggtgcgtccgggcagcctgatcatcaccctgtcgcagtccggcgaaaccgccgatacgttagcggcgctgcgtctgtccaaacagctggggtatctcggttcgctggccgtttgtaacgtggtcggctcttcactggtgcgcgaatcggatctggcgttgatgaccaaagcgggcacggaaatcggcgtaccctcgaccaaggccttcaccacgcagctcaccgtgctgttgatgctggtggcgcgtctgggccgcctgaaaggcatggcggaaagcgtggagcaagagatcgtgcatggcctgcaggcgctgccggcgcgtatcgagcagatgctgtcgatggataaagagatcgaagcgctggcggaagggttctccgacaagcaccatgcgctgttcctcggccgcggcgatcagtatccaatcgccatggaaggggcgctgaagctgaaagagatctcctatattcacgccgaagcctatgcggcgggtgagctgaaacacggcccgctggcgctgatcgacgccgatatgccggtgatcgtggtggcaccgaacaatgaactgctggaaaagctgaagtccaacattgaagaagtgcgcgcgcgcggcggccagctgtacgtgttcgccgatcaggacgccggcttcgtcagcagcgaaggcatgaccatcattcctctgccgcacgtcgaggaaatcgtggcgccgatcttctacaccgtgccgttgcagctgctgtcttaccacgtggcgctgatcaaaggcaccgacgttgaccagccgcgcaacctggcgaagtctgtcaccgtagagtaa

SEQ ID NO: 8805 - DNA, 618 bp, Glycine max
  Peptide Sequence Number=SeqID_100490
atgcctgacgttaactgccagctggcccagctttcgggataccacaaaaccaccgtttatcgcttaatgaattcgcttgagcgtatgaactacattatccggcatgatgatggcacctatacgctcggccaccgtctgctctatctcggcagctttatgagcaatcatttcacttgcgagaatgtacaaccggaattgcggcgctgtctcacagccatggcggccaacgccgtgtttgttccgcgtcgtccggccaacgtcagaggattacgccatagcaacctgcccggcagtcaatttccactggatggctccgctatcagcaaagttttacgtcattggggactgggtgaggcgctttcggaagacgaagaaacgctgccgttctatacctctggcgcgcgcgatccgcacaccgcggccttcgcgatgccggtttttggcgtccacgataaccccatcgcggcactggcgctgacaggaccgtcatcgcgtctgactgcggaccgcaaagagagcggcctcggccagctaatgcgcgagacggccaaccgcctgtcgatcaagttaggagccagtaaatccttctgcgaaacgttttacgatataaaagaataa

SEQ ID NO: 8806 - DNA, 726 bp, Glycine max
  Peptide Sequence Number=SeqID_100491
atggcaactgtttccatgcgcgacatgctcaaggctggtgttcacttcggtcaccagacccgttactggaacccgaaaatgaagcctttcatcttcggcgctcgtaacaaggttcacatcatcaacctggagcagaccgtaccaatgttcaacgccgctctggctgaactgagcaagatctcttcccgtaaaggcaagatcctgttcgtaggtaccaagcgcgcagcaagcgaagcggtaaaagacgctgctaacagctgtgaccagttcttcgtgaaccaccgctggttgggcggcatgctgactaactggaaaaccgttcgtcagtccatcaagcgtttgaaagatctggaaatccagtctcaagacggcaccctggacaagctgaccaagaaagaagcgctgatgcgcactcgtgaactggccaagctggaaaactccctgggcggtatcaaagatatgggcggtctgccagacgcactgttcgttatcgatgccgatcacgagcacatcgcgatcaaagaagccaacaacctgggtatcccggtattctctatcgttgataccaactccaacccagacggcgttgacttcatcatccctggtaacgacgacgcaatccgtgcagtaaacctgtacctgactgccgttgctgccgctgtgcgtgaaggtcgttctcaagatctggccgttcaggcggaagaaggcttcgtagaagctgaataa

SEQ ID NO: 8807 - DNA, 406 bp, Glycine max
  Peptide Sequence Number=SeqID_100492
tgagctcaagcttcgaagggaagagagagaccaatcacaaacacatagcatggtcttgaaagaagagttagccgcttgctcaaggtccaaaaggaacttgtctcagcggttatgcgagacaaagaccaacatgttagccatcatcagcaagtaccaagaagaactaaatcttgccacggcccacgagcatagagtggcggaccagtatgcccaagtgtacgcggaaaaggaggctagaggaagagtgattgactcactacatcaagaggcaacaatgtggatggaccgatttgctcttaccttgaacgggagtcaagaacttccccgattgctagccaaggccaaagcgatggcggacacctactccacccccgaggagatccacggacttctcaactattgttag

SEQ ID NO: 8808 - DNA, 412 bp, Glycine max
  Peptide Sequence Number=SeqID_100493
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacagcaaattatccgtgagtcggcgggcgatgtatag

SEQ ID NO: 8809 - DNA, 729 bp, Glycine max
  Peptide Sequence Number=SeqID_100494
atgcgaatactggaggagaacacgcgctgggccgagtgcagaataaagccacgatcttccgccagcggaccaccggcaaacaccggtttgtccagtttgatggcaggatcgcgttctgatgggctgatcttaagttttttcaggatgccttcgaccgtcaggttgtccatcggcttgttaacgatcaaacccatggcaccctcttcgttatgctcgcagatatacaccaccgagcgtttgaagaaagggtcctgcagcgacggcatcgcaatcaagaaatggtgctgtaaattcattctcactcgtttaccaaaaatagccggtgctaacggctgcaccggctttgggtggttcacggagctctcactcctgcggcatcctcagcccaaacgtttttcaatcgcgtccatcagcatgccggtgatggagaccgggaacgccgcctcgatttcgcggatgcaggttgggctggtgacgttaacttctgtcagtttatcaccgataatatcgaggccgacaaaaatcagccctttggctttcaatgtcggacctacgcggcgggcaatttcccagtcgctgtcgctcagcggacgggcttcgccgcggccaccggcggcgaggttgccacgggtttcgccgccctgcggaatgcgtgccaggcagtatggcactggttcaccatcgaccaccagcacgcgcttatcaccgtctttgatcgctggcagataa

SEQ ID NO: 8810 - DNA, 1119 bp, Glycine max
  Peptide Sequence Number=SeqID_100495
gtagcggtcgctgtagccgtcgtaacggtcggtcagttcagcgctctggcgcacccaggcgatatcggcggtgaagtccaggcggtcggtccacggcatgtggtagccgatgcccagctccggctggttcagttccagcttcagcgagccgtcgctgtaatggtaggtcttgctggtgcgcgaccagccaccgaacacgtagacctgttcggcgatggccacagagccacgcaggtagccgccgtcgaccttcgggtcgtccagtgcgttgtcgtcaaccttgacctgcgtccaaccgccttcgacgtaggtgtagctcagggcgtcggccgaagccgagagcggggcggcggccagcagggcggccacgatcagcatcttgcgcatgggaattcctgtgaatttcagtcctttggcgggcctgccccagcgggctgcccgtggcgacctcatgtcgtccagggtggaattttaatgaaagttttacaaattgcgagcgacggccgtcacagctgtggcatccgaccccgttcagcccgggctggtacactagccaggccggttcgccggtacacaaacgtcttcagggcggggtgcaattccccaccggcggtaggtgcgcaagcacgagcccgcgagcgccccggcccacggccgggggtcagcagatccggtccaatgccggagccgacggtcatagtccggatgaaagaagacggtgccacagggctcatgccctgcgcgtgcctgtttgccttgcggcgtttttcgctcacttttcgcggagaacgtttcttgtttactggaatcatcgaaggcgtcggccgtctggccgctcgcgaatccatcggcggcgatgtccgcttcaccttcaatgtcgggaatctgccgttcgacaacgtgcagatgggcgagagcattgccatcaacggcgtctgcctcaccgtcatcgcattcgacgccagcagcttccaggccgatgcctccaccgagaccctgggcctgaccacgctgggccagctgggcgaaggggcggtcatcaatctcgaacgtgccatgcgcccgaccgaccgcctgggcggccatctggtcagcggccacgtggacggcctcggccag

SEQ ID NO: 8811 - DNA, 231 bp, Glycine max
  Peptide Sequence Number=SeqID_100496
atgaagataagtaaattaccaattacaatgttacaaaaaagtcctcaattttggtggatgttctctctttggtgtttcactcaatttggagtgcgtcttagtccaatagctcttaaggtggttggccccttgcttcttgactcaaattctacaattgatggcaccaatcctcctttccaattccctatatggcaactcactaaccaaggaaacatagagacaagtcaataa

SEQ ID NO: 8812 - DNA, 96 bp, Glycine max
  Peptide Sequence Number=SeqID_100497
atgcccatacacatgcatatcttgtggtacttagggatggaggcgaatggaggacagggtcacggccgaccgttgtcccttcccggcgctagataa

SEQ ID NO: 8813 - DNA, 300 bp, Glycine max
  Peptide Sequence Number=SeqID_100498
atgaccaactactatccaccagaccttcctccttctattggagttcctcgaggcagccaaggagcagtgctgaagaaagttctccataggattgttgtgcagagctctaacttccttgacccaggaataaaattcccaccacaaaggcattattttatgacaagagaaaaaaaggtgggatgcagattcaacttgactttggcagaaggggcagaggtcattttgaaggacaatctacctcctaataaggttttccttagatggaagcctatcccagagaagtctccaagaaaaagctag

SEQ ID NO: 8814 - DNA, 46 bp, Glycine max
  Peptide Sequence Number=SeqID_100499
atgcagtatctaggaagtgatctaggtcgtctcccaacgagcaatg

SEQ ID NO: 8815 - DNA, 723 bp, Glycine max
  Peptide Sequence Number=SeqID_100500
gtgagtgtggacgaggttaaagatgtagatgctccagttcctgtacccactgctgaggtttccttagtggggcaggcacttcacactttccttgcttggccgacacatctgatcaagtctttatcacaccaggtagttgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccagatttccccctgtacataaagcacgaagacctctccgaaatcgcacacggtgatcaatgtctcagcatatcagtgttacagttgttgattctgcatctcactgaaacatgtatgcgagcggggaattctgatatctatggattcctcgagcctcaatccattcagaggtttgggcaatcgcagtttgaatctgaaagttacataaagagttggatgcagagttcacaacgcgatgtgtatcttggagcctacctaaatggaccacctggtgttgagagaccagtggtgcatgttgatcctgctacagggaaggccgacggtccccacaagaagaaattgagaacatatttggggattgtggcacgtgataaggtggacatcacctacgagaactggaaggaggtccctactgctcagaaggacctgatttgggaggatattcag

SEQ ID NO: 8816 - DNA, 539 bp, Glycine max
  Peptide Sequence Number=SeqID_100501
gtatggcgccgaccaggcaccctttggacccggataagtccaacagggccctgggattttccgcattgatcacagaactttgtcagtcgttcggagtccccgtcgcacctagcaaggtgattcggccacccatcacccaggcttttattgagaagtattgcacgcagagaccgacccagggtgatgcaccacaggccgcagacgtgccgccgcctcatcaggctggcccagctgggtcatttgattcagagcaatatttacgacatttggttcgccagcaggcggccaaccaccgagcgcacgtacagatccatgactgtatttaccagctgagcctcaacctgcagagccagggttttacttcttttccatgccctactccggatcagttcagggcagaggttgtgtggcccagagattggcctgaggcccaggcaggggaggcacccacagaggctcccggcgaggcagatgaggctcgcaaggacgaggagatgaccgatttgcttgatttattgggagggagcggagccacatga

SEQ ID NO: 8817 - DNA, 519 bp, Glycine max
  Peptide Sequence Number=SeqID_100502
atgtcggtagatccttccttcctatcgctcagaggcgcgtacctccacggaactgtgtggttgttcttgtatggaaacggaataggtcaaactactgaggggtctcctaccgctaagcatgcttccatgctatgtggtgcaccgggatgcattaacaagtatccttctcgtgcccgatgcggggaatcacgccccccttttgcagggcctcggccacgcactgttcggttgagtggcctggggttctcccatggtcttcgtacgtcatcaggatcggggcgaattcttgagttggccttgggggaaagttccttgccgcgttggaaccaacgccaaggtgggcattgccggctaggcgagtcggggttggagccagagcttggggggccttcctatggatgggcgcgagcacccttggttgtacgggcgctgagttggaggagtccccagcgcgagctgagaagctcgggtgatgttgcgcatattggtgggtaccgtgggagatctgcggcggcttga

SEQ ID NO: 8818 - DNA, 580 bp, Glycine max
  Peptide Sequence Number=SeqID_100503
gtttcttccctccttgagcaagattgtagctgtggtcagagattcggccagagagttggatcgtatgaagcaaactcgaaacggcgtagtgggcataccgcggaaatacttggaaggcaaggcaagggatatggcgagtcaagaagagtgggtcccgtttgcggatatactagctttgctaatctttggggttgtcctctttccgaacgtggacggtttggtcgaccaagccgcaattgatgctttccttgcatatcgccatagccaggagagcccggtggtgcgagaagaacagcgcacggatggcatcatcggtggttatcatgaatggctaagagttcatacacgagggttagattggctctccaagttgaaaattatcaatgaggagaactttgaaagctccgaaagaggggctcgcaaggaagagtatggccgagataaatttcgaggagctttgtggggaagcaacaatgagctcaagctctggagagaggaaagagaccagtcacgagtacatggcatggtcttaaaggaggagttagctgcttgctcaagatctaagaggagtttggcctaa

SEQ ID NO: 8819 - DNA, 7134 bp, Glycine max
  Peptide Sequence Number=SeqID_100504
atggagaggttgcccagttctgagaagactgtttgcggaggcaagagtgggaatggcttcaattccaagttgcgcaagtttgctggcaacgagaggaggaagatgaaaccgaggaagagcgaattggggttggacagagtgagcaagaggagcagcagcagcaacgatgttgagaatggtggcgaagtggagaagcagcagcatgagaaggtgcagaaggaggaagtggaggagggcgaattgggcactttgaagtggccaagagctgacctggagaatggggagtttgtgccggagatgccgccgccaccgaagagaggcgaggttgagaacggggagattgtgagtgagaaatggaaaggaagggagctagagaagggggagattggttctgggaaatggaggaaagaggatgtggaaagaggggagatagtgagtgagaagggtggtaggaaaggggaagctgatagaggtgaatacgggtcgtggagaggaggaaaggatgaaattgagaagggagagttcattccagatagatggtataagggagattatgataacagtagaatccgcaggtaccattcaggtagggacaaaggggggaaaattgaacgtgaacgtgaacgtgaacgtgaaaatacaccttcttctgggagatataccggggatgacttttttagaaagaaggagttaaatagaagtgggactcagcatgttaaaagttctcccaggtgggagggtggtggacaacagcggaatgtaaggatcagttcaaagattgtggatgacgagaagaatgtacacagcaatggtaaggaccatacacgagattactcttctgggagtcgcttgaagaggcttggcaatgatactgacagctatgagcggaagcaatctgcagattatgccgggttgaaaagcagaaggctttctgatgatagctgtcgccaagtttattcggagaactattctcgtcattctccacgctctgtggaacggtcttacaaaaataataatgccacaaaattatcagcagacaagtattctttgtccaccagaccggcttatgacaggcatggacgcagccctggtcattctgagcggtccccacgagaccgaggtaggtattatgatcatagggatcgcactccagtgcgtcgatctccctgtggtcgtgacagatctccgtataaccgggagaaatccccccatgggcgggagaagtccccatatatgaggaactgggatagaagtcgtcagcatgatcataaattgagaagtccaatgcgtgctgagcagtcgccaccagatcgaagttcgcatcatgatcgcagggattgtaccccaaatttggcagaagcatctccccttcaacgagcgaggaaagactgtcgacaggaatcaagtagtaaaaccttatcaagtgaaaaacatgattcccaaaatagttgcaaggatcgtgaagataagcagattcaaagggagtcaaattgttcaagtacagaatctcaaaatgaaaaaagtgtgcaagttaccattaagtctgttgagaaagacatctgcagtgaacctctaaaggaacagcagagttgcagcccaactgtcagccacaaagaatctcctcactccgagccacctcctgaggagctgccttcgatggaggaagatatggacatttgtgatacccctccacatgcccctgtgatgacagatttgtcgtcagggaaatggtattaccttgactatggtggtgtagaaaatggacctgctaaattgtgtgacatcaaggtccttgttgatgaaggtgtactaatgtctgatcacttcatcaagcacttagatagtgacaggtggttaacatttgaaaatgctgcctcacctttggcacgtcagagctttccatcaattgtgtctgataccataactcaactggtaaatcctccagaagctcctggtaatatcttgtctgatggagcagatattcttcaatctgctcatgataatcaccaggaaatgcagccaccagtttgccctaatgacagtgtgtttacatctgaacttttggaggacctccacatagatgaaagagttagaaatctgttagagggttatgatgtcactcctgggatggaacttgaggcaataaaagaagcactgcaaatgaattttgaaaatgcaaaaggggagggattggaagactatgaagttgaacaaaaagtttgcattaatcccttcaatcatgtatggtggtttggttttctttggagtgtttcctgccttagggaagattgtgattcaagtgctgatttagcatcaagagattctgaatctcagtcaagtatgacctgtgataaggataatggacttgcctttggtatttctagtgactggttttccacccattggtcatgtaaaggtggtgactggaagaggaatgatgatgcccaagatagatattctagaaagaaacttgtcctaaataatggttttccattatgtcaaatggtaaagtctggatgtgaagatcctcgttggcctcaaaaagatgacttgtattttccttctcaaagcaggaggcttgatcttcctctgtgggctttctgtgctgatgagcgggatgattgcagtgttgctagcaaatcagttcaaagtaagcctgcttctgtgagaggagtgaaaggcaatgttctttcggtggtcaggataaatgcatgtgtagttaaggatcagggatcattggtctctgagtcacgccacaagactcgggtcaaggaaagacatcattcaaggtcaactcggcccttctcttcaaccagtgatagcaagagatcatcaactgaacaagattctctgtcaaaagctgttagtgatcaaggttcttaccagatcgtggaattcattaacacccctaaagatcatctctgtactatccgtgagttgcaattacatttgggtgactggtattatcttgatggttctgggcgtgaaaggggcccctcatcattttcagagttacagtatttagtagatcaaggtatcataaaaaaacatagtagtgtgttcaggaaaagtgataaactatgggttcctattacctctgcaacaggaacttctgatggcagtctcaggagccagcaagaaagcagtttgatatctggtgcatgctctggttttccatcaaagcaaactcaagttgtttcatttggcgaaacgtacacaaattcaactttatttaactgcttacatcctcagtttgttggttatactcgtgggaagctacatgaactggtaatgaaatcatataaaagccgggagtttgctgcagctataaatgaggttttagatccctggatcaatgcaaaacaaccaaagaaggaaattgaaaaacaaatatattggaaatcagaaggcgatgcacatgctgccaaaagagcccggatgctggttgatgatagtgaagatgaaattgatttggaagatgatgatgttaatatcgagaaggatgaatccacttttgaagatctatgtggtgatgctactttccctgaagaagaaattggtattactgattctgatgtgggaagctggggaaatttggaaggtcgagtgttagcacggatcttccattttttgaaatctgatttgaagtcccttgtttttgcttcaatgacttgcaagcgctggagagctgctgtaaggttttataaagaagtgtcaatacaggtcaatttgtcatccttaggtcattcctgcactgataccatgttgtggaagattttgaatgcttacgagaaagacaagatcaattctatcattctaaggggttgtgtcaatattacggctggcatgcttgagaaaattcttctttcatttccttgtttatttacaatagacattagagggtgcaaccagtttggagagctgactcttaaatttgccaatgtgaaatggatcaagagccaaagtttgcacttgactaaaattgcagaggagtctcataaaattagaagccttaaacatattacagagctaacctcttttgtttccaaatccagcagtttaggtatagatgattttggtcaattgaaggattactttgatagtgtggataagagagataccaagcagttattccgtcaaaacttgtacaagcggtcaaaactatacgatgctagaaagtcctcctccattctatctagggatgctcgtacaagacgttgggcaatcaagaaatctgaaagtggctataagaggatggaggaattccttgctttaagactaagggaaattatgaagacaaattcctgcgacttttttgtgtccaaggttgcagaaattgaggctaaaatgaatagtggttattacagtagccgtgggttgaattctgtgaaagaggacataagtagaatgtgccgtgatgcaataaaagtgaagaatcggggtgatgctagtgacatgaaccatatcatcacattgtttattcagcttgcaacacggctggaagagagttctagatctgtgcacgatagaaatgaactactgaaattatgggacaatgacttgcctgcagggtcctgctctactttctcaaagtataagaagaatagattggtgaatgaaaggaagtataggagcaatggaactcatggtggtttggataatgtggaatatacctctgatagagaaattaggaggcgcttattaaagttgaacaagaaatctatggactcagagagtgaaacatctgatgatgatcttgataagtcttatgaagatgggaagagtgacagtgatactacaacctctgactctgaaagtgaccgagaagtacattcagaaagtctaagtagggagtcaagaggggatggatactttacgtctgaggaagagttgggttttataactgatgatcgagagtggggtgctcgcatgacaaaagcaagtctggttcctccagttactagaaaatatgaagtcattgaccaatattgcattgtagctgatgaggaggatgtgcgaaggaagatgagggtttcattacctgatgactatgctgagaagctgagtgcacaaaagaatggcactgacgagtcagatatggaacttcctgaagtaaaagattacaaacctagaaagcagctaggaaatgaggttatcgagcaagaagtttatggaattgatccttatacgcacaatcttttgcttgattctatgccagaggagttagattggtctttgcaggagaagcatttgtttatagaagacacactccttcgaacattgaataagcaagttaggaattttactggagctggaagtactccaatgagctacccgttgcggtctgttattgaagatattaaaaagttcgctgaggaggattgtgatgtgagaatggttaaaatgtgtcaaggtattctaaaggccatagacagtcgtccagatgacaaatatgtagcttataggaaggggcttggtgttgtttgcaacaaggaagaaggctttgctgaagatgattttgttgtggagtttttgggagaggtttatcctgtgtggaagtggtttgagaaacaagacgggattcgatctctgcagaaagatagtaaagatccagcaccagaattctataacatctaccttgagaggccaaagggtgatgctgatgggtatgacctagttgttgttgatgccatgcacatggctaattatgccagtcgaatatgtcattcttgccgacctaattgtgaagccaaggttactgcagttgatggtcaatatcaaattggtatttatagtcttcgtgaaattcaacatggtgaggagatcactttcgactataattctgtaacagagagcaaggaggagtatgaagcgtcagtttgtttgtgtggaagccaagtatgccgggggagctatctgaatctgactggtgaaggagctttccaaaaggttttgaaggactctcatggaattctcgatcggcaatatttgatgctagaagcttgtgaattaaattccgtgtctgaagaggactataatgacctgggaagagctggtttaggcagttgtttgcttggaggcctgccagattggcttgttgcttatgcagctcgccttgtgagattcgtcaattttgaaagaacaaaacttcctgaagaaattctaaagcataatttggaagaaaaaagaaaatatttttcagatataattcttgaagttgaaaggagtgatgccgaggttcaggctgagggtgtatacaaccaaaggcttcagaatcttgctgtcactcttgataaggtaaggtatgttatgagatgtatttttggtgatccacggaaagcaccacctcctcttgagaaactcagtcccgaagcaactgtttcctttctctggaaaggagagggttcatttgttgaggagcttcttcagtgcataactcctcatgttgaagaaggcatcttgaatgatctcaagtttaaaattcatgctcatgatccttcaaattctggagatattcaaaaagagcttcgaaagtctctgttatggttgagggatgaggtccgaaatcttccctgtacatataaatgtcggcatgatgctgctgctgacctaatccatatttatgcttataccaagtacttctttagaatacggaattatcaaaccattacatcaccacctgtctatatcagtccgcttgacttaggtcccaagtacactaacaagttgggagcagaatttcaggagtatcgaaagatatatggtgaaaattattgtttaggacagctgatattttggcataaccagagtaatgcagatccagatcgtaacctggctagagccagcaggggttgcttgtctttaccagacaccagttccttttatgccaaggctcagaagccatcacggcattgtgtttatggtccaaggaccgttagatctatgctggctagaatggagaggcagccgcagagatcttggcccaaagaccggatatggtcattcaaaagttctccgaaattctttggtagcccaatgttagatgctgtagttaataactctccactggacagggagatggttcattggttgaagcacagacctgccatattccaagccatgtgggatcgttaa

SEQ ID NO: 8820 - DNA, 336 bp, Glycine max
  Peptide Sequence Number=SeqID_100505
atggctccgagaaagctttccgcaaaaagatctaggagggacgctgcggctgaagggaccagtgccgctcccgagtttgatagccatcgtttcaggagcgctgagcaccagcagcgtttcgaggccatcaaaggatggtcattccgccgagagagacacgtccagctcagggacgatgagtacgcagattttcaggaagagatagctcgccggcgatggacgtcgctggtcactcccatggctaagtttgactcagatatagtcctagagttttacgctaatgcttggcccacggaggagggcgtgcgagacatgcggtcatgggtaaggggctag

SEQ ID NO: 8821 - DNA, 1245 bp, Glycine max
  Peptide Sequence Number=SeqID_100506
atgacgccggtgccagcattgcgctggtgcacggcgcggactaccggccctccgagcagggcgcccgcatctacatcggcgtcgatgacctggatgcgagcctcgaccgtgcactgcaatcgggagctgagctgcgcttcggcccggccgacgcgggtgactggcgtgtggccgagatccgcgacagcgaaggcaaccgcattgcgctgcaggcgcgcgcagctctgtagagccgagcccacgctcggctgctgttggcccagccgctccagctcagccgagcatgggctcggccctacaaggtcgcggcgcgcgagcgctgcagccactgcatgccgaagcgctgctgcagcacgtcacgcacatcacccacatcatgcagcgggcgcttgtccggcgcctgcccggggcggtactcggtgtagttgccgctgccgatggtgcggcgccagtccggtccggtcagcgacacgcgtagctggcccgggaagctggaatcggggtgggtgcatacgtaccagttgcccaccacgttgtcgatcggtgcaggcgcctgcagatcgaagcggtacatcgcccgccagccgtcgctggattcggatgacagcacgaagtcgccctcgtcaggcagacgctgcagcagatagcgctcatgcggcgtggcctgcggctgcgcatcgtgcagccgcagcggcacggtcggggtcaggctgccgaaaccggcatcaccagccagtcgtccccatccacatgcacgcgcagcagcagatgggtacgcgcggtcagttcgccgtcatgcgctgccagcagcacgcgcgcactcagcggctgcgcatcaaagcccagtgcctgcagcagggccagcaggccgccattgagttcgaagcagtacccaccgcggcggtcgtcaagcagcttgcgttgcacgctgtccaggtcgatcggcaccgcgtcgcgcagcaggcagctgagggtctcgaagggcagcagtgcgttgtggcgctgctgcagcagggtcaggccggccagggtccgcggtggcggcgcatccagctgcaggcgttgcaggtagcgggggacatcgagcgtcgtcatggaggcaccgggcggggaggaacgtccactgtgctcccccaaccggggttgaggtcaagcgcggcgcccgtgtcatgcccccgtcgcttgcaccctgtacaaaggccgcgtccacccgcgacggggggacccggacgaagaaggcgctaa

SEQ ID NO: 8822 - DNA, 753 bp, Glycine max
  Peptide Sequence Number=SeqID_100507
atggcccgcacgaagaaaataggggagatgacgactgaggccgcgaaggaaatcgctacgaagatcgattcctttgaggagcaggtgacacagggatccttcgtcccccatggacgtcaggatgttctcaccgctgctattggacgtccaaagcaccctaaacgtgttcgtgctgctggagtcggtgtcaccatcaagcaatactttggattggctccatggacgtcccacagatcttctccctgcctcctgaagaattctagaggagtccatcacagaaagagtgatgcggcagctcatggcatccttaagctagatgcagtcctagattcagtcccagatgcaatctcagggacttgcactgcctcccgagcctctggttggtccctccggtcctcgaataggtgcggcttgtacatcgaagcagatcctgcccgcctggttgccctggggagagtttatgagggatccactgttgttcataacactcctttgttgcttggccaagtaaaggtgggtgtggaggaggttatagatgcagatgctccagttcctgtacccactaatgaggtttccttagtggggcagacacttcacaccttccttgcttggtcgacacatttggtcaagtctttatcacaacaggtagctgtgtctccggcaaaaccacctccaaagcccgatccgcaggtcgatgatctgctttatctgatgacattaaccatcccaaagcttttcttgaggccttatcag

SEQ ID NO: 8823 - DNA, 506 bp, Glycine max
  Peptide Sequence Number=SeqID_100508
gatcagcccatgtcatcaagttttagcaggatcgacacacccttggcatcactctatgatcttaaatcaggaaagtttcacttggtcattccacatttactagcatctcaagatgaaggttgcatgcatttgcatcccaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtcgggcgtgcttttgccgtacgcaccacccc

SEQ ID NO: 8824 - DNA, 504 bp, Glycine max
  Peptide Sequence Number=SeqID_100509
gagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccaaccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 8825 - DNA, 372 bp, Glycine max
  Peptide Sequence Number=SeqID_100510
atggcagaaccatcgaaaaagagaaaaggaacttcgagtcggagtcagctgcattccgggtcacaagaagcaccaattcctccctccattccctctggatcattattctcatcagaggaacagcgtatacggtacacaaacctcttttcctctcgttccattgtagacccaaaattcatagatatggagttcttctcaaatgagaattttgaatgcttccaagcatttgaaaactccaatcttattccattcatgtctctgaaattacctgtctattctgaattagtcaaagctgaaattctgatactgaggacagatgtcgtacaggatgtcacgacatcgcgcttcagtacatgcagattgtatatgaca

SEQ ID NO: 8826 - DNA, 182 bp, Glycine max
  Peptide Sequence Number=SeqID_100511
cgaggaagcggaagagcgcccaatacgcaaaccgcctctccccgcgcgttggccgattcattaatgcagctggcacgacagcggataacaatttcacacaggaaacagctatgaccatgattacgaattcgagctcggtacccgagaacttcgaagctccggaagaggatgaagaagtctaa

SEQ ID NO: 8827 - DNA, 489 bp, Glycine max
  Peptide Sequence Number=SeqID_100512
atgtgggcctttcatacagggcgtcaactcaactgggcacacttagtcagatatcgcatgcataaggcattgcgattaaatgctccactaccatatccacagcttgttactctatttcttcgtcattttgaaattcctcttgattctgaatcttatattccaatcaagagatcctttttaattggtgctgctgcaattgtttcttttggttaccgcaaagagcgtgacggctcttgggtcagaaaggggactcaacccgctaatgaagaaggcaacctcccaaatgaagataattgcactcttcttcgcaggcttatggacaagtttgatggacttcagacttttgttggtgacaagtttgatgccatggaattacaagttgacatgaggttcgatgctatggaatcaaggatcacaagagttgaagaagatgtctctttcatccgaacttgttttgatccaccacctccgcctccttcatcctcttag

SEQ ID NO: 8828 - DNA, 881 bp, Glycine max
  Peptide Sequence Number=SeqID_100513
ttggctgatataattggtaacctaaaagaagaatggcgaagacatgctgaagaagaaaacattaaaagagacgaggcgtggatgaggagggtagaagaggaaaaacagtgcactatggacacatttaaaggacaaatacaacaagctatcaagttggagttgtcccaaattgtatcacaacattcagccccacttcagccaaatgatatagaagtattagcagcaagggtaagcacgaagggaagctgtgcagcagcagagacaaatgcattagctaaaaaaccctctgagttgaatggtgacagcgtcgggttgcatgtaactgccgagaactccaacaaattagtggcagtgggcaaacagtgcgacagttttggcaccatccacaacgtgccctatgctgatgatgttgttcgcgtgagtgtggtggaagttattttcggtgatgcggaggttccaatccctacatcggaaataaagtttgtcaaagaagctttagggagttttgttccatggccaagacatttggaagcagagaaggatgtcatctcaccattgaagactgttgaggaggaaaagccacctgaggttattgatccattgggagagttggtgaagaacttgttcgacatttaccaaaggcctgttgaggtgttatgggatggtgctaaatttgggatcaataatgtcaaagatggcttcttcatcacacacgctgatgcgagcgagataatattaggagacaagtgcttaaacatcttcattctacagctatggcttattgcgagcattggttatggagcattgtatgggttccttgaacctcagtgtatccacaatgcaaacaatagacgtcaagagtgtgaaaattacattggaag

SEQ ID NO: 8829 - DNA, 81 bp, Glycine max
  Peptide Sequence Number=SeqID_100514
atgtggatgatgttgaaaatgcatcgtgatgatgttatgttattgaccttgttggatatccctggtggcggaaatatagtg

SEQ ID NO: 8830 - DNA, 144 bp, Glycine max
  Peptide Sequence Number=SeqID_100515
atggagatacccaagcggttatccgtacaaacgatttctatcatcctgacccgtgaagtcaggcgaagatacccaagtggttatccgtataaacactctttcgctatccgtcagactcagagtccggtagcatgcagagactaa

SEQ ID NO: 8831 - DNA, 588 bp, Glycine max
  Peptide Sequence Number=SeqID_100516
atggctaaatggtgtctttatcatcacaaagaaaacttcttgtacacgcattttgaagagatttgtgaaatcatgaaaaaatatgatgtagctttttctttaggtgacggacttcgtccgggatctattgcagatgctaatgacgcagcacaatttgcagagctggagactttaggagagcttacgaagattgcttggaaacacaatgtacaggtaatgattgaaggtcccggtcatgttccgatgcatatgatcaaagaaaatatggataagcagctggaagagtgccacgaagcacctttttatacattagggccgttaacaacagatattgcaccgggctatgatcatataacttcaggaatcggagctgccatgatcggatggtttggatgtgcaatgctttgttacgttacccctaaagaacatctaggactacccaataaaaaagatgtgaaagacggggttattacctacaagctggcagcacatgctgcggatttggcaaaaggacatccaggtgctcagtacagagataatgctctgagtaaagcaaggaaatacgggaatccgctgaaatggggatga

SEQ ID NO: 8832 - DNA, 163 bp, Glycine max
  Peptide Sequence Number=SeqID_100517
gtcgactctagaggatcccctgaaaggacttgacgatactcaacaaagtaaatccaagcctcctgctaggtggattgttgttaaatatttcactgatcctagaccattggaaccagaaagattgaaggcgcttcgcaaccagtgggcaaagtactatttgaaa

SEQ ID NO: 8833 - DNA, 290 bp, Glycine max
  Peptide Sequence Number=SeqID_100518
gaaaaccccaaggagttgcgggtttttttctaccaattggggccctcccttcaccacccccatgcggatggtctacggggttcataactactcctcttactacaggacgcttacctagccaacatttagatccggctctacctaaatttttctggtttactccaacatttcccacttgtccgactgttgccgagcagtttttggatatcaaacggacctccccagaagcattcagactgaatgactctatgaaattacgtcgctacttccacatggtacgggtaacgtag

SEQ ID NO: 8834 - DNA, 894 bp, Glycine max
  Peptide Sequence Number=SeqID_100519
ggtgagacattgcctacctattccagatttatgaggatgaggattgatcctcaagagtttgctgcccatctctacatccctggtaggggttttattctaaatgcagagggccatcctgggaagcttctgaggaaagatctcaccactcttgcacagacatggagtgtcctctcctacaacaacctaactcccacttcccacacctctgatcttaatatggacagagctaggttggtttacggcttagtcacaagcatggacatcaatatcggagccctaatctcagccttgatcactgctctatgcagagttagaggagttacctctgacagtttgacctatgagagcctcagcccagccattaacttggcctacattaagaaaaactgttggaatgtggatgatctgacagttaacttcagaggggctaggaaggtaagcgctcgaccagtagatattccttcttcttccgcacccccagctccttccacttctgccactcctacaccagctcctcccacttctgccacccctgtaccagcttcccaggactctcagcgctttgaagccatgcttcggaagcagttcattgagaaggtatcctggcctggaaccttaccttctgctgtgagagagggggtagagatgagacctgatgaggttgttcttcctgagccaattatgccagttatacatgagactgttgaagtagcagatcctcctacactagtacaggagagacaagcatatcctcctacacccatcatggagatgctagaagaccctaccacaccagtcctgagactgtcatccactcctccaactaccccagttttacatctgacagatgaggaggatatgcaggaccaggacatgcagggcacacaggactag

SEQ ID NO: 8835 - DNA, 117 bp, Glycine max
  Peptide Sequence Number=SeqID_100520
ggtacatcttcttgggttttgatgcaatcctactccgcaagggcattggatagaaaactccaagtagattgggtcagagatgcaagagaaggccctagggttcttataagccttagg

SEQ ID NO: 8836 - DNA, 207 bp, Glycine max
  Peptide Sequence Number=SeqID_100521
atgagagcttctttcaggacttgtttggcttttcttcctcaatgtcactcaggagaagctatgagaatttttgctgtagaagaagatcctactgtaaacagagtatggatgcctaaaagggactgccctggactggctatggcaagagcctttagaaatttttgcctaaaagactatggtgtcgcctcagtccctgatgtgtcttaa

SEQ ID NO: 8837 - DNA, 328 bp, Glycine max
  Peptide Sequence Number=SeqID_100522
atgctgacatcttcggaaagggtgcagatgaccacgttggtctctactcgtcaatcggacttggggtctccgaatgatgaggtgcggataactggaaggtatctccacttgctaccagactcttgggtcatgatagcaaaaggtggggtggtcgacaaaagcggggcttttgctcctacatatcctcaacttgcgatgaggaactcagacctacagcaaggatgggcattctcaccctgggtcaaggtttatggtgagttaggattttggcttaaggcttgtagaacagctggacgtggtatatgccaaggtgttggtttggccagtg

SEQ ID NO: 8838 - DNA, 912 bp, Glycine max
  misc_feature (9)..(9): n is a, c, g, or t
  Peptide Sequence Number=SeqID_100523
atggggtgnttggggtaccaagaaatttttggaagcaaaggcaaattcttggcaagtcaaggcgaatgggccccattcatggacatcctggcacttttgacattcggggtggtcctctttccaaatgtggatgggttggtggaccgggcagcgattgatgcttttctcgcctttcatgaccgcaaggaaagcccggttgtcgctatcttagccgatctatatgacaccttcgaccgaagatgtgagaagaacagtgcaaggattgctgtacaccagccctctacgtatggatttccaaatgttcccttgatggggagaaggggttgcattaattacaatcccatcctcgccataagacaacttggctaccctatgagaggggcaccattagaggaaggcctcacacctattattgcacgaggttttaatagcaccaacacgggggtgcttcagaaggtctgcaaggcatgggagttggtgcaaaagaaggacaaggaacttagaggcagtagcaacgggcccatcagcggctatcataggtggttgaaagcctatgcacaaagtctcgattggctcccgaatttgagaaccactaagggggtggaggttgaagcccaggaagaagacgaagagatacaggccctcaagacagaactcgagaaagctcaaatagtcaaagaaaagttcaagtcagcagctgttaggatccgaaaggagaatgccgaactgagagatgtcaatatagccaccactaaggccttagaacaagagaccaagagggcctgtagggaagaacatggccggaacaaattccgaggggctctgtggggtagtaacagcgagtttaagctccgaagagaggaaagggacaaatcgcgagtagacagtttgatcttgaaggatgaattgagg

SEQ ID NO: 8839 - DNA, 273 bp, Glycine max
  Peptide Sequence Number=SeqID_100524
atggactgccccatatggatgctctggagcatggagtgcagcatctgtggagtaaaaataaaatatgctagacctgcaaatactagagttggaaatggcatctttgaaggtgctggaggaatcattggaatctctgtggaggaagagggaggaagtgtagaagaaaaaggacttcctgtctctagtgctgaagtggaaggggcctcagatctctttcctctagccttcctaagtcctctcaaagttactattggatcatcaagattccaataa

SEQ ID NO: 8840 - DNA, 684 bp, Glycine max
  Peptide Sequence Number=SeqID_100525
atgatattcaatcaacaagtgaaagtgcccttctccattggaacatataaggatgaaaaaaacaaggatagtaaggccttgtcttcaaaggccaaggggaaggaaaaagaggaaaaagattcttccaagaatatagttaagaaggaaaaccattttgcaacaaaaggtgatatcaaaagaacatttcttcttaaacaatccttctaccttctcctatcaagggaaacatcccttagcactgtcatacctcttgagcttgaggttattcctcaagtaaaggagttgttggataaggatttggttcgtattatgagacaccaaatccctatgataggtggtatgatgaatgtgttgagtggagcaaccctattttttaaaatcactcatgcatccaacatcttcatgattcacatacacaaggattctatggtaggaataatcaacatcaaaatacagaaaaagtggagtctccaatcatctttcttccttcttcattccgctgcaattgatcttcaagaagcaaaagacttcattgatgaagaagatccaaagcttacaagctccacatggagctacatcaaggaaggccttggactattttattccaaagagaagagtcaagcagggagattccatctctccttaactatttgtcctctgtttggagagatacaaaaaatctag

SEQ ID NO: 8841 - DNA, 654 bp, Glycine max
  Peptide Sequence Number=SeqID_100526
atggttttggttgaaggtttgctgttaagggagtcgattggagacgggtctgaggttcatgggtatgacaacaaagtttttgaagtgtcatctgactcttacttctcagtgtcagatttttctagttcaattaacctctcgacaatcgaggggtctagtgacctttcgacattttttagccaattgccgacaaatatgggtgaaaagctccaagtgttgaaggagaagcgcttgcctcctccaatcacgcttatggggtacacatgggttgacggaaagaacttcaagatcgactacttcaaagtaacaataaggtcaatcgttgggaagaaccttttcaacaactcagtggggaaccctttgtttcccttctactggcagcaatgccctcgacaatacaacaagtacctaaagtctcctgatcttgcttggaatcttatgggaatcatgactcaagccagcaccgatatgaattcttttcgcacagccttaaggaaccagatcattgccgatggggtcaaggactctctgaactcaacacttctagccaacatgaagtcggatggggacaacataaacctggaggattggatgcttgcgctaatgaccgaagctaaggggttaaagatgcccaccttaaatgtcaaggagtag

SEQ ID NO: 8842 - DNA, 558 bp, Glycine max
  Peptide Sequence Number=SeqID_100527
atggtgggttctatgccttcgagctttgcagatctggtatttgtgggggaaaggattgaagtaggcctaagaaggggcaagttcgattatgccgcttcaacaagtgctggcaataggaggaccggtacaggtggagctaagaaaaaggagggagatgcccatatcgtaactgcatctcccacatggccaaagtcccaacaaacccctcacaaccccacttaccaatatcccttgcatcaatacaattactcagccaatgtcggatctcctcctagtccgacgaccatccaacagagaattgtagaagcaaagcttcatgatgaatcaatattgattcaaagatgttttgatgataacaaagatgatgacaaaggtgatgacaaaaagctcaaaggtcaatcaaagaatgagttcaagatgttcaagatagaatcaagaacaacacttcaagattcaagaggaaaggtgaagaacacttcaagattcaagaggaaatttgatttcaagaataagatcaagattcaagactcaagtttcaagaatcaagagaagacttaa

SEQ ID NO: 8843 - DNA, 399 bp, Glycine max
  Peptide Sequence Number=SeqID_100528
atggcttggcatttgttcgggttggcatgtattcctcggtggtttctattggagtgctacaataatgatggcacagagttgggcgttgatacagtggactctgaggggaggacagcgatccacgtggatgacgagaaaccagatctggcggtttgtgatgagttccgaccaaaaaacgacaaaaccggcaaagcagttgaaaaggctggaccgaggagcatcaaaggttacataatggtgagggccactgttgactccccaatgcagttactttttgttcatttatgtctcaaggaaatttcaaagggggtttaccggaaagcacaccggatcgtcaagtatttaaaatttaaacggatgaatccgagtatcgaacacagggaactagcgttaggctga

SEQ ID NO: 8844 - DNA, 216 bp, Glycine max
  Peptide Sequence Number=SeqID_100529
atggatcaatatgaattttttgggaaactgtgtttggtgggaaactcggctttgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 8845 - DNA, 1410 bp, Glycine max
  Peptide Sequence Number=SeqID_100530
atgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttcctt

SEQ ID NO: 8846 - DNA, 607 bp, Glycine max
  Peptide Sequence Number=SeqID_100531
cacaagattagtttccaagttgagcctcactatcattccccacccaaaaccttataaacttcaatggctcaatgaggaaggggaaatgatagttaaccaacaagtgaagaccttcaagagggatgaggaagaaaaactagaaaaacaaaagaaaaagaaggatagtaagcccttgtcttcaaaggccaaggggaaggaaaaagaggaaaaggattcctccaagaagattgttaagaaggaaaatcatgttgcaacaaaatgtgatattaaaagagcactccttcttaaacaatctttcaaccttctcctatcaagggaaacatcccttagcaccgccatacctcttgagcttgagttattcctcaagaataatcaacatgaaaataaagaaaaaggtatgtttgattccattactttccttgactttttaaatagtgatcaaggacttcccagggaccctaagggaataaaggtcattcctgagtgtcttactccaccatttgttgaagaaataatcattgagtttcaagaaactatggatttgaggtcaaatccttttcaagggggagggaatgatgcaatcctaccctccaaggacattggatag

SEQ ID NO: 8847 - DNA, 527 bp, Glycine max
  Peptide Sequence Number=SeqID_100532
atgactagaggcaatccaggtgacttacaaccctttgatcctgaaatagatagagcatttcatagattagataggcatagtgtgcatcttgattaccttgaacattttgtaccttttgagcatcatgaacattttgttattggtgagtctgagcattctgtggttggtaatttagaacatcctaattttgagcattctgattttgaacattctaaaaatatggctcaacctccacctcatgagagaactctaagggaaatggttgcacctgatttcacttatgaaagcttgtgcattgaataccctgatgaggatgtcccatatgttcttaaaactagactgatccacttgttgcccaagtttcatggtcttgcaggtgaagaccctcataagaatatgaaagaattccatattgtctactccagcatgatacctccagatgtccaagaagatcacatctttctgaaggtctttcctcattctttggagggagtgaccaaagattggctatactaccttgctccaag

SEQ ID NO: 8848 - DNA, 198 bp, Glycine max
  Peptide Sequence Number=SeqID_100533
atgggtgccaagtacctcgaagtggtcaaacgagggtcgcatcccaacaatggatggtccccggacgaagttagggcgcataatgaacatactttgtctctgcgtgtcttcggacacgatcgagcctgggtggcagggcatagaatgaccataatttgtctatgcgtgccaccggacacgatcgcctctggatggtga

SEQ ID NO: 8849 - DNA, 504 bp, Glycine max
  Peptide Sequence Number=SeqID_100534
atggcacgttctccaaacaagataaagagcatcaatggctcaaaagaaagtcttaaactcagtgtgaggatcagtgatctatggtttattggcacgcctaacaaatctgagcaagctgaaatggtgttagtggaatcggattacagagtgtgtgatcatcaatttaaattggtgtttattggggttattgttgtgagggagtgtgttctaggggacatcccttttagaaaatacaggtttgctggatttgcagatgttgtgactggccagtttgaacatggactattggttgatgttattggtgttgtggaggaggttgtctttcggcaagttttaggaaaaggtagaagggtagttttcaaattaaaggacttgagccagcaattgctatcttgcactttgtgggatgattattgcttgcagtttgtgaagttcttagatgattatgaaggtgatggtccaattacagttctattaagccattgtaggatcaaggaagcgtag

SEQ ID NO: 8850 - DNA, 303 bp, Glycine max
  Peptide Sequence Number=SeqID_100535
atggaacatacgaatttggggatcccacggtcatgtggctccgcttgcccccggactcttgggtcacgcatttcatttctaaacgaccatttagaggaaacactgggtccaacaaagataggagaaaatcactcaaagtgtatcaatctcacacagggtaaggattatggtgagttgggattttggctcaaggcttgtagaacggctggtcatgatacatgtcaggattttgccaggggttcggggataaaggggatgtccccacattattcccatgatacacatgcgacaaatgatgattag

SEQ ID NO: 8851 - DNA, 153 bp, Glycine max
  Peptide Sequence Number=SeqID_100536
atggactcgagaaggttccaagttagtgtaccaagtagcagctaccccagtgtagctgggggtgatactgagggccctccaaaatgttttgcaggagtataccaccaactgcttacccttcagtggcatatccgaggcaaggctcgaagttag

SEQ ID NO: 8852 - DNA, 156 bp, Glycine max
  Peptide Sequence Number=SeqID_100537
atgggtgcaagggataaatcaatcatgcacaagattgattcaaggagttttgatgataacaaagatgatgacaaaaagctcaaaagtccagatcacttcatgataacaaagatgatgacacttcatgataacaaagatgatgacattcaagaatga

SEQ ID NO: 8853 - DNA, 237 bp, Glycine max
  Peptide Sequence Number=SeqID_100538
atgcttctaagacgtttccgtgagcgatttcgtgaagattcttcaccgttcttcatcgttcttcgatcttcaaccggtctgatttccttatcgcaattgaggatacataggagcaaaagccccgcttttgtcgaccaccccaagagatcgttcatggtccaacgccttaacgtttctctcctttcaaaaccaagagatcttgcggaaaaagatcaaaacaacttaaccaatgtctag

SEQ ID NO: 8854 - DNA, 100 bp, Glycine max
  Peptide Sequence Number=SeqID_100539
atgtatagacaacaaaaagtaaaagagttaagggaagatagaatgcaaaaccaaatttatactggttcggccacaacccgtgcctacgtccagtgtgaat

SEQ ID NO: 8855 - DNA, 294 bp, Glycine max
  Peptide Sequence Number=SeqID_100540
atgaggagaaacaaaagaagaaagagataccgaattgcctgccagaccctaactaaagggggattagcctttcattgtcatgagagacttttacactttagggggttgatgtggatggaagaagatggatggatagaggaggaaaagaggataatggacatagaaagagggtttcccaagttggagatactcaggcttaggatgtattcattagagaactctaagtcttcgggcgtggtgttatctcggtgtatgggttatggccttcccttctacttcctaatctttttatag

SEQ ID NO: 8856 - DNA, 386 bp, Glycine max
  Peptide Sequence Number=SeqID_100541
gcccacttggaccttccagggtgttccaacagaaggcggtgccttctggtggaagcaacccagctcgcctgggcgagctggattcacttgaaattagtgagaaaaattgtttctgtgaagaaaatccaagccgaggcgcttccgtgagcgatttcatgaagattttccaccgttcttcattgttcttcgttcgttctccggtcttcaaccggtctgatttccttatcacaattgaggaatacgtaggagcaagggaaacacccttgtcgaccacacctttccggtttttccgacgttttcctcgaataaacgttggtggtgactccgcgcattttcctcccatggaagatgcacccgcgagcctcgcgtcgccctcccgccaaagg

SEQ ID NO: 8857 - DNA, 432 bp, Glycine max
  Peptide Sequence Number=SeqID_100542
atcacgggtctctgccagtcattcggggttcctgtcacacctagtaaggtgattcgaccgccgatcacccgggctttcatagagaagtattgcacgcccagacaggtgcagggtggcgacccgcaggcccctgacgcaccgccaccacctcctcaggctgacccagctgggtcatttgacacggagcgggcgcacgtgcagacccatgactgcctctaccagttcagccttagcctacatagccagggtttccttccttttccatgccctactccggatcagttcaaggcagaggtcgcatggcccggagattggcccgaggcccaggcaagggaggcgcccgcagaggctcccgacgatgcagatgaggcccgcatggatgaggaaatgaccgatttgctcaatttcttgggagggagcggagccacatga

SEQ ID NO: 8858 - DNA, 291 bp, Glycine max
  Peptide Sequence Number=SeqID_100543
atggagcttgcatcacttgcactgcctctcgagcctctggttggtccctccagtcctcgagtaagcacaaaggggagttgtgttgatccctcaggaaacgatcctgagacgggtgactctgatagttgtggcttgtacatagaagcagatcctgcccgcctggttgccatggggagaatttatgagggaaccactgttgttcataacactcctttgttgcctggccaagtaaaggtgagtgtggaggaggttaaagatgcagatgctccagctcctgtacccactgatgag

SEQ ID NO: 8859 - DNA, 243 bp, Glycine max
  Peptide Sequence Number=SeqID_100544
atgcagggttaccttgtggtcacccgcacctttcgtcaaccaggggcaaacgagcccgttgacgcactgagactaacattgtctcctgcacctttagtcgtcctgacccgtgaagtcagtcaggtgacacgcgggattaccttatggttacccacacctttcgtcaaccaggaggcaaacgagcccgttgacgcgaagagaccgacatcgtcttctgcaccttttgtcatccagggacagtga

SEQ ID NO: 8860 - DNA, 456 bp, Glycine max
  Peptide Sequence Number=SeqID_100545
atgacagatcttgtgagcgcggaagatgagttaaatctccgcgtgtcaacgggcttgtcggccgcgattgacgaagggcgcagaagacgatcaaaaaagaatgtttatacggataaccactcgggtatttccgcccgtcagcgtgactcaaatttgagtatgacagatcttgtgagcgcggaagatgacgtaaatatccgcgtgtcaacgggcttgtcggccgcaattgacgaagggcacagaagacgacgttactctctgcgtgctatcaggctttgcgtcttacagacagcaaaaaagaatgtttatacggataaccactcgggtatttccgcccgtcaacgtgactcaaatgtcagtatgaccgatcttgtgagcatggaagatgacgtaaatcttcgcgtgtcaacgggcttgtcggccgcgattgacgaagggcgtagaagacgacgttag

SEQ ID NO: 8861 - DNA, 267 bp, Glycine max
  Peptide Sequence Number=SeqID_100546
atgaaaagtgataaagcctcacaagatatacactctatctctcaagcttgtagtgagcttcaaaacaaggaaagggaaacaaggctcaaaagggctatcaaaggaattaattcaaggacgcatcaacaagaatcaaggcaaggctattgtgcaagcaatcaatggggcaaaacacaccaaatgattataatgatggatggctcaaattctcacaaaggtaaaatcatcactttcaaattgagctttcaaaactatcatgacatgtag

SEQ ID NO: 8862 - DNA, 438 bp, Glycine max
  Peptide Sequence Number=SeqID_100547
atgacggagaaagagatgatcacaataatagtagacacattaccagtgttttactatgaaaaaatggtggggtatgcaccttcaagctttgcggatttggtcttcatcggcaaaaggatcaaagcgggtctgaaaagaggcaaatttgatcatcctactttgataagtgagaaagttggggcaaatgaagagggtgagaatgaaggagaaacccatgctgtgactaccattcctatacggccaagtttctcaccaacccaacaatgtcattactcagccaataacaaccattctccttacccaccacccagttatccacaaaggtcatccctaaatcaaccacaaaacccaccaaccacacaaccaatgctaaacaccacctttagcacgaaccaaaacaccaaccaaggaaggaattttgcagcaaaaagcttgtag

SEQ ID NO: 8863 - DNA, 129 bp, Glycine max
  Peptide Sequence Number=SeqID_100548
atgaaagtggttgatggaggtgcaatcgacccgtctaatgatcctttacattggattggagtcaaccccaaaggttcttacttaagagctcataaggagaagttgagtggtaaaatgcaagagtggtga

SEQ ID NO: 8864 - DNA, 981 bp, Glycine max
  Peptide Sequence Number=SeqID_100549
atgggctacgtgggagtacgtgagctcagttggaggtgggcaacaggggatggtgggtttatacgtgatttgtggatgtggaaaacttgttgtgcaccatcgcccgaccgccacctagtaccacatgtgatgggtaccccatattcctacaagcttgagatgaggaaagtggtacctggagatatgtcgcgggggtcaggagaccttggggacgtcaggcgagctcctggcagtcaacagataaaaggaacaaagaccacaaagcttgaaaacgaggtcaggaagctaggagagcttctggtaatcgattaccaaggggcctctggtaatcgattactagtctgtgtaatcgattacacagaggaatgggtcactggtaatcgattaccagagatgaaaagcctaaagataccccttttacttgcatgtagtggttatgagacacatagtgttgactacgtaatcatgatggcggcacagctaatccatgatcgagtggagatggagtgcctagagggagcttgggagaccctcgaagtccaagtgatcgaggtgacgtcatccgaggaagaccctgaggaggatcttgaggagctacctcctgagcctgctgtggatgctcttgactttctagagggtgacgaggacccacttcctgaggtggattctcccgaggaagtcatgtcggcatctaaggcagactctacgaaggatagtggcccgggagagatggcgatcaagaaggtcttcttggttgcaaacactgaacacaagggaccaacgttcctagggttcattgcaagaagaaggatttgcttcttggttgatcactggacacaaaagaccaacatcttttgggttcattgcaagaagtgggagggaagtcctttgtggttcattgcttgtaaaggattttacaaggatagtggaaatctcaagcgggttgcttggggactggacgtaggcacgagttatggctga

SEQ ID NO: 8865 - DNA, 1473 bp, Glycine max
  Peptide Sequence Number=SeqID_100550
atgggtcgccaagccacgcaagaagatgctcatgtcaagaagaccattttgaacaattcaggcagcgtcggtatcgttccgctagggttttggaagaacaatggctgctgctgcttctccagttctccctcaggaactcatagtcgaaatcctgtcatggcttccagtgaagcctctaatgcgattcagaacccatcatccactgtcatcgatggttgccaccgattcaagtactacaacttcgtcttcggtgtctgcaatgggttggtttgcttgtttgattcttctcacaaagatggattcgaagaataccgcatccggatttggaacccggccacaaggatcatgtccgaagattttccgcgcttacgtctccattcaaacgattgtaaagttgtgaattatcgtcgtgcttgtgagtacacaaagtttgggtttggatatgatgatttgagtgacacttataaggttgtggtaattctcttgtatggtaaatcacagcaaagggaggttagagttcgctgcttgggtgacccttgttggagaaagattttaacttgccctgcttttcccattctaaaacaacaactttgtggacaatttgtggatgacactgttaactggctagcgcttcgcaggccaggttctgattaccaatgggaaaccgttgctatcaatgagttagtgattttttcgtatgatctgaagaaagagacatatggatatgtgttgatgcctgatggtctttctgaagttcctgttgttgagccttgtcttggggttttgaagggttgcctgtgtctttctcatgatcagagaagaacccattttgttgtttggctgacgagggaatttggagttgaaaggtcttggactcgattactgaatgtaagttatgaacattttcgtaatcatggctgtccaccttattatagatttgtgacacctttgtgtatgtctgaaaacgaagacgttctgttgctggcaaacgatgaaggcttctatggtgacattgggaactccttgctcttgttaggggatcattgctggcctgggatttggggttccaagaggtggtctgcatttctgtttccgactccagcaatgacatctccctcatcacacaaccttttgtgtgttttcaccggaaatcagtgcgtggacaagatggctaaacttgggctgaactctggggtgggttttcagctggttgagtctcccccacaggatttgaagcctctcttaatggcagatgccctgggagttgaattcctgccaggttgtgccattggaggcatagttgagcatgcggtgaagaggaagcgttttggaggaagaggagaagatgaaggaggggatcagagagttgtgattatgacacggaaagctcccaaacggttagatagcccaacctggtggttgctttcggatcacaatgttctcaaaagttcagtcatatgctgtttcgaatga

SEQ ID NO: 8866 - DNA, 240 bp, Glycine max
  Peptide Sequence Number=SeqID_100551
atggaattttgtgcaagaaaatggaacaatagaagtgaaaagaggaagaagaacaaaggacaattgagagaaaaagagagaaaagagtttgatcctaaagcttgcacaacaaggaaaactgccaggaaaccacattacaagcgaaacctcaaagagagttgggcttcgtcctcaaaaggaaacaacaccagaaaatctagccttccatggattcaaacagaaaacgcaaatgaaacatga

SEQ ID NO: 8867 - DNA, 177 bp, Glycine max
  Peptide Sequence Number=SeqID_100552
atgaaattgacgcaattgaagataaatggagcattagttaatgcttttattgaaaggtggagaccagaaacacatacatttcatttgaagtgtggcgaggcaactattacccttcaagatgtttttgtgctacttgagagatgtgcatcgcaacagactatcatgctaaatcaatag

SEQ ID NO: 8868 - DNA, 123 bp, Glycine max
  Peptide Sequence Number=SeqID_100553
aatgaattgaaagattcgatttcgggaacttaccgattgaagactgaagaacgactgtcataccctaatttcgtccggggacctttgcttgatgacatgcgacctttctttggtccttgtgag

SEQ ID NO: 8869 - DNA, 756 bp, Glycine max
  Peptide Sequence Number=SeqID_100554
atgtacgccgcaccggccggcagcacggtgctgattgaccgcaactgccacaaatcgctgacgcatctgctgatgatgagcgacatcatccccatctggctcaaaccgacgcgtaacgcgctgggcatcctgggtggcatccctaaacgcgaattcacccgcgacagcatccagcagaaagttaacgcgaccccgcgcgccagctggccggtgcatgcggtgatcaccaactcaacctacgacggtctgctgtataacacgcaatacatcaaacagacgctggacgtgccgtccatccatttcgattccgcctgggtgccgtacaccaattttcatcccatctacagcggcaaaagcggcatgagcggcgagcgcattcccggcaaggtgatctatgaaacccagtcgacccacaaactgctggcggcgttctcacaggcgtcgctgattcacatcaagggcgattacgatcacgacaccttcaacgaagcctacatgatgcacaccaccacctcgccgagctacgcgatcgtctcttcgattgagaccgcggcggcgatgctgcgcggtaatccgggccggcggctgattaatcgctcggtggagcgcgcgctgcattttcgccgcgagatccagcggctgcgcgaagagtctgacggctgccgggcgacgaggcgtggcacggctttacccacgccgatcgcgatcatatgtaccttgatcccatcaaagtcaccatacttacgccgggcatga

SEQ ID NO: 8870 - DNA, 417 bp, Glycine max
  Peptide Sequence Number=SeqID_100555
atggtgacaactcgatctaattctgaaaatccagacacaatggagagaattttggagatgctaatggaggaccgacaaaaccgagatgcagaacgacaacaacttgaaacatgttttgcgcgcctagaagtcatgttggaaaatttattcaagcattcagatgatggcactcccaaaggttccgtcaataaagaagagacacccaaaaaccactccggcgaaggaaaaatagaacgatggggagaattggaaatccccatatatgatagggaatctgatgcttatagttggataaataaattggaacgcttctttcaaatgagagatatactggaagaagagaaaattcaagcagttatggtggcgctagatggaaaggctatcttggttccaatggtgggagacttgcaattctga

SEQ ID NO: 8871 - DNA, 516 bp, Glycine max
  Peptide Sequence Number=SeqID_100556
atggtagaagtctccacagaggccattgcctccctcgcccagtattatgatcagtcgttgaggtgtttcacctttggggacttccagttatcacctatggtggaagaatttgaagagatcctaggatgtcctctagggggaaggagaccataccctttctcagggttctatccctcattagctagaatttctaagatagtccaaatctcagcgcaggaattagaccacagaaagcaagtcgaaaatggggtggttggaatacagagaaaatgtttggaggcaaaagcaagaatcttggcagaaatcgacgcttttctcacctatcatgaccacaaggaaagctcggttgtcgctatgctagccgacttatatgacaccttcgaccgaagatgtgagaagagcaccaaggccaaagcgatggcggacacctactccgcccctgaggagatccaccgacttctcagtaattgtcagcatatgatagatttaatggtccatataattagaaaccgctag

SEQ ID NO: 8872 - DNA, 729 bp, Glycine max
  Peptide Sequence Number=SeqID_100557
atggcgcgcgtcagcagtgacgcctccgccagccagccgatgatttgggttgaacaggtgagcgtgccggattatctcgccggcaacgggctggtttatcaaaccagcgacgtgaagtacgtgattgccgccaataatctgtgggccagtccgctcgaccagcagctgcagcagacactggtgagtaacctcgggcaggcgttgcccggccggctggtggccagtcagccgctgggtgacacgcacgatacgctcagcgtgcacgtcaccggcttccatggccgctatgacggcaaggtggtcgtaagcggtgaatggctgttacaacatcaaggccggcttatcaaacatggctttaatctgacgctgccgcagaccgaagatggctacgatgcgctggtgcgcacgctggcgctcggctggcagcaaacggcacagcaaatcgctaacagcgtgccagatatggcggtagcactgagggatttgtgtcgatttcacggcaaattgatgacattggcacctgaaatgagggaaacgaggtatgaagagacagaagagagaccgcctggaacgagcacattcacgaggctatcaggcaggcattaccggccgctcaaaagagatatgcccttatcaaatgatcgatgcccggtctcactggttgggaggttggcgacaagccatggaggacaggtcggcggtggcttaggcaccgtcggatgtctgtaa

SEQ ID NO: 8873 - DNA, 516 bp, Glycine max
  Peptide Sequence Number=SeqID_100558
atgaagttcagagttctacttggtgcttccctgctcgcagtcgtcgccagcaccggtgcttatgcagccgacgcaatcgtttcgcaggaacctgccccaatggcagctcccgccttctcatggggcggcgcttatatcggtggtgaaattggctggggctggggccgcgccaagcttgacgacaagtccacggatcagtccaacgagttcaagccgaacggcttcatcggtggcgtctatgctggctataacttcgacatgggcaacaatgtcattctcggcgttgacggcaacttcgactacaacgacctgaagaagtcgcacgactatatttcgaacagcaacgctgttcagacttcagctgaaacgaagctgcagtggtcgggcgctgttcgcgcacgcgctggttatgccgttgaccgcttcatgccctacatcgccggtggcgttgctttcggcggcgtgaagaactcgctcaatgtcggcggcagcgactataacaacgacagaccctga

SEQ ID NO: 8874 - DNA, 321 bp, Glycine max
  Peptide Sequence Number=SeqID_100559
atgggatcttctctaccaaaagttatgcctctgtggtgggaattcaactcctgggttagggaggacagagttcttcattgtaggcccatggataatttcctccagcactcctccatagcaggctcgaaggtttccaatagaagaaggaaaatatggtggatagcagctacaaggagatcttctctcgtgtgctatcctgtagtacctctgttcaataaaaaacatatatatagacaatacaagagagagagaagggtagtggcagtcacaactcactgctgccctcctgaacaagcttaccaactaagctaccaaaagtag

SEQ ID NO: 8875 - DNA, 654 bp, Glycine max
  Peptide Sequence Number=SeqID_100560
atgcgttatgtggaagccgcagaggagtcattagaaaccactttccagtcttttgaggtggtaagcatttcctccgtggactccttcgctgggcagccttgcctatccgatgcagcagtaatgatggcccgggttatgttggggaacggttacgaacccggaatgggtttaggcaaagacaacggcggcataactatcctaataaatgccaaaggaaatcgtgggaagtatgggttaggctataagcccactcaggcagatataaagagaagcatcacgggaaggaagggcggtggtcaaagctcgcggttgagacaagaaagtgaaggaagcccgccctgccacataagtagaagctttataagcgcgggtctgggagacgaaggtcaagtggtcgcaatatacaaagatgatgttccaagtacattggatttggtacgacctcgccctcctaatttccagctggggaattggcgagtggaggagcgccccgacatttacgtagcgagcataatatccgatgacgagtcccccgaaggtactaatacctgggacccgcctatcaacttcgagcaagaaatgaatcaaacggaagatgaagggaacgaggatgtgagacttcccccagaaattagaaaggatagtcgcccatga

SEQ ID NO: 8876 - DNA, 909 bp, Glycine max
  Peptide Sequence Number=SeqID_100561
atggccacattagtagcacagcaaaaagcggctgcttttttccttgcaatctctggaaagaatattgataccgcggcgttagattactactcgcagaaaattgaaacttctgcactttctctggagcaagttgcgcaaaaattcattaccggcacctcaagcctgaacggtctgacggcttctcaaatcgtaaccaaggtctacaccgcagtgaacggcagtgcccccagcagcagcgtgcttgccgatcttttagcgggcaaccccaccacggcatccgttgttgccaaggtgattaacgacgtacttagctacagcggttttgattcaacgctgctgacagcacagagcaatttcgaagctcaagtcgaaaaaaccctgttccctgtcgcgacagccgcatcgtcggccggcgcagctgacgtacagggtgttttccatgtcgtgggcttaacgcaaactcaggacggcattacctactggggaaccgtattggcgcagggcagcaaaacgctggcggcggtcgcacaaaccttcgtgaacaacagcccgctgaaaacgttaagcgatagcgatttcatcaacgccatcttccaaaacagctatgaacgcgcaccaacttcggccgaaagcagcagctatctcgccttgctgagtggcggctcgactcgtggcgacgtcgtagctcaagtgatcgcagcactgaagggcaccgttgccgccggcgataccacggcccaacagcacttccaggcggcgacgcacgtgtggcaaccgggtgaactgccggctctgaactatcaggaacaagtcgcagcagccttcctggcaattcctggccgtggcgtcgatgcccgcgggctggacacctggagcaaagaactgtttgccggtaaaacttatgcacag

SEQ ID NO: 8877 - DNA, 303 bp, Glycine max
  Peptide Sequence Number=SeqID_100562
atgactcatcaggattttcaagtgcaagccattggtcagtttgctcaagcgacctgtgctcctgagtttggacttccaagaccgttcaatcagagattactcgtcttgcacgttggtggggttgctgtaaaacaacgaggacaacccttcccttgtgttcaggaatcctctacaacaagagacccacggtctcttaatcccttttcagaaataagaagaagagaagaagagatctctcttaaaagagatagattgtacaatgaagaacaatcaaaattctttattgaatatgcaagtggttga

SEQ ID NO: 8878 - DNA, 75 bp, Glycine max
  Peptide Sequence Number=SeqID_100563
atggataagagcctgaaggtgaaaaagaggctcagttttgaattacaaaaagtagcagctgggctaagcgcataa

SEQ ID NO: 8879 - DNA, 207 bp, Glycine max
  Peptide Sequence Number=SeqID_100564
atgatcccggtttcgttaaccgttggattttcatgcaatttggatatgctgtttgaaattcaattgcaaaaacttacaccgttgggatttgaatcgcatgaagacagtacaagtggaggtttcaatcttttctccgtctctctgacgtttgggaattctatcggagcagtcggaggaataactgatggaatctcagggaaccgctaa

SEQ ID NO: 8880 - DNA, 114 bp, Glycine max
  Peptide Sequence Number=SeqID_100565
atggagtcgtttggcacctcgatgtcgactcatcacatcctggggttgaagaaggtcccaagggttcggttgttcgccgattcaagtgggaaaactgcgaggagccaaccctag

SEQ ID NO: 8881 - DNA, 324 bp, Glycine max
  Peptide Sequence Number=SeqID_100566
atgtacccttccttgttctctttgaaaaacctagtagatgtaccctccactagaactgatccacaagagatgtaccctctcttgttctcagtcacaacaacccaagtagatgtaccctctacttgtacaacaaaggatgtaccctccaatgtgttaagacaaagttctcaggcagttagtcctttgaaactttgtgaatggagacacaaaagaattcaagcggttagtcctttgttcttttggaaaagggagaagagagacacaaaaagaattcaggcggttagtccttggcgaattctttttggcaaagggagtagggaatga

SEQ ID NO: 8882 - DNA, 333 bp, Glycine max
  Peptide Sequence Number=SeqID_100567
atgctaagcattatatttgggatgacccctatttctggaagttgtgcagtgaccgggttattaggagatgcattcccgaccatgagattgactcagtcctgcaattctgtcattcttccgcaccaggtggtcatcttggcatacagaggacagcttgcaaggtgcttgactgcggtttctattgacccaccatcttcaaggatgcgtggagaatctgtaggacttgtgagccttgtcagagagcaggcagctcactttcatggagacaataaatgcctcaacaacccatgttgttatgtgaggtgtttgatgtctggggtttggagtccctag

SEQ ID NO: 8883 - DNA, 526 bp, Glycine max
  Peptide Sequence Number=SeqID_100568
gtcgactctagaggatcccgtgtatagccctttgaagagaaggacatgtagtcctctaaaggcgagggcatgcagccctctaaaggcgaggacatatagtcctctgaaggcgaggacgtgtagtcctctaaaggtggcgtgtagccctctgaaggtgagggcgtgttgccctctgaaggtgagtgcgtgtagccttctgaaggcatgggcgtgcagccctctcaaggcgaggacgtgtagtcctcttatggtaagggcatgtaggcctctgaaggcaagggcatgcagccctctcaaggcgagggcatgcagccctctcaaggcgaggacatgtagtcctctgaaggcgaggacgtgtagtcctctaaaggtgacagcgtgtagccttctgaaggcgaggacgtgtagtactcttaggtcgaggacgtgtagtcatttaaaggggagggcgagaagccttctgaaggcgaggacgtgtagtcctctgaaggcgaggacgtgtagtcctcatatggtgagggcgtga

SEQ ID NO: 8884 - DNA, 663 bp, Glycine max
  Peptide Sequence Number=SeqID_100569
atgaatgtcagagccctcatttcagggcagattacttctatggcccagtctaactcctcaagacttggatttcctgctcttagcacagctttatgcaggaccagaggagttgcctccgacaatcttgtctttgaacgactaagcccattcattaatttggcatacataaggaagaattgttggaaccctgatgatccaacaattattattaggggggccagaagaccaagggcaaggccagttgagactccttctacatcagcagctcctcctccagctcgtattgcagcagctccttctaccccacctcctgtagagtttcaacgtttcgaagccatgcttcgaagcatacatcatgggcagattattttgctgcaaacctggccatggactcaacctcctcttcacagggacgacgaggatcccgccgctcaggaagctgcaaccactcctgaaaagtcccctgaggccactccaaagcctctgggaccaatggtagataccacttctccacagcaagcagtagatacttcaacgcctgaagttcaaaccaccccagtcctgtctccgaacacctctcttgtagctactcctgtattgcatttgactaacaaggaggaggttcagacatgggacacccaggaccaatcacaggatctttaa

SEQ ID NO: 8885 - DNA, 441 bp, Glycine max
  Peptide Sequence Number=SeqID_100570
atgcagctaccgcaaaagcccttgaacaagaaaccaagagggctcacaaggaagagcatggccgtgacaaattccgcggagcattgtggggcagcaacacatttatgcgagacagagaccaacatgttagctatcatcaccaagtaccaagaagaactaagtctagccacgacacacgagcatagggtggcggacgagtttgcccaagtgtacgcggaaaaggaggctagaggaagggtgattgactcgttacaccaagcggcaaccatgtggatggaccgatttgctcttaccttgaatgggagccaagaacttccccgattgctagccaaggccaaagcaatggcggacacctactccgcccccgaggagatccacgaacttctcgactattgtcagcatatgatagatttaatggcccatataattaggaaccactag

SEQ ID NO: 8886 - DNA, 365 bp, Glycine max
  Peptide Sequence Number=SeqID_100571
atgggacaactggccaagcagatagctgacaagtcatcaaacaactttggagcaaatacggaaaataatcctaaggaggaatgcaaggctgtgatgaccaggagtaaaaggtttgtggaagctgaggatgaagaaaatgtggtagacaaggagcaaaggggtgaaaagaaaggtgctgaggtcaagaaaaatgatgtgaagggtaaagagaatcaggaaaaagaaaagaaaataatggtccaaaataaagagatggaggaccaagaaaaagaaaaagaaagagaaaaagaaatagaaaataagaaaaatgaaagagtagaagtggaaaggctgtggaagagagtgtggaagtaccatatcctgtg

SEQ ID NO: 8887 - DNA, 522 bp, Glycine max
  Peptide Sequence Number=SeqID_100572
atgacccaaaagctggtagcccgcggagagagcttacggttatccgcacctcgtcattcagtgaccccaagtgtgattgacgagcggaggccaatgtggtcatctgcgccctttccagaggtgtcagcattttctggtggagactttttcaagtctcacaagttatccagaactacaggcggcgggcccgatgacatgcggagacaaattatggtcattccgcacacccttttgccattcaaacacagtcgtgtccaatggcacgcagagataaattatggtcattctgcgcccttttgtcatccagaggcggcgggcccgatgacatgcggagacaaattatggtcattccgcacacctttttgccattcagacacagttgtgtccgatggcacgcagagacaaattatggtcattctgcgcccttcgtcaatcgcggccgacaagcccgttgacacgcggagatttacatcatcttccgcgctcacaagatctgtcatactgacttttgagtcatgctga

SEQ ID NO: 8888 - DNA, 291 bp, Glycine max
  Peptide Sequence Number=SeqID_100573
atgggggccatgaaagagcaaatgaccacattgatggaatccataatgagtatgagaaaaatgatagaggtcaacacggctactgtccttgctgcaagtaccgccactaaggtggacccgactcacccatctggccttaatcaaagcaagcattccttcccaccatatggcttgcctcccaactatacaccacccaatgttacacacgcttccgatgagaatgtcgataactctgctcccatacccattgagagccaacatccccaatctggtcatgcacaggtcccttaa

SEQ ID NO: 8889 - DNA, 123 bp, Glycine max
  Peptide Sequence Number=SeqID_100574
atgggggaaccgcttcaagctcagccgaagaaggtatgggctcaagcggagcaacctcgttgggtctcaccaatggaagttaagcttcaggccaggctacttgctcaagaaaatgctccatag

SEQ ID NO: 8890 - DNA, 269 bp, Glycine max
  Peptide Sequence Number=SeqID_100575
atggcattagaagaagggaaggtgaagatcgagaagttcgatgacagagatttcagcttttggaagatgcagatagaggattatctatatcagaagaagctgtatcagcccttatcagatgttaagccagacgacataaagcaagaagaatggaacttgctagatcgacaggctcttagtgtgatcagattgacattagccaagaacttcgcattcaacatcgtaaacgagaagactactgcaggcttaatgaaggcgttatcagatat

SEQ ID NO: 8891 - DNA, 231 bp, Glycine max
  Peptide Sequence Number=SeqID_100576
atgggtgtgcctttggatttggcaaatgacttgaggaaatgggggtacaggactttcaggctttgtgatgttactaaaaatgtaactacatattctttgttgagaaatgagtatcacaaggttattaaaattgacaaaggatggaagaagtttgcttatgattatggacaagcaaaaggtgatgaaattgtgattgagattggacaaaagaagggaacttggttgatgtaa

SEQ ID NO: 8892 - DNA, 210 bp, Glycine max
  Peptide Sequence Number=SeqID_100577
atggaagtgcaaatgattgctgatagaaaaagaccaaagcgaataatggaaaccatggagagcaaatccaaaggggagagaattgaaaggcacaatcaaaatcggaaaaatgaaaatggcttcaacagcgcagacccaagcagaacgggaagaggccaaagaataagttcagcgtgcctcgagactgcaaaaaaaatcatgggtaactga

SEQ ID NO: 8893 - DNA, 264 bp, Glycine max
  Peptide Sequence Number=SeqID_100578
atgggcttcatatggagattgttggatattggcgatgatgcggtagagacttcgagggggtgcgggcggcaaagaggtaagcgacgagggatagggacagaagaggatgttggtggcaaagaaaagaaaagggtaagagggaggctgaagaaaagagaagggttagggttaaagagaacaatcgccaaaaggaatgtgggtggtggcactagtgtttggtggagctgtggttgtgaagggtgggcgttaactgttggaaactga

SEQ ID NO: 8894 - DNA, 153 bp, Glycine max
  Peptide Sequence Number=SeqID_100579
atggcaatcctttcggtgggcgcgcgcatagtgcaagatgagctcgcttcgcgcgcattagtgacttctggcttagcgccagtcacacacgctcaggctggaggtgaagacggtgcgcttagcgagttacgctcgctcagcgcctctatatag

SEQ ID NO: 8895 - DNA, 204 bp, Glycine max
  Peptide Sequence Number=SeqID_100580
atgtttgcttacagtcattgcgctaagcacaagcctcgcgctaagtgcatctttggtcatgcgctaagccacgagtctcaagcgcttagcactcaacccttgcatcttaggctgatttggtccgctaagctggccaaggctaagctaagccaatttcaatttgaactgaattcggctaagaaacggcccgaccgcaaagcgtag

SEQ ID NO: 8896 - DNA, 357 bp, Glycine max
  Peptide Sequence Number=SeqID_100581
atgaggattgatcctcaagagtttgctgcctatctcaccactcttacacagacatggagtgtcctcttgtacagcaacctaactcccacttcccacacctctgattttaatatggacagagccaggttggtttacagcttagtcacaggcatggacatgaaaatcgaagccctaatctcaggtcagatttctaccattgcccaaagtaactcctctagactcggatttctagcctcgatcactgccttatgcagagctaaaggagttacttctgacagtctgacctatgagagcctgagctcggccattaacttggcctacattaagaaaaactgttggaatgtggatgatctgata

SEQ ID NO: 8897 - DNA, 300 bp, Glycine max
  Peptide Sequence Number=SeqID_100582
atgccttatgaaccctctggtacttatgccaccggtgcttgggaggcctctcatcctatacatgatgttcacaacctgcgagatgaactactctctgttggaaagaatgtgttgcgctttggtatgggcatcccatcgcctaaggcaatatatgttgagccatactacttggttggtatccaagatggacccactcaagttttgctatctgagttcaacatcgtctacgtcacccaaaaggcgataaagggaagcgccttggcagactatttggctcaacaacccctcaatgattactag

SEQ ID NO: 8898 - DNA, 729 bp, Glycine max
  Peptide Sequence Number=SeqID_100583
ccagataacggtcgccgatgtggtcgatggccagaatattcaggacaacgccatgaccgctgccgaaaacctgattaccggcaacccggatctcaccgcgatctatgccaccggcgagccggcgctgctgggtgccattgccgcagtagaaaaccaggggcggcagaaggacattaaggtattcggctgggatctgacggcaaaagccatcagtggcattgacggtggctacgttaccgccgtgctgcagcaggatccgaagaaaatgggtgaagaagcgctgaaagcgctgaatagcctgacggccggcaaaaccgtgagcaaaaccattctggtgcctgccacggtggtgaccaaagccaacgtcgacagctaccgttcgctgtttaacatcgggaaacgcgttcagcgtgccggtgcgactgacggtgatcgccgccgccgcgctggcatgctgcagcgccagcaggtcgggcgcgacgccgcgcagcagggcagacgccagcagcacggcgaggaaggtgtcaccggcgccggtggtatcgacggccgcgacgttgatcgccgggcagtacacgcgctgattgccacgcatcagcagcgcaccggcagcaccctgggtaatcaccagtgtgttaacgccggtgggttgcagcagatcggcttccggttgattgactaccgcgatgtcaatcagtggccagagatcggcgaagtccggattgaccg

SEQ ID NO: 8899 - DNA, 552 bp, Glycine max
  Peptide Sequence Number=SeqID_100584
atgggagctggccatgcccgaagtcgttaccttaaccgcaaggagggggatgccgaaggcagggctagtgactggagtgaagtcgtaacaaggtcggaacaagttgataggagctacttttttcacccccatccatgtcgccacacgggggcgacatggatgggggtgaaaaaaggaaagagagggatggggtttctcttgcttttggcatatcgggccccggcgggaggcccgcacgacggagctattatctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 8900 - DNA, 444 bp, Glycine max
  Peptide Sequence Number=SeqID_100585
atgtctcaacatattggttatacacttgtgaattttagttcaaaacgagatgtctaccttggagtctacctgaatggcggacactggcaaatggtcgtcattctgcctaaggaaaacctagttatctggttttgttctttacataacaggccaaacaactatcttaagggaataattaacagtgctttgaaaggacttgatgatactccacaacctaaatccaaggctactgctagtttgattactattaagtgtaatagacaaaaaggaagcattgagtgcgactattacatcatgcactggatgtccacgatagtcttaggatctttcaggaataattgggaaatgtattttaatgaagttagaccattggaagtaaagagattcaaggcacttcgcatccagtgggcacaatattatctaaaagttagaaataaaacatag

SEQ ID NO: 8901 - DNA, 282 bp, Glycine max
  Peptide Sequence Number=SeqID_100586
atggccaagttcgacccagacatagtcctcgaattttatgccaatgcttggcctacggaggagggcgtgcgcgatatgagatcctgggtgagaggtcagtggatcccgttcgatgcggatgctatcagccagttcctgggatatcctttagtgctggaagagggccaggagtgcgagtacgaccagaggaggaaccggtccgatggttttgatgaggaggccatcgcgcagttgctgtgtataccggggcaggattttgcccggactgctgcagggaggtga

SEQ ID NO: 8902 - DNA, 745 bp, Glycine max
  Peptide Sequence Number=SeqID_100587
aaaattctctaaaccttcaaagaagatagaaagtaaaaacaacaccttcacatgcttcgcatgtgggaagcaaggtcacatcaaatatgaatgtcctatctaccttagaaaacaacttgctgaaaagaaaagaaataaagatagaaaacagaaaaggacctacatagcctgggaagacaatgcatccacatcctccagctcttctagtgaagaagaagttgcaaatgtgagcttgatgaaagattcaatagatgagtcctcaaccattgaagaaactaaggtaacttctaaatttaaagaagttttggaagcatttaatgaaatgcttgaagaagcgcaaaggcttgctattatgaacaataagttgagaagcaatttaaaactgcatatcactaaattggcttcaacacaaagtgagctggataaattgagacaagaaaatcaaaaacttgtttcgagttataaagccactagatgtgtttatgcatccacttctcttaatatggatgattacaaatctttacaaattgagtttgaaaagttcaaaaagaatcgctatgtagaacgtatgaagttgcaaactaagctttcctatcttaaagatatgtttagaaaaatgaacaaaggaaatagtagtcttagtcacatgctcagtgtgcataagcatactactgataaaactgttttggggtataacaagcaaactaccttttcgaagaaaaccaagtttgcatcgtccaacaag

SEQ ID NO: 8903 - DNA, 339 bp, Glycine max
  Peptide Sequence Number=SeqID_100588
atgatgataacaaaagatgatgacaaaggtgatgacaaaaagctcaaagatcaatcaaagaacaactcaagtgaatcaagaacaattcaagagttcaagataagaatcaagaagaattcaagactcaagaagaaaagggtacatctacttggggattgttatactgagaacaagagagggtacatctcttgtggatcagttcaagtggagggtacatccacttgggttttcaaagagaacaaggtaggatacatcccttgtggatctttggcttgtaaaggtttttacaaggttgaaagaaatctcaaaaaccgtaggttgcttagggactggatgtag

SEQ ID NO: 8904 - DNA, 297 bp, Glycine max
  Peptide Sequence Number=SeqID_100589
atgatctggttgctggacgaattacagcagatcagggaccagctagaggagtccatcacagagaaagtgacgaggcaagtcatggcatccttcagccaacttcagttgcagatgcaatctcagggacttgcagtgcctcctgagcctctggttggtccctccggtcctcgagtgagcacaaaggggagttgtgttgatccctcaggaaatgatcctgagacgggtgactctaacaggtgcggcttgtacatagaagcagatcctgcccgcctggttgctgtggcgtccccaaaataa

SEQ ID NO: 8905 - DNA, 297 bp, Glycine max
  Peptide Sequence Number=SeqID_100590
atgaatgatggctcatctacaaggccacaacagcagatgccaagtctctatgaccgaaccaagaagctggaagagactctagctcaattcatgcaagtgtcaatgtctaaccaaaagagcaccgattctgcaattaagaatctagaagtccaggtgggccagcttgcaaagcagttagctgaaagatcatcaaacagctttacagcaaacatagagaaaaatcctaaagaagagtgcaaagctatgatgactagaagcaaaacggcgattcaagcagaggaaagtagagttgattag

SEQ ID NO: 8906 - DNA, 372 bp, Glycine max
  Peptide Sequence Number=SeqID_100591
gatcaatggcatcttcgtcgtcatgctcatcgagcatacaaactaggtctggtccagttgatggtgacgtcttgtggatgcaacccaagcatgtttcagaacatgtttggaatggggaaccagatagaaaattacatattagacgagcagtgccgacatatcaaggtgaagaacaaataccagaggaaattgttcctctacttcggcaattgcagcacgtatgcgtggggacctgccgtgcttgcgtatttatatagagagatgtgcagcgccaccgattacaaagttaaatcaatcggaggtatgtgcatcttaatcccaatgtgggcatgggaacgatgcacgactttagctccaaagaggactcctccc

SEQ ID NO: 8907 - DNA, 76 bp, Glycine max
  Peptide Sequence Number=SeqID_100592
ttcaacacagaatattacttctgtgattttagggactgctggggagaaaaacaataggagaggaagaataattctt

SEQ ID NO: 8908 - DNA, 921 bp, Glycine max
  Peptide Sequence Number=SeqID_100593
atggcagagccatcgaagaagagaaagggatcatcctccaccgctgctgctgctgcccatcgccgccacggcccatccggagcacccacagcacctattcctccttctttgtcatctccaagatcatcaactttgttttcatccgatgatcagcgtctacggtacctttctcagttttcttctagaataatcttagaccctaagtacctagacgtagaattctttaatgatgaaacgtttgattgttatcaagtgtttcaaaattctggtcttgttgatttcatgtcattaaaattgccatattatcctgaacttgtaaaggtcttctactgcaatttaaaaattcaggatggtattattatgtctgaggtgcatggtgcaccttttgagggcaccattgttgatgactggaaattcgattattcaagtcatgatgctcgtcgcatggtctacaatgatcaagctgaaatgaccgcacaagcctctgaggaggatttgattcttatgtgggcttttcttaccggtcgtcagatcgactgggcccatttggttcggtaccgaatgcataaggcattacgggccaatgcacctcttccttatccacatttgattactctatttttgcgtcattttcaaattccgcttgatgatgaaccctttgttcaagtcaagcgttcctttgcaattggtgctggtgcagtgacctcctttgggtatcgtaaagatcgaaatggacaatggctgaagaaggatgcactccctcctcaagatgaacgtactccttcacctccccctcaacgtgaagattccgcactcatgaatgaagtcctctccgaattacggggtcttcgttcttatgttggtgaccgcttcgactcgttagattcacgctttgccggtatggacattcgccttacatag

SEQ ID NO: 8909 - DNA, 435 bp, Glycine max
  Peptide Sequence Number=SeqID_100594
atgaaaggaaggcataggtcacatcttagacctcactcccatagaagagaaaaggaaagaaagcctcaagaggctaacattaacctcccatacttccatgggaaggacaatgtagaggctaacttagtttgggaaataagggtagagcaacaacttaaaaagaagtctacatcaaaatcttatggctctcactcttatccaaagaaagaccaaggtcaaggcatcttaggggggacaccttctaagcccaaagatgataaggggaagactatagaaaagcaagtccctaaggctagtatgcaagagaagactagctctaataagttctttaaatgtcttggaaaaggacacattacctctcaatgccccaccacaaaaaccatgatcatgaggagtcaagacatttatagtagccaagatgaggctactacgtga

SEQ ID NO: 8910 - DNA, 660 bp, Glycine max
  Peptide Sequence Number=SeqID_100595
atggctaacaacccttccagtgatcaaaagaaggccaagtcctccaagatgaatgtgagaatccccaagtttctggacttggagtggttttctcagcaagggtttaacttgcctaatctgctcgaagcacagggtttgtccaagtttgtgcaggtgaaaggaactttctacccggagttgttgattgtgcttttgccaatatggaaggcagtagctagactggacatgggtggagtctgcaagtttgaagaatctactgatggttacaacaagatgcaaacttacaaaggtatgctccttgagccaacaaggaatatgaggaaccgcctagttgtaggtggtttaactgttgaagacagaatgctcgtttatctcataacctacattgtcacaccaaggtctagcaaccatgcacagatggttgacaatgatttacagatcgtgtatggtctaaaatcagccaccgcaacagcaatcatggaccaaatggaagaagaagcggaagatgaagctcagcaagagcctgcacaccaatgtagtccttttgagtctcttatgattcagaagatggatgccatgcttcaccttcatcaagagcactcagtcgatataaggatgaagcgtggttatgttcttgtgcttggttctgttgtctattga

SEQ ID NO: 8911 - DNA, 613 bp, Glycine max
  Peptide Sequence Number=SeqID_100596
gagggtgagggcgaggccagctgagctcccttccacatctgtagctccgactctagcatccacttcaacagcttcgtcagtcctagctcagagtgattctcaacactttgaagccatgcttcagagcattcatcagggacaaatcattttactccagagcttacaggtgatggcgcctccaggatccattcctactgttgagcagtttttggcgagtgtaacctggcctggggcccaaccttctcttcacagggaaaatgaaggtcccacagcccaagtaccacaacatatggaggatgagtcatccgaggacaccattccagagccattcattgtagaggaggaggcaggtgagacacagattagacaggaagctgctgctactcctgagagatctattaaggtcactttagagcctcctgcaccagtggtggacctatcctcgcctcagcatgtagtagatccctccactcctatactagagataccagaggacctgaccacacttgtcctgactctgaacacctctcctctagctactccagtacttcatctgacagatgaggaggctgttcagacacaggacactcaggaccagtcacaggaattctaa

SEQ ID NO: 8912 - DNA, 209 bp, Glycine max
  Peptide Sequence Number=SeqID_100597
atggtacctgaggatgctgagaaggaagtgaaggataaaatgactatgaaattagctctctggaatgaaaatgattacctatgcaagaatttcattttgaataggttagctgatgatctctatgattattatagcccatataagtctgccaaattagtttggctggctctggaagagaagtatgatactgaggaagctgggactaaaaa

SEQ ID NO: 8913 - DNA, 198 bp, Glycine max
  Peptide Sequence Number=SeqID_100598
atgagtgaacggattgtcatcatcaaaaagggggagattgtggaagcaatgacttccaaggttattttgatgatgccaaagaatcatgagctaagcaaattccacagattcaagaatcaagtttcaagaatcaagattcaagaattcaagattcaagaattcaagaatcaagtttcaagaatcaagattcaagaataa

SEQ ID NO: 8914 - DNA, 249 bp, Glycine max
  Peptide Sequence Number=SeqID_100599
atggacccactccctgaggtggattctcccgaggacgtcatgtcggcatccgaggcagactctacggaggatagtggccctggagagatggcgatcagtggaggctcttcatcatatcattattttggggatgccacatcatcaatgtcgatggaagctctcttcagaaaattgcttggatatgaaatcgagttgattcaacattctctgactcttataatgaagaagaagttgcaaatatgtgcttga

SEQ ID NO: 8915 - DNA, 576 bp, Glycine max
  Peptide Sequence Number=SeqID_100600
gaactcgagagacgccattgggatgaggagttgactgactttctggacagcaacattaatgttgccatggatactcttaacacattcttgaagacccctattattgtggaagagggggaaacactttgttcttactctagatttgcacccctgaggcttgatcctcaggagttagctgctaagctctgtatcccagggagaggattcgagcttaatgctaatgggcagcctttgaagattctgaggaagaacatgaccactcttgctcagacttggagcgttctttccttttctatcctcatccccacttcccacacttctgatgtcacttttgacagagccaaactcatttatggcatcatcatgaagatagacatgaatgctaggggagttcagtcaaattcgaggtccctggagagcctgagttctgccattaatttggcttatattaagaagaactgttggaatcttgatgatccaacaataactttcaaaggacccaggaaggctaggggtaagagatctgaggccccttccactttagcatcagaggcaccaacaccttcttcttctaca

SEQ ID NO: 8916 - DNA, 726 bp, Glycine max
  Peptide Sequence Number=SeqID_100601
atgccgaaaaatccccggtggcctcacaacgttgaccacgaagagattgccaaatttgaagcggtggcctcccgctggtgggatctcgaaggtgagttcaaaccgctgcatcgcattaatccgctgcgtctgggctatatcgcggagcgttccggcggtctgttcggtaagaaagtgctcgatgtcggctgcggcggcggtatcctggctgagagcatggcgcgcgaaggggcgaacgtcacgggtctggatatgggcttcgagccgttgcaggttgcccgtctgcatgccctggagtcgggtattcaggttgaatatgtgcaggaaaccgtcgaagaacacgcggcgaaacatgctcatcagtacgatgtggtgacctgtatggagatgctggagcacgttcccgatccgcaatccgtggtgcacgcctgtgcaaaactggtgaaaccgggcggccaggtcttcttctcgaccatcaaccgtaatggtaaagcctggctgatggccgtcgtcggtgcggagtatgtgctgcgcatggtgccgaaagggacgcacgacgcgaagaaattcatcaagcctgcggagttgttaagctgggttgaccagacgtggctcaaagagcagcacataaccggcctgcactacaatccgctgaccaataaattcaaactcgcaccgggcgttgatgttaactatatgttgcacacaaccgccaaaaacgactaa

SEQ ID NO: 8917 - DNA, 483 bp, Glycine max
  Peptide Sequence Number=SeqID_100602
atgttgctaagtagcaatgtcatctatatctgtgtaagagtggtcatgttggtgtgcatgatccgcactcgtctctttgcagcggcacgggtgaaatcttgccccggtatgcatagtagctgcgtgatagcctccctctctggttatgctcgcacagttggccgtcctccaatatcagggggtggcccaggaaccgtgcggatgtggagcacactgaaaatgaggacacgtagccttctaaaggtgagggcgtgcaaccctctcaaggcgaggatgtatagtcctctggaggtgagggcatgtagtcctctcaaggtgagggcgtgcagccctctgttggcgaggacgtgtagtcctctaaaggtgaaggcgtgtagccctctgttggcgaggacgtgtagtcctctaaaggtgagggcgtgtagccctacgaaggtgaggacatgcagtcctctgatggcgagggcgtgtagccctctgaag

SEQ ID NO: 8918 - DNA, 160 bp, Glycine max
  Peptide Sequence Number=SeqID_100603
tatgttcttcgaaggggatgatacctctagaaaccatcaagagagatatgactaccttgggggttatcacttgtcataccctaatttcgtccggggacctttgctcgatgacgtgcgaccattctttggtcctcgtgaggtgcttggcacccatcattag

SEQ ID NO: 8919 - DNA, 108 bp, Glycine max
  Peptide Sequence Number=SeqID_100604
atggggattgcatcattaggacctgaagtggtacaacaaacgacagagaaggtcaagttgatccaagaaaggatgaggactgtgttggatcaagtggcctcagaataa

SEQ ID NO: 8920 - DNA, 408 bp, Glycine max
  Peptide Sequence Number=SeqID_100605
atggccaaaatacaaggcccaaaagaaggaaaaacatattcaaatatttacaaagaaaagtggatccaaccttggcccatgggctcagaaatctaccctgaggatcatgagaaccctagggccttctttagtagctttagcccaatcctcttggattcttctatccaatacccttgggggggggtccacaaaatacgcgtgacaagcaatgtggccctcaaatacacatgtttgccctccatgttagccctgcctcatgagcatggacgttccacgcttagtaggcgggttcccaaactgacaggtattcaatcatctataaggtacacattatctgtaagctacaattatctacaagctagtcattatctgcaagggttgttacaacaccgtaacaattttgtatga

SEQ ID NO: 8921 - DNA, 237 bp, Glycine max
  Peptide Sequence Number=SeqID_100606
atgagggaatttgggactatagcagctcatccaggcgagctgatgcttagtcctgaagaaaatggctcgcccaggctagttggtcccttcagccctaagcaattcgggggcccagaactgatccacaaaagatgtaccctctcttgttctcagtcaaacccaagtagatgtaccttctacttataccacaaaggatgtaccctccaatgtgttaagacaaagatctcaggcggttaa

SEQ ID NO: 8922 - DNA, 109 bp, Glycine max
  Peptide Sequence Number=SeqID_100607
ggtaggttgcgacacatgggatgacaatgattcatccaatggtttggaaaaggagattaatctcctaaccaaggattatgaaagtgatgataacatttatcaggaatga

SEQ ID NO: 8923 - DNA, 513 bp, Glycine max
  Peptide Sequence Number=SeqID_100608
acacttgctagcattgccacacctcttgggcttgagtttattactcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcgctcgtacacctaacatcttcatggtgtgtgtacatagggacccattaggggttcccatgaaccctaagagaataaaggtcattcctgagtggcccactccaccaacaccactcactgagttggtgagaaactatgttccttcatgggaagatgcccaggaaatggagtatgaagaacctcgagatttgaggtcaaatcctttccaaggtggagggaatgatgcaatcctactcgcaagggcattgggtagaagactccaagtagattgggctagagatccaagggatggccctagggttctcttgagccttagg

SEQ ID NO: 8924 - DNA, 516 bp, Glycine max
  Peptide Sequence Number=SeqID_100609
atgcatacgtttcacatgagatgcggagagtgtactattactcttcaagacgtctctgtattgttaggtctacgtgtggatggtttaccattaatcggtccaacaaatcttaattgggcttatttatgtgaggaattattgagagtcagaccacaagaagatgaaattaaaggtagtgtggttaaactaagttggctggctcaccattttgcacaaataaataaccacaacgacgaagaaaaagtacgaagcacatatgcatggggacctgccgtacttgcttttctatacagagagatgtgcagtgccaccgattataaaactaaatcaatcggaggtatgtgcatcttactacaaatgtgggcatgtgaacgatgtataaccttggctccaaagaggactccttcccaagttgaaaataaaccactcgggcacaagtggctgcaacgtggacatatcggtgatgatggtgaggagttttcgtcgcagtggatatatgaaacatcatggaggtaa

SEQ ID NO: 8925 - DNA, 382 bp, Glycine max
  Peptide Sequence Number=SeqID_100610
atgactagaggcaatccatctgacttacaaccctttgatcctgagatagataggacatttcatagattagttaggcatcattttataccttttgatcattctgagcattccattactggtgaatttgtgcattctgttattggtgattttgaacatcctgatcttgaacattataattttgagcattctgattctgaacattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggtcttgcag

SEQ ID NO: 8926 - DNA, 153 bp, Glycine max
  Peptide Sequence Number=SeqID_100611
atgtcatatgacgcagcgattgaggtgaggaaccatgtttccccagagccagaggtggaggacgccggagttgcttcgttggcgaatccaaaggcgttaagggtcatgtcgtcaccttctactcttacttcctcatgtccaaagtgtgactga

SEQ ID NO: 8927 - DNA, 930 bp, Glycine max
  Peptide Sequence Number=SeqID_100612
atgccgtacacctcctacaccgggctgagccgcgacgacgtgctggcgatcaaagcctatctgttcagcctgccgccggtaaagcaggccaacccgcaaaacgatctgtcgttcccgttcaaccagcgttggggcatgaaattctggaacctggcgttcttccatgagcaacgctttacgccggatctcaacaaggacgagcagtggaaccgcggcgcctatctggcgaccgcgctgggccactgcggcgagtgccacacaccgcgcaatctggggttcggcctcaaccagagcaagcacctgagcggtgaagtggtgcagggctggttcgccgccaacatcacgccggacaaacagaccggcatcggcggctggagcgaccaacagctgtcgcaatatctggccaccggccatgcgccggggcgcagcagcgccgccggcccgatggcggaagcggtggaaaacagcctgcagttcctgacgccggaagataatctggcgctggtgaaatacctgcgcgatatcgaaccgatcgccggcgacgccgctgcggcggtgaatctgcagccgaagggcgcgggggcttccaccccgatcctgccgggcgggcaagagcagtcgctcgggcggcgggtgttcgccaacgactgcagcggctgccaccagtggaacgggccgggccgccagagcgagtatgcgtcgctggtgggcagcacggcggtgaacgatccgcaggggcgcagcgtggtgcaggccatcctgaaggggacgagcatcagcatcggcgatcggcatgaaatgatgccggcgttcggtagcgcctattccgacgaagaagtggcggcggtcgccaacttcgtggtcggccacttcggcgataagcagggcaacgtcaccgccaaacaggtggcggagcaacgcaagcagtag

SEQ ID NO: 8928 - DNA, 741 bp, Glycine max
  Peptide Sequence Number=SeqID_100613
atgaagttatatgcagagtctcttgtacactttcaaggagggtcaccttacacacatcctttctatggtttaggagagcttccccaggcatttgcatggcttagtgttgtttttggtgaaacatatatgttgcataagcttaagtgcaacatagaatttgatgaggaaggcaagattgttgagtttatggttgtcctctttatccccttgagggcaccttttgatctctttgacactaggaagatgcctagcaaaatccaactgtatgtcccctgtgttttcattttggacaactgcgaggagttgatgctagaatattttagctttgttaggggtattgtggattctgaggatcttcctctcaacatttctagagaaatgttgcagcagaacaagatcttgaaagtcattaggaaaaacttgaacaagacaaagcttactgaattgctcaagtatcaccccactaagagtggtgatgtgatgaccagcctcaaggtctatgttaccagcatgcacgaaggacagaaagacatctactacataactggtgaaagcatgaaagttgctatgaatttccctatttctattttgttttcattgcccaaccttgaggacaaggttgattttccagcggtgggtaatgatagcaatacagcccaaagggagagtaagcccaagagggtgcagaagacaccagcatatcccttgcccgacaacactatcacaattataacaaactag

SEQ ID NO: 8929 - DNA, 585 bp, Glycine max
  Peptide Sequence Number=SeqID_100614
atggccgtaataactcccgggaagatataccaacccccttttccaaagtggtatgatcctaacgcaacttgcacgtaccatgggaataccccgaggcattccatcgaaaaatgcttagcccttaaatacaaggatcggcccaacgtgaaagccaacccgctcgccaatcatggagggggagtggtttatgccattgagtcagatagggcgcacaggtctaaacctttaaaggacgtggcaacccctaggaggtttatctttgaggccctacaaaagggagccacgcagtcccgtggaggtatacacctccgagtggaaaggaagaagaggccaccgacatcaaccagcatcacggggctgagcggtatgacccacagcagtcgtgtgttttcactttccgacctgccaacacaacctacaaacattaagggaaaggctaagatagtagaggaacaaaatgacaagacgacccccactccgaacgaggatattccggtaaagggtattttggagaaaagggatggctgcggcaagaaggaagtgtcgctagaggaggcaagcgagtttctccgcattattcagtag

SEQ ID NO: 8930 - DNA, 1094 bp, Glycine max
  Peptide Sequence Number=SeqID_100615
atggtgaaactggggttggtgcgcttctcgctgctgctggcctcggcgctggtggtgctggcgatggtggtgcagatggcggtgaccatgctgctgcgcggcgaagtggaaagcatcgacgtggtgcgttcaatcttcttcggcctgttgatcaccccgtgggcggtctacttcctctcggtggtggtggagcagctggaggagtcgcgccaacggctggcgcggctggtggacaagctggaagagatgcgccaccgcgatctggagctcaatcagcagctcaaagacaatatcagccagctgaatcaggagatcgccgatcgcatcaaggcggaagaagagcgcctgcaggtgatggagaagctgacggaagagatggaacagcgcgagctggcgcagattgagctgggccagcagtcggcgctgctgcgttccttcctcgacgcctcgccggacctggtctactaccgcaacgaagacaaagagttctccggctgcaaccgcgcgatggagctgctgaccggcaagagcgagaagcagctgatcggcctgacgccgttcgacgtctacggccaggagatcgccgaaaaggtcattgagaccgacgagaaggtgttccgccacaacgtctcgctgacctacgaacaatggctggtgtatcccgacggccgcaaggcctgtttcgaactgcgcaaggtgccgttttacgaccgggtgggcaaacgccacgggctgatgggcttcggccgcgatattaccgagcgtaagcgctaccaggacgcgctggagaacgccagccgggagaagaccacctttatctccaccatcagccacgagctgcgtacgccgcttaacggcatcgtcggcctgagccgcatcctgctcgataccgagctgaacgacgagcagctgaaatacctgaagaccattcacgtcagcgccatcaccctcggcaatatcttcaacgacattatcgaaatggacaagctcgagcggcgcaaggtgcagctcgacaaccagccggtggacttcaccggtttcctcgcggatctggagaatctctccggcctgctggcgcagccgaaagggctgca

SEQ ID NO: 8931 - DNA, 246 bp, Glycine max
  Peptide Sequence Number=SeqID_100616
atggaaaggaacattaaagtccttttcccgtcccctcagccaggacgaagtgagaaaatttgtgttatccaccaacttagagatgtgaaaagcttctatccaccatattttcgttcttcaattggaaaccttcgagcctgctatggaggagtgctggaggaaattatccatgggcctacaatgaagaactctgtcctccctaacccaggagttgaattcccaccacagaggcataacttttggtag

SEQ ID NO: 8932 - DNA, 195 bp, Glycine max
  Peptide Sequence Number=SeqID_100617
atggattcactcggtgggagtcgtcccctcaacgctccaccaaaaactgaaatttattgtggaggggcacttagtcattgttttaagggaggaggatgttctgtcacggaagagtctttggaaacgactttccagtcctttgaggtggtaagcaacacctcccgatgcggtcccacatgtctggcgcggcaatga

SEQ ID NO: 8933 - DNA, 564 bp, Glycine max
  Peptide Sequence Number=SeqID_100618
atggctccgaagaaactctccacaaagaggtctagaagagacgccacaggagaaggatccagtgccgccccagagtttgatagtcatcgtttccggagtgccgagcaccaacagcgcttcgaggccatcaggggatggtcgttccacaaggagaggcatgtccaactcagggaggatgagtatacggactttcaggaggagatacctcgcagacgttggacaccgctagtgactcccatggccaagtttgaccctgagatagtcctagagttctatgctaatgcttggcccacggaggagggagttcgggacatgctttcatgggtaaggggtcagtggattccctttgacgcagatgccctcagccagttcttgggtgaaccgctagttttggaggaaggccagcagtgcgagttcagccagaggaggaaccgggccgacggtttcgatgaggaagccatcgcccagctgttgtgcataccggggcaggatttcgcctggaccgctgcagggaggcgagtgcggatcatgcgcaccagcatgaccactttgacccagacatag

SEQ ID NO: 8934 - DNA, 426 bp, Glycine max
  Peptide Sequence Number=SeqID_100619
atgatagttaaccaacaagtgaaggtacctttctccattgggacatataaggacgaagttaattgtgatatagttcccatggaggcagggcatattcttttaggaaggccatggcatattttcctatcaagggaaacatccattggcactgccatacctcttaagcttgaggatgagggtttggttcataagagcttaactccttatgaggcatcgaatccctatgataggtggtatgatgaatgtgttgagtgtgatcaagggtttcccacaaatcctaagagaataaaggtcattcctgagtggcccactccaccaagtgttgagggaagaagcccagattttcaagaacctctggatttgaggtcaaatccttttcaagggggagggaatgattcaatcctaccccccaagggcattggatag

SEQ ID NO: 8935 - DNA, 222 bp, Glycine max
  Peptide Sequence Number=SeqID_100620
atggcccgcaccaagaaaactgggcagatgacgtctgaggccgcaaagaaaattgttgagaagattgattctttggaggagcagacgtcacaaggttcgtttgtcccccatggacgtcaggatctcttgactgctgccattgggcgaccaaaacaccctagccgtgtgcgtgctgctggagccgatgtcaccatcaagcaatacttcggattggctccatga

SEQ ID NO: 8936 - DNA, 256 bp, Glycine max
  Peptide Sequence Number=SeqID_100621
cgtgatgagaatcatgaaactggccaaatacaggctaaaggcccaagtggagaaggacgaaggcccaagtggagaaggacaaagcccccgagtggagaaggatgaaggcccaagtaatccttgtggcgtctacccggacttatcttccttcaccggaagtggcgtctacccagacttatcttccttcactcgaagtggcgtctacccagacttagtctacccagacttatcttccttaaccggaagtggcgtctaa

SEQ ID NO: 8937 - DNA, 192 bp, Glycine max
  Peptide Sequence Number=SeqID_100622
atggggtgccccaagggtagagtcatctttgacaacggtcagaggtcgagacaaggtcaaaggcagaaactaatcagattacttatagacggacgcaaggagaggctagggtcacgaccaataggtcgtcatcctttgcctagcccgggacaagcggaaaacgccactgcaaggcagcctagtattctttaa

SEQ ID NO: 8938 - DNA, 225 bp, Glycine max
  Peptide Sequence Number=SeqID_100623
atgaccacagattcacctccattcctttatgttcccatggacccgggtatagggccccttttcaactcaccgtgtgtgcaaaaaagtccccaaccccttcggcgggagggcgacgcggggctcacgagggcatcttccaagggaggaaggtgcgtagagtcgccaccaacgtttattcgaggaaaacgtcggaaaaaccggaaaggtgtggtctacggactttaa

SEQ ID NO: 8939 - DNA, 289 bp, Glycine max
  Peptide Sequence Number=SeqID_100624
atgcatgcaggattaaaggtagagccctggggagagaggatcatcatcattcagatgatgttccctagcgaagaagctgttgatgatgctaagggatttccaggtgggccgcatgacccatcagtgttgactgactatggtgaccatgttgtagtcatcgtatggaatggagaggaacatcctgaattgaagctatcctcccatggaaggaaggttcagaaatttgggaggcttgctcctaaagttgaagggccagtcgctgccacaggattaagtcttttgatcgcat

SEQ ID NO: 8940 - DNA, 465 bp, Glycine max
  Peptide Sequence Number=SeqID_100625
atgcaaggcaaaaggcaacatctcatgctaatctttgtacgacactgtcatcttctgaataattttcttaatattcttattggctgtttccacagcttcgttcatctttggccggtagggcgtggaattgtgatgctggactttgaaatccgcgcacatctcctgcatcatcttgttattcagattggtgccattgtcagtaatgatcttcctagggagtccgtactgacaaatcagctccctctttatgaatctgaccactacactcctcgtgacattggtgtaggaagccgcttcgacctatttggtgaaataatctattgccatgagaatgaagcgatgaccgttcgaagccttgggttcgatggcccctatgacgtctatcccccacatggaaaaaggccaagggtggacatgacattcaggggatgtggcggggcattgacattgtccgcgaacgcttga

SEQ ID NO: 8941 - DNA, 258 bp, Glycine max
  Peptide Sequence Number=SeqID_100626
atgcttccttttgacttccggcatgttacggaacctcacggatttgtgcaacaatgcttcattttaactttcggcatgttatggaacttcacggattgtgcaacaatgggtgccaagtacctcgaagcggtcaagcaaaggttgcatgccatcaaacaatggtccccggacgaaattaggctatgcactgaggaggagtcattacttctggcattaaccactcatgcagatcagccttcagttcttccttctatctag

SEQ ID NO: 8942 - DNA, 249 bp, Glycine max
  Peptide Sequence Number=SeqID_100627
atgataccaattgataagagagaagatagttctggggaaagaagattaatcgaagaaccaggaggaacagggaaccttgaaagagaaaaggttccaagaggcagggtggttggagaatgttgtgggatggtatcactctcatcttgggtagtgagtgattctcatgtttatgggtcttgccttgaagtcaagttgcttcttgcaattgaagaaacctcaggctggtttcaatgtttgtttttcatctaa

SEQ ID NO: 8943 - DNA, 458 bp, Glycine max
  Peptide Sequence Number=SeqID_100628
atgaagatgaacatgaatgtcggagtcctcatctctggacagatcactcttatggctcagtccaactccttgaggctcggatttccatcccttatcactaccttatgcatggcccaaggaacatctactgtaccagctcctattccttcagcaccagttcctgctacttccggtccctccactcagagcacagacctcatgatggtggcctggctaggagtccagccttcttctaatggaggaggtgaggtcttcgcagctcaggagtctcagccagatccagagactacaactgctgctcaggaggatgattcaaaggccactcccccagagtcatttgcatctctagtatctacaccagcgctggagctgagaaccccgcaaggatcactagcaggcacgcctgtgctgcatttgaccgatgatgaggccatggatcaggacccaccgcataacca

SEQ ID NO: 8944 - DNA, 162 bp, Glycine max
  Peptide Sequence Number=SeqID_100629
atgccttccaaggcgagcgaggtgaggctcacgggtgcgctttccaaaggaggaaagatgcgcggagtcgccaccaacgtttatttgtggaaaacgtcggaaaaactgaaggaaaccggtcataaagattattccaagttcgggagttgtatttacgcttga

SEQ ID NO: 8945 - DNA, 330 bp, Glycine max
  Peptide Sequence Number=SeqID_100630
atggtgacaaaaaaggttaagaaatatgagaaaatgatgacacatctaccatcttgcaaaaaattagggcaaaagatggatcgggttacatcgctgcttcgtctattgccaaacacatttaagactgttgatgtccttgttacttctagtttcaccttgacaaagatgtcatggaccatgaaagaacacactttacggtgcccttaccgaacccgtgctagagctagagtaatgggtgaagtaatggaggtacaaaagttgatgaaggccgacatggaggccatgaaagagcaaatggccacaatgatgaaggccatgaggatcctctag

SEQ ID NO: 8946 - DNA, 546 bp, Glycine max
  Peptide Sequence Number=SeqID_100631
atgggcagcgttaaacggaaatttctccacaagcttttgggcattacgtttaaactagaaccgttatcgatgagtaccttagccacgacgtggtccatgcatttgactgacacatgcaagccctattatgccctctcccctcaacagggatttcttcttcagcgaaggaactcgcctgcctcctttagcgatacttctttcttgccacaaccatcctttttctctggaagacctttcactggaatattctcgttcgaagtgtggattaatttgtcatcttgtccttccgttatctttgccttccctttaacgtttacgggttgcgtcggcaggttagggggtgcaaacatgcaaccgctgcgggtcacgccgctcagccccgtgatattggttaccttggccgacaatgagctgatgtcgatggcttcttccttcctttcgcttggaggagcatacctccacaaaactgcttggctgtttcggtatggaaacggaacaggtttaactaccgaggggtatcggggcatttggggagctgcgtctctg

SEQ ID NO: 8947 - DNA, 825 bp, Glycine max
  Peptide Sequence Number=SeqID_100632
atgagtaaaatcagagtgttatgcgtagacgattcggcactgatgcgccagctgatgacggaaatcgtgaacggccacgccgacatggagatggtggcgaccgcgccggatccgctggtggcgcgcgatctgatcaaaaaatttaatccccaggtgctgacgctggacgtcgagatgccgcgcatggacgggctggatttcctcgagaagctgatgcgcctgcggccgatgccggtggtaatggtctcttcgctgaccggcaaaggctcggaaatcacgctgcgcgcgctggagctgggcgcggtggacttcgtgaccaaaccgcagctcggcattcgcgagggcatgttggcctacagcgagctgattgccgagaagatccgcaccgccgccagggcgcgcctgccgcagcgttccaacagcccggcgccggcgatcctcagccacgcgccgctgctgagcagtgaaaaactgatcgccatcggcgcttccaccggcggcaccgaagcgatccgccaggtgctgcagccgctgcctgccaccagtccggcgctgctgatcacccagcacatgccgcccggtttcacccgttcgttcgccgagcggctgaacaagctgtgccagatcacggtgaaagaagcggaggacggcgagcgcgtgctgccgggccatgcctacatcgcaccgggggatcgccacttggaactggcgcgcagcggcgccaactatcaggtgaagctgcatgacggcccggcggttaaccgccatcgtccgtcggtcgatgtgctgttccgctcggtggcgcaatatgccggccgcaatgcg

SEQ ID NO: 8948 - DNA, 345 bp, Glycine max
  Peptide Sequence Number=SeqID_100633
atgagttgtacatgttcgctaagtgcaccgcttcatctctctaagcgcaccgcttcagttcatctgctaagcgagaaaggggtgctaagccaaaaatcactaacgtgcgctaagcgcacaagcacgaacaaggccacctatttaagcctaaaatcagattttgtgaaaggagtttggactgggattcagagctttacatgtctaggagaccagagctcgaagcaggagccgatgcatgctttgttagggtcattcaatagaggaaactggtttgactctaaagtccttgatagtgcagggctgagttatcgtgctttcacgaggaatcagggtgcaataagttag

SEQ ID NO: 8949 - DNA, 747 bp, Glycine max
  Peptide Sequence Number=SeqID_100634
gaaatgccaccaaggaagctctccgcaaagagatctaggagggacgccgcggccgaaggaaccagcaccgctcctgagtttgacaaccatcgtttcaagagcgcagggcaccagcagcgtttcaaggccatcaaaggatggtcgttccaccgagagagacgcgtccagctcaaggacgatgagtacacagattttcaggaagtgatagttcgccgacgttgggcgtcgctggtcactcccatggctaagtttgaccaatgcttggcccacggaggagggcatgcgggacatgcggagtgcgagtttagtcagagaaggaaccgggacgatgaatttgacgaggaggccattgcccagctgttatgcataccgggtcaggattttgcccgaatcgctgccaggaggcgggtgcggatcatgcgcaccatcatgaccaccttgactcagatgtggatgacgcaccctctaaacccaaataagtctaacagggccctgggttttccagcattgatcacgggtctctaccagtcattcggggttcccgtcacacctagtaaggtgattcgaccatcgatcacccgagccttcattgagaagtattgcatgcctagacaagcgcaaggtgatgcaccgcaggccacagatgcaccgccaccacctcatcaggctgatccagctgggtcatttggcatggagcggtatttacagcacttggttcaccagcaggcagccaaccacagggggcag

SEQ ID NO: 8950 - DNA, 135 bp, Glycine max
  Peptide Sequence Number=SeqID_100635
gggcaggatcatcttgagctaccttctgggttggggataaaacatgaacagcgaaaaccaaccaaggtactagggaacggatgcaaatggggatggggtcacgaccgactgatcgtcgccccttctctgcgctaa

SEQ ID NO: 8951 - DNA, 207 bp, Glycine max
  Peptide Sequence Number=SeqID_100636
aatatttttcgatgctggattgcttatggaggaagcaacccagctttcctgggcgagctgggcggcaacctcctccccctttttcctataaataggctgaaggaggctgttctaaggatccctgagccccctggctatgtatttcagctgttgtgggtgaaaaaaataatttccgtgaagaaaatccaagccgaggtgcttccgtaa

SEQ ID NO: 8952 - DNA, 579 bp, Glycine max
  Peptide Sequence Number=SeqID_100637
atgaaatggttgaagaagctaatgcttggtgattttgaagtggtcaaattcgaagaaaaatggaaagagatggttgctacgtttgaattggaagacaatacttggattgctgaactgactattaagctaagagtcgttgattgcaaagagatggtgacgttttcagtttacacggttgtgaagtattgtagtggaagtgtttggtgtgtgtcgtattgcccatcaacggttgactttacatgtacttgtatgagaatgcaatccattggtcttccatgcgatcacatattggttgtgttggtttctttaaattttatggagttgccaagtagtttgattttgaataggtggtccaaacttgccacaaaacaaatgaaagacaaatatccgaattttgcaatgtattgggattcccaattgatggccaggtatgccactttggttgaagtttctagacaagtttgtgtagccgcataccgtgatgaagaggagtatgacaaaatgttgcatttcctatccaatgaggctagaaggttgaagtcgaagcaaaacaccgaacattgtgttgatgataattag

SEQ ID NO: 8953 - DNA, 465 bp, Glycine max
  Peptide Sequence Number=SeqID_100638
atggcattagaagaggggaaggtgaagatcgagaatttcgatggtagatatttcagcttttggaagatgcagataaaggattatctatatcagaagaagctgtatcagcccttatcaggggttaagccagacgacataaaattgacattagccaagaacgccgtgttcaacatcgtaaatgagaagactactgcaggcttaatgaaggtgttatcagatatgtacgagaagccgtcggcaaccaacaaaattaaatttgaggatgaggtgaaggcattgattctattgtcatcactactggatagttgggctgcaactgtttctgcagttagtagttctatgagagagaacacattaaagcttagtgacatccgtgacttgatcttaagtgaagatgttcgcaagagagatttaggagatcttccagtcagtttccacatcgcttggattgttagagttttgtag

SEQ ID NO: 8954 - DNA, 255 bp, Glycine max
  Peptide Sequence Number=SeqID_100639
atgtctatgttggatcaatttcagccatttatgcacgacttcactgacaacattgtggatgtcaaagcagacaaaaactgtggatatcggtcggttgctgatttattaggtatgggtgaagactcttggtcattggtctgcaaccatctgcttaaagaacttggcaaattctcagatgactatatcaagttcttttgtggcacggacaaatttgagaaattaaggatgtcactacttgttgatgggttaaccaag

SEQ ID NO: 8955 - DNA, 564 bp, Glycine max
  Peptide Sequence Number=SeqID_100640
tcacaaggactcgcactgcctcctgaacctgagattggtccttcagcagctcgtgttagtacaaaggagagttgtgttgatcccttagggaacgatccagacacgggtgactcaaacaaatgcgggttgtacattgaagaatatcctccacgcctggttgccctaggaagagtttatgagggatccataacagtttacaacattcctttgctgcatgatcaagtcaaggttggtgttgaggaggttagagatgcagatgttcccattcctgtacccactaaagaggttaaggtcatagggcagacacttaacacctttcttgcttggcctacacatcttgtcaagcgtttatcagaacagggagttgtgggaccaacgaatcctgcagataggccggatcatgaagtcgatgatcccctatatctgatgacactgaccatcccacagctttttttgaagccattgcaggttatgtgggatgctaccttgtttggcttgtttaatgaagacttccccttgtacataaagcatgaagatctgtctgaaataacacaaggtggttaa

SEQ ID NO: 8956 - DNA, 408 bp, Glycine max
  Peptide Sequence Number=SeqID_100641
aaaagaaagaggggaatgagcaacaatttgaaggttgtacattcagtaactaaagaattcaaaatagctagtaataagagggatttgtttttgggattttctgagcaccaagagcggctatgcaagaagcttgcacttgaggagggaaagatatttgcagctaatgaacaactaatgaacaaagttgaaaggaaagatattgacctcatagatgaggaagaagcacagattggtggtgatcgttctagtgcaacctcgaataaagctgagatttataacgaggaggcacggaagaaaacacagaagcataaaccaaagagggtggagagtgtcaatgctgatgcagaagcctttggtgatcactcgaaaattccgattgctttatgcattctgaagctgaagcactag

SEQ ID NO: 8957 - DNA, 143 bp, Glycine max
  Peptide Sequence Number=SeqID_100642
aaaatggaatgagagagaaagtggcgagtttatggagggctgaatggaaggtatttggttcaaagtttgaatgtgtatggatggagaatgaaggtgataaaaatggtgttcgagtgagattaaagaatgaaggtttagaatga

SEQ ID NO: 8958 - DNA, 424 bp, Glycine max
  Peptide Sequence Number=SeqID_100643
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttgccgcaccgtcggaggaaagcatcacgcctttcatcgcatggggttttagtgaccccaatgcgaggatacttcaaggagtccgcaaggcgtggggcgtagtgcaaaggaaagataaagagcttaggggaagcaacaatgggatcatcaacgactatcataagtggctgaaggctcgaacgcaagatttggattggttcccaaagctaaaggtttcaagcgaggaagaggatgaaacccctgaggagagtgaggaggtgcaaacctga

SEQ ID NO: 8959 - DNA, 273 bp, Glycine max
  Peptide Sequence Number=SeqID_100644
atgatggtggcccgggtgatgttggggaatggttatgagcccggaatgggtttaggtaggaacaacggcgacagaaccagcctgataagcaccagaggaaaccgtgagaagaagagcggaagccaaggttcgcaattgggacaagaagtcgaagggggcctgccctgccacatcagtagaagctttataagtgcgggtctagaacacgaaggccaagtcgttgcgatatgcgaggatgactcttcgagtgggttggatttggtacaaccatga

SEQ ID NO: 8960 - DNA, 186 bp, Glycine max
  Peptide Sequence Number=SeqID_100645
atgtccaacgagcgcaaagcacatgcatccccaaatgattttggaattccgccttctaaagagtttgatccaattgacaaagattctaacagagatggcaatttgcgagaatctggcacacccagacaattgatgaattatcaccgaaagctctttattcaaattgttagcagacatatccagtga

SEQ ID NO: 8961 - DNA, 708 bp, Glycine max
  Peptide Sequence Number=SeqID_100646
atgctgctccatcagatcggcgaagcgcagcagcgtggctttgcgctgcgccggggcggcctgcgcccagtcgccgcgttcaaagacggcgcgcgccgcgctgaccgcccgatcgatgtcggcggcttcgccgcgcgcaacctgcgccagctcacggcgcccggcgggatcttccacggcgaaaaatttccccgcggcggccggctggtagcggccgtcgataaacaaccggtgctcaatcttcaggaatgtcgtcggcgtatgggcgctgataatccggcaaatgcgcgccgacgtgttgctgaaactgtgggggatgccggtattgatggcgtagctctgcccggccagcaggtgatagctctggccgttgacctgcagcaccacttcgccctccagcagcgtgccgatctcttccccctgatgtttgatgcgctcgccggtggtggtgcccggttcgtaggtctcgatcatcatcgccagcgtgcggttcgggtcgccgttgtggatcagcttcatcgaaacgccctggctgccgatttcgatcagatcgtcactgccgatcacgatctgcggctccgccggtttttccggctcggcgaaaaacgccgacagcgacagaccgtataccgtcagcagcttttgcagcgtactgatggccgggctgaccttatcttgttcgatagtgctgatggcgctgtgggttaa

SEQ ID NO: 8962 - DNA, 219 bp, Glycine max
  Peptide Sequence Number=SeqID_100647
atgtgcttgttgttttggctcaaaatttattctataatcggtgcctatgttataccaatcttagttcctaaatttcaattgaaaattactgtgaaaacaagtgccaaagctagagggaattggaaaggaggattggtgccatcccttgaagaatttgagtcaagaagcaaggggccaaccaccttaagagctattggactaagaagcactccaaattga

SEQ ID NO: 8963 - DNA, 318 bp, Glycine max
  Peptide Sequence Number=SeqID_100648
atggagcagctccatggcattttatgggctagtatagagtatacggtgaagtttgatcgatttttgtcattggagaagcagagacgaaagaagaagaagcgatcttgggctaagaggaagaagaaagaagaagaagcggtgtcgggaggaagacaaaagaataagaagcaccgcgggagagaaatgaataatgactcgtacggacgagtcactttagctttttatatcaaaatggtgaagggcattttaaccctttcaccaacgttactgggtgcctcagcaaaactactgggtgtccaaagtaacaacctcatttaa

SEQ ID NO: 8964 - DNA, 641 bp, Glycine max
  Peptide Sequence Number=SeqID_100649
ttaccctcacctttagaggactacacgtccacgccttcagaggactccatgtcctcaccatcagagggctgcacgccctcacctccagaggactacacgtcctcgccttgagagggctacccgccctcgccttgggtacttttacctatcccctccagaggactacatgtcctcgccttgagagggctacacgccttcaccttggaggactacatgtcctcgccttgagagggctacacgccttcaccttgggtactagttaccttcaccttcagaggactacacgtcctcgccttgagaggactacatgtcctcaccatcagagggctgcacgccctcaccatcagagggctacacgcccatcagaggactacatgtcctcaccttcgagaggctacacgccctcacctttgggactacacgtcctcgccaacagagggctatcacgccctcaccttagaggactacacgtcctcgccttgagagggctactcgccctcaccttgggtactagttaccctcatcttcagaggactacatgtcctccgctacatgccctcatcttgagaggactacacgtcctcaccattagagggctgcacgccctcaccatccagaggactactcatccttcgccttga

SEQ ID NO: 8965 - DNA, 411 bp, Glycine max
  Peptide Sequence Number=SeqID_100650
atgacggagaaggagatgatcacaataatagtagacacattaccagtgttttactatgaaaaaatggtggggtacgcaccttcaagctttgcggatttggtcttcgctggcgaaaggattgaagtgggtttgaaaagaggcaaatttgatcatcctgctttgatgaatgagaaaactggggcaaataaagaggatgagaatgaggaaggaacccatgttgtggctgccattcctacatggccaaacttcccaccagcccaacaatgtcattgctcagccaatatcggcccttctcattacccaccacccagccatccacaaaggctatccccaaatcatccacaaagtttgttggccgcatgttcgcttccggcaagtgcaccggattgcacaagtagtataaaacgataa

SEQ ID NO: 8966 - DNA, 300 bp, Glycine max
  Peptide Sequence Number=SeqID_100651
atgtcgccttgtaccgggcatgggtaccgaacctcggtacgaacttctactggggcaacaccatactccttggtttatgggatggaagcagtactcccgtttgagataaagaacacgaaggcttgcgtttctggctcccctgagccacttttgatcgcgtttttgctttcgtttttggtgtttctattcactccaacaagccttaggcctatgttgtattctgaagcaatggggcatgccacattgcccccattctcttgcaatttatgtccaaacatgcgcccatcaagtgctcggtga

SEQ ID NO: 8967 - DNA, 300 bp, Glycine max
  Peptide Sequence Number=SeqID_100652
atgacttgttcccgggggaacaaaaggtgcagaagacgatgtcagtctctgcatgctgtcgcaacctacccttcgacgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgagagttgtatttacgcacggggaagggtgtttccctttgctcttacgtattcctcaatttgtgatgaggaaatcagacctacgtag

SEQ ID NO: 8968 - DNA, 1386 bp, Glycine max
  Peptide Sequence Number=SeqID_100653
gataaacttctgcgcacccgcgccctgctcggctgtttcaccttcgctaacttcagcattctgtggacgtcgatggcgtttctgcttgccgccccgccgttcaattattccgaaggggtgattggtctgttcggtctggccggtgccgctggcgcgctgggcgcgcgtcccgcgggtgggctggccgacaagggcaaatctcacctgaccacctccgcagggctgattttactcctgctctcctgggcggcaatctggtacggacacgtctcggtactggcgctgatcgtcggtattctggtgctcgatctcaccgtgcagggcgttcatatcaccaatcagaccgtgatttaccgcgtgaagccagaggcgcgtaaccgcctcacggccggatacatgaccagctactttattggcggcgcagcgggttcgctcatttccgcctcggcgtggcagcatgccggctggtccggcgtgtgtgggattggcgccatcgttgccgcactcaacctggtggcccctcagtctgttaatgtaaacgtaatcatttatcccagaaattttaatgtgggtgacatatttacaatcggcatgaacagttcagacccccgtcctcacatcctctcttcagcgggttcacaccctaccctttctgtgctcaccgggtcacggacttacccggcgctttctgatggttatgcccaaatggatagttcgtttacgcccattgaacaaatgcttaaattccgcgccagtcgccatgaggacttcccgtaccaggaaatcctgctgactcgcctgtgcatgcacatgcagggtaagctactggaaaaccgtaataaaatgctgaaagctcaagggattaacgagacgttgtttatggcgttgattacgctggagtctcaggaaaaccacagcattcagccttccgaattgagctgcgcgctgggctcctcccgtaccaatgcgacccgtattgccgatgagcttgaaaagcgtggctggattgaacgccgtgaaagcgacaacgatcgccgctgcctgcatctgcaactgaccgacaaaggtcaccagttcctgcgtgaggtgctgccacctcagcacaattgcctgcacaaactgtggtccgccctcagcgctgccgagcgcgaccagcttgagcacatcactcgcaagctgctcacccgtctggaccagatggatgaagacggcgccgtcggctcagccgatgtgaaaataagaagatcgtggagaacaacaatgagcgcaaatgcggagagcactaccccgcagcaaccggtcaataagaaaggcaaactactgcgtcatgctgaggaaacagacgacgcctacgtggcagggaaccaggtacaaattatggcgcag

SEQ ID NO: 8969 - DNA, 486 bp, Glycine max
  Peptide Sequence Number=SeqID_100654
atgtcaaatcataaaagcattgagtcagcactgaagaaccttgaggtcgaggtgggacaactggccaagcagatagctgacaagtcatccaacaattttgtggcaaatacagaacagaatctcaaggaggaatggaaagttgtgatgacaaggagtaaaaggagtgaaaaagctgtggatgaaggtacggaagtaccgtatcctgtggtaccttccaagaaagaaaaagatcgtcatctggcgagatttttagatatttttaggaaactggaaataaccatgcccttcagagaagctttgcagcagattgctgtgatccagaagatccttccacccaagcataaagatcctgggagtgtaactattccttgttcaattggaaaagtcaatgtgggaaaagctcttattgacctgggagccaacaaacttgctccagaacacaatgtttgcttacaggttatggaaggaggtcaagatgttctgaaa

SEQ ID NO: 8970 - DNA, 135 bp, Glycine max
  Peptide Sequence Number=SeqID_100655
atgaaaaattggaacgatagaggaaagggagatattggtgagccatgtgatggttcacctccgtcgttggtggtttactggtggttcgtcgatggtggccgcccaacgaggagacaaagcgaaagagaggagtga

SEQ ID NO: 8971 - DNA, 1378 bp, Glycine max
  Peptide Sequence Number=SeqID_100656
atgacgactcaggcacccccagcgatgcttccgctatccccggagcaaattgcgcgcttacaggccgcgaccaccgattttaatccaacgcagctggcatggctttctggctacttctggggcatggttaatcaggcaccgggcaccgttgccgcgcctgcgccagtcgccgctgaggtgccgggcattacgctgatctccgcctcccaaaccggcaatgcgcgccggctggccgagcagctgcgtgacgatttgctggcggcgaaactgagcgtcaacctggtgaatgccggcgactataaattcaaacagatcggtcaggaaaaactgctggtcatcgtgacctcaacgcagggcgagggcgaaccgccggaagaggcggtggcgctgcataaattcctgctgtcgaagaaagcgccgaagctgagtgataccgcctttgccgtgtttggtcttggcgatacctcctatgaatttttcagtcaggccggtaaagacttcgaccagcgtctggctgaactgggcggcgaacgcctgctggatcgcgtggatgccgatgttgaatacagcgaactggccagcgcctggcgtctgcagctcaccgatattctcaaagcgcgcgtgccggcggaaccggcagcgcagctggcagccagcgcggctggcagcgtcaaccaggtggacagcagtccttacaccaaagaagcgccgctcaccgccagctttgccctgaaccagaaaattaccggtcgcaactcagataaagacgtgcgccatatcgaaatcgatctgggggttccggagctgctgcagctggtatggctgaaaggcgatgagcaggtcgaggtgcgcggagaaaccctgccgctggccgaggcgctgcagaaacattttgagctgacggtcaacacgccgcagattgtcgagcagtatgcggccctgtcgcgcaacgaggcgctgctggcgctggcgggcaacaagccgaagctgcaaagcttcgcgcagagtttcccgattgtcgacatggtgcgccaggcgcccaccgaactgaacgccggccaactgactggcctgctgcgtccgctgacgccgcggctttactccatcgcctcgtcgcaggcggagagcgaaaccgaagtgcatatcaccgtcggtgcggtgcgttatgaaattgacggccgtcagcgcggcggcggcgcttctacctggctggccgatcgtctggaagaagatggcgaaatccgcgtgttcatcgagcataacgataatttccgcctgccggccaatccggatgcaccagtgatcatgatcggcccgggcaccggcattgccccgttccgcgccttcatgcagcagcgtgaaaacgacggtgccagcg

SEQ ID NO: 8972 - DNA, 801 bp, Glycine max
  Peptide Sequence Number=SeqID_100657
atgcgcacccgggcaaaaccgcgtaattaccctgcagggtcgccattgatggcggctttttatcttgttgttccggggactttcatgactgctttaaaccgcctgctcaccatcatgcaaaccctgcgcgatccggtgcgcggctgcccgtgggatcgccagcagactttcgcctctatcgcgccgtatacgctggaagagacctatgaagttatcgacgccatccagcgcgaagactttgacgatctgcgcggcgaactgggcgatctgctgtttcaggtggtgttctacgcccgcatggccgaggaacagcagcgtttcaatttcgatgacatctgcaacgccatcagtgacaaactggagcgtcgccatccgcacatcttcggcgaagcccaggtcgattccacggccgaagtgctgaaaaactgggaggcgatcaagcagcgcgagcgtgcggagaagtcgcagcactcggtgctggacgatatcccgaaagcgctgccggcgctgatgcgcgcctataaaatccagaagcgctgtcacagcgtaggcttcgactgggacagcctcgggccggtgctggataaagtgcatgaagagatcgacgaagtgatgcatgaagcgcagcaggccgtggtggacagcgacaagctggaagaggagattggcgatctgttgttcgctaccgtcaatctgtcacgccatctcggcagcaaagcggaaaccgcgctgcagagggccaacgacaagttcgagcgccgcttccgtcaggtagagaatattattcaggcccagggctga

SEQ ID NO: 8973 - DNA, 231 bp, Glycine max
  Peptide Sequence Number=SeqID_100658
atggatgcagccattcgaaatctagaagttcaaatgggccaattggcacaagacaaagccgaatggcccactagaactttcggggctaacacggagaagaacccaaaggaagaatgcaaggccgtgctgactcgagggcagaagaaagcacaggaggaagcgctattatacagaggaagctacccaagaagtttaagaaccccggaagtgttaccatcaagcgcaccatag

SEQ ID NO: 8974 - DNA, 279 bp, Glycine max
  Peptide Sequence Number=SeqID_100659
atgccggaaatcaaaaggaagcaggcttatgcgatccgtgaatttcgtaatgtggcggaaaccaaaaggagtttcttcctccagaaggcggttgcttctggaggaagcaaccttgctcgcctaggcgagctgggtggcaagctcctcccctattttgctataaataggggaaggagtgaagaggaaaggggttcagccttcttggcacttcttattctctcgaaattgttgaggaaaattgtttctgtaaagaaaatccaagccaagacgcttccgtaa

SEQ ID NO: 8975 - DNA, 121 bp, Glycine max
  Peptide Sequence Number=SeqID_100660
atgcccttgcggggtaggattgcatcagtagaggtcccctcccagaggatactagcagaatcaggcttagaagaatcggagtgggctcaaacacgctacgaacaactcaaccttattgaag

SEQ ID NO: 8976 - DNA, 397 bp, Glycine max
  Peptide Sequence Number=SeqID_100661
taacaacgagcttaagctctggagagaggaaatggaccaatcacgagtagacagtctgatcttgaaagatgagttgaaggtttgctcaaagtccaaaagaaacctgtctcagcggttatgcgagacaaagaccagcatgttaactatcgtcaacaagtaccaagaagaattaaatctagccacggcccacgagcacaaagtggaggacgagtatgcccgagtgtacgcggaaaaggaggctagaggaagggtgatcgactcgttacatcaagaagcaacaatgcggatggaccgatttgctcttaccttgaacgggagtcaagaacttccccgattgctagctaaggccaaagaaatggcggacacctactctaccccccgaggagatcccatatga

SEQ ID NO: 8977 - DNA, 171 bp, Glycine max
  Peptide Sequence Number=SeqID_100662
atgttatcggccagcgtttgcgaaaaaaattgcgcaatgtcggctgaaaatatcagtcgaggaaatgttcgatgtgggtcatccaggatgattcctttttcagacctctctatcgttaactttcctggccgatgtcggctagcatttttgtcgatcagtatcggtgaataa

SEQ ID NO: 8978 - DNA, 231 bp, Glycine max
  Peptide Sequence Number=SeqID_100663
atgtataacataaatataaggaatcgggacggggactatggttctgagtctgcatttagcattggtggacagtttctgaattcacatcttagcaaattaaatgaagacactgttgaggcattgatgtgctctcaagattggttgcgtaatgagattgaaggttccttaaaatcaaagatgaaattttgctcaatagttgatgatgcagacacaacaacgccaatggtttga

SEQ ID NO: 8979 - DNA, 258 bp, Glycine max
  Peptide Sequence Number=SeqID_100664
atgaccaggagtaggaccaaacagccagtggataccctccaacaaatggtagcaggcatacttagcaaggcccaagtggagaaggacaaaagcccaaatagagaaggacgaaggccgaagtggaaaaggatgaagcctcaagtggagaaggatgaaggcccaagtggagaaggacgaaagacccaagtgaagaaggatgaaggcccaaaagcaaaggcactactaagcatattaatcgttgctgaagcccaagattaa

SEQ ID NO: 8980 - DNA, 447 bp, Glycine max
  Peptide Sequence Number=SeqID_100665
atgggtttaggcaaagacaacatcggcataactagcttgataaatgccaaaggaaatcgtgggaagtatggtttaggctataaacctactcaggcggatataaagaggagcatcgcggaaagaaagagcggtggtcaaagctcgcggttgaggcaagaaagtgaaggaagcccgccctgccacataagtagaagctttataagcgcgggtctgggagacgaaggtcaagtggtcgcgatatacgaagatgatgttccgagtacattggatttggtacgaccatgccctcctgatttccagctgggaaattggcgagtggaggaacgccctggcatttacgcaacgagcataatatccgatgatgagtcccccgaaggtactaatacctggggacccgcctatcgacttcgagcaagaaatgagaagatcaagggtgggatcctctag

SEQ ID NO: 8981 - DNA, 273 bp, Glycine max
  Peptide Sequence Number=SeqID_100666
atgttgtctagaattcaattccgcacattgtcaccgttgggatttacgataaaatattcctggagagagaataaggaatcgcacgaagacagtaaaaatggaggcttcaatcccttctccgtttctatgacgtttaggaattctatcggaacagtcggaggaaaagctagaggaatcaatagagatgctattatcgctgtcagaagacacgtgatcccgcttagagtgttgttattgtgtgattccaaaaattattcaagtgttggagtttga

SEQ ID NO: 8982 - DNA, 58 bp, Glycine max
  Peptide Sequence Number=SeqID_100667
cataagacatgtgaggaaatacatgaagaaaaaggaagaaacgacaatggaggagaag

SEQ ID NO: 8983 - DNA, 330 bp, Glycine max
  Peptide Sequence Number=SeqID_100668
atgcgtactgttcaatgtttctgttgtaagcaatttggacattatgcttctaactgtccgaacaaattctgcaactactgcaaaaaggatgggcatattattaaagaatgccccataaggccacccaagcgaaatgtcacagcttttacagcctcagttgattcatctgttcctaataattcagccaatccaacacctgttcagcaacaagctcctgatcctgctccaactatgacccctgaaatggttcaacaaatgatcatttcagcattctctgctctaggattctcaggatcaacacttaggaaagataatcgcgaaggggcctaa

SEQ ID NO: 8984 - DNA, 624 bp, Glycine max
  Peptide Sequence Number=SeqID_100669
atgtcatcccactttctagaagggtgcgtatacaacactttcatcctgatcttgatgacgagagcggtgacgctggcgctgcttctgataaaaattcaaacacgcgcttgcttggctcgtggagataacagtcaactatttccgctcaaggtagttagttttaatactagcttccatgccaatcatcaccaaaccagtaccccaaaggttttcccttcacttgttcatcacggttctcactaccctccagcttttgcatactttatctctggtggtaaccaagacaaagaccggatcttgcgtttgttgttggcagtttaccatcctaggaataggtacctcctccatcttgggagggatgccagggatgaggagaggcaggctctggttgctgccgtgagggcggtgccggtgattcgcactttcgggaatgtggatgtggttggcaaggctgattatgtcacctacttgggatcctccaatgttgccatcactctccgggctgccgccattatgctcaaattggatagtgggtggaattggttcatcaccttgagtgcacgggattatcctctcataactcaggatggtatgcctatttggtcttttctatttgcatcttga

SEQ ID NO: 8985 - DNA, 378 bp, Glycine max
  Peptide Sequence Number=SeqID_100670
atgggtggacgagactgtgacaacttcattcaggggtattacagccgtgtgataagcacagagcgaactattctttcgccttttactaaagaataccgtgtgcttgtcacttcaagcggcatacggccaatttttggaagagctttcctgatcaagtgtgtggctgcatatacttctgaacagagcccacatcgagtgtttgatgcattggttgcagcgcttccaatatctgtgtcaggtgaagaagcgcagcttaagaggatttcagaactacaggctgaaaatgatgcaataggccaagaacttcagaagcagttggaagctgcaggtctgtgtccagttttctgtttttctctgaagtctgagcttctatcttga

SEQ ID NO: 8986 - DNA, 273 bp, Glycine max
  Peptide Sequence Number=SeqID_100671
atggagatcacaaaaggagatatattgggtgttactacatctttctatgcagctcttgaaaaagatatgacagtgatcgagggatttagagagtgcgaattgattgatttgaatcacacgttagtagccgtggtagtggaatcttgtaacaaattcaactcttttgatagaattcaaaacaaatacagggagtatccagttatcacatggtcatggctgcgaataataatagatcttcgatccatcaactttcaagtgcatggtgctctatga

SEQ ID NO: 8987 - DNA, 618 bp, Glycine max
  Peptide Sequence Number=SeqID_100672
atggtcctccgtatggtcttccctcttcgttgtgaacccaaacagaattatcatttccactcgattctctcacaaaccgcccaaactccctctctcgtcagcgttcgccatctcaccactctccacggccaccgcgacggacgtccgggcgccatcaacgggaccacaatcgcggtggtgagcgggggattcgtggcggcgaaggaggtgggcgatggcgacaaggagatgatgaggagggagtacttcaacaactccgggttccagtgttggaagaagatctacggtgacactgacgaggtgaaccgggttcaacgcgacattaggttgggccacgctaagaccgtggagaacatgctgagcatgttgaaggacgaaggttcccttcagggtgttacggtttgtgacgctggcgaagaggtttccgagctcgggcacgatgttgccagcgagctcgttgctggagatggcgaggtattggaggtgctaccaggtgttgtactcgggagggatttggccagagaggaagttgtcgtcgaggtgaaggcgatggaggaggggaatggcggtgacggagagaggaattttcaaattcactcccttgaagatagaatttga

SEQ ID NO: 8988 - DNA, 1701 bp, Glycine max
  Peptide Sequence Number=SeqID_100673
atggacacaagaacattgctcctgaaactactcatcactcttgtggctctttcaggatgctcttcttcggcttcagatcatttggttaatgtatccaagttggagaagttcgtggatgagcttcctcacatgcccaaaatccttggctatcatctttcagatggcgtcccaaaatctaagtccttgaagattggcatgttcaagaagaaatggaaattccacagggatctggctccagcaacagtgtacgcttttggaacaaccaaacacacagcaacagttcctggtccaacgatcgaggccatctatggcgttgacacccacgtgagatggcaaaatcacctccctccaaagcacatacttccctgggaccctacgatccccaccgcgatgaccaactccacacgtggcattcccacagtggtccacctccacggtgggatccacgcgccagagagcgacggaaacgccaacgcatggttcacatcgaaatacaacgaaaggggacccacatggacaaagaagacatatcactacccaaataatcaacaaccagggaacctatggtaccatgaccatgccatggggttgacccgagtcaaccttctagctggcctactcggagcctacatcattcgccaccctcagatcgaggacccgctaggcttacccagcggtgacgaattcgatcgaacgctgatcgtgttcgatcgcagcttccgcacggacggttcgatcttcatgagttccaccgggaacaaccctaaaatacaccctcagtggcagccagagtacttcggcgacgccatcattgtcaacggcaaggcgtggccgcgcctcacggtgcgacgtcgtaagtatcgattccgcataatcaacgccagcaacgccaggttctttagattcttcttcaccaacggcttgagattcacccacgtggcatccgattcggcttacatcgagaagcccgtaacgaccaatgagacgctggtggggccatctgagatcacagacatcgttgttgacttttctcaatccaagagtaacttggctattctagccaacgatgcaaaatatccttaccctgccggtgaccccgtcaatgaggctaacggcaaggttatcaagtttatcatcgtacctgatcaagaagttgacacgtcacgggtccctaaacggttgttagaataccctgttgttgatttatccagtgtggcgcacacacgctatgttgctatgtacgagtacgcgagcgacattgatgagccgacacacttgtacctaaatgcgaaaccgtatgaagcagcggctacggaaaccccgaaggtggggtccacagaggtgtggtatgtgatcaacttgacggaggataatcacccgcttcacattcatttgggtttgttcaaggtgttggatcagacggcgctggtgaaaccggatgatgagtttagagaatgtatgaagaaaatcaacgatgcggtcaagtgccacgtggacaagtacgctcgtggcaagaaagaagaggtgccggctcatgagagagggtggaagaatgtgttcaagatgatacctgggcatgtgacgaagattgccgtgaggttttcttacattcacaccaatgcttcatatgtgtttgatgcaaccacagagcctggctacgtctatcattgccatgttaagtatacttaccatttcttttaa

SEQ ID NO: 8989 - DNA, 544 bp, Glycine max
  Peptide Sequence Number=SeqID_100674
atgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggtcactcttcttttcttgttcatttctctattcgtcaatatcatataaactcaaatgagcaaaaagtggacaatactcagatgaaacctaaggatgtagttgactggaaacgtgagagtacaattatgaggtggaatcccatgtcgagacctgctatgttggttgatgttccaagagatagtaatattaccg

SEQ ID NO: 8990 - DNA, 303 bp, Glycine max
  Peptide Sequence Number=SeqID_100675
atgatggtgaatgaaggctttagtcattttaactttggcgctcttccaaggaggatttatgatcaaggtaaaggatgtagcgatggaaagggtacgaacaacggtggcggcttcaccagcaaagtcagaggtgaggtaggtgatgtgaggcatagagggaaaggggaggtcgtggatgacagcactatagtcacgtgctcaacgaaagtcatgaatctaggatggagtggtcgcaagacttgtggtgatggcgatcctagtttgcggtggttacgaggtgagtggtggtgttgtggtggttag

SEQ ID NO: 8991 - DNA, 657 bp, Glycine max
  Peptide Sequence Number=SeqID_100676
atgggtcatacagaagaagaacctgaaactgttgctgtgagctttgttgaggctgaaaggaagaaggaagaggagccaaagaagggtgatgattcaacgcctgttaacaaaaagaaaatcattaaagaggccacgtgggacttaaggagtgtgaatgaagggttatggtggaacaagtttgaggcactgacaccgcttgagcaaaagcaggagataaacattaaacactgcaaaattcgtaggaaccgcacaattgagatagttgcaaccagcaagtcaccaccatggcacttgttgaagcctctgcttctctttcaatctcttctggtgttgctcgtcttttcactccaccaaaatgctctcccaccgctcactttcctcatcggaattttgttgcaactcgaccatcattcatcgctggttccccactctgtaagagctttagttcctgtggaagggaacagtttggatgtgtggctaggtcggctagccatggttggctttgcagtagcaatcactgttgaaattgctactgggaagggactcctagagaactttggactcacaagtccactgcctacagttgcccttgcagtaacagcacttgtgggtgtcttgacggcagtttttatcttccagtcagcgtcaaaaaattga

SEQ ID NO: 8992 - DNA, 1107 bp, Glycine max
  Peptide Sequence Number=SeqID_100677
atgtattggcacgtgccgaagataaggccagagaccctacaccttcttcctttcagcctcaacaaagctcacagcaacagtttcagtcagttaaagtgtgcactgtgcatcatggaaaagtgcacattagtatgttacaagaacttgacaccagaatctgggagttgtgatcccctatgttcactcgatgaaactagctcacaagagtttgaagacagctaccagcccaagactgatttcctcaaagctgttgcaatattagcagcagctgcaactggagcactgacaattaaccattcatgggtggccactaatcaggatcttgctatggcattgctatttgtaataggatatgcaggcatcatatttgaagaatctccagccttcaataaaagtggagtgggactgttgatgactgctccatcaactgatatagctgtttcagagcttacacatgcatctgtggaagtcagtgaaatagtgtttttcttgcttggtgcaatgaccattgttgagattgttgatgctcatcaaggatttaaggtggttactggcaatataacaacccaaaacccacgccttctctggatgttcatcattatcattattgctcctcgaggacagcttgttttctctgtgggtttaggagctttgatttttgtcccagtattcaaggctctcgcaggtttgcctccatacatggggatgctgcttggactctgtgtgctttggatccttacagatgctatccattacggtgaatctgaaagcctggaggcagctgggattcttcgggaaatagcaaactaccttgatgcacacgtgccaagtagtgaactgattgccagtagtattggactcatatctgcactaatagacaatgattctgagttctggcagttgattgcattttgtgctggtactggtggatccatgttaattattggctcagctgctggagttgcgttcatggaggatggaaaaggtggacttcttttggtacttacgaaaggttatgctgctggtattgttccatatttagcgcttcataacctcaacatctctctaccaactctagcggaggttcctttcctttctggttcataa

SEQ ID NO: 8993 - DNA, 114 bp, Glycine max
  Peptide Sequence Number=SeqID_100678
atgatgcaaatgtttcacgaaaccaagaatcaatgggcacgtgatgaccctgcatttgttgtgatctgctgtctccttttggcagttgcaactttggcttattgtgcggcgtaa

SEQ ID NO: 8994 - DNA, 1416 bp, Glycine max
  Peptide Sequence Number=SeqID_100679
atggagtccaacggtcatgttagagtaaagagaaatgatattattaaagaaaatggtcattcccatttgtcaaataatgatgatgaacatgatccatggactgcatgggcatacaagcctcgcaccatcacattgttacttattggcgcttgctttcttatttgggcaagtggagcacttgatccagaaagagatgcatctggggatctagttacttctgttaaaaggggtgtatgggcaatgattgctgtttttcttgcttattgcctgctgcaagctccttctacggttcttattaggccacatcctgcaatttggcgcttggttcatggcatggctgttgtatacctagttgccctcacatttttgctttttcagtcatttgttgctctgtctccagcaagtgaacgaaagtgtactaacatgtattctcaatttttgtccctacagaagcgtgatgacgctcgacagtttatgaagtttcttcatcctgatcttggtgttgaacttccagagagatcttatggcgctgactgtcgtatatatctgcctgaaaaccctgcaagcaggtttaagaatgtttatgagacactttttgatgaatttgttttagctcatgttattggatggtgggggaaggcaatattgattcgtaatcagccccttctttgggtgttatcaattggttttgagttggtggagtatacttttcgtcacatgttgccaaatttcaatgagtgctggtgggacagtattattcttgacattttgatctgcaattggtttggaatttgggcaggaatgcatactgttagatattttgatgggaaaacatacaaatgggttggtctaagccagcagcctaatataataggaaaagtgaaacgaacattaggccaattcacaccagctcagtgggacaaagacgagtggcatccattgcttggtccttggcgtttcattcaagttcttagtctttgcattgtatttttgacagtagagctcaacacattctttttgaagttttgtctctggatacctcctcgaaattcggttgttatatataggttgattttgtggtggctacttgcgattccaacaattcgtgagtacaactcataccttcaagacagaaagccagtgaaaaaggtcggagcatattgttggctctctcttgccatttgcattgtggaacttctgatttgcattaagtttggacacggcttgtatccaaaatcaatgcctatatggctgcttagtatagtggaacagatcacagtttctttgggcggcaaatttatagttccagctggtagagaggttttcaccattggtaaattgcccaatttcttcgcctccatcggaatgaatcattttgaaacgtgtatccagccatttcaaggaaattttgagtga

SEQ ID NO: 8995 - DNA, 477 bp, Glycine max
  Peptide Sequence Number=SeqID_100680
atgtgcttaggtgtctcttacactgaacttgcaatcccatcaaaccctaatctccaccccttcatgttttttcgcctcgggatctccacctcgcctactttcttctttgttttctttttgcacctaccgtatcagcaaccgccgacaaaggcaaggcaaccatcaccgttgaagagaataacgaatgaagagaggcggttacagagtaaccgtcagaagcaagagaggatggaaattgaaggaggtgtaggaagcaattgtcaacaccgaacgcccgtcaacgactcaacgggttactctcttgcagtggcatttaacgcaatctttctcgtcatcttcttactcttattactctcatactccaacaatgtagagagcacgagaactctcaaagatcagtcttcttctcctgccttcataggcttaataatcaatcgggcttattctggacctagtcacagaggagccggtcattga

SEQ ID NO: 8996 - DNA, 984 bp, Glycine max
  Peptide Sequence Number=SeqID_100681
atgaaatggagcaaaatcccaaccgaaaagtgggcctttaacattccgaatttgaaagcgtgggaatcagcgaaagcacaaaacggaaaaagaaaagacgaacggagactctcctctttgttcacagcaatgcagacgctacttctgccggcaacatgcgccggcagcttcacggcggttccgctctcagcctctgccgtcgccgcccctcgtctcccgcaaccatttctccgcccgaattccttgccctcattccctctcaatttgactctttcttcttcctcatttagtaactctatcgctcgtcaaccatggacgaagcttcccttcaccgcaagcgcttcttcgcaagtatctccggctttcactccctccaacgacgaatcagaaaaggccaaactcgagctggtggcgaagaggttggagaagacggcaaggtacttcaagcgtttgggtaacttagggttttggggccaactagtgtgcaccgtcgtggctgccgtcatactctcattctccgtcatcgtcaccggaaaagtgacatctccggccacgttttatgccacagcgggtggaatagttgctgccttcatttcagtgttttggtcctttggctatattcgcctctctgagaagcttcgaaaaacttcaaatgaccctaccaaggcacctcctcgtgctgatgtagtgaaaggcttgaaaaatggtatagtattgaacctgttggggatgggtgctgctattcttgggatgcaagccacggttggattgttagttgctaaggctctcacttcctcggcaaacccgtactatcagggaatttctcctggtagcaccccagtgctcgcattggatgtatttttggtgcaggcttcagcgaacactattctttctcatttccttgggcttgttttctcactggagttgttgcgatcagtcacattaccaccttcagaagcaactccatttcccaagtttgcataa

SEQ ID NO: 8997 - DNA, 1041 bp, Glycine max
  Peptide Sequence Number=SeqID_100682
atggtattagccttttcctttaagtttaaatctgcacttgtgatggctttctcgatgtctgttgagggaataaacattcaaccatgtttgtctggctacatttcatcatgtcatcaagaagttgatttggattctatttgcaggatattgggaggtgttgttgtaatagcagcaaatgctggtggtgcatggagtcctattggtgctgttaccactactatgctgtggataaatggccaagtatctgcagtgcaaacaatgaagggtttgtttttaccttcagtcatttctctagttgttcctctggttctgatgtccttgactagtggagttaatgggaaggaacaaaggtctctggatgtctttgcctctgaaccgattgctcctcgagggcaacttgttttctcagtgagtttaggagctttgatttttgtcccagtgttcaggtccctcacaggtttacctccgtacatcggaatgctgctcggacttggcatgctttggattttcgttgatgctatccattatggtgaatctgaaaggcagaagctaaaagtgccacatgctctgtcaaggatagacactcaaggagcactatttttcttgggaattctattatccgttagcagcctggaggtagcagggattcttcgggaaatagcaaattactttgatgcacatgtcccaagatgtgaactgattgcaagtgctattggactaatatctgcagtaatagacaatgttccattggttgctgccacaatgggaatgtatgatgtctcttctttccctcaagattctgagttctggcaaatgattgcattatgtgctagtactggcggatccatattaattattggctcagctgctggagttgcgttcatggggatggaaaaggtggacttcttttggtacttacggaaggttagtggctttgccttagcaggttatgctgctggtattgcggcctatttagcgcttcataatctcaacatcttccaaccaacacttgcagaggttcatttcctttctggttcttaa

SEQ ID NO: 8998 - DNA, 438 bp, Glycine max
  Peptide Sequence Number=SeqID_100683
atggcttttcgttcaggttctctgtctcgctccttaatgtctacagctagggcatcactccgaccggcggcgccgtcgtcaacccttccccgcctccgtccgccaccactcgccgcccctcgcgtccagtcccgccgcttttccatgcctgcttccagctgtcccatggtaccttccgtcgttcttgtcaagatcgctagtagtctcgttgtgagtcttgctgagatgagatgggtagaatttgtgagtttgtctagcttggttcataagaaggtattaagattcaaatttatagggatgaatggaaaagatggagccttcttcgacgttgcttccttgctagacacaactggttcagtcttgacggggccagggtgggggtggcgtggtgcaacggcttgggatgggaggcgtatgaggaaagggaagggtgtgtag

SEQ ID NO: 8999 - DNA, 2463 bp, Glycine max
  Peptide Sequence Number=SeqID_100684
atggctagtccaactggagaattgacaagccataacgacagtaccgctgagccgatggcaactgaacaatgtgaattgtctgaaaaaacgcctcagataggatctgaaggtttagagagggaacaaaaggagcttcttaccgagttaaccagttttgttattgacgaaaaatcaaatcaagtttctgctgatgtgacggagaattctgttattcaactgcctgcaccgcctcaacatgactttgaaaagaattgccagactgtagaagggtcatgccttgaacaaagtaccgtcgaacaagtctctgttgatttatctaatgataaatctgaaaacaaatgcaagccattgtctgaaaatgttcaaagtgaacccgtagaatccattcctgccttcgtcgttgacgggcaaatgcaatccagtccagctcaagctaatatgagttctgtgaatgaattgttggatcaaccttctggagatgttgtgaacaatattaccaattgttcagaaaaaatgtctaatagcccaagtcattcgcaatcgaggcgcaagggtaaaaggaactctaaattattgaagaagaagtatatgctaaggtcgttaggaagcagtggcagagctttgcggtcaagaacaaaagaaaaacccaaggaacctgaaccaactagtaatttggttgatggtaatagtaatgatggagttaagaggaaaagtggtaggaagaagaaaaagagaagagaagagggaataactgatcagttttctagaatcagatctcacttaagatatttattaaatcgaataagctatgaaaacagcttgattgatgcttattctggtgagggctggaaaggatacagtatggaaaagttaaagcctgagaaggagcttcagcgggctaagtctgaaattcttcgacgcaaattgaaaattagggatctatttcgaaatttggattcattgtgtgctgaaggaaagtttccagaatctttgtttgattccgcaggagagattgacagtgaggatatattttgtgcaaaatgccagtccaaagagttgagcactaataatgatataattctttgtgatggtgtttgtgatcgtggatttcaccagctctgtttggatcctccgttgttaactgaagacattccacctggcgatgagggttggttatgcccaggatgtgattgcaaagatgactgcatggaccttgttaacgactcctttggaacaagtctttctattagtgacacctgggagagagtctttcctgaagcagcatcatttgctggaaataatatggataacaacttgggacttccttctgatgattctgatgatgatgattataatcctaatggttcagatgatgtgaaaattgaaggggatgagtcaagttctgatgaatccgagtatgcttctgcttctgagaaattggagggtggttcacatgaggatcaatacttgggccttccatctgaagattctgatgatggtgattatgatcctgatgctccagatgttgactgtaaggtcaatgaagaaagttcaagctctgatttcacatctgattccgaggatcttgctgctgcatttgaggataacacatcccctggacaggatggtggcatcaattctagcaagaaaaagggtaaagttggtaagctatctatggctgatgaactgtcatctttactagagccagattctggtcaagggggtcccactcctgtttctgggaaaagacatgtggaaaggttggactacaaaaagctgtatgaggagacgtaccacagtgatactagtgatgatgaagattggaatgacgcagctgctccaagtagaaaaaagaaactcactggcaatgtgactccagtgtcaccaaatgcaaatgcttcaaataattctatacatactcttaagagaaatgctcatcagaataaagttgaaaatacaaatagttcacccactaaatcccttgatggccgttcgaaatctggttccagggataaaaggtctggatcttcagcacacaaaagactaggagaagccgtagttcagagacttcacaaatcttttaaagaaaatcagtatccagatagaagcacaaaagaaagcctggcacaagaacttggacttacttatcagcaggttgccaaatggttcgacaatacacgttggagcttccggcattcatcacaaatggaaaccaattctggtagaaatgcttcaccggaagctaccgatggcagggctgaaaatgagggggagaagcaatgtgaatcaatgtctccggaggtcagtggaaaaaactctaaaaccacaagctctagaaaacggaagcatttgtcagaacccctatctgaagcacagctggatatcaatggcttagcaacaagttcaccaaatgttcatcaaacgcaagtaggcaataaaatgaagacaaggaaaaggaaatga

SEQ ID NO: 9000 - DNA, 2400 bp, Glycine max
  Peptide Sequence Number=SeqID_100685
atggtcatcgacatcgaatccttggaagacaggagacatgatgttttgcctaattcttctattttgtcaagccttttcaaggctgaggtcaaaaagtccaaccatgagccgtgtagcatggagattttaattgatgacctaaaggatgttgatattgctccacttcttgacttgtgcatgaacttagatacttctgaaatagaggctgttgatgtacgtaatgaatcatcatctgtattaaatggagaatatgcattatcattgatgcgtgctattaatcaaaagcttcgagtagtccatctacaggattcatcatttggaaaagacttcttacgggatatttcacaacgaggtttggcatgccaagttttgacattgaggtgttcacgtttccggaagctgaacttaatgggggagttcatgcatatacacaccctaaatcttgatttcagttcttcccttaccagtttccaggaagactgttttaattgtatgcccaacctaatgcgcctctcaatgtgtgatacacagattacaaatctttggacgactgttgcagctctctctaagcttccatctttgattgaattaaggtttcaatatttgcagtattgcaatgatgctgtgacatcttttatcccatccagtgggaagtctgatgacactgctgattttagcccgcttgatagtgttccttttattggtgaaccacacactgatacaacagaactgacagatcctaactttaatgctgaagatcctctaagaaatttttattcctttgatgaagaagttataaatcctgatgttcaaagcatggttgaggattcttcagatgatagtgaagttggctttactagtcgtcatcataaatactggtttgcagatgtttttcctgggtggagttcagaagtgcctcttcagaatgagaatgaagatggagaagagtcattgcaaggtgcttttacagaccgtattgctgatgtttctatgaagtatatgtcttgtcatgcatcaccaatatgctatgagaagcattacagagagttcatgatagcttcattgccgaatctaaaaaatttagataatatgccaatcagaaagattgacaaggaaagggctaccagaatattttctcaatactttgaatatcttccatataaatggaagcacaaagagagtgttgtaagtatcttacagaagagagaaataaaatcaggccacaataaggtgcaatcttctaagcataggccatcatatccttctggaaagtcccaatatttttatactaggtctctttctgctgctaaattggggtcttcaacttggcctattttgcatcccctttctttagtaggatgtgaattggacaagggctttcatccaaggcagtttgagtaccatccatctgactctagtttgatggtctttggaactttagatggtgaagtagttgtcatcaaccatgagactgaacatattgtgagttatatcccatcacttggagcaatgaatagtgttttgggtctctgttggctcaaaaaatatccctctaagcttatagcaggatcagacaatggttccttgaaattgtatgacatccaccacataccaagaaaagttactggcatacatgggaattttggttgtgttacctttgatgaatttgaccagttgacatctgttcatgttaactctacggatgaactatttcttgcaagtggttactcaaaaaatgttgctttatacgacatcaacagcgggaagcgcttacaagtgttcacagatatgcatcgtgggcatattaatgtagtcaagtttgctaatcattcccagtcaatttttgccacttcatcatttgatcacgatgtcaagatgtgggacttgagacaaaaaccaatacacccttgcttcactgtttcaagctccagaggaaatgtgatggtttgcttttctccagatgatcaatatattcttgcatcggcggttgataatgaggtggttagacaatatcaggctgttgatggtaggcttcacttagtttttgatatagctcccactgaaagttctcaaaattacacccgttcttattacatgaatgggagggactacatcataagtgggagttgcgatgaacatatccgtatttgctgtgctcaaacagggaggcgcctgagagatatatcccttgagggaagaaacttaggaaattccatttttattcaatctttgaggggggatcctttccgagatttcaatatgagcgtgttagcagcttacatgcagccaggctccaagtctaaaattgtcaagataaacttactagcatctagtagccatgccaacaaggatgattctgatgatttgcgaccttgccggttccacagtatgggaggttga

SEQ ID NO: 9001 - DNA, 243 bp, Glycine max
  Peptide Sequence Number=SeqID_100686
atggcagttagaaacggtccgaagatggggagaaggttgaaaccagacaggttcgtggtgtttgacagggcaaggggacccacaccttcaattcttttccctgatttgttcaattgctgcgaaatcaatggtgtggattcgtgtctaatgcttgtgactttgatcaagagtgaagatgatgaagtggagcaagagactgtattcgtatactggaccgaacggccggagtgtatcattgagtag

SEQ ID NO: 9002 - DNA, 315 bp, Glycine max
  Peptide Sequence Number=SeqID_100687
atgttgctgggtgcacctagcatgtcccagcggcaagatgggagttgggctaagggcgacgagggttattggacacattcttcagcgactgcgtttttggatcggaacctcttctgcggcgtagcaatgggacactccaacgtttggaactctcacccaaaaaactacggtcctggttctcgcacttgtatggccttatgtgctgcaggcagtgcttccgtagcaatgccaaggaaattggcttcatcaagtatcgctaaaagagcagttgtcaactacggaccaatattgtgttctggcactaggatgttttga

SEQ ID NO: 9003 - DNA, 609 bp, Glycine max
  Peptide Sequence Number=SeqID_100688
atggagtggaggaccatgttggagccatggatgcgaggcacaagccttgaagagggagggaaaagtgaagctattgggttgcagggtgttgtgggcaaatttggaggatgtgttaaggaggtgactgagaaaggtgttgaggttgtggcatttttgcaacttttggagaattgggtggttcaacatgaggctactagcttttggtctccatccaaatgtgtgaactacactgtcgacaacgaggactacacctcctcctccaccagcctcctcgtcgccatcactggcttcctcacctccccctccttccatgacaccaccaacactgtcctcccctcctccatccctacctcctcagctgcaacaattgcacactcttcttctctttcgcctccatcttcttcgtcttatttcataactccatcccaccagggtgtaggggtcaaagacgcagcggtggaggacggggaaagaatcgcacttgttgacgagggagttggtgatgaggggaatgggaacggtggagaagccatagtgagtgggatcctcttggtcgcagaagagcttcttggcacagggcttgtcggaggagaaggaagacgacgatga

SEQ ID NO: 9004 - DNA, 780 bp, Glycine max
  Peptide Sequence Number=SeqID_100689
atgacgagcgcttcggagctatttcactccagaaggcatcgattgggacgaagtgctctcgatctagggctcgacaccgaactcaacgccgccgattctctccgccgccactaccacctccgccgcctccgtcaccacccggagcgtgcatctgatagaattgatgggaggtatcggcggtctttcgcaagcgagagcgttgattctgaagaaaatgtgagaagtagtcttagaggaagtgacagtgagagactacccgtgggtgtggttcttgcacgggcaaggctccttcagaggttgagaggggaacctctatccacaaacagttggaaatgttgtggcgcgtgttcccatgctaatccaaatgataaaaacaaaatgaacgcaaaagcaaggcaatatgatagagattcatttggtgaggatcgagaaagtgaattgtcaaacgaagatccaaccagggcatctctagtttctgacttgacttctcaaatggcaaggtcccagttcttgcaagagctaaacacaaagccacctgggcttactcaagaggccttggactgtttgcatcaagaagtttttagcagcagtggcaatgagataggattggagtccagggtactgcaggattgcagtatatgcttggagtcattcacagatggagatgagctgatacgtttgccatgtggacataagtttcactctgtttgcttggatccttggattcgctgctgtggagactgtccatactgtcgaagaagtatagttgtaattaactaa

SEQ ID NO: 9005 - DNA, 1926 bp, Glycine max
  Peptide Sequence Number=SeqID_100690
atggcgaaattcgtggtggagaagaacagcttgacggtgacgtcgccggacaacatcaagggcacgcacgatagcgcgattgggaacttcgggataccccaatacggaggcagcatggctgggaacgtgttgtacccaaaggacaacaaaaagggttgcaaggagttcgatgagtatgggatttccttcaaatccaaacccggtgctcttcccactatcgttttgctcgatcgaggaagttttgcagctggttttgctttgcttgagaagtgtttttggttccttggttgcatgtttcgcttcttcttttgtcggcttaggtgcactgccttgatgtttggttcatggggttttgctattgcttgttcatattgcttctttgctttgaaggtatggaatgcacagaaggctggagcttctgctgttcttgttgcggatgatattgtggaaaagttgataaccatggacactcctgaggaggatgtgtcatctgcaaaatacatagagaacataacaataccttctgctctcattgagaaaagttttggtgaaaagttgaaagatgccataagtaatggggatatggtcaatgtcaatcttgattggagagaggctgtcccccacccggatgaccgtgtggagtatgaattgtggaccaacagcaatgacgagtgtggagttaaatgtgatatgttgatggaatttgtgaaagattttaaaggtgcagcacagatattggagaaaggtggttatactcaattcacaccccattatataacttggtactgtcctcaggcattcacaatgagcaaacagtgcaagtcccagtgcataaatcatggaagatattgtgctccggatcctgagcaagatttcagcactggttatgatgggaaagatgtggttattgaaaatttaaggcagctatgtgttttcaaggtggcaaatgaaaccaaaaagccttgggtgtggtgggactatgtcactgattttcaaattagatgcccaatgaaggagaaaaaatataacaagaaatgtgctgatgctgtcattgaatcacttggcaagtgcatgggagacccaaatgctgattctgaaaatcctgtcttgaaagaagagcaagatgcccaagggtcacgaggtgatgttaccatattgcctactctagttgtcaataatagacagtatcgaggaaaattggagaaaggtgctgttatgaaagctatctgtgctggttttgaagaaactactgaaccagctgtttgtttgagcagtgatgtggagacaaatgagtgtttggagaataatggtggttgttggcaggataaagtagctaacatcaccgcatgcaaggatacgttccgtgggagagtatgtgaatgccccctggtggatggtgtgcaatttaaaggagatggttatacaatctgtgcagctagtggacctgggcgttgcaagataaacaatggaggttgttggcatgaagctaggaatggacatgcatattctgcttgttcggatgatggaggggttaaatgccagtgtcctgcaggctttaaaggtgatggtgtcaaaaactgtgaagacattgatgaatgcaaagagaagaaagcttgtcagtgccctgaatgtagctgcaagaatacttggggaagctatgactgcacttgcagtggggatcttttgtatataagggaccacgatacttgcataagtaaaactgccagtcaggagggaagatcagcctgggctgctttttgggttattttagttggcttagttgtggctgctgcaggggcataccttgtgtacaaatacagaataaggtcatatatggattctgaaatcagagccatcatggcacagtatatgcccttggacagccaaggagaagttgtaaatcacgtgcacgaagaaagagcgtga

SEQ ID NO: 9006 - DNA, 312 bp, Glycine max
  Peptide Sequence Number=SeqID_100691
atgacattactttatttttgccaacttatgtcaggtccatatttatatggaaaaatacaaatgcaatgggcatcacatttctttaacttcaggtggggtagaatagtgatcccttatgggaatctaatgccttccattcctgctggcataaaaaatgctcatataccaaacaagatcccctgcagccaagtcatggctcagactggaaatcaagtcttcatagcaaaatctgttggaaaatcccctgctcagtttctggagatgacaaaattttgcagaagtattattggcaatgatgaagaatgcacatga

SEQ ID NO: 9007 - DNA, 591 bp, Glycine max
  Peptide Sequence Number=SeqID_100692
atggacaatccaaaacaacagccagaatgggttaagaccctatcatctgagaaatcaggagaagcagcagctgaaactagtggggatgaggcttcctgcccagccaaatatataaagatacttaaggagattctgtcatttccaggagtttctggaatgtcagcagcaatagggttgcaaggacattttgccagtggccaaccaaatcttgcttatatgaggtcaggtcttgatcttcttgctacaactgtacttccaatatggctcacagaagcaagtgtggatccacaacctagtcaggcagagtacttggaagaggtactaagagagtcttattctcatcctgctgttgaagggattataatgttttctggtccagcacaagctggtttcaacaccacgatgctagccgatgagactttcaaaaatactgctgctagagacgttgtgtgcaagctgattcaggagtggggaactgggtctcatattgccacagcagacaatagaggagttgtagatatttcactgcaccatgacgattatgatgtaactgttacatatcctctaatccactggaagccattcatgtga

SEQ ID NO: 9008 - DNA, 126 bp, Glycine max
  Peptide Sequence Number=SeqID_100693
atggtggtggtgataataagggtgttgatggcggtgacgatgatggtgggttggaataatggcgacaacaatggtggagtgtgtgatggtggtggtggaggtggcaacgatgggttgtggtggtaa

SEQ ID NO: 9009 - DNA, 1224 bp, Glycine max
  Peptide Sequence Number=SeqID_100694
atggcaggtggtggaggtggaggaggaaagctggatgagttccaacctcatcccgtcaaggagcaacttcccggtgttgattactgtgttaccagctctccttcatggcctgaagggattattcttggctttcagcattacctcgttgtgcttgggtccattctcattctttccaccatccttgtccctctcatcggtggtggcaatttggcagattgtgttgaaattggtctccctgcattggttatcctggtcatcctgtcccagtacattccccaaaggatgaaatcaagaggagctgatcgatttgcagtcatagttgcaataggacttgcatgggcatttgctgaaattttgactgcagccggtgcctacaataaaagaccacctaaaactcaattcagttgtcgtactgatcgatctgggttaattagcgctgctccttggataagagttccatatccatttcaatggggacgcccttctttcaatgctggtgatacttttgctatgattgctgcttctcttgttgcaatagtagagtcaacagggacattcattgcagcatcaagatttggcagtgcaacccctgttccaccatctgtgcttagtcgcggtgttggctggctggctatgggtctaagttgtcttgactctaggcataagatgagttatcaattttcaatcaatcaacgttataaagaagcaactgatttacagtacatagagtttgtgattggccttggactgaaaatgatgctagccagaaaatttggagcagttcttgcttcaatacctttgccaattatagcagctatttactgcgttctctatgcctacgtagcatcagctggccttggtttccttcaattctgcaatctaaacagttataggtcaatgttcatcgttggcttttctctcttcatgggtttatctgttccacaatatttcaacgaatatgtattgctatccggacatggccctgttcatactggcaccaccgcgttcaacaatatagtgcaagtgattttctcatccccagcaacagtggcaatcatagttgcttacttcttggatttaactatgagtcgtggagagggctcaactcgccgagacagtgggagacactggtgggaaaaattcaggaccttcaaccaggatactagaactgaagacttctattcacttcctttgaacctcaacagatttttcccatcattctga

SEQ ID NO: 9010 - DNA, 309 bp, Glycine max
  Peptide Sequence Number=SeqID_100695
atgactttagtcaagatagcgtttgcagtgatcttttctgctataatagtttgcaatgcgcttgattttacaaggataccaagaatgacaactccgggtgaatgtcatgaaagtgatgaatgcaacttagttttacctaattgcaaaggaagagcaatttgtgacaatggtatttgcatgtgtgttgagaacaaatcaagctcgaaacaagagtgtcaaacaaacactgattgtgagtctcattgtcttccaccatgtgatattccatattgtgatataaaaaatgctgtatgtaaatgcttttgttag

SEQ ID NO: 9011 - DNA, 276 bp, Glycine max
  Peptide Sequence Number=SeqID_100696
atgacgaagctgccggaacaagctgggcaagcttctgacgtcgggacggcggcgcgtggaccacacgcgccggaaaacagtccttggatttccttccaaaaattggcacccataggtatctcagcctcaaaaagtaatctcctccactgcaggaaccactcccaggctccacctatactgctgaatattctacctccattttccaagaagagcgcaattaaacttggtcaaatctctgattcccaaacctcctttctccttcgacagacatgttga

SEQ ID NO: 9012 - DNA, 2232 bp, Glycine max
  Peptide Sequence Number=SeqID_100697
atgtcaaataatccgcaatatccaggcttacagcctcttcggcctcccattgctggttcactggatcctccgcgcaattttgttccgcctatgcctgttcaatttcgccctgctgttcctacacaacagtctcagcagttcatttccatgccttctcaacattaccaacatcaacctgttggtccgggcggtgttcccctgattggtgttggaatacctccccaaaatcaacagccacaattttctcaaccaattcaacagttacccccgagacctagtccgcagttaccacccccatcacaggcaattccaatgccggttgctcgtccaaacatgcacatcccatctgaatcaatgatgcagcagtctgattctcaagcccattctcaagctcctaatgggtacacacctggtttaggtggtccgggaatgccactctcttcgtcatatacgtttgcaccatccacttatggtcaagtgcaggctaattttaattctactggccaattccaacctgttcctcaaattcatgctctcacgggttcttcatcccaaagcattactactggtgcaactcttcagagcaatggtggacaacctttggttacaactgttatgcctttggctaccattgcccagccacagctcactaagaatggccccacagattggattgagcatacctctgctaccggaagaacggtagatgcaacaacaaactggaaggagtatactagtcctgatggaagaaagtattactacaacaagatcacaaatgaatccaagtggtcaattcccgaggagctgaagttggcccgtgagcaagttgaaaaagcaattgtcagtggatctcgtcctgaagcattgctgaattcccatcctcaaccctctccgacaccttctgcaactgaagcaacacccaacacagataattcaactttacccagtcaaggagaaccatcaagtcctgtttcagttgctccagttgttactacatctataagtaatccacaatctgagatgccttctggaccatctctgtctacttctgcaaatgctataactggagcaaaagtggacgaacttgaggcacctgtaaatactgtcacaccatcagatacttgtgtgggaagtgataaagctgttgttactgatattaacactgctgtaacaccaatgaatgatgttaacaatgattcagctcaagatactctaggttctgcagacagagttcctgtagaagataaagaagatggtaaaaatgatttgataggagagaaaagtaatgatgtggctgcagaaacaaaggcagttgagccagaacctccagtttatgcaaataagatggctaaagatgcattcaaagcactcttggagtctgtaaatgttggatctgactggacttgggatcgggtaggcaaagcagtgtctatatttgaaaatgatgaacgtttcaaggctgttgaacgtgacagagatcgcagggatatgtttgaaagcttcttggaggaacttctaaacaaggaacgagcaaaggtacaggaggaacggaagcgaaatataatggaatacaggaagtttttggaatcttgtgactttataaaggctagtacacagtggcgaaaagttcaagatcgcttagaggctgatgaaagatgttctcgtcttgaaaaaattgatcgcttggaaatattccaggactatttacgtgatttagaaaaggaagaggaagagcagaagaagatacaaaaggaagaagtgagaaagacagaacgtaaaaaccgtgaggaattccgcaaattgatgggagaacatattgcttcaggcattcttacagcaaaaactcactggcgtgattattatacaaaggtgaaagatttacatgcttatgtagcagtggcgtcaaacacctcaggttcaactccaaaagacttgtttgaagatgttgctgaagagcttgagaaacaatcatcccaacacctaatcctaattccccatgattacaaaaccctctctgatattgctggagcaatagtagaaacgtatgtcaaatcctttctcaaggtttctcagccaagtccagctgaaaaatatagcgtcctccatcagcttgttgatgttctagctgaaagctactgcagaatgagtgctgaagaaagtgctgtcttggattctgcggaaacactcccaccatatttatccaagataaggattcccaccaaagcggcataa

SEQ ID NO: 9013 - DNA, 1383 bp, Glycine max
  Peptide Sequence Number=SeqID_100698
atgaagctgagactcagatctttggaatccaaagaaacccttaaaatcgaagtccctgattcctgttctctgctgcaactcaaagacaccgtttctcgcaccatctcttcttcttcctcttctctgcatctttccctcaacagaaaggacgaaattcatgccccttcgccggaagagcccctccactctctcggcgtcgccgccggcgacctcatcttctactctctcaaccccatcgccttcaccctcgaaaccctcctccacaagccagaaactgcttcacgcgacggtccctccatccaggactcgccggaaaccctcgccagcgactccccctccgttcccgacgccgaaaagcctccaactttggacgccgcggaactggaacccatggaaatgattgatgggtctgacgagatggtggtggtgggtaccaattccgagcctttcttcgtgagaagggttctgaaagaagcgcttgggaacaacgttaatgatttcaagttattagtgtttgcggttcatggtgtggttcttgagtctggatttgttcgaatcgacaaggattgtggtatggcggttactggttctcaccttcttgatgattctcctccggctttttcttcggtgatatctttgaggtatgccctgcctgagattctggctaatggtgcttctcacagtgtgaatttgaaatttcagacattggggcattttgtgaatgtttgtgggtcgttgtctgatgatgttgggtcgaggttgcattttgtttgtttggataaacgtaaatatgttaggcctttagaattgatgctggctaattctgaagctaagggtagtgttaatgatggagaagatattctctttggaagtgaagtttttgaaatgtggaagatggtgaaagataggcttgcattgccattgttaattgatctttgcgagaaggctgggtttgatcttccaccttgtttcacgcggctaccgatggagcttaagcttttgattttagagcgtcttcccggtgttgatttggccaaagtggcttgcacctgttcggagttgcgatacttgtccaccagcaatgagttgtggaagaagaaatatgaggaagagtttggaaaagaaggagatagaaaagggtggcttttcaaggatttgtttgctgtgtcctgggaaacgaagaagaggtggcgagcggttccttttcgacgacgggggatttcaaggaacattattttctcacccaaccattttagaatgcctccagtttggggtggagaatatggtgtgcagccagtctttggtgtgccattccctagataccaactatggcggaatatcattccctcgcgtactctgactctaggagatttcaatatataa

SEQ ID NO: 9014 - DNA, 1047 bp, Glycine max
  Peptide Sequence Number=SeqID_100699
atgaggctcaacggtgaaatctcaagtggagaagaagaggagaaacaaacgggaacgacgacgttttcgtcgcagaaagtggtcgttggctacgctttaacgtccaagaagaaaaagagctttctgcagccaagtttcactggcctcgcacggaacagggggataaactttgttgctattgatctaaacaagccactgctagaacaaggtccttttgatattatcttgcataagttgtcaggggaggagtggtgtgagattattgagttcactacttcagtactatggcatggaaaacaattttcatataggttaaaagccaataatgctgcacaccaaatgcatccatttcctaaaaaggattataggcaaaaacatccagaggtaactgtccttgatcctccggatgcaatccaacatttacacaatcgccaatccatgctgcaagatgtggtggatctgaacttatctgattgtcatggcaaggttggtgttccacgtcagctagttatcccaaaagagaaagacccctctagtatcccttacgaaatcactaaggctgggatgaagttgccattagttgcaaaaccactagttgtggatggcactgcaaagtcacatgaactatttcttgcttatgatgaattctctctttcagagcttgaacctccactagttctacaagagtttgtcaatcatggtggtcttctctttaagatttacattgttggggaaaccataaaggttgtgaagcgtttctctcttcctaacatcagtaagcatgaggtatcaaaagttgctggtgtattccgttttccaagagtttcatgtgcagccgcttctgcagatgatgctgatttagatcctaatatcgctgaacatccgccaagacctttattggagaggcttgcgagggagctccgccatcgattgggactgtgcttgttcaacatagatatgattcgagaatatggaaccaaggatgtgttttacgtcattgacatcaactactttcccggcaagatatggaaaaatgccagactatga

SEQ ID NO: 9015 - DNA, 831 bp, Glycine max
  Peptide Sequence Number=SeqID_100700
atggcagagaagagcaaagagctgctccagtttgagcataaaggcacacccctttcttccttagaatccactcttcttgtttgtgataataaaaaagaatcagacacacaaactaggagactcccccctcatggcacaccactcactgccccacatcccccaagccaacatagttgtgatgcccataacagtacttattgggtatatgcatctgatgcgtacttatcactggtagtgattcactccaagtacaactggagttcccccaaaaagggtgttttggtcttgtctggttttcaacttaacttttggtgtgatttgtctgtcactggactggaagttttctgccccttgtcttgtgtgccaaacagatttgctgtatttttagggaaggttaaagacttcctaggagtgatgtcagaagcaaataagaggcttgaacttgatgcaaaggacaatcctgagaattatgatattgaagagctaactggaaatgaatcggaagttattgaaatggatttgatgcttggtgtagctgatcttcatacaccagaggcagtggctgctgctgaatctgcaatttccacttgtcagcctgtgattccattggctgctgatggtagtgaaacagattcagaggaaagtagtactgatgatgactgtggggatgatgatattgaaagcagtgatgattatcacgacgatggaaacaacagtgaaaagccttcatctcttgttcaaaaatctatttccagtaaggataatattcaggaaaaacaaaagggaaatgttcattccaaaaaacgtccaagaatagttgagctatcttga

SEQ ID NO: 9016 - DNA, 1641 bp, Glycine max
  Peptide Sequence Number=SeqID_100701
atggcttccttcatgtttgtctacctctttatccttctcaccttgaccaatttcgtaaccactatagcacagttcgaccgtgatattccggaccgcgtttgttcaaacaacctaaccactccaaacagcaccttccaattgaacgtgaagacccttctgtcttatttatcttccaacgccacagctaacaagcaatactacaacaccacagttggcagtagaaaccactccgacagtactgtctatggaatgttcctgtgctggggtgacttaccccctcagctttgtagccagtgcgtcgcaaatgcaaccaaagacatactctccgattcatatccaaattgttacttgaccacagatgcccggattgagctccgagactgcatgattcgcttttccaaccgttctttcttctctaccgttgacttaaatagttacttctattcatgctccagttccgatgcgtccgacaaaacaaactggatgagtgtgttttccaaaacgattaacgaagtcgctgatgaggcagcgaattcaactgttggtgcaaagaaatatgcaacaaaggaagcaaggatatctggaggatttcagagcctttactgtgaggcacagtgcacacctgacctctcaccccaagattgccgaaaatgtctaaatgtttccatagcgaatagtcaacagttttgtgaaggtttagcgtcacctgtttcctctcccagctgtagtattaggtctgatgtgtaccctttctatcgccccagtaccgctctggcaccaacaggagaggtttccacaaatttttccagcacagactcacaacatcctgcttatctttcccacaattgttccagcaacgaaaccatgatcaccacggaccgcgcttttctatccaatctcaagtcccttctctcttccttgtcttccaatgtcaccaccaaaaccggtttctccaagaccaccgtcgatggcaaaaacccctctgacacggtgagtggactcttcatgtgccgcgggaacctttccactattctctgtcagcaatgtgtcctaaatgcgacccaacgaatatcctcagagtgcccctcttccaaagaggccatcatatggtacaatcactgcttgcttcgctactccaataatccctcatccctgatatccacagtggacacaactccaacctatcaaaacttcagtatcgtcaatacttccaatcccaaccagctgcaaagcttcttcacttggactatggcgactgctttacctgaagtgaagtccgtgatagaggacagtaccattaagaattatggaacaaaagaagtaaaactgaatgatcagcaaaccctctatactcttgctcaatgtacgccagatctatctaatggcgcttgcggcagctgtttagacaagattttcaaatacgaaattccatggtgttgtttggcgagtccagagggaaaagtactatctcctagctgctatatcatgtttggattgtccccattttacacagatgatgaccgagttgaggcgtacaggcaacccagtcctcctccaacaactgcaggtgatgttcctattcaagctattttttcatgcaaacatcgcctaattaatcaactttcaaagttatggtactga

SEQ ID NO: 9017 - DNA, 834 bp, Glycine max
  Peptide Sequence Number=SeqID_100702
atggctgctgtttcttgcgtgtttcttttctttctttcttgtctatttctaaaatccatatctcaagccagcgcccagataatgttaaccgaatcctgtgataataacagcaacggcacctataacaccaatctcaacacccttttatctactctctcttccaacactgaaattaactatggtttctacaacttctcatatggtcaaaatgaagacaaagttaacgccattgggctctgcagaggagaccttaagccagatgagtgtcgtagttgtctcaacgatgccagaagcaatctcacagtcaattgtccaaaccaggaggaagagaaagagggaattttgcaccttgacaaatgcatgttgcgctactcaaatcgctcaatatttagcgtcatggagacttctcctacgctttatatgtggaattccaccaatgcaaccgacgtggatcagttcaatcaggtgctccagaacctgatgaggactctaactgagagagctgcatcgggtgactctcgtcgtaagtatgcagagggaagttcgtctgctccaaattttcaaaccatacatggtcttgtgcagtgtactcctgatttgtctcagcaagactgcaaacaatgcttggatcgtgtggctatctcacaaatcccaagttgttgcaatggcaagatcatgggtggtaaagttcttacaccaagttgtaatactagattcgaaacttaccggcatcttccgtcttcaaaaggaaatagcgacgcgtcacgaactgtactcctcgtcgccatggcagtgctagtcgttagcgttgatttggtgctcggttttatctga

SEQ ID NO: 9018 - DNA, 324 bp, Glycine max
  Peptide Sequence Number=SeqID_100703
atggaccagttcaatcaagtgttggggaacttgatgaggaatctaacaggcatagctgcatcaggtgactctcgtcgtaagtatgccgcggcaaatgcaactgctccaaattctcagaccatatatggtgctgttcagtgcactcctgacttgtcaggacaagactgcaacagttgcgtggttgaggctttctcaagaatcacaacctgttgtgtcggcaagataagtggtagggttgctgcacccagttgtaatattagatatgaaaacttccgcttctatgatgaacctactacggcagatgcaccagcaccagcaatgtga

SEQ ID NO: 9019 - DNA, 1452 bp, Glycine max
  Peptide Sequence Number=SeqID_100704
atgggttcttttcattttttccttctgctcctaactttcttttccctctttgttcacacctctccctcccctatcatccaagcagctatcgatcaaggtaccaaagcctactataactgcacaaggaacagcacttttgctgcctatagctcttaccgttctaacgtcaaaacacttctagattttctctcctccaatagcaccaacaatgccagattctacaacactacagtttctagcaaagacactgtttacggtagcttcctatgtagaatagacaccactccaaaacactgccaagaatgcgtgacacaagctgccaaactcatatcatcgctttgcaaaaatgctacagaggctatagtatggtaccaagtatgctatgtgcgctactccgatcgtcgtttcttctccaccgtggaggagagtcctaaactctcctttatgaatgataaagattatgtgggtaacgttgggctcttcaacaacattgtgtgggatatgatgaacgatttgagaagtgaagcagcaagtgctgctaataaatcggctgataagtctgtgaacatcattgataatgaaaaggtatatggctacgcttggtgcctcccatatctgtccaaagagaactgcagctggtgtcttagcgatgccatagcagaaattccaactggttgctgcagaggaaaatctgggggaacaataatatatcccagttgtggtgttagatacgaatcatatcaattccataaggcacaaatcaggggtggttcggtgacgccgccgccacttcccagtagtccttccccttttgcttcaccagttgggaatgacagtaccactctggaaaccttgcgatttgaattagccaaaattgaagctgctacaaacagatttgctaaggaaaacatgataggcaaaggcggatttggagaggtttataggggtattcttttggatgggcaagaaatagcagtgaagaggcttactggaagctcccggcaaggagcagtggagtttaaaaacgaggttcagtccgatgtgtttagttttggagtcatggttctagagattattaatggaaagaggaaaggttgttcttctgaatcagatggtattgatgacatccggagacatgcttggacgaaatggacagagcaaacaccattggaactattggatcctaacataggaggaccatattccggagaagaagtcatcaaatgcatacacattggtctgttatgcgttcaagaagatccaaatgatagacctacaatggcaacagttgtgttttacctcaacagcccttcaatcaacttgcctccccctcgtgaaccaggatattttaagcgcgatagaatacaagacaacaagacgacccacaaagaattggataatatcagtgattccatcaacggaatttctttaactaatttctttcctcgttaa

SEQ ID NO: 9020 - DNA, 234 bp, Glycine max
  Peptide Sequence Number=SeqID_100705
atggggacaacttccctgagaacctcgagtttgctaagggatgggaacactgaaattcagatgtgcaacagttgttgtagctctcataagaagaagcattgcatgacacttgtgttaccaagtccctctgctgtagctactcttcgggaagtcttggcagcagcaatgatattctcttggcatccttgtcagtcactagttgaaactcatgatccagggtctagatatgcatga

SEQ ID NO: 9021 - DNA, 246 bp, Glycine max
  Peptide Sequence Number=SeqID_100706
atggaagagcatttagtgtacaatggaattgatcaaagctatacatgttggacaaggtacggtgaaaagagaaacgagactgctgattatgagatgcatgatcgtgtgagaaacacggctcctactaaggtagacaatgataaaaacactgatcccaaagctcaggccttgaagacagctatggctgttaaatcaggtggccaagtgtttaagaaaaaagctaaacagactaggacattactgtga

SEQ ID NO: 9022 - DNA, 423 bp, Glycine max
  Peptide Sequence Number=SeqID_100707
atgaagttcctggagtgttctgctttagatcggcttaatgatttcttgggtaatttgaatctgggagaacgtactatcaaaggatgccttgaagcttatagttgcaaacatgctggatcggataaaaaactctccatcagtttggagacagagattcttgattatcttgggaaatcatccgacactgattcctcctcaccagatcaaaccttcttaaccagaaccagccgaaagacattggtttacctggttctaaccctgtatcacatgtatcccgattatgacttcagtgcagttaaggctcaccagtttttcacagaggaatcacgggacagctttaagcagatttttgatacctacatgcatgaagcttccaagggtttaggtagggaaggagaagaaagagaaaaagactctgaataa

SEQ ID NO: 9023 - DNA, 1044 bp, Glycine max
  Peptide Sequence Number=SeqID_100708
atggaggaatcaggtttgtcgtttgagatgtggaagctattagcttgtgaaaattacatccgaaacctcccctgcaacaataacagtggtagccatatcaagaaacatgccatgctccacaactccagcaagctgcaaaattgcatcactggcagccttcaaatccccaatactcctctcgaaatacaaatccacaataaagttcccattatccgtgacataaggttcatccttctccgcgaaagtcctaagcttggcaacgcacccagcctcctgaaaaagcttctgcaacctcgccgcggtgaacctccaacagaactgaataacctcaacgggcatggccaagccgctgccccccaaatagttaacgagcttggactcgtcgacgatgacgatgaacttcttgcaggcgccctcgaccatcttttctcgaaggagggagccgccgcggcccttgacgaggttgaggaagggatcgacctcgtcggcgccgtcgatggcgagatcgacggtggggtgggagtcgagatcggagagggggatgccgagggagagggcctggtcgtgggttttggtggaggtggggattccgacgatgtctttgagttttccttggcggaggagctcgccgatgcggtcgacggcgtgcttggcagtggagccggtgccgaggccgaggaccatgccggactcgacgtactcgacggccttgtaggcggcgattttcttgaggtcgtcttgggtgaggatgacggaggagggggaggaggggtggaggaggccggcgtccatggcggctttctcggtggcgatgaaatgggggtagggaatggccatgttaatgttaatgggtgctcgaaaaaggttgaaacttgccacgccctgaggtttaaattgaatggaatcaagacaagagagaagatagggggaatttacgtgtttcgcgcggtcctggcctgggaaagagacacagagtcagagagagagagagagattccaccaacacaacgccaaggaagaaacgcagccaccaaaggcatgcag

SEQ ID NO: 9024 - DNA, 111 bp, Glycine max
  Peptide Sequence Number=SeqID_100709
atgatgcaggatgtcgcggctccaccagaggctttttttagactgttagcgccagggaccagatttttggtgaagttggtaaggtatatgatgtcaagtggaaggacataa

SEQ ID NO: 9025 - DNA, 282 bp, Glycine max
  Peptide Sequence Number=SeqID_100710
atggagttcgggatggacgaggaggtgatcacggagcccgtggattcgtctagagctcgggatagcattttggtcacgattcggttcagatcgttgattgaaagagagtgccatagaggagacgagatcgcatggtatgcagacggtgataagattgtgcgcaatgagtataatccagctactgcttatgcatttgtgtttggaccgcatacaaattccaacgaggtgtatgaagtagctgccaaacctgtggtgaaggctgccatggagtctttttggtaa

SEQ ID NO: 9026 - DNA, 816 bp, Glycine max
  Peptide Sequence Number=SeqID_100711
atgatgattggatgtggaattacctggatgttgtggaagcttgggaggattgatggggacccggcgttgagaggaacgaggataagggctacgtgggagtacgtgagctcagttggaagtgggcaacaggggatggtggagtggtacctggagatatgtcacgggggtcaggagaccttggggacatcaggtggggtgctattgcccaaaaccaagcttgaccaatcccgacccaacccgggcatagtcagtcagcagcatgttgtggaggcctctggtaatcgattaccaggctgtgtaatcgattacacagaggaacatgccactggtaatcgattaccagttatgtgtaatcgattacacagtgcatttttgcagatcgtgatggcggcgcagctaatccatgatcgagtggagatggagtgtctagagggagcttgggagaccctcgaaggcaacacgaggtgccgatttcggggcacgattcgatttacggctacttcattggtgcatccagatgaacccgctcgcacgcttcagcgtactgtggagtggatactacccacgactacaccataccgtctagtggagccagtccaagtgattgaggtaacgtcatccgaggaagaccctgaggaggatctcgaggagctacctcctgagcctgctgtggatgctcttaactttctagagggtgatgaggacccactccctgaggtggattctcccgaggacgtcatgtcggcatccgaggcagactctacggaggatagtggccctggagagatggcgatcagtggaggctcttcatcatag

SEQ ID NO: 9027 - DNA, 1167 bp, Glycine max
  Peptide Sequence Number=SeqID_100712
atgaaaagagaaaaatatgcatcatataatagtcataactcttgcaagagcctaagtgaagaactttgtgactattacgaaggaaggcatatgtcaaatcttagacctcactcccataggagagaaaaggaaagaaaacctcaagaggctaacattaacctcccatacttccatgggaaggacaatgtagaggctaacttagattgggaaataaggataaagcaacaacttaaaaagaaatctacttcaaaatcttatggctctcactcttatccaaagaaagaccaaggtcaaggcatcttaggggtgataccttctaagcccaaagatgataaggggaagacaatagaaaagcaagcccctatggctagtatgcaagagaagactagctctatagagtgctttaaatgtcttggaagaggatacattacttctcaatgccccaccataaaaaccatgattatgaggggccaagacatttatagtagccaagatgaggctactacttcacctttctctagtgaagaaggacagccattagtggttaaagagaagtgtaaggaggtaagtgtctcctccaagaggttagctaagaaggaaactcattttacaataaagacaagcattaaagaaacttcccctcttagacaacctccacattttctcttttgtaaaaagacacttgctagcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgttttgagtagtgcaaccttcttttgtaaaatcactcgtgcacccaacatcttcatgttttgtgtacatagggactcgttaggtagtgaacaaggggttcccacgaaccctaagagaataaaggtcattcctgagtggcccactccaccaaatgtcgagggaaggagcccggagtatgaacaacctcgggatttgaggtcaaatcctttccaaggtggaaggaatgatgttcggtgtgagtgcagcattggtaattttagcactggagaccgcatgaggaaacctaagggtgacagaaggatagcattgaaaaaggaattttag

SEQ ID NO: 9028 - DNA, 75 bp, Glycine max
  Peptide Sequence Number=SeqID_100713
atgaagaacaacaatgaaggagaagatgtagcggaagacaaaggagaagaggtgagaggaggagtcatccactag

SEQ ID NO: 9029 - DNA, 603 bp, Glycine max
  Peptide Sequence Number=SeqID_100714
atgcatagatctcccacaggcaatttagtttctctggacttagaaattgaggctacattgcaaaggaacagggccgagaggagaaggaaacttctgcaagacagaatagttgcatccattcttgaggaggagacttatttctctgacttattatcacctgattcaccatcatcaagggaatccgccactcaattacctaaagtcattaccatggcagaagagcatgaccagaggattacccttgaggattactcaagtagttcagtaccacaatttttcactagcattgcacgtcctgaattgcaagctaacaacatcaactgcccacattctttaattcatttaatacaagggaacttatttcaactccctatgcacacttggcaacgttcattgaaatatggcaacagtctgaaaacctgggaagatgttgttgaaaagttcctaaagaaatacttcccaaagtccaagactgaagaagggaaagctgcaatctcttcatttcatcaatttcctgatgaatctctgagtgaagcaatggagagattcagaggcttgttgagaagaactcccactcatgggttttctgagccaatccaatga

SEQ ID NO: 9030 - DNA, 1018 bp, Glycine max
  Peptide Sequence Number=SeqID_100715
gccgagcaggcaccggcggcaccgcagattgaggccaaagcctggattctgatggactacagcagcggcaaagttctggcagagtccaatgccgaccagcgtcttgatcccgccagtctgaccaaaatgatgaccagctacgtggtcggccaggcgctgaaatccggcaaaatcaccagtaacgacatggtgaccatcggccaggatgcgtgggccaccggcaatccgaaactgcgcgggtcgtcgctgatgttcctcaagccgggcgatcgcatcccggtctcggaactgaataagggcgtggtgatccagtcggggaatgatgcctgtatcgcgctggcggactatgtcgccggcagtcaggatgcctttattggcctgatgaacaattacgttaaagcctttggcctgcaaaacacccacttcatgacggtgcacggtctggacgccgaaggccagtacagcaccgctcgtgatatggcgattatcggccagcgcctgattggtgatgtgccggaagagtatgcgctgaacagagaaaaagaatttaccttcaataatatcaaacagatgaaccgcaaccgcctgctgtggagcagcaacctcaaggttgacggcatcaaaaccgggcatacctcgggggcgggcaacaatctggttgcttcagcggtggacggcgatatgcgcctgatttcggtggtgctgggcgcgcagaccgatgccattcgcttccgcgagagtgagaagctgctgacccaggtcaacctcggcgtggcgaaggatgcggcgatcactatcccgaaagggcagatgaaaaacctcaaagccagctttaccctcaacgcaccgcagctggaagcgccgctgaaaaagaaccaggtagtgggcactatcgatttccagctggatggcaaaaccattgagcagcgtccgctggtggcgatggaggatgtaccggaagccggctttgttggccgcatctgggatttcattatgatgaaattcaacggctggtttg

SEQ ID NO: 9031 - DNA, 528 bp, Glycine max
  Peptide Sequence Number=SeqID_100716
atggccttcaaacacaatgtacagagtttgatcaatgcggggtggctgacatttcaagaggacaacccaaatgtgaggactattcctcttgctagtcatgggggctcagcggttaatgcggtggaagagtgggaacctcgggggccgaagtggatgagggacgtgttaacctctaggagcgcaagaaaagaggaaggggatgtgtgcatgcagtcggttgataagagcccgagaaaacccaagccattggtgatccacttcactagggatgttgccactcagaagccccaaggtttccagcctgtcccagttaagaagcctacgcctttcccttacaaaagtgataaggcagtgcaatggaagtacgccgcacaagggcctgacagaaggaaagatgcgtccgttgtacatgttaaggatgatctatcctccgctatggtcacaaacatatctggtatgagtggcatgactcgtagcgggcggatcttcacagcacctgagctaccggtgcgatccaaagacccatag

SEQ ID NO: 9032 - DNA, 519 bp, Glycine max
  Peptide Sequence Number=SeqID_100717
atgagagagtggtttgcttatagacttcaatccaggtcaaatgaagcacaaactttgttgcattctagaaaactattccaacaattcatcgttgaagcatataccatggttgagtctgaaagacttagctacatcaggaacaacaaaaaaaaacttagagttgacaagtattgcagtttacaaacatcattggatgctggaaccagtaaaggctcatctaaaggaaaaagagtgattttgccttcaatgtttgttggcagtccatgttacatggatcaactttactttgatgatatatttctccatgtgaagctacttggaaatttttttgttgttccaatacatgctagaaagcctgttgtggagagattacattttcatctgccaaggcaacacaatgttctttatgaagaagatgatgatatcctatcaaagccaagcattacagattcaaaattcttagcttggatgaatagcaacaaatgtttttcagaaggtagaaatcttacttattcataa

SEQ ID NO: 9033 - DNA, 441 bp, Glycine max
  Peptide Sequence Number=SeqID_100718
atggcagaaccatcagagaagcgcaagggatcctcgagtcgacgccaacgacattccgaggctcaggaaacgcaaattccctcctccattccttcttcctcattgttctcaatggaagaacaaaggatacggtacacaaatattttctcttctcattccattattgatccaaaattcattgacatggatttcttttcaaatgagagttttgaatgcattcaggcatttgaaaactccaatctcattcctttcatgtctttaaaatttcctgtttatactgaattagttaaagccttctattctaacctagaaattcaagaaggcactttgatttctgaagtttatgggataaaaatggtcattgaccaatccctattctatgacttgacccaattatctagtgaaggtataccatttgaaggtacactgaatgatgattga

SEQ ID NO: 9034 - DNA, 477 bp, Glycine max
  Peptide Sequence Number=SeqID_100719
atgatctcatcaaactttctatttcctgaaggaaactccattaataggcctcctatatttaatggtgtgggttatcattactggaaaatccgtatgcaaatcttcatagaggttatagatttaaacatctgggaagtcattgaaatcggtccttacatccctactgtcacaacctacccttcggcaggagagccacgtggggctcacgggtgcgtcttccaagggaggaaggcgcgtgaagtcgccaccaacgtttattcgaggaaaacgtcgaaaaaactggaaaggtgtggcctacgaactttaatcgtgaaaggttcgggagttgtttttacgcacggggaaggagagaatgatgcaatcctccctaggaagggaccagtcactagaaccatgagcaagaggctccaagaagattggactagagctgctgaagaaggccctagggttctcatgaacctcagggtagatttctga

SEQ ID NO: 9035 - DNA, 621 bp, Glycine max
  Peptide Sequence Number=SeqID_100720
atggagtttgttgagtcgaaccctttcttccaaaaccccaaatccatgtcttattctatgcttctcctccaacttggtgtgggattggcctttcctttcttggaggaggtggtggtggagagtggtaatagtatggttttttctttggtgggggtggtggctttcgacggccaacgtaaaactttgtcgaatctctatgacatggatcaattacgtaataatgtgaatgctaggtcgttgcccggaagcaacacgatgtatggctcgagtacagtgtcaaaagagcaagggtcgctgcatcgccgcccggatgtagtgaaaagtaagcaagggttcccacattttcatgaacgggtgtgggtaaagaagctagttcatgacaggaggattcgctttggttcatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagattaagaaatggggtagggattattgtggacaaggagtggaagaaggatgtcgtggat

SEQ ID NO: 9036 - DNA, 885 bp, Glycine max
  Peptide Sequence Number=SeqID_100721
caaaggaaatgcatgtgatgtaggtagcaaatacaccttggaagtacatataagtgatctaggtaacgaaggtaccttgattgtgcgtgggaggttgtatgccattttcgttttaagagtagcatttcttggtaaactaactttccaaatgtttgccttcgcagaaaatggccccgaggaagcttgcctcaagaggtccaggaaggataaagcggccgaaggaacagttccgctcctgagtatgacagtcaccgctttaggagcgctgtacaccagcagcgcttcgaggccatcaaggggatggtcatttctccaggagcgacgcgtccaactcagggatgatgagtatactgatttccaggaggagataggtcgtcgacggtgggcatcactggttacccccatggccaagttcgatccagaatggatcgcgtttgatgcagatgctatcggccagctcctgggatatccgttggtgctggaagagggccaggagtgcgagtatggccagaggaggaaccggtctgatgggttcgatgaggaggccatcgcccagttgctatgtataccggggcaggattttgcctggactgctgcaaggaggcgagtgcgaattatgcgcaccaacatgaccaccctgactcagatatggatgactttgctgctcagcaacatcctgcccaccgaccataattccgacctccccttgccgaagtgtcagctggtgtacgccatcctggcgcggatgagcatccatatggctcagttaatcgctgatgccatctatatttttgcaggtatggcgcctaccagacaccctttggatccagataagtccaacagggccctgggatttcccgcgctgatcacaggactctgccagtc

SEQ ID NO: 9037 - DNA, 384 bp, Glycine max
  Peptide Sequence Number=SeqID_100722
atggtgggttacacaccttcaagctttgcggatctggtcttcactggcgaaaggatcaaagtaggcctggaaagaggtaaatctaaccatcttgctttgataaatgcaaaaactggggcaaatgaagaggatgagaatgaggaaggaacccatgttgtggctgccattcctacatggctaaacttcccaccagctcaacaacatcattactcagccaatattagcccttctcattacctaccacccagtcatccacaaaggccatccctaaatcaatcacaaagcctgtctaccgcatgcccaatgcccaaacaccaaccaagaaatgaattttgcaacgaaaaagcctatagaattcaccctaatttcggtttcctatgctga

SEQ ID NO: 9038 - DNA, 630 bp, Glycine max
  Peptide Sequence Number=SeqID_100723
tggagaaaacaccgagactatttcaagtctcacaagtcatccagaactacgtaggtctgagttccttgttggaggatacgtaggagcaagagcctcgcttttgtcgaccacaccgcttttcgttaccatgacccaagagctggtagcccgcggagacaccttacggttatccgcacctcgtcgttcagtgaccccaagtgtgattgatgagcagaggccaatgtggtctgagttcctcattggaggatacgtaggagcaagagcctcgcttttgtcgaccacaccgctattcgttaccatgacccaagagctggtagcccgcggagacaccttccggttatccgcacctcgtcgttcagtgaccccaagtgtgattgatgagcagaggccaatgtggtctgagttcctcattggaggatacgtaggagcaagagcctcgcttttgtcgaccacaccgcttttcgttaccatgacccaagagctggtagcccgcggagacaccttccggttatccgcacctcgtcgttcagtgaccccaagtgtgattgatgagcagaggccaatgtggtcatctgcgccctttccggagatgtcaacatcttccggtggagactttttcaagtctcacaa

SEQ ID NO: 9039 - DNA, 597 bp, Glycine max
  Peptide Sequence Number=SeqID_100724
atgaaggccgacatggaggccatgaaagagcaaatggccacaatgatggaggccatgatgagcatgaagaagataatggaaaccaatgcggttatagttgccgctactagcgctatcgctaaggtgaacccgatgctcccatctggcctcaagcaaatgaatcatccaacctcaaatatgttaggcaaagatttgggaagtacggacgaccccatgatgtgcaaattcaaaacaagcacgccttcccatcatatggcttgcctcccgactatacaccacccaatgtggcatacactctcaatgaaaatctcaaataactccactcccatactcattaagagccaacaacctcaatctgatcatgtgcatgtctctcgacccatggaggagacgcatgaaattccccaccacgatctagcgacttcgagccttgcctcggatatgccgctgaagggcaagcagttggtggtgtatccctgcaaaacactttggagggccctcagtgtcacccacaaccacaaccctcacattccacagcagttaaaaaccctcatgcaatggcagaaatgggaaagaggaaaggctcagggccattga

SEQ ID NO: 9040 - DNA, 1299 bp, Glycine max
  Peptide Sequence Number=SeqID_100725
atgccgctggaaggcgaagcgttgctgttacaggtgctggagcaggttaaacacagcgcctcgcctgcggcgctgagctttttgcaggcattactgctgggggcgatcactgaacagggcgagcaggatgcggcggaattccgcgcccgctttcagcagctgaccggcccgctgatggcgaaatcggtcgaagacacgctgtttttccgcaatcacgtggcgctggcaatcaacgaagtgggtgccgaaccgctgccgcacgcgttctcgcttgaacgctttcatcgcgaaatgcaaatccgactgcagcaccagccggatgggctgtcgggcacctccacgcacgataccaaacgcggcgaggatgcacgcgcgcggctgtataacctgagtgaagcgccggcgctgtgggcggagaatgtgacgcgctggcgccagatgaatcagccgcacgtggtcgcgctggcggacggaccggcgcccgaaccgccggttgagtggatgttgtaccaggcgctggcgggcgtctggcccaccacgctgcagccggaggacacggcggcactggacgcgctgcgcgatcgctttttgccgtttgtggaaaaagccctgcgcgaagcgaagttacgcaccgactgggcggacagcaacgaagcttatgaaaatgccgtgctggagtatgcccgccagctgctgtcacccaccaatccggcgtttctgcaggacttcagccacgcactgcagccgttcatccgggccggactggttaacagcctgagccagacggtgatcaaactgaccgcgccgggcgtgccggatatctatcagggctgcgaagcgctggatttcagcctggtcgatccggacaaccgacgcgagccggatttcgctcagctgacggcgcagctggatgtccacgccgcgccggatttcgccagccagcaggactggctgagcggccggctgaagcagcagatggttgcgcgcctgctgcatctgcgccgcgaccatgcgcagctgttccgcttcggtgattatcaaccgctcagtgcatcgggcgaacatgcggaaaaagtgatcgcctttgcccgtcaggacagcgactacgcgctgctggtgattacgccacggctgattttcaatggtgctcagtggagtcatacccgactggcactgccggaatcgctggcgcatcgccactatcgcaatgtgctgaccggcgagaccgtagtgattaatgacgatgttacgctggacaatgtgagctatagcgcgccgctggtgctgattagccagtag

SEQ ID NO: 9041 - DNA, 573 bp, Glycine max
  Peptide Sequence Number=SeqID_100726
atgatcacgctggatgacgtggcgtcactcctacacgttcccatcactggcgcgctgcataagtttgagccgctagttacttcagacacgattggtctactgatagagcttcttgaggtcagtcatgaggaggctacatttgagacccgacaggctggtgggcctcatgtccggttggggtggcttcgggacttgtatgagagccagtgcagggccagacgatgggttgcaacagtccgcacgtatctgctccacttggtgggttgtactcttttcgccaagagttcaacccatgtacatgtcgtgcacctagaggctttcagggacctggcccagtgctggatatacgagcactttcctacagtgcatacatgtgtcattcatgatgcttatgatgaggagagcccacgggcctacaggtggcttacgggtaaggctcatatgacggggatccagggagccccgtatcggagacgtctggatgccctgactgtgactgacatgtgctggatgccctatgctgagcatcgaggagtcaggggctttgacttgatattgtcgtacaccggctag

SEQ ID NO: 9042 - DNA, 189 bp, Glycine max
  Peptide Sequence Number=SeqID_100727
atggtcattttctgccctttgtcattcagtaagtcgagaggtgggggagacaaattatggtcattccgtacacctttttgccatccgaaggcgatcgtgtccggtggcacgcagagacaaattatggtcattctgcgccttgccgcccaggctcgatcgcgtccaaagatacacagagacaaattatag

SEQ ID NO: 9043 - DNA, 441 bp, Glycine max
  Peptide Sequence Number=SeqID_100728
atgtggggacatcccctttatcctcgaaccgctggccaaatcttgacatgtatcatggccagccgttctacaagccttgagccaaaatcccaactcaccataatccttacccttggaggaaaacacaaagagaaggaaaattcccaatccaagaaagggagaagacacaaaaaaagaagagagaattccgaatccaagaaagggagaagacacaaaacaaaaagaaaattcccaatgaaagagtgggagaaagcaaaaaaaaaagaaaggaaaattcttgatcaaggatcgaaagaaaacagaagaaatatgcagaaaggtcttcggaccagacaatatctgaacaatacagaattgtcaccaagtaaacaaaaaagaaaggaaaccacgacccaaagtggccctctccctttgattgccaaccaaaatcctgtgcgctag

SEQ ID NO: 9044 - DNA, 309 bp, Glycine max
  Peptide Sequence Number=SeqID_100729
atgatgctgccgtatggtgttggtgcagtcactttatttggttaccgtaaggatcataatggtcaatggctgaagaaggacacactacctccgcaagacgagcgtactccctctcctcctcctcaacgagatgattcctcagcccttatgactgaagttctttcagagttacggggcctccacacctatgttggtgaacgattcaattccttggatggtcgctttgaaggcatggatacccgcatcacccagcttgaagaggatgtgacttatcttcgttggtgcttcgatcttccaccgtcttcttag

SEQ ID NO: 9045 - DNA, 636 bp, Glycine max
  Peptide Sequence Number=SeqID_100730
atggagacaacaacggggtcatcttggttgatggggttgattcccttaaagtccttgtctataaaggtgataagagggagacttcgctataagggtgcatcgacaaaaattaatgttgatatcatgtatttggttgtgtctgaccccgacctgggaggcttcactggggtagctgaatggcccttggctcgttcgcacaattcattcatgttaccaggtggttttttgcacagactgtctacgaacttgtcagggcgtaaggcgaggagcatggaatgcaatattggccaaggtggtcggggtcatgcgatgagacctgctagtggtgtactacatattgaatcgttcgatgatggtttcgaagctatctatggacctaggtggaagtccaccgtaccaggtcaatgctactcccttaaggaagaggttcacctgtgtcaggaaggtattcaaatgctcctctggatctattgtcccatcatatcacttgaggttgagcggtttccaccccaagggtatgtctgcctccataatatggtcgacaaaaggatgtcaacggacagtttgtgctattggacgatgcatgtgggagagactcagatcatctacagtgttgcttgtgagtcaggggtgtga

SEQ ID NO: 9046 - DNA, 219 bp, Glycine max
  Peptide Sequence Number=SeqID_100731
atggagcgttgccacgaggaggaactcaaaaaattgaagggttaccacgacgagttcgaggctcataaatcactcaacctggagcgctatgatgggccactgatccagacgaacatctggatgcgttccttacccaggctaacctttacaccaatgacgacacgatcttatgtcgagtctttcctacatcccttaaggggaagcattaatctggtgtag

SEQ ID NO: 9047 - DNA, 192 bp, Glycine max
  Peptide Sequence Number=SeqID_100732
atgtaccctcttttgttctcagttacaacaacccaagtagatgtaccctctacttgtaccacaaaggatgtacactccaatgtgttaagacaaagttctcaggcgataaatggcagcggaatggagaaggaagagagagaggagacgccacttcaaggagaagatgagtctagaagaagctcaccaccatag

SEQ ID NO: 9048 - DNA, 486 bp, Glycine max
  Peptide Sequence Number=SeqID_100733
atgggaaatcaacagcgacaagggtatactcaaggaggattttcaggctttcagcagggtccctataatcaacaaggacagtggaggacacaccctggcaaccagttcaacaaagaccagagtgggccttcaaacaggccaatccaacaaggacctaacatattccagaggactactaagctggaggagaccttgactcagtttatgcaggtaacaatgtcaaataataaaagcactgagtcagcactgaagaaccttgaggtccaggtaggacaactggccaagcaaatagatgacaagtcatccaacagttttgtggcaaatatagagcagaatcccaaggaggaatgcaaagctgtgatgacaaggagtaaaaggtttgtgaaggccgaggatgaggatagtgttctgcataagaaaaaaactgctgacaagaaaggtactgattgcaagaaaaatgaggtgagaggtgaaagtaataaataa

SEQ ID NO: 9049 - DNA, 408 bp, Glycine max
  Peptide Sequence Number=SeqID_100734
attcaaatgtccaagaattgtaatgaggccttgctgggcaaatggggctgggaattggcgactaatcagaatcacttttggcccagaattgtaatgtccaagtatggtggctggaatgctctgattcatgggagaaactccacagctttctctaagtggtggaaggacttaaaatctattttccagcagcagcacactaataggctgttttataatttgtgttggaagttgggtaatggggcaaaaatcaggttctggaaggataaatggagagacgatgatttaactcttcaagaaaaataccctactttgtatcaagtgagctaccagcaggattcttctatcagcctaatgggaattcttgttgataataaatgggaatggaggatgcaatggaggagaaattga

SEQ ID NO: 9050 - DNA, 318 bp, Glycine max
  Peptide Sequence Number=SeqID_100735
atgaaactggccaaatacaggctaaaggcccaagtggagaaggacgaaggcccaagtggagaaggacaaagcccccaagtggagaaggatgaaggctcaagtggaacttatcaaggtaatccttgtggcgtctacccagacttatcttccttcactggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccccgtaa

SEQ ID NO: 9051 - DNA, 366 bp, Glycine max
  Peptide Sequence Number=SeqID_100736
gctcatgagaaccctagggtcttctcttgcatctctgacccaatattcttggagtcttctatccaatgcccttgcggggtaggattgcatcagctcatcctcgaaggggagcctcctcgacatcctgacgaggtccacaaggatcatcgagagcatgctcagggagacatcgactcctactcctcgtttcccgctgagggaccggggaaactcgatctcatcgaagaaagattgagggttgttgaagggtttagcgattatccattcgcagacatgaccgacctatgcctggtgccggacgtcgtcatccctccaaagttcaaggtacctgacttcgataggtacaaagggacgatttgtcctagg

SEQ ID NO: 9052 - DNA, 330 bp, Glycine max
  Peptide Sequence Number=SeqID_100737
atgcgagcaggaaattctgatatctatggattcctcgagctacagtccattcagaggtctgggcattcacagtttgaatctgaaagttacataaagatttggatgcagagttcacaacatgatgtgtatcttggagcctacctaaatgggccagacaactaccttaaggggattattaatagtgctatcaagggtcttgatgatgctccacagcctaaatcaaagacttctgctagatggattgtcgtcaagtattttaacgatcctagaccattggagtcagagagattaacagcattgcggatccagtgggcacagttttatctctga

SEQ ID NO: 9053 - DNA, 1056 bp, Glycine max
  Peptide Sequence Number=SeqID_100738
atgaaagatatcgaactggcgcgtaaaattgaagaagtcgtgcagtggcagccacaattacaggcaggctcagccctggaaggcacgccgcagggagacttgcgttgtatgaccaatcgtcagcctgaattgccgccagccatatttttaatgggccccactgccagtggcaaaacggcagcgactatagccttggcagagcgcttaccggttgaaattatcagtgtggattccgcactggtttaccggggcatggatataggcaccgccaagcctgatgctgaaaccttgcgtctggcgccacatcacttaattgatctgatttctccgctggagcaatattccgcagcacaatttgccagggaggccttggcgctaatgcatgcggcaacagccaaaggacgcatcccggtgttggttggtggcaccatgctctatttcaatgccttgcagcatgggctgagtgatttgccagaagcagatgccgccatccgcgcccaaattgaagcagaagcacaggccgttggttggccagccttgcatgcccaattagccagcatagatccaaccgttgctgccaaaatacacaacaccgattcccagagaattgagcgggcactagaagtctatcgcatcagcggccagccgatgagcgcactgcgcgcgcaatcaacaaaagtttcgttgccgttcaatatccttaaactggccttgatgccaagtgatcgcagtgtgttacatcagcggatcgctcaacgcttccaactcatgcttaaacagggctttgtggatgaagttaaaacgctattggctgattacccacaactgacaatcgaaagccccagtatgcgttgtgttggctatcgccaggtgctgcaatatttgaatggtgacattgacttacctacgctgggagagcatggcgtgtatgccacacgacaattggccaagcgtcaacttacctggttgcgagggatggaggatgtgcacaccctggattgtttgcaggatgattggatattgcaggcattcaccttaattgaacaacatcgatag

SEQ ID NO: 9054 - DNA, 294 bp, Glycine max
  Peptide Sequence Number=SeqID_100739
atggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 9055 - DNA, 540 bp, Glycine max
  Peptide Sequence Number=SeqID_100740
atgatggtggcccaggtgatgctggggcacgactacaagccaggaatgggtttgggtaagaacaacggtggtaggaccagcctggtgcgaccagaagaaaccgcgggaagtttagaaaggaagaacaaaggccagggcctgcggttgggacaacgagccaaagaggccccgccgtgccacattagtacgagcttcataagtgcgggtttaagacacgaaggtcaagtcaccgcgatatgtgatgattactccccaaggagatcggatttggtacggccatgccctcccggtttcaaactaggaaattggcgggtggaggaatgcccagacgtttacgcaacaagcctaatatccgacgacgaatcccgcaaaagtactaatatcggggacccaaccgtcgatttcgagcaagaagcaagtcggacggagaatgaagaggacaaggatgtagggcttcccccagagttggagaggataatcgctcaggagttgaagaagaagctgctccgaaatctgatggtgggggcaactggcacatag

SEQ ID NO: 9056 - DNA, 461 bp, Glycine max
  Peptide Sequence Number=SeqID_100741
atggctaccattgaattatcaagtagatatgagagcaagttatcatatgacaccggaatttggggctttgtggttgatttagggatggcctttatggataattgggtggtggggaatttcatgtgtctcccccatggtttaagagacatgtgcatgataagtttgaggttgttggctctcaatgagcatagaagtggagttattgacattctcattgggagtgtgcgccacattgggtggtgtaagttgggaggcaagccatatggcgggaaggcatgggggcatcgggttcactttagtaacagcgctggtagcggcaactgcaaccatattatcttcttcaagctcatcatggcctccatcattgtggccatttgctctctcatggcctccatgtcggccttcatctgctcttgcacctcttttacttcacccattactctagctctagcacgggttcg

SEQ ID NO: 9057 - DNA, 444 bp, Glycine max
  Peptide Sequence Number=SeqID_100742
atggtggtgacgggtgacggagaattaggttggaccttgggttgggtcgatcggtccgcctccggtgtgcaccggtcggctcgtcccttctgccggcgatgcgctcctgtccttaactggccgggtcgtgcctccggtgctgttactttgaagaaattagagtgctcaaagcaagcctacgctctacgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 9058 - DNA, 553 bp, Glycine max
  Peptide Sequence Number=SeqID_100743
atgggagataacaacagcagactctccttccccgaaaacaccgagattgtttcaaatctcacaagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattgatgagcagaggccaatgtggtcatctgcgccttttccggagatgtcagcattttccgatggagacttttcaagtctcacaagttatccagaactacaggcggcgggcccgatgatacgcggagataccttccggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 9059 - DNA, 696 bp, Glycine max
  Peptide Sequence Number=SeqID_100744
atgggtatgatgaaaatcttaattatagtaaccaatatcggtatgtatgcaagcggtaacctgaaaacaggtttatggcttagtgagctcacacatatctatcatgcagctaaagagaaaggttatgatattactattgcaagtcctcagggtggcaacgttccggtagatcccgagagcctgaaacattttacactcgataaaatttctgaacaatattggaatgaggatgattttcggttattgcttgtaaacagcgtgaaactagctgaccttactcagcaggagtatgatctgatctatttagctggaggacatggtacgatgtacgattttccggatgattctactatacaatcaatggttagcaaccagtacgaaaaaggaaagaaagtcgctgcaatctgtcatggcgtggggggattgttaaatgttaagcttagtaacggtgaatatctgcttaaaggaagatcaatgactggatttgactggtttgaggaaactattgccagaagaaaacgggaggtacccttcaatctggaagcggccattaaagggcggggtgcagatcttaaaaaagcttttattcctatgacctccaatgttgttgttgatggtaatttaataacgggtcaaaatccgtttagttcaaaggcaatggcaaaagtggttatggaacaacttgaaaaaatgtaa

SEQ ID NO: 9060 - DNA, 322 bp, Glycine max
  Peptide Sequence Number=SeqID_100745
cttaggtggagggcaaagaatgcctccttctgggggggccagagccatcagtgagatacactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 9061 - DNA, 291 bp, Glycine max
  Peptide Sequence Number=SeqID_100746
atgtcagtgaaaaactttgttgggcacctaggagtacatgacaagacaaaccacacactaggagaccagtcaggatcacgttgttttgcgataatgctccaaccatatgggatcaacataggcttaaaggagcactcaaaccgggtgtatttacccctaaggcctacactccaaagagtccgtcagggcctctccttcctgattcaggttcaacccataaaacattttagcacagagactctatctatgaactgtacaaaacacacgactcctcaattgttctcaaaatag

SEQ ID NO: 9062 - DNA, 907 bp, Glycine max
  Peptide Sequence Number=SeqID_100747
atggatgagaagagaaagaaaaaactaaaggaagctactcaatccggaagcactgacaccgtcattgatcctccatctcccatcaaacgacacgtgaagtggaaactagcccgcaccaagaaaactggtgacatgacatctgaagcagcaacggaaattgctgacaagattgatgcgcttgaggagcaggcctcacaggaacaccctggtcgtgtgcgtgctgtaggagccggtataaccatcaaacaatactttggatcaacttcaagaacctcctccattgctcccgaatacctgcaacagctgacgcaacaaatcaaggaccaactggaggattcaatcacagaaaaattcactcgacgactaatgttatccctcagccaaatgcaatcacagggactcgcactgcctcctgaacctaatgttagaccttcagctgctcgtgtcagcacaaaggagagttgtgttgatccctcagggaacgatccagacactgatgactcatacaaatgcgggaagagttatgagggatccacaaccattcacaacattcctttgctgcatgatcaagtcaaggttggtgttgaggagattagagatgcagatgctcccattcctgtacccacgaaagaggttaaggtcatgggacaggctctcaacacattccttgcttggccgactcatcttgtcaagtgtttatcagaacatggagttgtgggacccgcgaaacctgcagataggccggatgatgaggtcgatgatccgctatatctaatgacattgaccatctcacagctttttctgaagccattgcaggttatgtgggatgctaccttatttgacctgtttaatgaaaacttccccttgtacataaagcatgaagatctatctgaaattgcacacggtg

SEQ ID NO: 9063 - DNA, 1500 bp, Glycine max
  Peptide Sequence Number=SeqID_100748
atgaagcttgcttctacagctcttgcatacatgtcactcgctgtgggtgccacgtactggagacctaatggtgtgttcttgcatacgtgtcacttgccgtgggtggcacgtactagagacataatgacatgttattggggagtatcagtttttggcatgggtgttagttcctgtgctgctcctcttaatgtcttccggggccctgtagtctttgatgttatgaccaataccacagtgatatctgcagtatttggttgtgtcttcaatgttatgtctagggtagccgaatgggggtgcgtaatgctcgtacctgagtcctttggggaaaggctcgcgcttgtttggcttatgtctcttgtccaacttgtgcaaattgggcttggtgtgtgcttcgcacttgtcgcgcttctgtccgacttcattccagaatttggacatttcttccctttggatgtggagcatggaatgcaatgctacctcaagattgaggttttggatctagacggtcatgcggtgagacctgctagtggcatactggcactaaatcgtttgacgagagtttcaaaattgtctatggacctagaggttgagtgttttccaccacaagtgtatgtctgcctccataatgcgatcgacaaaaggatgccgacaaatagtcttcactggacgatgcacgcgggagagactcaaatcatctacagtgttgcctgtgcgttggggggcgagggaaccattcaactggcaactgctcccggtcccttcaacctcaagccaccacagcaaaaagactccggctctgtgctccgacccaaaccccccgtacccactcttgacccgacccgttcactgctccgccctttctgcttcgatccaggatccagacccgcccggcccagtctctccctcaaaatggaactgctccgccgaatgagccgcggctgcttcaagaccgaggtcgattccgccggccaggacttcttcgacgccgccgccgccgcggcgcccaacccggctcctcaccaccttgttattatggttaacggaatcattgggagtgctgctgattggagatatgctgcagagcagtttgtgaagaagcttccagataaagtgattgtacaccgcagtgaatgcaattcttcaaaattgacgtttgatggtgttgatacaatgggcgagaggctagctgaagaggtattatctgttgttaaacgttggccagaggtgcagaagatatcctttgtggcgcattctctaggaggcttggtggcaagatatgctattgggagactttatgattattcttcaacattggcacttgttggtaccagtagagactatttcaatgaagagaaaacagaattttcaaagcaattccttgaacagagttatgaagccaagattgctggtttagagcccatgaactttataacatttgcaacaccacatctcggttcaagaggaaataaacaggtagctgaagtttgctatgaacagtag

SEQ ID NO: 9064 - DNA, 228 bp, Glycine max
  Peptide Sequence Number=SeqID_100749
atgcattctcatgatttcaggattgtcatcataaaaaagggggagattgtggaagcaaagctttccaagtttattttgatgatgccaaagaatgaagtcaagaatcaagagtcaaacaagtttcaagaatcaaagagtcgttcaatcaagaatcaagattcaagtgaagattcaagagaagactcaagatatgcaagaacttcaagaaaagcatcaagatcagtataa

SEQ ID NO: 9065 - DNA, 615 bp, Glycine max
  Peptide Sequence Number=SeqID_100750
atggagggtgaagctccggaagaagacgaagaggtacaggccctcaaggcagagcttgagaaagcccaaacagtcaaagaaaagttcaagtcagcagctattaggatccaaaaagagaacgccgaactaagagacgtcaatatagccaccaccaaagccttggagcaagagaccaagagggcacataaggaagaacatggccggaacaaatttcgaggggctctgtggggcagtaacagcgagcttaagctccaaagagaagaaagggaccaatcacgagtagaaggcttgattctgaaggatgaattgaaggcttgcctaaggtcaaagaggagtttgtctcaacgattatgcgagaccgaaacaaacatgttagccatcatcagcaagtaccaagaagaattaaatttagcccgagtgtacacggaaaagaaggctagaggaagggtgattaactcgttacatcaagaagcaacgatgtggatggaccggtttgctcttactttgaacgggagtcaagaacttcccctattgctagccaaggccaaagcaatggcagacgcctactcccccccgaggagatccacgggctcctcagctattgtcagcatatga

SEQ ID NO: 9066 - DNA, 402 bp, Glycine max
  Peptide Sequence Number=SeqID_100751
atgaagaggactgatgcagcaataaaaaatttggaggtacaaataggccaactagctgagtcagttactgaaaggcccactgaaacctttgcggtaaatgctgagatgaagcccaaagaggattgcaagttaattttcactgagagagaaaagaaaaaaaagaaaactgaggaagatgaaaacattctccaagtcaatacccctcctcatcaacttattgtcatggaagaaagacatggaaaacatgagaaagccttaagtgtcattctttccttgatcgctaccacttctcttgcaataatgtggaaggtgcttccagaatacacgattttcatggcgtctctagctaagaggcgaaaatgcaaggaaaatgtgttctacgtgaccttcatgccaccttga

SEQ ID NO: 9067 - DNA, 219 bp, Glycine max
  Peptide Sequence Number=SeqID_100752
atgacattcatggggctccgaaaaaaaagtggagaatggaattggcgaacagcgctacgcaataacttcgcggctccagactccaaagcgctaggcaatgacattcatggggctccgaaaaaaagtggagaatggagaattggcgaacagcgctacgcaataattcgcggggctcctagactcgaaggtggaggacacatgaacagcgctaggcaatga

SEQ ID NO: 9068 - DNA, 204 bp, Glycine max
  Peptide Sequence Number=SeqID_100753
atggagattcttcaccattcttcatcgttcttcatcgttcttcgttcgttcttcattgttcttcggtcttcaaccggtctgagttccttatcgcaattgaggatatgtaggagcaaaagccccgcttttgtcgaccaccccaagagatcgttaatggtccaacgccttaacgtttctctcctttcaaaaccaagagatcgttaa

SEQ ID NO: 9069 - DNA, 150 bp, Glycine max
  Peptide Sequence Number=SeqID_100754
atggtgtggcatctccaatcatctttcttccttctccattccgctgccatcaatcttcaagaagcaaaggagtccattgatgaagaagatccaaggcctacaagctccataggagctacatcatgtggtatcaagagcatcttcatctag

SEQ ID NO: 9070 - DNA, 239 bp, Glycine max
  Peptide Sequence Number=SeqID_100755
agaattggaaaggagtattggtgtcatcccttgacgaatttgagtcaagaagcaaggggccaaccacctcaagagctattggactaagaagcctttcattggaagtgaaaaagaggctaagtcttgaattgcaaaatgtagcaattgggctaagctcagcaattgggctaagcgcagctttagcgtgctcagcacaaaggagaatctggcagagcatcagcatcaaagccgcgtgctaa

SEQ ID NO: 9071 - DNA, 237 bp, Glycine max
  Peptide Sequence Number=SeqID_100756
atgtttcattctgcaaattttgttacgtcatgtggacataatctatctcatcatgagtcggaactgccaagaaatataagcaatttacatgatgatgaagatgatgatgatgattatattgcgtctaactcatacgttgaagagtctttggatgaagatgatagcattaaaggaatatctgatacagatgatcaagtcaccgcattattgaaccagtttcaattgttcacccaatag

SEQ ID NO: 9072 - DNA, 318 bp, Glycine max
  Peptide Sequence Number=SeqID_100757
gctgacccagctgggtcatttgacacggagcggtatttacggcatttggttcgccagcaggcggccaaccacagggtgcacgtgcagacctatgactgtctctaccagcttagcctcagcctgcagagccagggttttgattcttttccatgccctactccggatcagttcagggcagaggtcgcatggcccagagattggccggaggcccaggcaggggaggcgcccgcagaggctctcggcgatgcagatgaggcccgcatagacgaggagatgacaaatttactcgatttcttggcagggagcggagccacatga

SEQ ID NO: 9073 - DNA, 129 bp, Glycine max
  Peptide Sequence Number=SeqID_100758
atgtcagaaaatctatatgcagcggttgtgaatgctgggagaaattcaacacttgaagatagagtcacccatctagacattgcacttaaggaatgtgttaggcagctaagaaaaacaaggtgtttataa

SEQ ID NO: 9074 - DNA, 256 bp, Glycine max
  Peptide Sequence Number=SeqID_100759
atgcatagatctcccacaggcaatttagttcctctgggcttagaaattgaagctacatggcgaaggaacaatgccgataggataaagaaacttctgcaagacagaacaattgcatccattcttgaggaagagactcatttctcttacttattatcacctgattcaccatcatcaagggaatctgccactcaattacctgaagtcattaccatggcagaagagcatgaccagaggattacccttgaggattactcaa

SEQ ID NO: 9075 - DNA, 534 bp, Glycine max
  Peptide Sequence Number=SeqID_100760
atggcttctaggaaacgtaaaagtattagtttaagacccacagcgcaatatgacacaaggagattctcttccttagatgcttggaccagatacatagataatgtcctggggagaaacattttaccagagaggaaagtagagatatatcactctgagctagatgagtttaaggttgaattggagaggcataatttccataaacgcctcaccaatttagttgatggaagcataaacctagctttggtgaaagaattctatgcaaatttatacagttctgaggaccgtccaccaaaggagtccagagtcagaggtcatttggtgaagattgatgctgacagtctcaacacattcttggagacacctgtggtattagctgagggggagaccttactcgcttactccagatactgcagattgcctatagactatagagagatagaggctgccttatgcatacctggccgagggttcatcttgaactctgagggccatcttgggaagattctcaggaaggatttgactacactagctcag

SEQ ID NO: 9076 - DNA, 642 bp, Glycine max
  Peptide Sequence Number=SeqID_100761
aaagcttgatgaaaagctgctcaacaacttggaaatcaagctgaactccatacaggctctggctgatgatgcagaactaaagcagttcagagatccacgtgtcaggaactggcttcttaaggtcaaagatgctgtgtttgacgcagaggatctcttggatgaaatacaacatgagatctccaaatgccaggtcgaagctgaagctgaagctgagtctcaaacctgcacttgcaaggtaccaaatttcttcaaatcttctcctgttggttcctttaacaaggaaattaaatcaaggatggaacaggtccttgaggaccttgaaaatcttgctagccaaagtggctatctaggtttgcaaaatgcaagtggtgttggatcaggatttggtggtgcagtatcacagcaatcacaatcaacatctttgcttgttgaaagtgttatttatggcagagatgatgacaaagaaatgatctttaattggctcacatctgacattgacaattgtaacaaactatcaatactttctattgtgggcatgggtgggttggatgaatttgatgttttcaatgtaacaagaacaattcttgaggcagtcactaaatcaactgatgatagtagaaaccgagaaatggttcagggaag

SEQ ID NO: 9077 - DNA, 771 bp, Glycine max
  Peptide Sequence Number=SeqID_100762
atggcactagaattggtcggtggtgctcttctttctgctttccttcaggctgcgtttcagaagcttgcttctcatcaaattcgggacttctttcgtggaagaaagcttgatcaaaagctgctcaacaacttggaaatcaagctgaactccatacaggctctggctgatgatgcagaactaaagcagttcagagatccacgtgtcaggaactggcttcttaaggtcaaagatgctgtgtttgacgcagaggatctcttggatgaaatacaacatgagatctccaaatgccaggtcgacgctgaagctgaagctgagtctcaaacctgcacttgcaaggtaccaaatttcttcaaatcttctcctgttagttccttttacaaggaaattaagtcaaggatggaacaggtccttgaggaccttgaaaatcttgctagccaaagtggctatctaggtttgaaaaatgcaagtggtgttggatcaggatttggtggtgcagtatcacagcaatcacaatcaacatctttgcttgttgaacgtgttatttatggcagagatgatgacaaagaaatgatctttaattggctcacatctgacattgacaattgtaacaaaccatcaatattttctattgtgggcatgggtgggttggatgaatttgatgttttcaatgtaacaagaacaattcttgaggcagtcactaagtccactgatgatagtagaaaccgagaaatgaaatcaaaaggaatgggaagctttgcaaactcctcttaa

SEQ ID NO: 9078 - DNA, 434 bp, Glycine max
  Peptide Sequence Number=SeqID_100763
gagctctcatctctggccatatcacatctatggcccagtctaactcctctagacttgggttccctggtcttatcacaactctatgggctaggagagcgagggcaaggccagctgaggctccgtccacatctgtagctcctcctccagcatgtaccttagcagctccttctaccccatcttctacagactttcaacactctatcccttctgttgaacagtttaatgaatgggtagcctggcccgggactcagcctccccttcacaggaaggacgaagaagctacagccacttatgagaaatctcttgaggccacttttgagccttcagaaccagtggtagagacagcttcaattcagcctatagtagacccctccactcctgaggatcaaactacaccagtcctgtcttcgaacacctctcctccagctacccct

SEQ ID NO: 9079 - DNA, 354 bp, Glycine max
  Peptide Sequence Number=SeqID_100764
atgggtgagagagagagaaactgggagggaaggcttgagtgggaaaggagtgtttgtcgtgatggaggtaaaggggtgtacaagttcaatggagattttacgcttattacttttccaacataccggctgagtataaggagtaggatatgtggaaggttgccaaagaccttcaaaccagaacttgcacagcttataatgcacaacataaacccatctatttttggggggaaacaagagggaggtcactatggggcaggagaagcaatagtgtggaaaaggaagtcggagaagccaaagttggatcgtgagaagccggaactggatcgagagaaagactcatggtgtggtagatag

SEQ ID NO: 9080 - DNA, 438 bp, Glycine max
  Peptide Sequence Number=SeqID_100765
atgaggaatgtcagcaatagtccattcctagactccagtactacaaactacactaatggttctcacgcatcctcaactcatggccaaataaaccctcgtagtcacaattcctctacttctgctgaccctccaaacaacaacactcaatggggtaatgtctctcactcagtccctgcatgccagtattgtggtcgttgtgaccacactgccaaaacatgttacaagctgcatggtattgggacccctctgatcatcatctctactaagcaaatatgtcacaacatgataacagttctgatcccaattggttgcttgatttgtgatcttggaaatttatccgtctcttttttcaacactctggctccacctctatactttggcatggttgctttttatcttggaagaccagaggagttcaaaataacagtgtcgcggtaa

SEQ ID NO: 9081 - DNA, 159 bp, Glycine max
  Peptide Sequence Number=SeqID_100766
atgggaggtgcaaatagaaagtttcaaaatctgggcccttctagaggattctgggtatttccttgcttaaggtggaagcaacgtagctcgcctgggcgagctgagctcgcctggggggaggagggaagaacaaaaacgttcaaccctcctggtatctga

SEQ ID NO: 9082 - DNA, 249 bp, Glycine max
  Peptide Sequence Number=SeqID_100767
atggagcggtatcgacagcacttggttcaccagcaggcggccaaccaccgggggcaggtgcagaaacatgagtgtctctaccagctcagccttaatcagtttagggctgaggtcgcatggcccggagattggcccgaggcccaggcaggggaggcgcctgcagaggctcccagcgatgcagaggaggcccgcatggatgaggagatgacagatttgcttggtttcttgggagggagcggagccacatga

SEQ ID NO: 9083 - DNA, 186 bp, Glycine max
  Peptide Sequence Number=SeqID_100768
atgcaacaaacactagacctaaatcagtgtcacagaaattggaagaaaatattttatccaagcacaaacttcaagccttattccatgtattggggggaagttatggctggccatatgggtagaggtgtcatagaaggagcaggttgcatggtgaaggcagatggaactctgttgctaggcttgcaa

SEQ ID NO: 9084 - DNA, 960 bp, Glycine max
  Peptide Sequence Number=SeqID_100769
atggtgcgaggacaggtcgttcgttttgatgctgacaccattaacgacttcctcgacaccccagttattttggaggacggggaggagtatacaacatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttattacgatcttgcgcccacttctcacacttctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgtgacattcagggggtggtttctgataccctgatctttgagtcactcagccctgcgatcaacctagcctatgtgaagaagaactgctggaaccccgccgacccatcgatcactttccctaggcctcgccgcacacgtaccagagcttcagcatcagctcccgaggcccctcttcctacccagtctccgtctcagccatcccagcgaccgcgacatccacctgcttccacctcagcatccatggacatgcatgggcagatgctgagatcccttcacgttggacagcagctcatcatggagaatatgcataggctgtccctacacctgcagatggatcccccgctcaccactccagaggcctatcgtcagcgagtcgcctggccaggagaccagccctccactgacaggggggaagagccttctggagccgctgaggatcctgcagtcgatgaggacctcattgctgacttagccactgctgactgggcccatgggcggacttgggcggaggcagttgatttttcttga

SEQ ID NO: 9085 - DNA, 588 bp, Glycine max
  Peptide Sequence Number=SeqID_100770
atgccatatgtggaggccacaaaggagtcattagaaaccgctttccagtctttcgaggtggtaagaatttcctccgtggactccttctttgggcaaccttgcctgtcagatatggcagtaatggtggcccgggtaatgttggggaatggctacgagcccgaaatgggtttaggcaaggacaacggcagcataactagcctgataagcgccaaaggaaatcgtgggaagtttgggttaggctacaaacccacacaggcagatataaggaaaagcattgcgggaaggaaaaacggaagtcaaggctcgagctttataagcgcgggtctaggggacgtaggccaagtcgttgcaatatgcgaagatgatgctctgagtgggtccaatgacgagtccctcgaaggtactaatacctgggacccgcccatcgacttcaagcaagaaacgaatcaaacagaagatgaagagaacgaggatgtgggacttcccctggagttggaaaggatagtcgcccatgaggaccaagaaatggggcctcatcaagaagagatagaactagtagacatgggaactggccgtggaaaaggagaa

SEQ ID NO: 9086 - DNA, 191 bp, Glycine max
  Peptide Sequence Number=SeqID_100771
caccactcattgagttggtgaggaaccatgttccctcatgggaagatgtccatgaaaggggtgtcgagggaaggagcccagagtatgaagaacctcgggatttgaggttaaatcatttccaaggtggaggggatgatgcaatcctaccccccaagggtattggatggaagactccaagaggcttgggctag

SEQ ID NO: 9087 - DNA, 360 bp, Glycine max
  Peptide Sequence Number=SeqID_100772
gagttctccaagctctttggcgcgtttaatattgcggattttataccctatctcgggtgcgtggatccacaaggtttgaactcgagactcgctagggcacgtggcgcgctcgatagcttcattgataagatcatcgacgagcacgtgcataagatgaagaatgataagagcagtgaaattgttgatggagaaacggacatggtggatgagttgctggcgttctacagcgaggaggcgaagttgaacaatgaatcggacgatttgcagaactctatcagactcactaaggataacatcaaggctatcattatgccacctaatgaaattgataattcgtggcatgaaagtttacgcatttga

SEQ ID NO: 9088 - DNA, 586 bp, Glycine max
  Peptide Sequence Number=SeqID_100773
gtctagaagggacgccactagagaaggctccagtgccgcctcagagtttgatagtcaccgtttctggagtgccgagcactagcagcacttcgaggccatcaggggatggtcggggccatagggagaggcgtgtccaggggggggaagatgagtactcggaattccaggaagagatatctcgcaagcattggacacctctagtgactcccatggccaagggtcagtggattcccttcgacgcagatgccctcagccagttcttgggtgacctgctgattttggaggaagaccagctgtgtgaattcagccagaggaggagccaggcagacagtttcgatgaggaagccatcgcccagctgttgcgcataccgggcaatgtcttgcctagcgaccacaactccgacctccctctgcctaagtgccagctggtgtatgccatcttgacacggatgagcattcacgtagcccaggtgattgctgatgccatttatttgtttgctggaatggcgcctactaggcaccctttggactcggagaagtccaacggggccctagggtttccggctatgatcacgggcctctgcca

SEQ ID NO: 9089 - DNA, 525 bp, Glycine max
  Peptide Sequence Number=SeqID_100774
atggagattattatttctattccacaaataaattgtgatttgtgtcgaagagagcattacaaggacaattgttatctctattccacgaataattctgggtggagacaggagtttaatccttaccatcattatgaagaagaaaaagctcctgatcttgaaagtgtgttcgaagaattcatggcatatcatgctagctctaaagctaatcaaaattcaatgcaaaatcatgagattcattttggcaagagctactatttagaagattatcaaagggaaccagagttacaaacctactatcaaaaggaagcagaaagaggtttcaatctggacaatttgttgatgcaattcaaggatacaattgaatcaattcaacgagcatttaaaagtacagaaattcaggttggtaagctggtagaagaagtgactcaagttgtaagcagaagagaagaagaatttgtagaggttgaagctcaagaggaaaaccctataaatgagcatgatgcgctaagcaagttcatcaattaa

SEQ ID NO: 9090 - DNA, 290 bp, Glycine max
  Peptide Sequence Number=SeqID_100775
tgaaattggagcccctggtacccctgactttttcagagtaactagcttggcccttcccaatagccagcttttgggttccatttctgaagacttaggcttgatccaataccttcgccacattgatctttccaacaacttcctcaatggctatctacccaacactatcttcaactcttctgaacttcatgtactttccctctcaaacaatgttatctccggtgaactacctcagctaattggtaaaatgacaaaccttaaacttctcaacctctccgacaatgcctttggcg

SEQ ID NO: 9091 - DNA, 462 bp, Glycine max
  Peptide Sequence Number=SeqID_100776
atggccccgaggaaacttgcctcaaagagatccaggaaggataaagtggccgaaggaactagttccgctcctgagtatgatagtcaccgctttaggagcgctgaacaccaatgctatcggccagctcctggatatcctttagtgctggaagagggtcaagagtgtgagtatggccagaggaggaaccggtccgatgggttcgatgaggaggccatcgcccatttgctatgtataccggggcaggattttgcccggactgctgccgggagacgggtgcggatcatgcgcaccaacatgaccaccctaactcagatctggatgactttgctgctcagcagcatccagcccagcgaccataattccgacctccccctaccgaagtgtcagctggtgtacgccatcctgacgcggatgagcattcacgtggctcagttaatcgttgatgccatctatatattgcag

SEQ ID NO: 9092 - DNA, 306 bp, Glycine max
  Peptide Sequence Number=SeqID_100777
atgtcgaaatgggcacttgcaaccgacaaggaaagtgtcgacgacactatatgcgaaaagtacggcattagcaaggagaagtgggcccaattttgtcaaacctgcagagacccttcgtgggaggatgtgcaaaagaaggcacaggccatccagaaacaaaacacttcccctcacgtgttgtctcgtaggggttacaaacatttagaaaacaagttgatggatgagaagagaaagaaaaaactagaggaagttgctcaatccagaagcactaacactgtgattgatcctccatctcccatcagatga

SEQ ID NO: 9093 - DNA, 153 bp, Glycine max
  Peptide Sequence Number=SeqID_100778
atggagaaattcaagaacaaaaacattggagaaaagaaggcaaagaaggcctacatcacatgggatgataacgacttagaattgtctgatgattctgaaaaagaagtgattaatctatgtctaatgggcaaaaactatgaaagtgacgaagag

SEQ ID NO: 9094 - DNA, 330 bp, Glycine max
  Peptide Sequence Number=SeqID_100779
gggacacatgtcccagacagtgtctcgacatcagggaaagctgctgcttcaggtgctgtgtccaaggatgccttgattgctgaactcaaagacacatgcaaggtgctggaagcaaccatcaaagccaccacagaaaagaagatggagctagaacggctgatcacaaggctctcagaaagtggtattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 9095 - DNA, 352 bp, Glycine max
  Peptide Sequence Number=SeqID_100780
atggcttctaggaaaagaattgcaccctctacacctactcaagccagatttgatagatccagattcacttcccaagaggcttgagtttgatgagttcaaggaggaactcgagagacgccattgggatgaggagttgactaactttttggacggcaatattgatgttgccattgtaaaagaattctatgcaaacctctatgaccccgaggacaaatcacctaagcaggtgagggtgaaaggtcatctgattaagtttgatgaggatactcttaacatatttttgaagacccctgagttggctgctaagctttgtatcccagggaggggattcgagcttaacgctgatgggtag

SEQ ID NO: 9096 - DNA, 684 bp, Glycine max
  Peptide Sequence Number=SeqID_100781
atgactttgctgctcagcaacatccagcccagcgatcataattccgacctccccctgccgaagtgtcagctggtgtacgccatcctgacacggatgagcattcacgtggctcagttaatcactgatgccatctatctatttgtaggtatggcgcctaccaggcaccctctagacccggataagaccaacagggccctgggatttcccgctttgatcacaggactctgccagtcgttcggagtctccgtcgcacctagcaaggtgattcggccgcccatcacccgaccttttattgagaagtattgcacgcagagacaggcccagggggatgctccacaggccgcagacgcgccgccaccacatcagacaggcccagttggatcatttgatacggagcagtatttacagcatttggttcgccagcaggcggccaaccaccgagcgcatgtacagacccatgattgtctttaccagttgagcctcagcctgcagagccagggttttacttcttttccgtgccctactccggatcagttcagggcagaggtcgcatggcccggagattggcctgaggcccgggcaggaggggcgccagcagaggctcccgacgaggcagataaggcccgcgaggatgaggagatgaccgatttacttgatttcttaagagggagcggagccacatga

SEQ ID NO: 9097 - DNA, 433 bp, Glycine max
  Peptide Sequence Number=SeqID_100782
atggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagcagagtctaagttctctgatgaggagtatcaggagtatttgaagctcaaatctgagagacccagcaaccaagctcaatcctcatctgtaccatgtttttcaacagcttgtatctctcaatcaattgaaggtcctagtccttggatactcgactcaggtgcctctgaccatatttctg

SEQ ID NO: 9098 - DNA, 1445 bp, Glycine max
  Peptide Sequence Number=SeqID_100783
atggctactccacctgccttgccacctcctcctcctgcagtagcatcaacgtctccgtccaccttgaagcagacacgcaaagcaacacagctacgatccttggccactagaccacctggggcagaatttgaaatccttgaagcttctgacagtaggacaaagaagaaagttcttcagattatggccgacaagtacggtgtggacgacactgtctgtgaaaaatacggcatcaacaaggataaatgggcccagttttgtcagacccacagggatccctcatgggaggatgtgtggaaaaaagcacaggccatcctgaagcaaaacaccgcccctcacgtgttgtctcgtgggggttatgactatttagaacagaagctgatggttgagaagacaaagaaaaaactagaggaaactgctcagtccggaagcactgagggtgtcattaaccctccatctcccatcagacgacacgtgaagtggaagatggcccgcaccaagaaaactaggctgatgtcgtctgaggttgcaaaggaaatcactgagaagattgattctttggaggagcaggcgtcacaaggttcgtttgtccctcatggacgtcaggatgtccttactgctgccattgggcgaccagaacaccctggccgtgtgcgtgctgctggagccggtgttaccatcaaaactcgagcaactcacttaacaaatctgggaccagttggaggagttgatcacagaaaaagtgactcgggacttgcattgccttcgaagcctgaggttggtcccttagctgctcgtgttagcacaaaggggagttgtgttgatccctcaaggaacgatccagagacgggtgactcaaacaaatgcaggttgtacatcgaagaaaattcttcccacctggttgccctaggaagagtttatgagggatccacagcggttcacaacatccctttgttgcatggccaagtgaaggttggtgttgaggaggttaaagatgcagaggctcccgttcttgtacccactaacgaggttcaactagtggggcaggcactgaacaccttccttgcttggctgacacatcttgtgaagcatgtattagaacaagcagttgtgtctccaacaaaacctccagatagaccaaatcatgaggttatgtgggatgctaccgtgttcggggtgtttaatcaagacttcccattgtacatcaagcacgaagatctctctaaaatttcacacggtggtcaatgtctcagcatatctgttatacagttgtggattctacatctgactaagacaagtatgcgagcggggaattccgatgtgaatggattcctcgagccacaatccattcagagatctgggcaatcacagtttgaatcagaaagttacatcaagagttggatgcagagctcaaaacacgatatctaccttggagcctacctgaatgg

SEQ ID NO: 9099 - DNA, 489 bp, Glycine max
  Peptide Sequence Number=SeqID_100784
atgagcacgaagtctgccataaagaatttggaagtccaagtgggacaactggcaaaagagttggcggataggtcatcaagcagctttagtgctaacactaagaagaattcgaaggaagaatgtaaagctgagaagaaggtggaggaacataaacaacagctggcagctgagctggcactagaaccagtttctgattttgttgaacttgaggaagttgtggaagatgaagatgaccaacaggagagagagacaccaataaaagatagtcaagaaggaataaagatgaaggaagaacaagaaaaagaaaaagaaaaagtagaaaaagaaaaaaaatcaaaaaatgcaaaagaaaaagagaaggttgatgatgagaaaaagaagagcaagagtgaggtttcaagagagaaaagagagagattacttcagctgaaggcaaagaagtaccatatccgttggtaccttccaagaagtataaagagcgacacttag

SEQ ID NO: 9100 - DNA, 615 bp, Glycine max
  Peptide Sequence Number=SeqID_100785
atgtattgttatagctcgcgccaggagtcgtattattggctggccggggtgtggctggagccacgtgttgtgcagacgctttttccgttgtggcagacccttctacttgagttgggagggaacttccagctcggatcgagaagtttgggtggttgtgttggtatgagttttaagcattttggggcgttttcatccaccgttggaggcgtattcaaacttgcctttcctcagtccggactcgattctctctccggcgaagataaggtctgcaaagttggctggcatatatcctatcagcttctcgtagtagaacgtctctccaccatattccttgatggactcatgttcccgtttgctcatgctctgaagttggttccgatcgggagccatatccgtgttgtattggtactagacacagattggctaaatccgagaaaggataatggtcgaggccttccaccgctctcaatctctcttccagcagatcgatctttcccttgtcttttgaaatgggagtgtcgcaacctacccttcggcgagagggcgacgcgtgactcgcgggatgcgtgttccacgaaaggaatacgcgcggagtcgccaccaacgtttatttga

SEQ ID NO: 9101 - DNA, 228 bp, Glycine max
  Peptide Sequence Number=SeqID_100786
atgatccaagagctggtagcccgcggagataccttacggttatctgcacccttttgtcatccagaggcggcgggcccgatgacaagcagagacaaaatttggtcatttggcacccttgtatcatccagaggcggtgggcccgatgatacgcggagataccttacggttatccgcacccttgtatcatccagaggcggcgggcccgatgatacgcgaagataccttacg

SEQ ID NO: 9102 - DNA, 847 bp, Glycine max
  Peptide Sequence Number=SeqID_100787
atggtggaagaatttgaagagatcctaggatgtcctctagggggaaggagaccatacctcttctcagggttctatccctcattagctagaatttctaagatagtccaaatctcggcgcaggaattagaccacagaaagcaagtcgaaaatggggtggttggaataccgagaaaatgtttagaggcaaaagcaagaatcttggcaggtaaaggcaaatggaccccgttcatagacattcttgcactgttgatcttcggaggagtcctctttccaaatgtggatgggttggtggatctagcagcgatcgacgcttttctcgcctatcatgaccacaaggaaagcccgctctttatgtatggttggtttcacacctttttcgccaagagaggatttccaaatgttcccttgataaggacaaggggttgcatcagttacaatcctgttcttgctataaggcaacttggctaccctatgagaggggcaccactagaggaagagctcgcgcctgtcatttcacgagaggtggtgcaaaagaaggacaaagaactcaggggcagtaacaatgggcccatcgatggctatcgtaagtggttaaaagcccacgtgcaaggtttggattggctcccgagtttgagaactgctaaaagggaggaagttgaggcatcggaggaagatgaagaggtgcaggcccttagggtagaactcgagcaagcccaaacaatcaaagaaaggttcaaatcagcagctctgaagatccgaaagaagaatgccgaactgagagatataaatatagctaccaccaaagccttggaacaagaaaccaagagggctcgtagggaaaagcacg

SEQ ID NO: 9103 - DNA, 279 bp, Glycine max
  Peptide Sequence Number=SeqID_100788
atggctgatgaacaaagacgagtgaccttggaagattactcaagtacttttgtgccgcaattcttcacaagcattgcatggctgccagagttgattcagaacaatttgtttcatggtttgcccaatgaagacccgtatgcacatctagctacctatattgagatatgcaatactgttagaatagttgagaggcaaaaagatggctccattcatttaaaaggtaatagtcttaagacttgggatgaagtggttgaaaaattcttgaagaatacttcctag

SEQ ID NO: 9104 - DNA, 84 bp, Glycine max
  Peptide Sequence Number=SeqID_100789
atgcctgatgcgagatggatcgaaaaaaatcctgcagcgaaagatgaccggtccaagtctccccacgagaatcccatggatggc

SEQ ID NO: 9105 - DNA, 393 bp, Glycine max
  Peptide Sequence Number=SeqID_100790
atggcggcgcagctaatccgtgatcgagtagagatggagtgcctagagggagcttgggagaccctcgaaggcaacacgaggtgccgatttcaggatgaacctgcacggatgcttcagcgcacggtggagtggatactacccacgcctacaccatatcgtctagtggagccagtccaagtgatcgaggtgacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagcggaggctcttcatcctag

SEQ ID NO: 9106 - DNA, 547 bp, Glycine max
  Peptide Sequence Number=SeqID_100791
gacggagaagacgacgttagtctctacgtgctatcaggattttcatcttacagacagcaaaaagtttttacagataaccactcgtctatttccgccggtcatcgtgactcacaagtcagtatgacagatcgtgtgagcgcggaatacgaccaaaaagtttatacggataaccactcgggtatttccgcctgtcagcatgacttaaaagtcagtatgacagatcctgtgagcgcggaagatgaccaaaaagtttatacggataaccactcgggtatttccgcccatcagcgtgactcaaaagtcagtatgacagatcttgtgagcgcggaagatgacggcgctgaagacgacgttagactctgcgtgctatcaggcttttcatcttacagacagcaaaaagtttatgcggataaccactcgagtatttccgcacgtcagcgtgactcaaaagtcagtatgacatatcttgtgagcgcggaagatggcgtaaatctccgcgtgtcaacggtcttgtcggccgtgattgacgaagggcgcagaagacgac

SEQ ID NO: 9107 - DNA, 87 bp, Glycine max
  Peptide Sequence Number=SeqID_100792
atggtgcggaatgaccataatttgtctttgcgtgccatcgggcatgaccgtatgcggatggcgaaaaggcacgtcgcctctggctga

SEQ ID NO: 9108 - DNA, 357 bp, Glycine max
  Peptide Sequence Number=SeqID_100793
atgtatgaataccctaggagaacccgcgcattaacgcgtaagcattcctttcaaaattcgtgtggatattcatgctttgttggaaaaagggaaatggctccgaagaaactctccacgaagaggtctagaagagacgccacaggagaagggtccagtgccaccccaaagtttgatagtcattgtttccggagtgtcgagcaccagcagcgctttgaggccatcaggggatggtcgttccacagggagaggcgtgtccagcttaaggaggatgagtatatgggctttcaggaagagatagctcgcagacgttggacaccgctggtgactctcatggctaagtttgaccctcgccgatag

SEQ ID NO: 9109 - DNA, 693 bp, Glycine max
  misc_feature (679)..(679): n is a, c, g, or t
  Peptide Sequence Number=SeqID_100794
atggctgaaaagacaaagaaaaaactggaggaagctgctcagtccggaagcactgagggcgtcattgacccttcatcttccatcagacgacacgtgaagtggaagatggcctgcaccaagaaaactaggcagatgacgtttgaggcaacaaaggaaattgctgagaagattgattctttggaggagaaggcttcacagggttcgtttgtcccctatggatgtcagtatatcctgactgctgccattgggcgacaagaacaccctggtcgtgtgcgtgatgctagagccggtgtgaccataaagcaatactttggatcagctccacgaacctcccacagttctttctccatagctcctgaagaactcgaacagctgactcaacaaatcagggaccagctggaggagtcgatcacagaaaaaggacttgcactgcctctggagcctgaggttggtccctcagctgctcgtgtcagcacaaaggagagttgtgttgatccctcaaggaacgatctagagacggatgactcagacaaatgtgggttgtacatcgaagaaaatccttctcgcctagttgccctaggaagagtttatgagggatccacagtggttcacaacatccctttgttgcatggccaagtgaaggttagtgttgaggaggttaaagatgcagaggctctcnatcctgtaccctaa

SEQ ID NO: 9110 - DNA, 405 bp, Glycine max
  Peptide Sequence Number=SeqID_100795
atgggttctccacctgcctctactcctcctcatcctcatcctcctcctcctcctcctcctcctccttctccttcggacgcatcggcttcgccgtctgctgtgaagcagacacgcaaagcctcacgtctacgatcgttgtccactagaccacctggtgttgaaagaccagtggtgcatgttgatcctgctacagggaaggccgacggtccccacaagaagaaattaagaacatatttggggattgtggcacgtgataaggtggacatcacctacgagaactggacggaggtccctactgctcagaaggacctgatttgggaggatattcaggcggaatttgatatcccagaggcttctgacagtaggacgaaaaggaagttactacagacagtgggggagagatga

SEQ ID NO: 9111 - DNA, 117 bp, Glycine max
  Peptide Sequence Number=SeqID_100796
atgggttcgatgaggaagccattgcccagctgttgtgcacaccggggcaggatttcgcccggaccgccacagggaggcgggtatggcgcctaccaggcaccctctagacccagataa

SEQ ID NO: 9112 - DNA, 127 bp, Glycine max
  Peptide Sequence Number=SeqID_100797
atggtggatgcgcttgccactttagcgtccatgtttcagctgacaccgcatagagacctaccatacattgagtttaggtgtcgcggtagacccgcacattgttgtttggtggaagaagagcgggacg

SEQ ID NO: 9113 - DNA, 252 bp, Glycine max
  Peptide Sequence Number=SeqID_100798
atgcaaggttctcttgaggctcgtgcacggtgcccctcattaccccaatgtaaggctttgaggtaccaatcattgtctttcgttatgaccttgaagcagggaacctattggatgagaacttctaatctgcccctaggtttgcttaaggttaatgcctggtgcccctcattgcccaagtgtaaggctttgaggtatcaatcgttgtcttgttttcatagccttgtagcaaggaagaatgaaagaagcaactga

SEQ ID NO: 9114 - DNA, 210 bp, Glycine max
  Peptide Sequence Number=SeqID_100799
atgacactctcacttaggaaaactaggcagcaagtgtcgaggtcaccctatcgtgcacaggcaactctccccccccatggtgatcaacctgagtctcaatggagttccaaaccgagtgacatgcccccaagtacaagtattcccccttatgagaaactacaagtacttactgacaaagtttatactatttccatgcaatatgaagtatga

SEQ ID NO: 9115 - DNA, 513 bp, Glycine max
  misc_feature (408)..(408): n is a, c, g, or t
  Peptide Sequence Number=SeqID_100800
atggtgcaaaagaaggaaaaggaactcagaggcagtaacaacgggcctatcggaggctaccataggtggctgaaagcctacacacaaggtctgaattggctcccgaatttgagaaccactaagggggtggaagttgaagctccggaggaggatgaagaggttcaagccctcagggagaacgccgagctgagagacgtaaatacagccaccaccaaggccttggaacaagagaccaaaagggcccatagggaagaacatggctggaacaaattccgaggggctctgtgcggtagtaacagcgagcttaagctccggagagaggaaagggaccaatcacgagtggacagtttgatcttgaaggatgagttgaaggtttgcctaaggtccaagaggagcttgtctcagtgnttgtgcgagacggagaccaacatgttagccatcatcaacaagtaccaagaagaattaaatctagccatggcccacgagcataaagtggcggacgagtatgcctga

SEQ ID NO: 9116 - DNA, 297 bp, Glycine max
  Peptide Sequence Number=SeqID_100801
atgaatctggggatctcccagtcatgtagctccactccctcccaagaagtcaagcaatttcagcacatgaacatcacaagaatcctcataaaaaccctagaacagaatggaaaactagcaagactacccatcatatctcccaaaaccccatacccacgaaaatcaagagagaaagaagtccacccaaacctgaaatttcgaagtcccactcgtagacacgcacttcacgactccgaaaatgccctcctttcgcgatttggagcagaaatgggcaccaaaggttggagctttgtttga

SEQ ID NO: 9117 - DNA, 183 bp, Glycine max
  Peptide Sequence Number=SeqID_100802
atgactaatgcaaactctccgcaagaatcattacattcagtctcaaacgggaatctaagggtttttgcggtgtgtgtgtttcttggtttgggggtgtgtgtctgtcatgagggtgataggggatcaaccattgcacaaacactattcgcttacaaggcactagcggcagcacaacaacggtag

SEQ ID NO: 9118 - DNA, 285 bp, Glycine max
  Peptide Sequence Number=SeqID_100803
atggagattaaggaaccgctagttctacttcatccgcgagaaggctatgttttcttggttttttgctgtttgtttgtggcatttgaggagtggaggactcacccctacagccaacaacttttaggtattgacgatgctgaggacgctgatgcacctgtgggcttgtacaatggatcgggcaacattcctagatacattgtgaagctagtgcacctagtcaaagttaccgaggatcaaggagaccacttggatatgacgtccatagagatcaaggagtacatataa

SEQ ID NO: 9119 - DNA, 261 bp, Glycine max
  Peptide Sequence Number=SeqID_100804
cctacgcaaattatgatggttgacattcctgaggatgttaacccaaggaatgtaaggactccagttgctgaggagaatgtaaataaggctctggatgagttcaaaaatgaagttgaaggagcatttcctcgagtaggagatactttggctgaaattttgcttcgaaagaaggactgcaacagggacatcatgttgtatccttgttgcagtgtagttttcgacaagtctactgcaagggccttcaaatcatctgaagtttga

SEQ ID NO: 9120 - DNA, 960 bp, Glycine max
  Peptide Sequence Number=SeqID_100805
atggccacttccacaattttctccctgtcatgcactcccaaaagcacattgctttccaaaccaaagcaacacacactatccccttccatgtcattgctgtcaccggaagtggtacaaaaaagcctctaccagcctctaagaaacaatgtatctccaatttctatgaagcctaagagaaatcatgtgggtggcttagtgaaggcatcaatgaataacaagaacgtggaggtattctccaaggaacatcttgctgtgtctctggccaaatatgttgctgatctatccaataaattcatcaaagaaagaggatacttcgctatcgctctttccgctgggtctatcaagtacctcaggaagctagtggaacctcactattctaacactatccaatggtctaagtggcatatattttgggtagatgagaaagtggtgccaaagactcacgtggatagcaactacaagcttgcttacgatggatttatctccaaggtgccaattcctccatacaatgtcaacacaattgatgatgccttgccagctgatggagcagctgatgtttatgagacaactctcaaacgcttggttgcaagtaatgtggtcgcaaaatcactagccacaggatttccaaaatttgatcttgtgttgttagacatgggtcctgatgggcatgtggcatctctgttcccagagcaccctacactgaatgagaccaaaaaatgggttacctttctcaagaatgcacccaccgcaccaccagagaggatcacctttaccttgccagtgatcaatgcttcttcaaacatagcaatggtggtgactggtgctggtaaagcagatgcagtctactctgcactggaggaagctcctagtgattataagctccctgctcaattggtttcacctagagaaggagagttgaaatggttcttagacaagggagctgcatcaaggttatggtag

SEQ ID NO: 9121 - DNA, 333 bp, Glycine max
  Peptide Sequence Number=SeqID_100806
atgacggaaaaggagatgataaccgtgatagtagacacattaccagtgttctactatgaaaagatggtgggctacacaccttcaagctttgctgatttagttttcgccgacgaaaggatcgaaatgggtttgaaaagaggcaaacttaatcatcctgcatggacgaatgagaaaactggggcaaatgaagaaggtgagaatgaaggagaaacccatgctgcgactgtctttcctacatggaaaatcccccaccagctcaacaacatcattactcagccgatatcaacccttctcattacccaccacccagccatccacaaaggccatccctaa

SEQ ID NO: 9122 - DNA, 219 bp, Glycine max
  Peptide Sequence Number=SeqID_100807
atggacaagtgtcttgtaaagttgcaaacccaatttcgagaagatccaacggttaacgaaggctggacagcgtttttaccaaggcagcttcatgtagttttctctagaagcttcattaagaggcttcctccagaagcttcctcgtggcttctttgcgaagctttctcaagtggattctttgagaagttagatccttatctatccacacccttctattaa

SEQ ID NO: 9123 - DNA, 1462 bp, Glycine max
  Peptide Sequence Number=SeqID_100808
atggcgatgcgcgaagagctgaatcacgacggtgcggaataccgcttcgtcgacgacgaaatcctcgggccgttcggcgagctgcactgcgtggccgcgctgccgccggcgccgaccttcctgcagccgggcgaagcggatgaagcgctgatcgccatgcagcgtcagcgctatcagcagatggccgcgcgccactcgtcgaacagcaaccacagcgcggtggcggccatcaggccggacatgacgccgttaaacgcgcgcagcttccaggcgacctggagcgcgttgcgcaaccggtcgcccagcaccgcccacagcagcacacagggtaaattcagcacgacgaaacctgcgatgacgctcagcgtatggaagaaggatcgccacgttgatcaccatcagccaggccttggggttgaccgcctgaaacagcgcgccgttgaggaaactcattggcctcacctgctctttggccaggtaggcgcagccgatcaccgccagcgggaagcggatgacgccggcccagctgagcgccagcgccagcagcgggataatgatagccagctgcaccgcgcagccggcgccgatgccgaacagcatcggcagggtgcggcgcaggccgaagttgacgcccgacgaggccagcagcaggttgttggggccgggggtaatcgacatgacggtgacgtagctgacaaaggcggagtccagcatggcaggttccttgaaaatgacggtaataacgagaggatcagcataatcgctgcaatgggagaaactgtgaccctgctcgatgaaaccccggatacccgttacctgcagctggcggatacgctggccgaggccattcgccgcggcacgctgctgcccggcgaccgcttgccttcggtgcggcgctgtgcgcaaacccatcgccacgctgccggcgctgaagatggcctcggcgcccagcggccgcatcgagccgccggcggacgacgtgctggcgctgatcgatactgtgttcgccgcccagcagaatccggccttcaccaacattgcgctggcctgcccgcagaccagcgatttttatcccggcggcaagctggggcgcatgctgtcctctcagctgcgccgtcaaccggatctgatcggacagtattcgttgccgcccggcagcctgcggctgcgtcagcagatcgcccgccgttcgatgacgctgggcatgctgctggagccgggcgacgtggtgctgacccacggctgcatggaggcgttgcagctggcgctgcgcgtcaccaccaaaccgggcgactgcgtcgggctggagtcaccgacctacttctacctgctgccgctgctggccagcctggggctgaaagcgctggaaatccccaccgatccgcagctggggctgtcgctggacgcgctggagctgctattgaacgagaaacggctgaacgcggtgattgccatgcccacg

SEQ ID NO: 9124 - DNA, 231 bp, Glycine max
  Peptide Sequence Number=SeqID_100809
atgaatctggggatcccacggtcatgtggctccagcatgccacccggtctcttgggacacggtaacaaaaagtggggtggtcgacaaaagcagggcttttgctcctacgtatcctcaatttatgatgaggaactcaaacctaccatttcatttctaaacgaccatttagaggaaacactgggtccaacaaagataggagaaaatcactcaaagtgtatcaatctcacacat

SEQ ID NO: 9125 - DNA, 53 bp, Glycine max
  Peptide Sequence Number=SeqID_100810
atgaagtctaatttcgacacttgggaagaggtgtggaagcaatatcttccaag

SEQ ID NO: 9126 - DNA, 297 bp, Glycine max
  Peptide Sequence Number=SeqID_100811
atgtcatcgcctttagaggactacatgtcctcaccttcagagggctacacatccttgccttcagagggctacacaccctcgcccttcagagggctacatatcctcgccttcagagggctacacgtcctccccttcaaaggactacacgtcctcgccttcaaaggactacacgtcctcaccttcatagggctacacgtccttgccttcagaggactacagtccttgtcttcagagggctacacgtcctcgccttcagagggctacacgtgttggatcaagtggcatcggaataattaa

SEQ ID NO: 9127 - DNA, 459 bp, Glycine max
  Peptide Sequence Number=SeqID_100812
ccccatgaattcatttcctagcgctgttcatgtgtcctccaccttcgagtctggcgccccgcgaattgattgcctagcgctgttcgccaattctccattctccacttttattcggagcccaatgaattcattgccaagcgctgttcatgcatcctccaccaacgagtctggaggctcgcgaattgattgcctagcgctgttcgccagttctccattctccacttttattctgagccccatgaattcattgcctagcgctgttcatgtgtcctccaccttcgatgttgttcatgcatcctccaccaacgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgct

SEQ ID NO: 9128 - DNA, 123 bp, Glycine max
  Peptide Sequence Number=SeqID_100813
atgagctggcgctggaaccgagaaattgttgaggaagcagaaggaattaatgaagcattgggcttgaatctagcattgggcttgaatctagaattgggcttggacttgaagagggcagactaa

SEQ ID NO: 9129 - DNA, 496 bp, Glycine max
  Peptide Sequence Number=SeqID_100814
atggaatcaaccaatgtgaagaacaagtcaagtggaaaaagaaagatgtctagtgaggacacaagaagttactttgcatggaacttggaaatggagcgtgtgctaactaatgtgcttagagatcaaagaaatttggacaataaaggtgatggaaattggagagcaacatggtatgaaattgcgagtgacattcttattcaaagtggatttgactgggatagcacaaagtacatgattaccgttgaaaatgaaattgcatggaatgaatatgttaagtcacatgaagaggtcaaacgatttcaattcaaagtcattcctaattgggatgatattgttgacctatgttcaaaggatagagccactggactcagagcaaaaaatgcattagatgcaaatgatatcatgagcaaagaaacaaatgaagaggaagcaattcatagtgtgagttttgacttggagggatcaagttctgccacaagaaaaaacattcgctcaa

SEQ ID NO: 9130 - DNA, 159 bp, Glycine max
  Peptide Sequence Number=SeqID_100815
atgtaccctctgcttgtaccacaaaggatgtaccctccaatgtgttgggacaaaggattctcaggtggggaagggaagaatcaaaagaattctcaagcggttagtcctttgaatctttgggaagagagaagggagacacaaaagaattcaggtggttag

SEQ ID NO: 9131 - DNA, 237 bp, Glycine max
  Peptide Sequence Number=SeqID_100816
atgaggtccttcaatcgtgattttccatcatggagatgtagcggaagacaaaggagaagaggtgagaagagacgtcatccactagggaataagccatggaagaaggagttttgccaccaagagagtgccatggataagaagcttggagagggtgcttcaatggaggaaaagaaagagagagagaaggagagaggagggagcacgaaattgaaggaagaaaagaggaagagaagttga

SEQ ID NO: 9132 - DNA, 667 bp, Glycine max
  Peptide Sequence Number=SeqID_100817
atgtcttggtctgcttccgtggagttatggtttctcggccaaagatatcatgatcacttggaaaagggagttgatgctgttccgaatgacaggagagctgaatgggaaaagctggattttcagttgtgtgcagtgctatggcaatctgttgaatcggatgttttggagatccttagatcattcaaaacatgttgctctttttggaagaaagcacaagagatatttgccaacgacattcaaagtaaagctagagcagcagtggaagaactgaagagatttcttgcagcaaaatcgttggaggaagtgaataggaagctggacaagttctacatggtccttatcttgagaagtctacatttagattttgataatgtgcgtgatcaaattcttgcaggtgaccaagtcccgtcaatggactccctcattactagacttcttcgcgtgcctcaagccttgaaagaagaaaatttagctgaaagtgtggaaacatcagctatggttgcatctcgtggaagagaaggaggtcgcaacaatagaggagactgtgtagctcaggtagctcagaccgaaaaatcagagcctaagttctctgatacagagtatcaggagtatctaaagctgaaatccgagaaatccagcagtcaggcttcatcttcctctgtaccat

SEQ ID NO: 9133 - DNA, 351 bp, Glycine max
  Peptide Sequence Number=SeqID_100818
atggctggagcaggtggtggtggtgacgagtaccatcagttggacggcgctcaacgtctgttagtggatgcgatgaatgcacagatgcaacgtttgctagaccgtaccacagaggaggtctatggacgactagaagctttggagaaccaagccaatcagaatgctagacgaaatatagatgggaatagaggtaacaatggcggtaatgacggaccgaggcagaaccgggttgagggagtaaagctcaatgttcctcccttcaaaggtagaagtgatccagatgcctacctggactgggaaatgaagactgagcacgtatttgcctgcaatgactacactgatgcgcagaaa

SEQ ID NO: 9134 - DNA, 468 bp, Glycine max
  Peptide Sequence Number=SeqID_100819
atggaagctctctttggtaaattgctagcttgtgaacatgaactgactcaacaatcttatgcaaaagaaacagaaaagaaaaggaaagaaattgctttgaaagtcaactcctcaagggaagaatacaaagatagttctagcagtagcaagatgaaatgtaaggacagaaaattctccaaatcctccaagaagattgagaacaaaaacaacaacacatgctttgaatgtggtaagcaaggtcataacaaatctgagtgtcctatctatcatagaaaacatggtgaaaagaaaggaaaaaaggatagaaaacaaaagaaagcctgcatagtatgggaagatagtgcatcaacaaccttcgactcttcaagttatgaagaaattgcaaaagtatgcttaatggcgaagtccatgaatgatccatcaacaaatgaagaaactgagggaaatcctgattttgaagaactttag

SEQ ID NO: 9135 - DNA, 150 bp, Glycine max
  Peptide Sequence Number=SeqID_100820
atgccgaaagatagggggaggattgtcatcatcaaaaagggggagattgtagacaaagaatcaagccgatgttttgatgatgccaaaagatcaaatgcgtctcaaagctttattcaagacaaagcaattaaagatattcaagatggatga

SEQ ID NO: 9136 - DNA, 126 bp, Glycine max
  Peptide Sequence Number=SeqID_100821
atggcctttgtggataactgtgtggtgggtaaggagatgggttgttactggctgagtaatgacattgtcagtagcatcctatccgaagccattatactgacactgcctaacgaaggcaaccattag

SEQ ID NO: 9137 - DNA, 57 bp, Glycine max
  Peptide Sequence Number=SeqID_100822
gtttaatcctagacgatcctaagtcagcccttgtgccatcagggttcatatcactag

SEQ ID NO: 9138 - DNA, 495 bp, Glycine max
  Peptide Sequence Number=SeqID_100823
atggatataaacgagggaagaaagaaggaaaagggcacacaacaggaacgaagaaaggttccttttctcaagctgttctcctttgctgatttctacgattgtgttttgatggctattggaactgttggggcatgtgttcatggtgcttctgtgcctgttttctttgtcttctttggaaagattatcaatgtcataggcttagcttacctttttcccaaagaagcttcccacgaagtttccaagtatgcgttggattttgtgtatctaagcatagcaatattgttttcatcttggacagaggtggcttgttggatgcatactggggaacgtcaagctgcaaagatgaggatggcatacttaaggtcaatgttgaatcaagatataagtctttttgatactgaggcatctactggagaggttatttcttctattacaagtgacatcatcgttgttcaagatgcactgtctgagaaggtatgcatgcatttgaattaa

SEQ ID NO: 9139 - DNA, 213 bp, Glycine max
  Peptide Sequence Number=SeqID_100824
atgtttctgcatgctttggatgttctcatttgtgttcatcctaaagagttcatattcatgggtcagtgcattaatcctagatctcttaacatcagttgtgccttcatgtaccatttctctctaggtttttctattgttgtgcctgttgatgtgcttccatctactatggtgggtgcgtatggtcctatttctatggcttcccaaatattgtag

SEQ ID NO: 9140 - DNA, 972 bp, Glycine max
  Peptide Sequence Number=SeqID_100825
atgctatggggtggtggtcgaacttatggggtcaaatcaatacgttctaagaagaaatatttgaatctcatcgatctcataagtattataccaaatcccatcaatcgaatcgcttttttcgagaaatacgagacatctaagtcatccaataattcgattgatgataaagaaagagaattcttggttcagttttctaccttaacgacagaaaaaaggattgatcaaattctattgagtctgactcatagtcatcatttatcaaagaataactctggttatcaaatgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattcctctaaaataa

SEQ ID NO: 9141 - DNA, 375 bp, Glycine max
  Peptide Sequence Number=SeqID_100826
atgtcaggatttacatgcgattctcctcaaatttcagccagcccgcatcaattagaccttgcaccttacgcttcaggcccctacaatgctcaatggaatgccccggggcttctccatggcaagcacacgttgcgttcgagtcgtattctcggagaaatggaggttgatgaaccttggttggggttatggctaccattgaattatcaagtagatatgggagcaagctttctcgctgcaaaattcatttcttggttggtgtttttggattgtgctaaaggtgatgttcgtcattggaagtgcgatttgcctctttttagacctactttgatcctttcttcggtgaagaccatatcatcaaagcttgaaggtgtgtag

SEQ ID NO: 9142 - DNA, 360 bp, Glycine max
  Peptide Sequence Number=SeqID_100827
atggcagaatcatcaaagaaatgtaagggttcatccacctccgcttcggcttcaagagctcatcgttccggagccaacagtgcatccacaacaccaattccaccctccttatcttcgtccacactattttcttccgaagaacagcaaaaacggtactcaaatcttttctcatctcattccattatcgaccctaagttcattgatatggaattcttttctgctgaaacttttgattgcattcaagcctttcagaacctaggtcttatacctctcatgtcattacaattgcctatttatcctgaattggttaaagctttttattgtaatcttgaaattcaggacgacactctgatttctgag

SEQ ID NO: 9143 - DNA, 1002 bp, Glycine max
  Peptide Sequence Number=SeqID_100828
atgacatcgcgccgcgggaagtcagcgaagaggacgaaaacgaagcctactgggctgcggttagccgccgaagagaacggtgaagcgctggaggaagaagaggaagaagcctttgatccgaccggtctgccgatcaaactggcgattgtcgggcgtcccaacgtaggtaagtcaacgctcaccaaccgtatcctcggtgaagatcgtgtggtggtgtatgacatgccgggcaccacgcgtgacagcatctacattccgatggagcgtgatgaccgcgagtacatcctgattgataccgcgggcgtgcgtaagcgcggcaaaatcactgatacggtggaaaaattctccgtcatcaaaacgctgcaggcgattgaagatgccaacgtggtgatgctggtgattgacgcgcgtgcgggcatttccgatcaggacctgtcgctgctcggctttatcctgaatagtgggcgctcactggtgattgtggtcaacaagtgggatggcctgtcgcaggagattaaagacgaagtgaaagagacgctggacttccgtctcggctttatcgacttcgcgcgtgtgcactttatctcggcactgcacggcagcggcgtgggcaacctgtttgaatccgtgaccgaagcgtacgactgctcgaccaaacgcgtaaatacctccatgctgacgcgtatcatgaacatggctgctgacgaccatcagccgccgctggtgcgtggccgccgcgtgaaactcaaatacgcgcatgccggtggttataacccgccgattgtggtgattcacggtaatcaggtgaaggatctgccggattcctacaagcgttatctgatgaactacttccgccgctcgctgaacgtgatgggaacgccgattcgcatccagtttaaagagggcgataacccgtatgcgggcaaacgtaacctgctgacgccaacccagcagcgtaagcgtaagcgtctgatatcgcatctgaagaaaaacaaacgctaa

SEQ ID NO: 9144 - DNA, 312 bp, Glycine max
  Peptide Sequence Number=SeqID_100829
atggagcatacatcctttgtggtacaaatagagcttcaagtggagcgtacatccacttggttgttcaaagagaacaagggagggtacatcccttgtggatctttgcttgtaaaggattttacaaggttattggaaatctcaagaaccggtggttgcttggggactggatttgcaggatccacgaatccacgatgtcggatacaatgtcctgacatcctgcccgagaatactggagttgctgtacaatgcaagataaaagtcaagtgcagaagtgaagctgcaggatccacgatgtcggacacgatgtcctga

SEQ ID NO: 9145 - DNA, 374 bp, Glycine max
  Peptide Sequence Number=SeqID_100830
gtggattcgccactggagattatggatcagttggtactggttcaacccgtgcaggtgtgggctcaggaggagcagcctcgttgggtctcaccactaaagggactaaggtttgggagctctggacatctgatcctactgttattgacggaggagctggagtggatgatgaagggctgttatctgctctggctctttttctcgatgccatctgcatgcaagcttggcactggccgtcgttttacaacgtcgtgactgggaaaaccctggcgttacccaacttaatcgccttgcagcacatccccctttcgccagctggcgtaatagcgaagaaggcccgcaccgatcgccctttcccaacagtttgcgcagcctga

SEQ ID NO: 9146 - DNA, 777 bp, Glycine max
  Peptide Sequence Number=SeqID_100831
atgtggctgaggatgttcctcggcgtcataggcccacttcctcaacacttggctgaggatgtgcctcatgcgtctgatggtagcccagagaggacagcagctgccgatgatgctgagataggtcgattggctagtgatgggacaactgatgatgatgaggggttccccggtaggccacgcgatcccatctgttttgataggattttgctgatcatgtggcacacaacatatggagtgggacatgagcgactcgatctcaagttggtctcccatggtaggaaagtagataaatttgggagaccggctgctaagatcgaaggtatgattgcggtcaccagattggatccattgatcaggtgttctgtgatcaccactgatcctggactcatatccgcctttgttgagaggtggcatagggagacgagcagcttccacctcctagtaggggaggtgacgatcactctagacgatgtttcgtcgctactgcacattttgattactggcgcgctgcattcattcgagccgctggctacatctgacgcagtcgccttgttgacggagctacttgaggtcaccccagatgatgaggacatgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgtgagttgtatcatggcccaaatggaggaggactaa

SEQ ID NO: 9147 - DNA, 282 bp, Glycine max
  Peptide Sequence Number=SeqID_100832
atgtttaaagatgaagagctggacatcaagatcttaaattgtctcacaagaacttgggagccaaagattacaacaatcaaggaatccaagaatctagctacaatgacgatggaagctctcttcgataaattgctagcctgtgaacatgaactgactcaacaatcttatgcagaagaatcagaaaagaaaaagagaggaatagcactaaaagccaactcctcaaaggaagaatatcaagatagtttcgacagtgaggaagatgctgaaaacttcaacttgatg

SEQ ID NO: 9148 - DNA, 513 bp, Glycine max
  Peptide Sequence Number=SeqID_100833
atgtgggatgctaccgtgtttggagtgtttaatgacaacttccccttgtacataaagcatgaagatctatctgaaatagcacacggtggtcaatgtctcaacatctctattatacagttatggattctgcatatgactgagacaaaaagttatattaagaattggatacagaattcaaagaaggatgtgtacctaggagcctacttgaatgggccaaacaactacctcaaaggaattattaacaggtcagtcctatttttcaatacattttcattagcattagtcaggaacatcaatattttaattgtacaatacgcatccatgcttgtattcaacaatactttgaaaaaacttgacgatactccacaaagtaaatccaaagttgctgctaggtggattattgttaaatatttcaatgattgtagaccattggaaccagagagattgaagatgcttcgcatccagcgggcaacctattatttgaaagttaaaaatgaaataattagtgtttaa

SEQ ID NO: 9149 - DNA, 213 bp, Glycine max
  Peptide Sequence Number=SeqID_100834
atgacgggagatgcatcaaagttcacacatatctctcccaagaaaagcgggcatgtaacttatggtgacagcaacaaaggtagaattcttggagttggaaaaatagggtttagagtcaacaatgtttatatgatagacttaagtcaaaaactagataataatcaatgtttcttagcaaagatgatgatccatggctatggcataaacggatag

SEQ ID NO: 9150 - DNA, 300 bp, Glycine max
  Peptide Sequence Number=SeqID_100835
atggttgatgtgcttccaaagaaaagaatactgatgttgcatgaggagtcgcaggggaaccggaaaacgacggcgtacactaccacactcgaccacaacattcagtcaatggcgcaaggcatgacccaagcccttcacaccagcgagcacctccgtcgtgtgatgggcagtgacggttgctcccctaactggtgggtgcagttttgcgtgttatcctatgcccgcactcgatcgacgctttacaagctcagatggtgtttcttgaagaagaggaccattggcgtgagagaagagtcgtaa

SEQ ID NO: 9151 - DNA, 495 bp, Glycine max
  Peptide Sequence Number=SeqID_100836
atcacttacctccgcaaggaagatgatcaaagtattggtgaacacatccgcactttcaaaggtttatgcgaaaaccttgctgcaactaggaaacctgtcccagacaaagagaaagttttctatctcctcacaagcctcgggcacgagtatgaaacattcacaacaaccttgctaaaacctccaaggccatcatactttgagttaatctcacaactccaaagccatgatcaacatcacaattggttctccaatcattccaatacgcacaactcttccactcctgaagtggctttctatggcgaacaacaacaatatcatcagttttcctctcaacatcaaaggaattctcaaaccttcacgtcaactgggagaggatttcaggctcaacaacccaggaaccaaaataaaagccaaatccttatgaacacacaacagagacaacccccaccactgggacaatgtcgtatgactcttgcagaacgagaacagttttag

SEQ ID NO: 9152 - DNA, 105 bp, Glycine max
  Peptide Sequence Number=SeqID_100837
atggaggagataaatggagaagacgatgaagaacaaggaactaaactccatgtagagcttgtaggccttggatcttcttcatcaatggagtcttttgcttcttga

SEQ ID NO: 9153 - DNA, 237 bp, Glycine max
  Peptide Sequence Number=SeqID_100838
atggattacgcaacgatgcttgtttttccttccggaatgttgcgaaacttcacggattacgcaatgatgcttgtttctccttccggaatgttgcgaaactttacgaattacgcaacgatgcttgtttttccttccggaatgttgcgacacttcacggattacgcaatgatgcttgtttcgagggttctaaaaggagcaaacaaggttcaaggaccgaccgcaagtactcctggatga

SEQ ID NO: 9154 - DNA, 120 bp, Glycine max
  Peptide Sequence Number=SeqID_100839
atgaagatgcagagaaacagtacacacgaagcagaaagtacacaagtgctcaaggttatggaggtgcagaggtttgggtgcaaagagagtagttctggcttagcgcaacaggcgcactaa

SEQ ID NO: 9155 - DNA, 255 bp, Glycine max
  Peptide Sequence Number=SeqID_100840
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagaggtatctttgagaaagaagtggtacatagatagcggatgctcaaaacatatgactggagatgcatcaaattttacacatatatctccaaagaaaagcgggcat

SEQ ID NO: 9156 - DNA, 804 bp, Glycine max
  Peptide Sequence Number=SeqID_100841
atgatcctgctggagcagccgctggcggtgctcggtgcgctggccattatcgtgctgggcaaatcgattgccgcctggctgctggtcacgctgctcggccactcgcggcgcaccgcgctgaccatctccgtcagcctggcgcagattggcgaattcgcttttatcctcgccggactggggatttcgctcggcatgctgagcgacgaaggccgcaacctggtgctggcggcggcgattctctccatcatgcttaatccgattctgtttaccgtgctggagcgttatctcgacaaaaccgagaccatggaagagcagacgctggaagaggcaattgaagaagagaagcagattccggtggatatctgcaatcatgcggtgattgtgggttatggccgcgtcggcagcctgctgggacagcagttgatggaagctgatgtgccgctggtggtggtggagaattcgcgcccgcgcgtcgaagcgctgcgcgaacagggcatcaaagccgtgctgggcaacgcggcgcgagtcgataccatggatttagcgcgtcttgactgcgcgcgctggctgctgctgaccatccccaacggctatgaagccggggaaattgttaccgccgcgcgcgaaaagcgggcagatattgagattatcgcccgggcgcattacgacgacgaagtggcctatatcatggagcgtggcgccaatcgcgtggtgatgggcgagcgggagattgccaacagtatgttgcatgtattgcaggaagagatcgcgcaaaacccgattgtgcgcgagtgcccgatttaa

SEQ ID NO: 9157 - DNA, 553 bp, Glycine max
  Peptide Sequence Number=SeqID_100842
gctttcagaattgggcattgagatccggtcaattttgacacatcgttcccagtggagttcacagccttcaggttatgctcagttaccatcaagggagacattcatttccaagtcaaaggcaaagagcatttctgagataaacaacctttgtgaagagtttgtttgtgttactgttggtacaatcacaaggattcttatggacaatcattcatggtgttatccatcttgcattcagtgctataagaaaatagatgtctatctagaaccatttgtgtgcccatgtggcaaacataatgatcgggttgtgcttagagttgaagtcatggtcaattataaagatgaaaacacaaaatttctcctgtgggatcgtgaatgcactgaattgattgggcaatcagctgatgaagtcaacaccctcaaaatagaagatggtgatctagatttaaatgcctccccaaaagcacttgataaactactgggtcgtctgttcgccttcaaagtcaaaatccagccgcagtataaaaaaacatactattttgaagtgctccagtga

SEQ ID NO: 9158 - DNA, 285 bp, Glycine max
  Peptide Sequence Number=SeqID_100843
atggagaaagacttcctcactagactcttcaccccttacttcatcttcacttccactagaggaagggcaagaagtagtctcctcttgactactataaatgtcttgacccctcatgatcatggttttctttggggggcattgagaggcaatgtgacctctcccaagacatttgaagcatttaatgttgctagtcctttcttgggaactagtcttaggggtgtatttttctatggtcttgttggatcaagtggccttggaataattaagaaaggggggttgaattaa

SEQ ID NO: 9159 - DNA, 1254 bp, Glycine max
  Peptide Sequence Number=SeqID_100844
atgtcccccgaatccgtctgggcttggcactccagccgcgtttatatcaaaacatctgccttgacctcttccattgatggaagattggtcaagagacacttatcctcctgcgtgatcagattgggaatgaccttgttgaccaaagtgttttacttgagttgttgccaccaacaaatagcaattgacatttatttgttttatttcagttctaaggttgaaaacaaaaacttcgaaaatgacgctacaattgaaagcaatgttgtttgccatatgctctcaaagggtggcctaatgttggtgatatatggggatagaaagtggggagaaggacaaacgagactggctattttcatgatagctacctttctcttccaagatctcttgagagatcttctcgccattcaaggagattccaaagcaagcctgttgttcagcgctggaaggttcccacaactaagcgaactcgtacaaaagcttggaatatgtcagtggtgggatgaatatttaagtcgtagattggagcaaaaagcacattatttttggtgtgaatttcgtgaaataagttgggatcctatccgtcatgaaagggaaacaagtgatacaactgagaatttaggagacatgttacattctaaggaatgggctagtatgcataaagcagaagacacaaatcccatacaaaattttgataagtatctagataccttagacgacttacttggtatgcctcacactggcattacaccttgtgatgatgtgactcgtgatattaaccttagtgttgatgaactcgcaaagttgaagttggtggaacaaattttgttattaagtgatgctttcatggaggctaaggggaagtttaaagaggcacacaaattgttagctgatctaaaggaaaagcttaaagtttgcagactgaaaaatgactatgttcaattgaaagagaaagtaacacaaacagaggctataattgagggattggttttaaacatccaagaaattaatgataaaattttgtcgcttcaagagaaattaatggtgaaatccaatacacttgaaaatatgcagaagagtaaggctgagttaacctctaggctggtttacactgccaactcaattccaacccttagtgagaagattcaggttgaattatctgaaagatcgaaatgggagatggagaaagccaacaacgccaagcatgtagctgagatagaagagaagttaatgtgtttaagaggcttaacatcttcatga

SEQ ID NO: 9160 - DNA, 291 bp, Glycine max
  Peptide Sequence Number=SeqID_100845
atgatagcgagaggacccgtgggcatggatttcaacgttgcaacagacaactcaagtatcaactcaacaggagacatggatatcaccgaaaagatacggtccctagaagaaagaataaagcctattaaatgtctatatatcattatattactagaaagaggtctagagaagaggcataatgccatagaagacactaacaaggtcattttgaagggaaaaatacctatggaagcaacattgccacctcagaagctgacttatagtgttggtagctcagttggaagaccttaa

SEQ ID NO: 9161 - DNA, 402 bp, Glycine max
  Peptide Sequence Number=SeqID_100846
atggcacatgcaccagctgcatctattgatggctccttgttgcgcttacaagacaatcatatttcaaatcaagtgtggggaggccaagaaagaatcattcatcctaggtgcaattatttgggcctcaagattgacgaactaccagtagctggtgccattaccagtgatgtacgtgttgcttgtcaagcgttactaagggacacttcacctaataagtatattaagggaaaattgatttatcttacttggttgcgacaaaattttcaggaacttcctgttcatgctaatgatattgttgttgcacaatatgctagaactcatcatgatgctgataggcggatgtttgatgctagatatatcaggagcaaaagttcactttatgtatctcctcttgctatctaa

SEQ ID NO: 9162 - DNA, 327 bp, Glycine max
  Peptide Sequence Number=SeqID_100847
atgggttctccacctgcctccacaactcctcctcctcctcctccttctcctcctcgtcctcctcctacttcgaacgcatcggcttcgacgtctgtcgtgaagcggacacgcaaagcctcacgtctacgatcgttgtccactagaccacctggtgttgagagaccagtggtgcatgttgatcctgttacagggaaggccgacggtccccacaagaagaaattgagaacatatttgggggttgtggcacgtgataaggtggacatcacctacgagaactggaaggaggtccctactgctcagaaggacctgatttgggaggatattcag

SEQ ID NO: 9163 - DNA, 222 bp, Glycine max
  Peptide Sequence Number=SeqID_100848
atggaagcggaatggagaaggaagagagagaggagacgcctcttcaaggagaagatgagtctagaagaagctcaccaccataagaggtcatggataagagcttggaggaagaaggagatgaatgaagggagaggaagagaagagcacaaaatattgtgctctaaaagagctctgaaatctgaacccactaatccaagatcaattcccaagattctccactaa

SEQ ID NO: 9164 - DNA, 747 bp, Glycine max
  Peptide Sequence Number=SeqID_100849
atgattagaccatgcaaactagaaatgcttttttcttgtataaaggaagggattactcgatccatttccatatcgatcatgatatatataataattcgagcacccatttcaaacgcatatccaatttttgcacagcagggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtgggaacaggggaagggggtcagatttatcttgacgggagcaagagtaataataatgtgtataatgctacagcagcgggtatggtaaaaaaaatcatacgaaaagaaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtactttaa

SEQ ID NO: 9165 - DNA, 995 bp, Glycine max
  Peptide Sequence Number=SeqID_100850
cctttgaagattttaaggaagaacattaccactttagctcagacatagagcgttccttctctaacttaattcctacctcccacacatttgatgtcacactggacagagccaagttaatctatggcatcatcatgaagatggatatgaatgtggggtacctcatctcccaccagatctctattattgcacaacatgattcatccatacttggattccctgctttgatcacaactttgtgcaaggctagaggagtccaatcatattctagatccctagagagcctaagccctgccattaacttggcatacattaagaagaactgttggaatctagatgatccaacggtgacatttagagggccaaggaaggccaggggtaagagatcagaggtctccactacttcagcagcaccagagacaacaactccttcttcttccacagctccaacacctcccaatgcttcattctatgctctagagcttacacaggggacaaaccattatcctgtagagccttcaaggcttgggccaaccatccatcaagagcatgatgagttagacacacaggagcccacagcaacagctgaggagccagtagaaggggaggatgagctcactcctcctgagcccttttattttgatacagatgtacacatggctcaggaggagacttctacagatcagatactagagccatctcctgcacttgttcctgaggagaccttgctatcttcaccagtcatggagccaaagcagcctattcaagattcatcagcagctccagcactggatcttaaagaagatcagccacaggatgagcaggatcttgcaccattagaagagaatgagcatgtgattggaagtatgactgaaaatgttagtcagtttatcagattgattgtgaaggaatgcattgaccgtatcccggagagcatcatcctcaagaagcttggttcaaagcaaacttgtcccaaatttgggggagtaattatcaag

SEQ ID NO: 9166 - DNA, 399 bp, Glycine max
  Peptide Sequence Number=SeqID_100851
aagtactgcacgcagagacaggttcagggtgatgcaccacaggccgcggatgcgccgccacctcatcaggctggtccagccggatcgtttgatacggagcagtatttgcggcatttgattcgccagcaggcggccaaccaccgggctcatgtacagacccatgattgtctttatcagatgagtctcagcctgcagagccagggctttacttcttttccgtgccctactccggaccagttcagggcagaggtcgcatggcctggagattggcctgaggcccaggcaggagaagcaccagcagaggcaccaacagaggctcccgacgaggcagatgaggcccgcgaggaagaggagatgaccgatttacttgatttcttaggaggaagcggggccacatga

SEQ ID NO: 9167 - DNA, 402 bp, Glycine max
  Peptide Sequence Number=SeqID_100852
atgaggggcatcgtgcatgagcctcaataccctcgtctccagaggactatacgtcctcaccttcagagggctacacgtcctcgccttgagaggactacacgtcctcaccatcagagggctgcacgccctcacctccagaggactacatgtcctcgccttgagagggctacacgccctcaccttgggtaccagttaccttcactgttgagaggactacacgtcctcgccttgagaggactacacgtcctcgccatcatagggctacatgccctcaccttcagaggactacacgtcctcaccatcagagggctacacgccctcgccattaaaggactacatgtcctcgccatcatagggctacatgccctcaccttcagagggctacacgtcctcacacattag

SEQ ID NO: 9168 - DNA, 252 bp, Glycine max
  Peptide Sequence Number=SeqID_100853
atgaaaattaggacttgcttgtgggagtttttgctcgaatttgggctgccccatgaaatggccccaaggaagcttgcctcaaagagatccaggaaggataaagcggctgaaggaaccagttccactcccgaatatgatagtcatcgttttaggagcgctgagcaccagcagcgctttgaggccatcaagggatggtcatttctccgggagcgacgtgtccagctcagggacgacaagtataccaatttctag

SEQ ID NO: 9169 - DNA, 267 bp, Glycine max
  Peptide Sequence Number=SeqID_100854
atgaggggagcgccaaccgcagaaagtctctcgcctttccttgcgagggatctaggcgcgcaaggtctcaaggttatacaaagaatccaagaggcgtggaggaggccgttgaggaaagacaaggagcttaggggcatccgtaatggcgtcatcggaggttatcatggatggctaagaattcacacgcgagggttagattggctctccaagttgaaagttatcgatgaggagaactttgaagctacgaaggaagatgaagaagtctga

SEQ ID NO: 9170 - DNA, 210 bp, Glycine max
  Peptide Sequence Number=SeqID_100855
atgttcaagaaggaatcaagaacaaggatgagttcaagatgttcaagaaggaatcaagaacaattcaagatcaagactcaagaggaaaagttgaagaacatttcaagattcaagaagaaggatgaattcaagaatcaagatcaagattcaagaatcaagagaagacttaatcaagataagtatgaaaaggatttttcaaaaattgagtag

SEQ ID NO: 9171 - DNA, 246 bp, Glycine max
  Peptide Sequence Number=SeqID_100856
atgacgaaacgccagtgcgttagtggtattggccccttcataaccaacgcgctcaagctggtcgaaataagcgtgcatgttgtgctccttagcatcagacccgaatggtcagcagtgaagcgttattttgcggaggcctcgcaaatccatgtatttaattacatcgcgtaccggcgcgcagcgccgctgcaagatttaacagatgggcgcgtaaaatttcgatcgcgctcaaagaatcacaaataa

SEQ ID NO: 9172 - DNA, 894 bp, Glycine max
  Peptide Sequence Number=SeqID_100857
atgctcatccatccatccgacaaccttccgttctctggcgatccgcgtaaggaagaactgcgccagcggctgctgcggccggatgcgcccaaagtcattgccgtgtcactgtcgaaggagctggatcgcgagcgacgcacgcatcgtcatgccgccggtcagctgttttgtctgcgccagggattgatgacggtgaacacctcgtcgggcatttttgctaatccgccgcggctggttggctggattccgccgtggtttgaccatgcccttgtcgggccggggcgcgtgctgggctggacggtactgattgacgaagcgctggctgcgccgctgccggatcggccggtgctgctctcctgcccgacagtgctggagccgctggcagaacggctggcggtgctggagcctgaactgtggagcagcgcgcgctatgcccggctgggtcaggtgtttcttgatgaactgtacgaatccacgccgcaggaactcaccctgccgctgccggatgagccgcggctgcggcagattgcacgcctgctgatggacgatccggctgatacacgcaccgggccggagctggcgcagtgggctggtctgagcgcgcgcagtctgagtcgccactggtccagcgcgggctggcggcaggccacagcgtgcagcaggttgcctggcaggtgggcttcgacagcgtcagcagctatatcagcgcgtttcgcgccgccttcggctcaacgccaggcaaatattttacgacgccagccgactctgcgaatgcagcatcagcaggctagccggaccgtcaatcggtggcaggctgtgccggtatttgcggcgaaacgcgccgggtggcaggtcaaacatgcgccgaaaggtgcggcagtaggtttgctgtga

SEQ ID NO: 9173 - DNA, 384 bp, Glycine max
  Peptide Sequence Number=SeqID_100858
atgtcattgcctagcgctgttcatgtggctccattatcaagggcgaagcttctggtgactgggaagcacaagaaagaagaagaagtagaaatgagagtcgtcatcgcgaaaagggcaggacggacgaaatcagtgtcctatctttgctttcctcttatctccgatgagaggttcctccagaaggatgttgcttctggaggaagcaacctggctcgcctgggcgagctgggcggcaagcatctcccctattttgctataaataggggaggaaccgaggcgcttccgaagcgcttccgtaacgtttccgtgaagaatttcgtaaaaggtttcaaccgttcttcgacgttcttcgttcgttcttcattgttcttcgatcttcaacgg

SEQ ID NO: 9174 - DNA, 261 bp, Glycine max
  Peptide Sequence Number=SeqID_100859
atggatgaacatcaacagaactggaaagaaatggctaacacaatgatgaaaattaacaaaaaagtagaggaaatgttcaacattgttcatgttatggatcaggatgaactagagcctacttggcatctactacattctagtggcaacatgcactctttcacacataaccaagatctggtgagcccagctctacttgctggatggataaaatttatagggttctatgggcttactagaaaggccttgacccactatggatag

SEQ ID NO: 9175 - DNA, 134 bp, Glycine max
  Peptide Sequence Number=SeqID_100860
actcaatggatgactcctcaaccattgaagaaactgaggagttccaaaaggcaagggactcactatggtacttggatagtggctgctctaagcacatgacgggtgacaagtccaaacttactgacattgtataa

SEQ ID NO: 9176 - DNA, 162 bp, Glycine max
  Peptide Sequence Number=SeqID_100861
atggatgaaaaatgtaaccaaatgcaagagaaaaatcaggaaatgaatgaacatgcagtcaggtttgggtttaggcttaccttgcttaaagcggtggatgaagcggtagacatggtgatgaatgacctgtctaatgctaaagtcgataatgatttggcatag

SEQ ID NO: 9177 - DNA, 900 bp, Glycine max
  Peptide Sequence Number=SeqID_100862
atggccaagtttgatctggatatagttctagagttttatgccaatgcttggcccacggaggagggcgtgtgggacatgcgatcatgggtaagggaccagtggattccttttaatgcagatgccttcagccagttcctgggatactcgctagtgttggaggagggccaggagtgcgagtatagtcagagaaggaaccgggtcgatggatttgacgaggaggccattgcccggctactatgcataccaggtcaggattttgcccagaccgctgccaggagacgggtgcggatcatgcgcaccaacatgactaccttgacccagacgtggatgatgttgctgttcagcaacatcctgcccagcgatcataactctgacctccctctgccgaagtgtcagctaggtatgccgcctaccaggcaccctctagacccagataagtctaaccgggccctgggatttccagcgttgatcacgggcctctgccagtcattcggggttcccgtcgcacctagtaaggtgattcgaccgccgatcacccgggcctgcattgagaagtattgcacgcctagacaggcgcagggtgatgcaccgcaggccgcatatgcaccgccaccacctcaccaggctgatccaactgggtcatttggcatggagcggtatttacagcacttggttcgccagcaggcggccaaccacagggggcatgtgcagacccatgtgtatctctaccagctcagcctcagtcagcagagccagggtttcgctccttttgcgtgccctactccagatcagtttagggctgaggttgcatggcccggagattggcctgaggcccatgcaggggagcgcctgcagaggctcccggcgatccagaggacgcacgcatggatgaggagatga

SEQ ID NO: 9178 - DNA, 255 bp, Glycine max
  Peptide Sequence Number=SeqID_100863
atggtcactcctatgagcactgcttactatttggataaagatgaaatcggtcaatcaatagacttaaagaaatatagagaagcggaatatatttttgctgaaagttgttatgcacaaatcctttggatgagacaacaattttctaactatggcttaaaacttgatcatatatacctatccattgtgacaatacaagtgcaatcaatcagtccaaaaatcctattctacactctagaacaaagcatattgaaataa

SEQ ID NO: 9179 - DNA, 339 bp, Glycine max
  Peptide Sequence Number=SeqID_100864
atgtgtggcatctcttgtcaatgtcaggatttacacgtgattctcctcaaatttcagccagcccgcatcaagttagaccttgcaccttacgcttcagggccctacaatgctcaaggaacgccccggggcttctccatgacgagcacacgttgcgttcgagtcgcatcctcgaaaaaatggagattgaggaaacctagcagggtttatggctaccactgcattatcgagtggacatgggagcaagtcaacataggacaccggaatttgggtgaattctacaggaatggcagtcatagcatggggctcctccctcattctcaccctcttcatttgccctag

SEQ ID NO: 9180 - DNA, 186 bp, Glycine max
  Peptide Sequence Number=SeqID_100865
atgacagtagggagcaaggacggtactttcaaagaatactttgggaagtatggggagatagtggatgctgtcataatgaaggaccgctttacccagaaaccaagaggatttggatttattacctttgcagatcctgctgttgttgacagagtgattgaagacaaccatgttattaatggaaaggag

SEQ ID NO: 9181 - DNA, 279 bp, Glycine max
  Peptide Sequence Number=SeqID_100866
atgctcttgggaacggaagcttctagcacactccatacatcttctcaaagatcccaacgaagcttcattaagaggcttctagcacactccagacatcttgccaaagatcccaacggtcagatcatggacaagtgtcttgtgaagttgcagaccaaatttcgagaagatccaacgattaatgaaggctggacagcgtttttaccgaggcggcttgatgtagctttctctagaagcttcattaagaggcttcctctagaagcttcctcgtggcttctttga

SEQ ID NO: 9182 - DNA, 363 bp, Glycine max
  Peptide Sequence Number=SeqID_100867
atggtaggacgaggaggagacgcattggggaataccagcggcccgcatcgggggtataataggaatgcttacccctacagcctacccccgaatttcacaccaccaaccatgcacgagaaccttatagggggcgcccgtgaagagcctcgagagcatgcccaagtggacatcaactcatacccgctattcaccattgagggaccagcacccaatgccttggctaataccgtgggagtctctcaaccccgcccaatgcaaccactttacttctccgtaggggggccgtccccggtagtggagggaagggaaaaccttgatctcatcgaaaagagattgagggcggttgaagggttcagtgactaa

SEQ ID NO: 9183 - DNA, 246 bp, Glycine max
  Peptide Sequence Number=SeqID_100868
atgacggggttgagtcgccactgtggctgcctcactagcttagctccatcctctaaaacaagggaggcagagatacaagtagagggtacatctacttgggatgttgtaactgagaacaagagagggtacatctcttgtggatcagttcaagtggagggtacatctacttggttgttcaatgagaacaagggagggtacatcccttgtggatctttgcttgtaaaggattttgcaaggttgaaatga

SEQ ID NO: 9184 - DNA, 132 bp, Glycine max
  Peptide Sequence Number=SeqID_100869
atggaaaaatcagaacacttggctactcctatgaacacaaattgttatcttgacaaagatgaatccggacaacctgttgatgcaaagcaatacagaggaagtgatcctaggtcatttcccaatgagcaatga

SEQ ID NO: 9185 - DNA, 126 bp, Glycine max
  Peptide Sequence Number=SeqID_100870
atgcctttcatgaagttgggctggggaaatatgcctaacatggagattagcttgaagataagggtaaggaggaaatatgagatagttgtgtctgtaagggtcctagttttcgccctaggcatctag

SEQ ID NO: 9186 - DNA, 147 bp, Glycine max
  Peptide Sequence Number=SeqID_100871
atgactgtgagcagttgggctaagctcaacaattgggctaagcgcatatccaccactaagtgcagcttcagtgcgcttagcacaaaggagaatctggcagagcatcaacatcaaagccgcgtgctaatcgcgagatcactgcgctaa

SEQ ID NO: 9187 - DNA, 471 bp, Glycine max
  Peptide Sequence Number=SeqID_100872
tttgattactctagtcatgatacccgtcgcatggtctgcattgaccagacggatatgactggtatattgcttgtcgggtcattgacatttgattgtcgcatcatgcattatatcattgttaaaattttgatgcctcgttcttctaatcttgctcaagcttctgaggaggacttgattctgatgtgggctttcttgaccggtcttccaatcgactgggcccatttggttcgttaccgcatgcataaggcattgcggtctggtgcacctctcccttaccctcagcttgtgactttatttcttagacattttgaaattcctatggattctaagccttttgtgctagttaaaagctccttttctattggtgttggtgcggacacgcaacctctgcaagacgagcgtactccttctcctccacctcaacgagatgattcctcagcccttatgaatgaagttctttcggaattgtga

SEQ ID NO: 9188 - DNA, 367 bp, Glycine max
  Peptide Sequence Number=SeqID_100873
gaatttacaagatagtggaactctcaagcgggttgctcggggacttgacataggcacaagggacagcactttgatttctgaggtttttgggataaaaatggtcatcgaccaatcccttttccatgacttaacccaattgtccagtgacggtgtaccatttgaaggtacactgaatgacgattggaagtttgatttttctgcacatgatgtccgccagttggtttgcaccaacaatgcggatatgaccggacgccttcttgccggctcattggcttttgaaagccgcatccttcattatctgattgtgcggattttgcttccacgatcttccaatcttgcccagtttctggaggagatctattatcat

SEQ ID NO: 9189 - DNA, 348 bp, Glycine max
  Peptide Sequence Number=SeqID_100874
atggtagccataaccccagccaaggttcatcaacctccatttctccgagaatacgactcaaacgcaatgtgtgcttgtcatggagaagccccggggcgttcaattgagcattttagggccctgaagcgtaaggtgcaagttacaatgctaaataaaatggataaatttgatatctttgtcccacatcctctcacaaacgcatctttgcttattcaactttcaccgaaatgtggttgcaagccattggtctatttactcaagcgatctgcgctcctgagtttggacttccaagaccattcaatcagaaattactcgtgctacacatttggtgagggtgtcgtaaaatga

SEQ ID NO: 9190 - DNA, 603 bp, Glycine max
  Peptide Sequence Number=SeqID_100875
atgagcattcatgtggctcagttaatcgctgatgccatctatatatttgcaggtatggcgcctaccaggcaccctctggacccggataagtccaacaaggccctgggatttcccgccttgatcacaggactctgccagtcgttcggcgtccccgtcgcacctagcatggtgattcggccgcccatcacccgagcttttattgagaagtactgcacgcagagacaggtccagggtgatgcaccacaggccgcggacgcgctgccaccacatcaggctggtccagccgggtcatttgacacggagcagtatttgcggcatttggttcgccagcaggcagccaaccaccgggcacatgtacagacccatgattgtctttaccagatgagcctcagcctgcagagccagggttttacttcttttctgtgccctactccggaccagttcagggcagaggtcgcatggcctggtgattggcctgaggcccgggcaggagaggcaccagcggaggcaccagcagaggctcccgacgaggcagatgaggcccgcgaggacgaggagatgactgatttactggatttcttaggagggagcggggccacatga

SEQ ID NO: 9191 - DNA, 131 bp, Glycine max
  Peptide Sequence Number=SeqID_100876
gccccgacaatgctcaatggaatgccccggggcttctccatgacaagcacacgttgcgttcgattcgtattctcggagaaatagaggtgatgtttgccattggaagtgcggtagacagactttgtggttga

SEQ ID NO: 9192 - DNA, 255 bp, Glycine max
  Peptide Sequence Number=SeqID_100877
atgtcatttttgggagaaacaagcagccagaccattgctaactccagattagccttcatttttccaaatggatcaatcactcacaaccaaactggtgtttactttcaaagtcccactccaacaccaataacactggatgctatactcaacctgcttcaatcaactatcactcctactatgatgcatttatgtattacaacgggaagtgcaacataccacgtcaaggatgtagcatggacaaactcaaggatttaa

SEQ ID NO: 9193 - DNA, 310 bp, Glycine max
  Peptide Sequence Number=SeqID_100878
cccagacttatcttccttcaccggaagtggcgtctaccctgacttatcttccttcactggaagtggcgtcatccaaaactctacagcctgtatcaagcgatccgcttcgactcaggtgcaaattgcaaagaagaatgaaagttatgccaagcaagcccacaagaaaaggaaggaagtggtacttgaacccggtgatgatcttggacatttgagggcaaatgttttccaagaaggagggaatgatgagaatcctgaaattggccaaatacaggctaaaggcccaagtggagaagggcgaaggcccaagtag

SEQ ID NO: 9194 - DNA, 381 bp, Glycine max
  Peptide Sequence Number=SeqID_100879
atgcatgctttgttagggtcattcaacagtgggaactggtctgattctaaagtccttggtagtacgggactaagttgttgtgctatcacgagggatcgggaaatagaagctacactaagaaggaacagggctgagaagagaaggaaactgttgcaagacagaacattgaggaggagactcatttttttgattcattgtcacttgattcaccatcatcaagggaattcactaatcaacattctgaaactgctaccatggcagatgagcatgatcagaggactacccttgaggactattcatgtggctttgtaccacaatttttcactagcattgcacgtctggaagtgcaagcgcacgacattacctacccacattctttga

SEQ ID NO: 9195 - DNA, 468 bp, Glycine max
  Peptide Sequence Number=SeqID_100880
atgaaagcaccaatgttacttgatggttcgagactcaagcaatctccagaatcttccttcacaaacttgagaaagaagaacaagaaagaaagaggattcgagaaagaagaagagggaattctggctaatatctcttcctctgtgtcacttctttccttgatcgtcagtcttcacaggcttaatgacatgggagggattagaagtgtacttgctaagttgtcagacatggaagacattgtgaatgttggacaaaataggagcctcaaatggtgtcatcccaatgcttgcatgaaagctattgttgtaggtgaattctacctatcataccctaatttcgtccggggacttttgcttgaaggcatacaacctttgattgaccgcttcaagattcttcctccagaaggtggttgcttctggaggaagcaacctggctcgcctagacgagttgagctctcctgggcgagctag

SEQ ID NO: 9196 - DNA, 312 bp, Glycine max
  Peptide Sequence Number=SeqID_100881
atgccggaccattcggccgacagcatccactttccggatgcagatttgaacctgcggccttcaggttatgagcctgacgagctaccgggctgctccaccccgcgttatgggtgcgatattatgaccggttttggtatttttttgcgctttgggcgtgatttgatctgttttgtatggacctggcagcgacctactctcccgcatcttaagatgaagtaccattggcgctggagcgtttcacggccgagttcggaatgggatcgggtgcagccgctccgccataaccaccaggtcggcgaagaacacaaatga

SEQ ID NO: 9197 - DNA, 561 bp, Glycine max
  Peptide Sequence Number=SeqID_100882
atgaaagagcaaatgaccatgatgatggaagccatgacgagtatgagaaaaatgatggaggtcaatagggctatagtcgttgccgcaagtaccaccactaaggtggacccaactcatccacctggccttaatcaagtaaatcgtccagtctcagatatgtgcacaacgaaaattaaaagagtagggaagaagaagaccaacacacatgagttttatactggtttggcaacaacctgtgcctacatccagtccccaagtgacctgtggtccttgagatttcttttcaaccttgtaaattcctttacaagcaaagatccacaagggatggacactcccttgttctctttgaacaacctagtggatgtaccctccaccagaactgatccacaagagatgtaccctctcttgttctcagtcccaacaacccaagtagatgtaccctctacttgtaccacaaaggatgtaccctccaatgtgttaagacaaagttctcaggcggttagtcctttgaaactttgtgaatggagaaacaaaagaattctcaggcggttagtcctttaa

SEQ ID NO: 9198 - DNA, 195 bp, Glycine max
  Peptide Sequence Number=SeqID_100883
atggcccgatcatttatcaaaggccaatcttcggtagaagagaaggtcaacattctcttggcaaatagggagtttccaagttcatgcccaagtacttattacttcttgggtcgtaatcgctctcttattggtttcagccattctaattattcgaaatctgcaaaccattcccgctttcggtcagaatttctttga

SEQ ID NO: 9199 - DNA, 222 bp, Glycine max
  Peptide Sequence Number=SeqID_100884
atgcagagttcaaaacgtgatgtctaccttggagcctacctgaatggtcgacactggcagatggtggtcatcctgcccaaggaacacctagttgtctggtttttttcattgcataacaggtcagacaactaccttaagaggataatcaacagtgtaatagacaaaaaggaagcattgagtacggctattatgtcattcactggatgtccaccatcacattag

SEQ ID NO: 9200 - DNA, 546 bp, Glycine max
  Peptide Sequence Number=SeqID_100885
tggtcatgttggtgcgcattatccacactcatcgctttgtagcggcacgggtgaaatcttgccctggtatgcatagtagttgcacgatagcctcctcctctagttgtgctcgcacagttggcccttctcaaggattaggggtgcggatgtggagcccactaaaagtgaggatgcgtagccctctaaaggcgagggcgtgcagccctctaaagtcgaggacgtgtcaccctttgaagtcctctaaaggcgaggcgtgtagtcctttggaagcgagggcgtttagccctttgaaggccaggacgtataaccctctgaaggcaagaacgtgtagtcctatgaaggcgagggcgtgcagccctctaaaggcgaggatgtgtagccctcagaaggcaaggacgtgcagtcctctgaaggcgagggcgtgcagccctctgaaggcgaggacgtgtagccctctgaaggcgaggacatgtagtcctctgaaggcgagggcgtacaaccctctaaaggcgaggatgtgtaatcctctgaaggctagggcgtgca

SEQ ID NO: 9201 - DNA, 258 bp, Glycine max
  Peptide Sequence Number=SeqID_100886
atgtctaatgaagaagtgaagttgcaggatccacaatgtcggatacaatgtcctgacatcctgcccgaaaatactggagttgctgcacaatgcataagtcaagataaattgtcaaaagaagatagatctcctccagcatcaagaagttgcagcccagaatcgtacacggctataaaaacatggaggctgcacgagttctgtaccaagtccgggattgaagagttattttgtgagtttagggacttgagtcttttgtga

SEQ ID NO: 9202 - DNA, 318 bp, Glycine max
  Peptide Sequence Number=SeqID_100887
aagcgccctagagaggagaagcaggggcatgggccaacagaaaaggccacaagcgaaagaggcccctccatgtcacgtcagcaagagctttgtgagtgcgggctggaggaccttgacgttgattttgaacgaatagcaagccaagccgaggatggagaagatgaagatatggggttttccccggagctagaaaggatggtcgctcaggaagaccgagagatgaagccacacgaagaagagacggaaatcgtgaacttgggtgttggcgaagaaaggaaagaggtaaaggttggtactggcatgactacaccggtttga

SEQ ID NO: 9203 - DNA, 252 bp, Glycine max
  Peptide Sequence Number=SeqID_100888
atgtcaggatttacgcgcgattctcctcaaatttcagccagatcgcatcaattagaccttgcaccttacacttcagggccctacaatgctcaatggaatgccccgaggcttctccatgacaagcacacgttgcgttcgagtcgtattctcggagaaatggaggttgatgaaccttggcaggggttatggctaccattgcattatcgagtggatatgggagcaagtcagcataggacatcggaattggggtga

SEQ ID NO: 9204 - DNA, 198 bp, Glycine max
  Peptide Sequence Number=SeqID_100889
atgttgccaaagggggagagaacttgggagagcacacttgggtgttgtcatcatcaaaaagggggagattgtagacaaaggatcaagctaaatgttttgatgatgccaaaggattacatgaatcatatgcttctcaaagatttactcaagacaaagcaattaaagatactcaagatggatgatcaagacagtctatag

SEQ ID NO: 9205 - DNA, 219 bp, Glycine max
  Peptide Sequence Number=SeqID_100890
atgactagtatatatgtgaggggtagagggtgtcacaacagccatatgtatctatcattgatgccaagattcacatcaggatgctcacaatcaaacatggagaatactccaacaggaaaggtaaggttagtttttcaccaatggtacgttaagaaggataagatctccacgatagtgaactctgccatcgcttctatggaaaaaccattacccggttga

SEQ ID NO: 9206 - DNA, 174 bp, Glycine max
  Peptide Sequence Number=SeqID_100891
atgtttcatcatcaaagaaagcaaggtctagaaaacaaggtagatgatcaaggtgatgaaagggaagaaggaattggtgctgtgggtgctccagaaggttcgtggcggtggtggccagcagcagcggtggtggaggaagatcctttgcgcttcgttgatgattctgtcatttga

SEQ ID NO: 9207 - DNA, 987 bp, Glycine max
  Peptide Sequence Number=SeqID_100892
gcctcacgaggaaatgggcccttgcaggcgatcaggacggtgtggacgacactgtctgtgagaaatacggcataagcaaggaaaaatgggcccaattttgccagactcgatgtgcgaaaaaaggcacaggccatccagaaacagaacactgcccccaagttttgtctcgtgagggttataaatatttggagcagaagcttctggctgaaaagacgaagaagaagctagaggaagctgcacagtcaggaagcgttgatggcatcatcaaccctccatccccggtcaaacgccacataaagtggaagatggcccgcacgaagaaaacaagggagatgacgactgaggccgcaaaggaaatcgctgagaagatcgatgttctcaccgctgctattggacgtccagagcaccctagacgtgtctgtgctgctggagccgctgacccagcaaatcagggaccagctagaggagtccatcacagaaaaagtgacgcggtagctcatggcatcgttcagccagatgcagtcccagatgcaatctcagggacttgcactgcctcccgagcctctagaaacgatcctgagacgggtgactcagacatgtgcagcttgtacatcgaagtagatcctgcccgcctggttaccctggggagagttatgagggatccactgggggttacagatgctgatgctctagctcctgtacccactgatgaggtttccttagtggggcaagcaattcaccccttctttgcttgggcgacacatctggtcaagtctttatcacaacagacaactgtgtcttcggcaaaaccacctcaaaagccttatccggaggtcgatgatccactttatctgacgacattgaccatcccagagcttttcttgaggccttatcaggttatatgggatgccaccgtgtttggggtctttaatccagacttcccgctctacataaagcacgaagacctctctgaaatcgcacacggtg

SEQ ID NO: 9208 - DNA, 1835 bp, Glycine max
  Peptide Sequence Number=SeqID_100893
gtcgactctagaggatcccaccttcggtacgcagccacaggccacgcggcggcagtggctggatcggcgctacgtccagggcattgatcgcatccaccggcagatcgcgtgccagcagctgctcggcgcgcagcagcgcctgcagggtggcatcgctctcgcccaggcgctgcagcagcgcctcaccagccgggccatcggcacgtgcctgcgcactgcgcacggcgttggccagcgccaccgcgctcacttccgggtccttggcggcaccgtcgagcagcttctccgcacgctgccactggccgtgctcataggcctgcaggccgtcgatcaggcgtacccggccctgcttgcggcggtagcggccccaggcacggaacggtgcggcaatcaggctccacagcagccacagcaccagcaccgcgatcactgtcagcagcgccaccttcggcaggttgctgtggtagtcgtagccgccgtagcgcagggtcacttcgccgaagcggttcaggtcatcggcgccgagccattgcgcggccaccacgccgatggccacggccagcaacagcacgaccagggattgcaggggtttcatgtgggattacctccggtcggtctgggtgcgcagctgctgcagggtgctgccaagaacagcgttgctggcctgcagcggaagctcgcgcaaggccttcagttcagcacgttgcgcgcgcagggccgtatcgcggccggtgcggtcgccacgttcgatcgcggcgcgcgccagggtcagttccagccgcagtgcatcgtctgcattgcggcgctcggcggcggtcagcggaccgttctggcggctggggctgatgtccacgaacggggccagcgtggcctgccaccaggccctgcagggctttggccaggctatccaggcgctgcagcgattgcgcgcgcgggccggcaccaagggaatccagtgcatcgcgctcctgcaccagggcgtggcgcagattcaggccgtcgctgtcgggcagatcggccaacgcggtggcggcctgtgcatacaggcggcgtgcgccttccacgtcgtcggcgtagttcagtcgctgtgccgcctgggtcaacagcagctcggcctcatcgcgctgtaccgcctggcggccctggttggcgctgtcggccagcttggccaggttctcttccagcaatgcactgcgctgcgaaaggcccagcatctcatcgcgcagcacgcggttggtggtcgccgcatcctgcaggcgctggctggtcgcgcgctggtcgcggcgcaatgcatccagtgtcgcctgcaggccctgcagctgcacggccgtggtctgtgcctgcgcttcctgttcgtgctgttgttgttgccagacgtaccagccggcatagccgcccacgccaagcacgaccaccccggccagcggcaacagccagcgcacaggtcgacggggcggggaaacgggcggagtctcgttcatggggcttccttgtcggcaacgtcgccggtcaggttccggcaggccgcgttgtgcacagcatcactgttgccgaccacagcggcaagcgtgacccacgtccctgttcagttgtgccgtggtgggcccggccgcgcgcaccacgcgttgcagccccaatgcgtgcgcctgttcgccgagccgttcgctggccacgacgacggtggcgtgcgcctgaaagcgttgctgcaatgccggcggaagctgctgccagaaatgctgcagcgcttcgccactgctcaccgccagcacccacggctgcgctgaatgcgccaatcgagccaatgtgcggggcggcaggcgcagcaatcggcgctg

SEQ ID NO: 9209 - DNA, 94 bp, Glycine max
  Peptide Sequence Number=SeqID_100894
gatgttcctccagaaggcggttgcttctggaggaagcaacctggctcgcccatgctcctcccctattttcctataaatagagggaggagtgaag

SEQ ID NO: 9210 - DNA, 252 bp, Glycine max
  Peptide Sequence Number=SeqID_100895
atggatgattacatgtctttgcaaactaaatttgaaaatttcaaaaatggtcactatgctgaacgtatgaaattgcaaagtgagctctcctatcttaaagatctttttagaaaattagacaaaggaaagagcgatctcaatcacatgctcagcgtgcaaaagcatactaccggttttgatgatgccaaaagtttacttgatgagcacggattgaatcaagtcatagaacaagatcaagaaaatctaagataa

SEQ ID NO: 9211 - DNA, 168 bp, Glycine max
  Peptide Sequence Number=SeqID_100896
agtacattgaaaagagaaaacctattggacttctcgaatctcgacatgatgaaagagtgggagtgggttgacaacaatatcgatgtgcagaccgatgatttaggatttactttggtagatcttaagaaactcgcttaccagaatgaccctttcgtcatggcagaataa

SEQ ID NO: 9212 - DNA, 531 bp, Glycine max
  Peptide Sequence Number=SeqID_100897
atggttggaactagaggtcttggtcgcgctttagggcgcgcaatagggaaagtgttgggtaggagagatgagagtgatgatgatgccccccgcggcgaaggcctactgcatcagcgcgtaggcagaccccatgacacatccgttctgagtgattttgaaaatcacattgctttcagagtgtggaatggagaggaacgtcctgagttgaagctatcttcccatggaaggaagatggctaagtttggaaggcctatcccagagattgaaggccttgtggtggccagtggactgagtcttttgatcgcttgttccctagatacaggagatcgtggaccgatgtctgctttttggtcttcactttttctggaggaggacgcatggagttcatatcagggtaagcaatatctcccagctttgacttcaaatgtattttaccacaaacatcgagctgctcaaagcgtttcgatatggtttccatctcctcggttatggtcacctgtgtctcacttaacccttgatctgaaaaactaa

SEQ ID NO: 9213 - DNA, 1056 bp, Glycine max
  Peptide Sequence Number=SeqID_100898
atggctgaaataggttcatttgcatccgaatcatactcttctgaaaataagttgaaggtagccccactttactccaatgctaatttctctcagctagaagtggtagaccattatgatgttcatccatattcagcttctgatgatgacatacccactattgattactctctactcttctgtgatgaccctaataagcaattccatgcccttgaatgcctccgtgatgcatgccaggaatatggcttcttctatttggtaaaccataccatccctgatggagtatttgataatatattaaaaggagtttctgatttctttaatcaaacaaccttggatgagagaaggaactacagcaaaaaatttccattggataaaattcgatgggaactaaactcctccgctggggaaaacagggaatatctaaaggttgttgctcatccccaatatcattttccttccaacccttcaggtttcagcaaaattttagaagaatatggcaaagaaatgagaaagatagtaattggattagcaagggcagtgtctaagaccttagggtttgaagaacacttcgtggagaaggcattgaacttgaaatcagggtttgacgtgttggccatgaacctttatccacccaatgccaaatccaagggagccgttggcctgtctgaacacactgaccctggcttcgtcattacacttttgcaagatataaatggtggtcttcaaattctttcccacaaagggaagtggatcaatgcttatattccccatcatgccatactcatccagcttggtgatcaacttgagatcttaaccaatgggatgtacaagagtcatatccatcgagttattgttggcaacaataaggtgcgaaggatctctgtagtgggcattcacggaccttcgttggacaaattaatcagccctagcatagagtttgttgatgaaaaacacccacagggataccgtgggatgacctacaaagaatccttggaagtaaacggggatgacgagatcgatgtgcaatcatcacttgagcaagctagattagtgtga

SEQ ID NO: 9214 - DNA, 231 bp, Glycine max
  Peptide Sequence Number=SeqID_100899
atggatgttgaggcaccttttattactcaaggatggataaaattggttgaaacaagcattgttggtttggctgctagtctagcgatccctcctagctgtcgccaaaagggaggagctaacgactggacgtgctgcaacctaggaatcaccaagcagctctttcgctttatagggatcaggaaggcagagcacaattcttcttggaggagggttggtttgcccgatgactaa

SEQ ID NO: 9215 - DNA, 171 bp, Glycine max
  Peptide Sequence Number=SeqID_100900
atggcgggagagaaaggaaacaaaatgagacaaaagatcatggagttgaagaagaaggcagaggaagccactacacccagtggttgttcattcatgaacttggacaaattcattaaggaggaaccaatcaaggctgcagagaaatctcatgtacctagctgcaatagctga

SEQ ID NO: 9216 - DNA, 291 bp, Glycine max
  Peptide Sequence Number=SeqID_100901
atgaatgacttggtttatgtgatatataacttgaagctgaaaaagggatataatgatgaggatgagcaacctcaaggtgaaagtgatggtggcaatgttgaattagtgggagatgttggaggaagttcaaatgatctagttgtagacattttcgatctagataatttaattttggtggaacctaatgatgatgcacaatctgaggaagaccttgatgatgatggagatggtgatgaaagtgatgatattcatggagatgatcctattagagaattgagcaaagttctttaa

SEQ ID NO: 9217 - DNA, 435 bp, Glycine max
  Peptide Sequence Number=SeqID_100902
atggacgattcaaagattatggagaaggtgctcagaacattaacacccaactttgatcacattgtagtagtgatcaaaatgcagaaacacacagttcaacttcccaagatcatagtcttggaagcaattcaaatgagcagcatgataattccagttctagaggaggaaactctttcagaagtcgaggtggtaaaaggcttattgacaaaagaaagatccagtgttacaattgtgataaatttgggcacttttcccatgaatgctagcagattggcaacaacaatgtccatagcaaatataagaagaatgatcaggcacacttggaataggaggaagatggatcttattcagatcaaattttgcttatggtcgacaagggtgttgcccttactcctatgtatcctcaagtgcaatgaggaactcatacctacataa

SEQ ID NO: 9218 - DNA, 399 bp, Glycine max
  Peptide Sequence Number=SeqID_100903
atggcgttaggctcaaatgaggaggagggtcgtctgaggatagagggggttcagtgtgaggggaaagtcctcgtctgtgatgatgaggtggagacggaggtgacaacgatgccccggtgcccacttatcatcacagtagtagcagaggcctttgtctcgtttaagggccatttcttcggtgaggttgggaatgggggtgagagttggggtggtgggggcgatggctacggcggcgatctgagagcttatcttcctgaagcttcgccagtgccatggcctgaggggaggagcgaggccgacgaccctattagcaaggcgctcgaattcggacagatactcgtttacagtaccgcgttgctggagtttgaagagcgccccatatggatcatcgtaatatga

SEQ ID NO: 9219 - DNA, 228 bp, Glycine max
  Peptide Sequence Number=SeqID_100904
atggttccacaatacaattgttgtccctcgcatgagaaaaagagttccattaatactgttagaactcataattgggacataactaggattctcttgaaatggggtggccaatctaacatgactctcttctcaaatctctcaccagaaagcaaatacaatgaggaatcaaattcacccatcgtagaaaatggtgcaaggtgttgtaggatggcagatgtatcatcgtaa

SEQ ID NO: 9220 - DNA, 180 bp, Glycine max
  Peptide Sequence Number=SeqID_100905
atggctcatggcggttaccggtggtcgtgggtagtggaggaggaggcgaaattttgcttgcctgggcgagcttgcccaactcagactcgtttgggcgagttctgggcaaatccttgcttaaacatatttcactccttctgtgaaaaggtcatatctcaatgtccaaatgttatttcgtaa

SEQ ID NO: 9221 - DNA, 306 bp, Glycine max
  Peptide Sequence Number=SeqID_100906
atggagaggaccacactccaacctagtgctttctttatacgtttatttgctctttattttttttctaaatcatcgtcgcacactcatcctactttctcttcttcttccacctcctcctccaccactcgccttcagccaccacctctccctcctatgttgtgtcgtttgaaccgcggggataactgcgatttcgatctccaccccaatcacagttgtgattattgtgactgtgatagggacttcaagcgttgccacaaccctagccgctactctcccttgtcattgccgcgctggtcacctccgtag

SEQ ID NO: 9222 - DNA, 390 bp, Glycine max
  Peptide Sequence Number=SeqID_100907
atgtcacaacctgcattttttttcagtttcatgcaaccatggcatgatttacattgcaaaattgaaggccctgctgcatatgatatactcactaattttgagcaacgttggagaaaagccaccaaatggtctgagttgggtcggaaactcaagagagtatctaactggaacgatgattctttgatcaagttagaatgcatctcttggattcttagtccttcggaatcaactccaattgatgttcctgaactatgggtttttcgatccatagattctggttctttgaaaggattccctaaggatgtagttgttgccatgactcagcgagcagcaatttgtctacatcggcttgtcatgaagggaagccttatattgaagataatgaagtga

SEQ ID NO: 9223 - DNA, 396 bp, Glycine max
  Peptide Sequence Number=SeqID_100908
atggcacacaacgaccaacatggtcgtctgcaccctttgtcgaagatgcgacatctatcgaccgagactactttagtctctctttttcgtcatccagagacaatcaagtccgatgacacgcagaaccaacatggttgtttgcatcctttgtcgaagaccgaatctatcgaccgagacaactttagtctctcttttcgtcatccagagacaatcaagtccgatgacaccagcgaccaacatggtcctctccaccctttgtcaaagatgcgacatctatcgagagacttctttagtctccttttcgtcatccagagacaatcaagtccgatgacacgcagcgaccaacatggtcctctccctttctcaagcgacatctatcgaccgagacttctttag

SEQ ID NO: 9224 - DNA, 457 bp, Glycine max
  Peptide Sequence Number=SeqID_100909
gattcctgaacacaagggatgggttgtccctgtgtgtttcagactttgtaaacggatttttacaaagggagtggaaaatctcaagtggattgctagagtactggacataggcacggaatttgccgaaccagttgcgacacacacaacttccattggaagacgctctcgtgtgcctcgcgatgccctcccgccaaagggtaggttgcgacacacacaacttccattgtttcctcaccctatgcaaccacaggttgttccatttgctaaacaacagaaagcaagttccactggagaagatgcaagccaccagctccatcatgctatatatgaccaactatacaaaactgttgagctgatagaagctggtaatctggttcaggcgcaagggatatttgcgcggctcaatcaccagctctccccaattgataaaccttttcatagggatatttttacatga

SEQ ID NO: 9225 - DNA, 1434 bp, Glycine max
  Peptide Sequence Number=SeqID_100910
atggctttgccttttcggcgagctttagaaggaacctggacaagggctgagcatctccagtatgatagtgcatttgtcggggttggcttcaatcctccggtgtgtgatcatgaagctgaggaacttgtcgccgcctatcccgaaagtacattttttagggttgaggccaaatggaatgaccctatggcgaaagttggcatctttagtgatgaatgtcattttctcctcgtctggaggatgcattttgatctagttgtatccggaatcagtgtagtcggtgcacattcattgtttgcctttggccttcttgaccattatgacgttgttgacttcttctttgacaacttcttcttgaccaggacgatgtttggcctggggtatgatgatcagcttgtggatgcgccaatgctcatgactggtgagttggacaagctctttgatgggtttgggacctctgtcggaggtgttgtctcgcagatctatgtcaaattcactgtccaggctggattggtagacggtcagggctcaaatttgagacctttcagccgatgtggggtgaggcatggcaagctcccggatgggaggatatggtgctaccttcaagctctttacatatttgatggtgaatctcctggagagcttgccttgaacgaaggtgatcatcaagttcactctatggaaggttttccaatacaagatattagtggaactgtcctggtcgatgaggaccctggacaccatgaagtttgctatgattatgaagacaaccacaatgttatcttggttgacaaggttgatgcccttgaagtccctgtccgtaaaggtgataggagggagacttctctgaatcggtgtgttgacaaaattgatgttatcgcttacgccactgtggttggtgtctttgtctgcctcgatcttctgctcttcttttgtatgcttcttggttcctatgttgctcctatggatgtccttagggtcttggttcttcttggtggttgtctgacggttgtgcccccaaatgtgttcatgaagtttctgagggactcgtcgtctgcttgttgcagactgaccaaggcagctgaggtcatgcggttcgcttgtgtcatgaaggcatctagatgctcgtttggatctgttgtctcatcatactgctcgaggttgagtggtttctaccccaagggcaaggtgtgggcggattgctcgttgtcatggggacgtctgacacgagtatctagctggtcatggccaacctttagatttttcaattcttcttcgtggtgtcgctccatctccacgataccgagtgccaacatgagtgaatgtgagaggattgacgagaggcaacggggtatactttaccgtggccccatggtgcctttgacaggaggggggacgtgcaaaacaaatgactctgacactcaagtaagaatatga

SEQ ID NO: 9226 - DNA, 432 bp, Glycine max
  Peptide Sequence Number=SeqID_100911
atggaagatattagtttttcactagaaggaatttgtcctattccttcaccaattgatctgtctctttcaccttcaccaattgaccagtctccttcaccaattgatcaggctcattcacctattcaagcttatcttacaccaattgatcctactccttcacctcatgaagatgaagttaataatgtggatgcgcaaagaggaatatgtaggctggaaagtaaggacaagatttttatgagaggggtgaagggccaaacatttcttacacctaaggtcgtgcaaggaaagcaagagttgggtgctggaacttatgatgcagaatatgcaaggggagagctagcaaaaacaattattatgcatgagtatccactatcagttgtggatcaccttggctttaggacatactctgctgccctccaaactgtgttttag

SEQ ID NO: 9227 - DNA, 379 bp, Glycine max
  Peptide Sequence Number=SeqID_100912
atggcagaatcgtcaaagaagagaaagggatcatcctccacaaccgctgatgctgctgcccatcgccgccacggaccatccgaagcacccacagcacctatccatccttccttgtcatctccaagatcatccactctgttttcttccgatgatcagcgtctactgtacctttctcaattttcttctaggatcattttagaccttgagtacctagacatagatttcttcaatgatgaggcatttgattgttatcaagtgtttcaaaattctggcttggttgatttcatgtctttaaaattgccttattatcctgaacttgtcaaagtcttttactgcaatttaaaaattcaggatggcattctttcttctgaggtgcatg

SEQ ID NO: 9228 - DNA, 528 bp, Glycine max
  Peptide Sequence Number=SeqID_100913
atgtcacgctctcgtgcttcatcatcacattggaccagcatgaatgaggaactcgaacacattgttgtgcatatgcccaaattaacaattgaagagcaagggcaatgtaaggaattggcatacaagatgcagcatgtcacggctccaccagagggtttcttccagatgattttcggtgaagttggtaaggtatatgctaccaagtggaaggatgtacttggcagttctgtgaccttcaaggtttatctcaccgagcaaaaagtttcttgtagcagcctggacgttccaagtagcatgtattatttcttgaaagacaaaggctggactcatttgcacttgggagatgttgcagaatgtcggctcgtgttcaatcattggagaaagtcactgaaaattggagccgggtggaaacatttctgcgagacgttgtcgttcactactggcatggagatagtttctgaatttattgatcctgatgttaatcacgtgctttactggccatgtttattaattggcttaggattgtga

SEQ ID NO: 9229 - DNA, 198 bp, Glycine max
  Peptide Sequence Number=SeqID_100914
atgttgaatccaactcagtttcaggccaaagaagagaacgttcaagtagttgatgacttgctcagcgagtggcatccgctaagcgaggcatacaactcacttagcggtgtgcagccagcctgcccagcaaggtctttgtctcttctcgcgcttatcgcgcccagtctcgctaagccaaaattcactactctcgcttag

SEQ ID NO: 9230 - DNA, 1359 bp, Glycine max
  Peptide Sequence Number=SeqID_100915
atgggttggtgtgatatgaaatatgatgatgatgaagtggcggttagaaaagggcataaaaagggtcgttggagggagcatgagaattcttggaagcatattcgcaaaatgtggttgatcgagtttagtaaccagggaacactagcgagtgggtggttgttggtggtggtggttgttggtccttcgtcttcctccgtgctagtgattgttgctgttggtggttattgttgcttcgtcttcatcagttctccttctggttcgttagaaaatcttcttcgagcccgtagacaacaacaacaacaggttgttgtcgaggaccctcctacggaggaggaattggtcgacgaccaaccagaagcacctgttgaagaaggtgctactgatgttgagggttttccagacggaccccatgacacatcagttctgagtgattttgaaaatcacattgctttgagagtgtggaatgtagaggaacgtcctgagttgaagttatcttcccatggaaggaagatgactaagttcgggaggcctgccccaaagattgaagcccttgtggtggccagtggactgagtcctttgatcacttgtttcctagatacgggcgatcggggactaatgtatgcttttgtggaacgctggcataaggaaactagcagtttccatttgcctgtcgaagaggtgattatcaccttggatgacgttgcgtcattgctacatttgcctgttgtaggggcattccatagctttgagctacttcatgtcgatgacgctggcgaaatgttggtggagttactcgaggtcagtgctgcagaagcgagagctgagacgattcagtgtcatgactcttatgttcgactattgtggctgcgcgacgtgtatgagctaaagatcgaggcatgtgactggatcatagcacattttccatccgttaattccgctgttgctaccgaggattatgacgagaggagaccgcgtgcatgtcgatggacctctggcaaggcactgcccgtttccacgtattggagggatctggatagactgacccttgacgcgatgtactggatttcgtacggtgaccaccgttcatttagagaatttgagactattccgccacaccctgctgtgtcttcgctgtctgttgcagaaattgatgatagatggatgcagtttggtgactacattgcacttgatcttcctagagtaccgccggttcagcaacatgaagaatttgttgaagcaaatatgtatcaacaaccgatggcggaaacggcacctaatgaggcagacattgatcaacatcatcttcggcatgcaatggatgactttgcaacaattgcgataggttggacaggctactga

SEQ ID NO: 9231 - DNA, 1074 bp, Glycine max
  Peptide Sequence Number=SeqID_100916
atgggacttatcaggcttagtcataaagctccccctactaagatttttatggtgcaatgtcgtattcctattccatatactaagagttttatggtgcaatgccatattcatattccatctatttgccctagatgtgggaaatgggtgttgatccctaatagggttaacatgaattggcaaacgtggattcatgctcagatgcaacatgtgggaaggcttcttttgtgggagtttatggccatggtgtttgatagtgagtttgatggtgtggagtctaatggagttagcttgagtggtgagtggattaagggctactatgggaacattgaccatgcagatatcttgaaagcacaactgttggggttgcttcatggtttgcaaaaatgcagtaatgttctttgtgtttcagactcgctgcatgcggtccaattgatcaagaagaaagtccatagctacaatgcacattatcatattgttgaactggccatgtccgaggagctttttattttggagcttccgctgccagagatggctgatttacttctggttgatgttgtgcaaatgatcgtgttgtttagcgtgagagtcgtggtggaatccatgaggaagagtgtgagtataaataatctctcgttggataagctccctctcaatgctaccaaccccatcggctacgcctccgtcgacgatgatgctccaatcaacttcggcaatgccaatgaagaaggcactcatggtttgacactcacgagagtatatggtggattatggtcggttttcgttgccggagaagaagagatggatgaagatcagtggatgtatgatagtatcatgtccgaagaagttgaaatgaatgtcgaaaatgaggaagatgccgacgttaaagttgattgctctgatgcctttaatacttatgaggagtgggagtataggcctaagaaacataatttggtaagaacatgcactggcagtagaaaatgtggatgtccgtttaagttgcgtgcgaagccagtttcgggaggagacgacgagatggatgaaaagattgttgttgctgatatgacgaagtccatg

SEQ ID NO: 9232 - DNA, 468 bp, Glycine max
  Peptide Sequence Number=SeqID_100917
atggaagccttttcccccttctgtaaacaggttgctgcagaaaatatggccaggaggccttacattaattgggctgtcaagagagttacccgatttctgcaggttctgtggcctagatcccggacaaacatatttggttcaaatgcaactggtatgtcccttccaacaagtgatgttgaccttgtggtttgtctccctccagtgagaaacctggaacctattaaagaagctggaatactggaaggtcgtaatggaattaaagaaacgtgtcttcagcatgcagctaggtatcttgccaatcaagattgggtgaaaaatgattctctgaagacagtgaaaaatacagctattcctattattatgcttgtggtggaagtaccacaggatgttattacctcatcagctcctatgatacagtcgttaaatgaagagccacattgtactcctgtctcctggagaacatggtaa

SEQ ID NO: 9233 - DNA, 627 bp, Glycine max
  Peptide Sequence Number=SeqID_100918
atgacttccttctccctcaatattgacaatttcatcactctgaggctcacccccacaaactaccctatgcgtgaacaagccttagcattagtagacagccaagacttggcagataattgggtgattggaacactctctaaggaagcacttggactcgttgttggcttagacactacccacactgtttggattgcacttaaagacttgtctatgcgacaaccttgttgcaattgggaagcttgtcctagacaaagaaaattttttctatctctcacaagccttgtgcacgagtatgaaacattcacaacaaccatgctaaaacctccaaggccatcatactttgaattaatctcacaactccaaagtcatgatcaacgtcgcaattggttctccaatcactctaatgtgcacaactcttctgctcctcaagtggccttctatggcaaaccacaacgatctcgtcagttttcctctcaacatcaaggaaattctcaaaccttcacatcaatcgagaaaggatttcaggctcaacatcctaggaaccaaaataaaatccaaaccttaataagcacacaacaaagacgtcctccaccaccaggacagcgtcatatgactcctgcagaatga

SEQ ID NO: 9234 - DNA, 276 bp, Glycine max
  Peptide Sequence Number=SeqID_100919
atggcgggagagaaaggaaacaaaatgagacaaaagatcatggagttgaagaagaaggcaggggaagccactacacccagtggttgttcattcatgaacttggacaaattcattaaggaggaaccaatcaaggctgcagagaaatctcatgtacatcatactgttggggatatcactgcaacaacctttcttagtgcttcaacagcagcaaggcatgcacagccaacttggcatgagctccagtggaagtcaaggcctccacatgctgcaaagtga

SEQ ID NO: 9235 - DNA, 261 bp, Glycine max
  Peptide Sequence Number=SeqID_100920
atgcaaaaacacttaacatttcatcatagcatgttacaggctaggagatttgtaaacttactggtacgatcacctaaggtgcgaagaccatgggcaaacgggtcacagcagctacacttcttcgagatggcacacagctccactgcacacaatggatgttggcgagagagcgaggtttcgagggagcttcagggagtggtactgttgaagatagggagagaagggtttgagggagacctacggagagacctcgaagtttga

SEQ ID NO: 9236 - DNA, 432 bp, Glycine max
  Peptide Sequence Number=SeqID_100921
atgttgaagtccctggtcacaattactatattcttgatgattgtctgtgctcaagatggtctgagtgataataccatttttgacggaaagaaaactgtgcgtgtctataatgggatgaatgatggcattcttgtgtatctccattgtcgatcaagggacaatgatcttggccaacatgttcttgccgttggagagtatcaagaatggtccttcacagataacctttttggcacaactcttttttggtgcacaatggatgcaggcaatgtgcatgcgagttttgaagtttacaatgcccaaactgaggagatgaattgtagtacccaatgcaatagaattctaaataactatggaggctatttttttattcagtactatcgctactgggagaagagattgtcatggcatattccaaaaacaccatctttttaa

SEQ ID NO: 9237 - DNA, 324 bp, Glycine max
  Peptide Sequence Number=SeqID_100922
atgggttctccacctgcctccactactcctcctcctcctccttctcctcctcgtcctcctcctacttcggacgcatcggcttcgacgtctgccgtgaagcggacacgcaaagcttcacgtctacgatcgttgtccactagaccacctggtgttgagagaccagtggtgtatgttgatcctgctacagggaaggccgatggtccccacaagaagaaattaagaacatatttggggattgtggcacgtgataaggtggacatcacctacgagaactggaaggaggtccctactgctcagaaggacctaatttgggaggatattcag

SEQ ID NO: 9238 - DNA, 177 bp, Glycine max
  Peptide Sequence Number=SeqID_100923
atgcaagctgtggacaatttgaacaccattattacccctgctttggttggcaaggacccaactcaacatattgctattgacaacttaatggttcaacagcttgctggaactattaacgaatggggtcggtgtaagcaaaagcttggagcaaatgccatattggcattacaaggttaa

SEQ ID NO: 9239 - DNA, 528 bp, Glycine max
  Peptide Sequence Number=SeqID_100924
atgcaatctcagggacttgtagtgcctcctgagcctctggttggtcctggtccctctggtcctcgagtgagcacaaaggggagttgtgttgatccctcaggaaatgatcctgagactggtgactctgacaggtgcggcttgtacatagaagcagatcctgcccgcctggttgccatcgagagagtttatgagggatccactattgtttataacactcctttgttgcttggccaagtaaaggtgagtgtggaggaggtcagagatgcagatgctccagttcctgtacccactgataaggtagttgtgtctccgccaaaaccacctccgaagcccgatccggaggtcgatgatccgctttatctgatgacattgaccatcccagagcttttcttgaggccttatcaagttagatgggatgccaccgtgttcggggtcgttaatccagatttcctccgaaatcgcacacggtggtcaatgtcttcagcatatcagtgttacagttgtggattctgtaagtcttttatataa

SEQ ID NO: 9240 - DNA, 264 bp, Glycine max
  Peptide Sequence Number=SeqID_100925
atggttttcttgaccagacatgaagagtctataaaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggaatttacaaggttgaaaagaaatctcaaggaccgtaggtcgcttggggactggatgtag

SEQ ID NO: 9241 - DNA, 318 bp, Glycine max
  Peptide Sequence Number=SeqID_100926
atgctgtatgacaattgtgaaaatgctggttccctgaaagtaagagtcagtcatgcagtgaagcatgaatcacaaagagagaaaagaaaaaagaactcagcatcaggcctagcccaacatctcgctcaacgcaaagcacgtgctaagcgcgaaggaagcagtcacactaagcgtgcaacacgcgctaagcatgcaaaccagaacaatggcgctaagcgagagcagctcgctaagcgcgagatccagcacgcgttgagcgagaggagcgcgctaagcaagcttacgatggtccaagtccactttagcagctataaatag

SEQ ID NO: 9242 - DNA, 471 bp, Glycine max
  Peptide Sequence Number=SeqID_100927
atggctttgaacacaaaggagaggaatgaaaggctattttacaagttgttacttgatcatgttgaggagttactcccagttgtgtatacttcaactgttggtgaagcttgtcagaaatatgggagcatcttcatgcatcctcaaggtctttatataagtttgaaggagaaagggaggattcttgaagtactaaggaattggcctgagaagaacattcaattcattgttgtaattgatggagagcgaattttggcttttggggatctacgctggatgggaataccagtaggaaaactttctttatattcagcacttggtggagttcgtccttctactgaaaccaaacatgcgaagaagaacagagaagtggtggcgtatgggagctcaagtggcggcgtcctacaggagcttaagcggcgacataagggatctaaagaggcagtgacgacaatgacgttggggtttcactag

SEQ ID NO: 9243 - DNA, 267 bp, Glycine max
  Peptide Sequence Number=SeqID_100928
atggatatgcattaccaagagaaaaatgataagatgcttcagattcagaattctatggatcaaatacaattagcgatgaatctgttattgcagaatgcttctcaacctccaggaagttctccgaaaaatggctccccgatggtgcaaccgattaatgcttctttgcctgttaaagagatttcacttggattttctcactttgatggaacggcgcgtggcatggttctagatgtcgtagaaattatctctggtgtctacttggtctga

SEQ ID NO: 9244 - DNA, 345 bp, Glycine max
  Peptide Sequence Number=SeqID_100929
atggacgtcgatggcagcaccacactcctcttcatcgcaggactcgacttggagccctgcgtgaagctgctgacggaggttggcgtgaatctgaaccaccgcgaccggagcggcagcttcgtggtgctacacatggcggcggggtacgtgaggcccggtgtggcaaaggttctcctagatctcggcacagatctcgaggtggcggggcatagggggacacatgaaactgcacttgctattcaggggagcagccatcgctacccatcatgctatggaagtgctcattggcgcgaagggcctaagtcatgtcttgtgtcgttgactgaatgttgtggtcaggtgtag

SEQ ID NO: 9245 - DNA, 120 bp, Glycine max
  Peptide Sequence Number=SeqID_100930
atgcggatttggcccgcggggttccagcagcccgcattagaaaaagaagatgaagatatggagatggagaaggctcaagctatttcaaatatgaaaccatttgttgttggagatgtttaa

SEQ ID NO: 9246 - DNA, 192 bp, Glycine max
  Peptide Sequence Number=SeqID_100931
atgtatgaggttaagagcacaacaacgttgcagattctagcagtggcaagcataacagaaaccaggtttggccacttcagtatttggagccagcaggaagatcgagaggatttccatcaaactatgaggcaggaaccaattccaggggcagaacaaaaaaaattgttagaatcaatgttgagtgaatattag

SEQ ID NO: 9247 - DNA, 417 bp, Glycine max
  Peptide Sequence Number=SeqID_100932
atggattcaacgacgttcctctacaagcaccgatgtaacttggcatggattcaacgacgttcctctacaagcaccgatgtaacttggcatggattcaacgacgttcctcttcaagcaccgatcaacgacgtagttggccaaccattcaacggcggtggttgccggtgcaacgatgtggtagcccttacacaccacgtcggtgccaccatacctgaccttaaaagcttacctttcaacgtcgttcgtcgtgccgacaacgtcttcgaaggcgaacctgcaactacgggcctccagtcatccccgtcgcaggaatcgtgtgcttctaaaatggtggatggagaccgtcgtagattggccggaggcctacgacgacctctcattcaaagtcggccctgcaccgtcgttgaactccgatga

SEQ ID NO: 9248 - DNA, 114 bp, Glycine max
  Peptide Sequence Number=SeqID_100933
aacaaagctaaggataatgtggattttgttgctgggaatgtgaaacttattaccaccaaagaagtgtgggaccaatatttggaagaagcaaggagggatgacaaaattgtctaa

SEQ ID NO: 9249 - DNA, 273 bp, Glycine max
  Peptide Sequence Number=SeqID_100934
atgatccagcacaactccacctgtaaaaatgaatttgatggacaccacttccgtagtgaggaacatcagcgccgctttgaagtgatcaaagattggtctttcctcaaggaaagaaagtttagagccactgttgcatggcttggggacatacctaattttcaggaggagagaagacctgcagatgctcaaggagctgcccaaggaaatggagaaagggaagaggatgataaagacatggcagatttggttgattatttcattagaggagactga

SEQ ID NO: 9250 - DNA, 678 bp, Glycine max
  Peptide Sequence Number=SeqID_100935
atggtggctgagcacagcagtgtgaggaacgatagtgacagcgactacgaggactgggatggcatggagagcaccgaattggacgaggcgttcagcgccgcgacgccgttggtggacactctgcaattttgtgatgtggttgcacccaacactgaagctaatgtgggccttttgtcatggcttggcatctgtgaagctaattcagcttttcctcagaacttttccctcttgtgcttccattggtatttctattttacacttttggtcttagtcaccttttcttcctggtgtttgggattttacttttgtcacaactggtatgggatcaaaatttcagggttgattggggagaggatggggatggggggggaaacattttttgtgacttccggtattgttctctattttggtgacatgttgttgcttactattaaaaaggggcttgtgcttggtcttctgctatatccaatagctttgaaatatattctccaaatatgtgagtggtctataaatacaacttctgctgaagcaagaagatactatgagattgggagatctcttatatttgttgcttcccttggaattgtcctgatcgtgattgtaccatcatggatgcagtttgtgcataagtttcaaatgcatccttttttgtggtatctcatcaatatcttgatataa

SEQ ID NO: 9251 - DNA, 447 bp, Glycine max
  Peptide Sequence Number=SeqID_100936
atgccaaatttaaggttttatgtggcagttgtggttgtgattttgtggcaatccttgatattgcgaaaaattgaagacaaggtggaggagaacatctgcaagtttgccaagaaaggtcttactccctctcacattggtgttattcttcatgactctcatggaattgctcaggtgaagagtgtcactggaagcaagattcttcgtatattgaaggctcacaggcttgctcctgaaatttcgaaagatttgtatcacctcatcaagaaggttgtttatattaggaagcacttggagaggaacaagaaggacaaggattctaaattcaagttaattttggttgagagtaggattcaccgacttgcccattactataagaagacaaagaagcttccacctgtgtggaaatatgaatcaacaactgccaacatctcttgtcgcttagagtga

SEQ ID NO: 9252 - DNA, 285 bp, Glycine max
  Peptide Sequence Number=SeqID_100937
atggcgtttgaatgtgggactaagtccatagacgtgcaaaacactttgcataatggaattctaaggggccaccggaatattgaagatagagtgaatgtggaagatgggcacatggaattaattactatgctaattcaagaagctcatccattagtagctgaaaagtatgcttccaactccagtcatggaaacccaaacttgattctagctgttgtcattatggtgttgactgcaaggttcaactattggaaacatcatttccaactacgatgttgtgatgtctaa

SEQ ID NO: 9253 - DNA, 372 bp, Glycine max
  Peptide Sequence Number=SeqID_100938
atgctgaagactccgacgctccccgtccccatctttgacaaattagccctaaacccaaatgcttgtgaagctgcctcagagaggattaagggaagtcacaatcacatgttgacgagctttggtaccctaccagttacgcacaaaatccttcttcatccatgcgccaatgagctcaacttagcaagaatcattgatggagatgcaaacgttgcgcttatccacgatcgccactactttgtcggtcacctcttagatctaagtcattgcaaaggtcctcgttgctcagtacgcttcgtgcaaacagtgacaaatgagggagttgttagccgattgacaactaaactaaatcgcgcaagtagtaataaacgataa

SEQ ID NO: 9254 - DNA, 462 bp, Glycine max
  Peptide Sequence Number=SeqID_100939
atggaactcactcctgaaagagtaaaatgcttcaagaggttctttcttgatgtggatgtaagaaggaaagtgaatattgagtttgccaacttctcggatggaagagaaggttttgatgatcttgattctttaaatgatagaggtgtccacgtgtccgtgtccgtgtcgtgtccggtgtcggtgtcggtgtcggtgcttcatagccagcaatactacgataaagatgagggtcagaaaaatcttgagacatcactggaaaatttgaatcctcaaagccaggtggctgtgagacatagccaggttcatcagaggcacatgttggttgagtatgttggaggaggtagtaggggaaggcttgttggtgtctatttcatgacgaggtgggaaataaatattggaagtatgttcataagttgtgataatgcaataaacctgtgtggttggagaatgcagagatgttaa

SEQ ID NO: 9255 - DNA, 687 bp, Glycine max
  Peptide Sequence Number=SeqID_100940
atgcagtatgaatgttcatctcctcctcctgctgttgatgacgttgaggcccatattcagaatctggaaaatcaactcaagcaacagtctgaagaattctcaaattctctggctactatcaagaaacttgaaacccaaataagaagattagaggaggaactggagaaacaagccgaaggatttgaagctgatgtagatgccgtgacacgtgacaaagttgagcaggagcaaacagccatccgtgccgaagaagctttgcgaaacaccagacataaaaatgctaacactgctgagaggcttcaagaagaatttagaaggctctcaacacaaatggcttctacatttgatgcaaatgagaaggctgccatgagggcattgaccaaagcaagtgaacttcatgcgcaaaaaagactagtggaagcaatgctgcacaaagttaatgaagagcttcagtcagccaaagctgagtatgaggtaaaactgaatgaactatccaacaaaatagacatgatgacagctcagaaacaacagatgtttttggaaattgaggacaagtccaagcagcttgaaaatcagaagacactaccagaggtactagagatacaactattgaaagtaagtatgcagttggatcctgtgaatacacagacccaagctattacccctatagctgttacatggttataa

SEQ ID NO: 9256 - DNA, 2268 bp, Glycine max
  Peptide Sequence Number=SeqID_100941
atgacaaagcattttaaaaagcctgggtttactcaaatccaaagcatgaccaaaatagttgccaactacagactaaatggagttaggggggacaggtggagatggtggtggttggctcttatatggtcgatttggcagcagcgaaataagataatcttctccgatgacacattcgatgctaataaaatcatggatgatgcatcttttctattgtgggcgtggctatggaatttagagctacggaatttagagaaggactttaacattagctacaatcactggtccaacaaccttagatcaagatttcatatatgggacatcgtgttcgagtttttattgctaaaggaaagggtcaatatacctccaatagaaggtaatgtaagggagatcacgagattcccagaagacgtaactgagaaggacctctgggtccagttcaaaaggtggggagatgtaagggaggtcttcatctccaagaaaagaaacaaaggaggcaggcgatatggctttgtgaggttcagtggagtgactgacgtgcacagactggagagacagctcgacaatctcatagttggggggctgaagctatatgtcaacgttccaaagtacgaaagagggaagggtagagatgcagttagaagaccagagccgaaaacccaaactgaaggcgatcaccaaggaaagacaacaccctaccagaaccattcacggtacagggagccccagatgtcctatgcgaaagccttactcactaacccaacaacctcaacgccgaggagatatacagagaatgcgagtcccaggtctgagggatcacagtcatcggtgcacctcgagattccgacggggactaaacaatggtatgtcgaggcgtggatgggtcgtatcaagaaactagcgaacctcgaaacagctgaagatgacatagcttgggagttaggaacagatgtcgtcccgaaataccttggggacgacctgttcttattactaggcttgtcggataacagggcagaagaggtggttgaggaagaagcacgacacgggacaacaccgtttcatacgctggagaaatggaatcccaagctgagagcaggtcacagactaacctcggttctctgttggggtatcccgctaaacgcatgggagacggcgaatatcaggaagatcgtggcaccgataggggagttcatggaagtggatgatgacgcagacgagatgcgcaggctggatagggcgagggtgttaatcagaacttcatggaaaccaatactccagcacacagtaaatctccacatcgccggagaattacacaaagttcacattgttgaagaaacaggtctcatcaatgggaggtgcagttgtaaactccgaagtatatgtgggtcatcggatgcgattgcttccgacgacagcgtcatagctagcccgcgctcagacgccattgaagtgctagattccacccttacgccgagggatatcgacggtaacaccaccgccaggggaacgaacacggacaacagagaaaatcccctattacccagtggtacaccccatgatgatgatccagcggataaaacccctgctaggtggacaatctgcaaaaatagtaaagctgacaggcctattccgagagaaggaaatgagaagccaacaggcaggctactcacatcgaagatggagacaactttcgcaaatgaggaaacacccagtacccacttcaagccacgtgacgagagcaacggagaccagaatgcagcaagatcgtcccgtgatacagaaattgttgaccccatgcatggccaaggcacacaaaacgaatggggagtgggtaatttacagatggcatcatccaaggctacacgtgtgccactagcagctgatagaggacaaacaattgattataaagaaacaatgcccacacttgtcaccgagagcaaaaaggaagcatgtgacattagtgatgctatttgtgggcctctgttagtgggccttaataatcccattcttgttgaaccagacactcaacaaaatataaactcagctgctaataaacccgaaacactgggaacgcggaaggtgtatctcagaaacaaggggtgcaggaagcagaaggccctcattagtgtaaatgtttgtcaaacggatgaaagtccagagacaaacaatttgaagcagaccacagtagatatcgcaactaactccctgagtaataagggagctgaatcaccttcgaataaggccatgaagtctactgcatgccagttttga

SEQ ID NO: 9257 - DNA, 1122 bp, Glycine max
  Peptide Sequence Number=SeqID_100942
atgcttcatcttcatgtggttgagattgagaagactactaaaaatgagatttctgatgatgaggatgaggaagagaacaaggatgaggagcgtaaagttgaagatgtggacgaagataaggagaaggatgagaagaaaaagaagaccattaaggaggtatctcaagagtggtcattggtgaaaaaccagaagcctatttggatgaggaaacctgaagagattacgaaagaagaatatgctactttctacaagagtcttaccaatgatttggaagatcatttggctgttaagcacttttctgttgagggtcagctggagtttaaggctgtcctctttatccccaagagggcaccttttgatctctttgacaccaggaagaagcctaacaacatcaaattgtatgtttgccgtgtcttcgtcatggacaattgtgaggagttgatgcctgaatatcttagctttgttaagggtatcctttgttctgaggatcttcctctgaacatttctagagaaatgttgcagcagaacaagatcctgaaagtcataaggaagaacttggtcaagaagtgcattgagatgttctttgaaattgctaagaacaaggaagactataacaagttttatgaagccttctctaagaacctgaaacttggtattcatgaggattctcagaacaagacaaagctagctgaattgctcaggtatgactccactaagagtggtgatgagatgaccagcctcaaggactatgttaccaggatgaaggaaggacataacgacatctattacattactggtgaaagtaagaaagctgtcgagaattcccccttccttggtaagcttaagaagaaggggtacgaggttctctacatggttgatgctattgatgagtatgctgttggtcagcttaaggaatttgagggaaaaaagttggtctctgctaccaaggaaggcctaaaacagggactttcaagaatgaagattggctgcctaacttctagcataccctcacagaaggtaaaagatgttgatgttttagctgaacgtgaagcgtcttggtctcaacatgttttagttttggagcactttcccatgttcaaatacttctcttggaagctgtag

SEQ ID NO: 9258 - DNA, 1500 bp, Glycine max
  Peptide Sequence Number=SeqID_100943
atgggatttatgttagtagaccttcaaaaggtaggttacaaagatgacccattcatcatggcagtgcaagtgcgacaggtgttttatgttgaagatccttgtgactgtacatggctcatggcatcacccccaccgtcacccaatgctacagataatcctccggagggtcaagcaagtagtgagccgacagtgaagtatggtatttatccagctatttgggcggaatttgcaaaaagccgccaaaccccaaattggcagggagtacgcaaacgggcgcaagagattcaaaaatacaatgattgcccacacttcctatctcaaggggggtatgaactgctagacaaaaagcttatggacgagaaaacgaagaggcgggaacaactcgcagagttcactgaaaatccttcatcaagcatcgaccccccatcccctgtatcgagacaagaaaagtggaagctggcccgcacaaaccgttataggaaaatgtcctctacggcaacaaaggaaatagcagacaaaattgattcattagagcaagaagctacgcaaggaagctttgttccacatggtcgcgaagacattctaaacacaactattggcaaacctgaacatccagaacatgttgttgggacgggtgttacaattatccaatactttggacaagcgtcacgtgggtcatcgacttcgtcgccatcaatcacccaagcacaattggctgacatcatcagtgggataacggatcgggtattaggtgcccgagtcagcacaaagggcagttgcgttgaacctcaggcacaaggattagctaaagacccttctgatgttggtgtcgaactaatggggttgtatgtagttgatggtgatggcactatgctaatggctatgggaaaagtgtacgataattcttccaccatacataatattccttatgcagatggcttgattagggtgaatgttgttagaattctcatgggggacactgaggattcacaaaagcctcccccaaagtcgattgaacagcctgaaaagggcattggtgtggcaaaagataatgccctggtagagttggttaagaagttgtatgtggttttcgaaaagccaatggagttgtcatgggatggggaaaaatttgggctgcctaatgccaaaaatgggtttttcatcacacatgcatatgtgactaaaatcatttcagggaatacgtttctaaacatttctatactacatctgtggatgatggcacattggcaacttcttgttttgtgtccacgagacaatattgtattttggttttgttctttacggaaaaagcctgatgttcacattaaggctgctgttaacagtactttcgaaggtaaggagaatggacatccacctcaatggattgaaccaaagagtcatgtacaagccggagggtatgagtgtggatattatgtcatgcattggatgtggtgcatagtcagcgacggactgaagaatgaatggaacactgggtactga

SEQ ID NO: 9259 - DNA, 450 bp, Glycine max
  Peptide Sequence Number=SeqID_100944
atgagcaagaggcttcaacaggattgtgctagagctgctgaagaaggccataggattctcatgaacctcagggtaaaggacgcaagggtgcggccagtgagaggagttaagggtggcaaagatgtggctggtgagaggagatggggttacgagggtgcagtcggtgaggtcgtgagggtcgcatgctccaccatgagccacaagggtgatgagggttcgacgaggggtaaagggtgtataataggaaatcaacatcttactaagaacatcgagactgtttgtgcagtcaacccgaatgacattgttttgcctttaatgactaaaaaatacaaagaaatgatgtttagctatctcactcctttgaaaaccttaaaggttctcattccttactccttgccgtcaatgccactccctcccaacaacattgacattgctcttcgtcgtcattga

SEQ ID NO: 9260 - DNA, 552 bp, Glycine max
  Peptide Sequence Number=SeqID_100945
atgtctgaagaaattgatatggatgatgaaaatggtgtaaatgaacatgttgattgttcagatgtgttcaatacttctcagtgggctcgatcagttgctcatgaaaacggattcgtggcggtgaaggtgattataatatctaacacaaacactggtattagaggaaggacttcatttgtgttgtttgtgaaaagagtgatcaggtttaggaagaaagattttgttagaagagatattgagagtaggaaatgtcagtgtcccttcaagtttcgtgggaaaccagtggttggagagcaagattggatggtgaagttgatgttgatctccattaacggagatgtgaagcttaccttgacggtggaagagcaaaatggagttgcaagtcctcaatgccgacgacgaaccacccaatgcgcggcaaacgaacctccaaggaaagcaaacggcgccggaaggagaagaagaagcttgaacagcacaacaaagaaaaggaaaaggcacagggaagaagctcgtacggaaggcatgaacaatgcaaatgagtgtacatag

SEQ ID NO: 9261 - DNA, 1050 bp, Glycine max
  Peptide Sequence Number=SeqID_100946
atggtgctagcaagtaccaaagaattgttcatgggaagcccttttcgccttggcgataaccctactccgagtatggggtctatagaggttgctcctcataacactgttcatacatgggtgggtgctgctgataagccacaccatgaagacatgggagcattctacacagcagctagagacctcattttctacgctcatcacctgaactcggatcgattgtgggggctatggaagacattggaaggaagaagaaaggactatagtgatgatccaaattggttagattctgatttttacttctatgatgagaatgccaattttgttcgtgttaaggtaagagattgccttgatactaaaaaattagggtatgtttacgaagatgttgatcttccatggctgcgaacgccacccacatcgccgaaaagcaagctattgagaaaagcgaagaagagtccacttttgagttcaaagccaagcaaatttcctttggttttggattccataacgagtaccgttgttaagaggccgaagaaattgagaagcaaggaagataaagaacaagaggaggaggttttggtgatagaagggattgagtttggaagtgataaatatgtaaagtttgatattcatattaatgatgatgaagataatttgaatgaaccagatcagacagagtttgtgggaacttttgttaatttgttccatggacaaggccataatatcaacactagttttaaggtagggatatcgaaagtgctcgagtgtttagaagctgaagaagacaatgttgtgctggttactttggtgcctaaggtgatccgtaaaacacacagcaactttcagatcgtgttctacgccatcgtcgacaacaatggtggaaaaaggacagggtcacggtgcttacctagacggtggacgacaacgttgctcttcgtggaagcctcctcaatgcaccacgacaacctcctaatcagggcaacaatggcggcaacctcctcaacgaagaagaagaagaaatcctctgaggtgaaaagaatgaagaagaactag

SEQ ID NO: 9262 - DNA, 258 bp, Glycine max
  Peptide Sequence Number=SeqID_100947
atggttgatgggggtcaccacttccactttgataatcaccttaagaggtccatagatatgtggactaaacttcttattaacctagtgtcgcaacgtgcccttcgcgggcgagcgagggcgaggctcatgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgtttga

SEQ ID NO: 9263 - DNA, 498 bp, Glycine max
  Peptide Sequence Number=SeqID_100948
atgaaagttgttaatgattttgtcaagctagtgatgaaagagtttgattctcataatgtatatccattcctaggatccattactccccttaattttggtggtgatcactcaatcttatatccagttgttagagccatacctgagaaccttgggggaccggttgatgttcttcgttttgatgcacatcctgatctttatgataaatttgaaggaaagtattattcgcgcgcttcttcttttgctcgaatcatggagggtggttatatatgctcgctgactcttgttgacataagatcaataaataaagaagggcgtgaacaagccaaaaagttcgggataaaacagtatgaaatgcgacatttttcgaaagatcgcccatttttggagaacctgaaactaggagaaggtgtcaaaggcgtatacatctcaatcgatgtggattgtctcgatccagggtatgctgtaggagtgtcccattatgaatcaggaggtctttaa

SEQ ID NO: 9264 - DNA, 573 bp, Glycine max
  Peptide Sequence Number=SeqID_100949
atgcatctacaagctctccctcaacaacctctctctttgcgtcaccatatcccctttcctctcaaactgcaccaatctccaaaccctagacctctcctccaacttcctcacaggcctaatcccctagaactacagtccctggtcaacctcgtcgttctgaacctctcttcgaacagtctccaaggggtcatccccccggtgctcataatgtgcgcctacctcaacattattgacctctatgataatttgcttactgggcccatccctcagcaatttggcctgctcgttcgcctctccgctttcgatgtgtccaataattgcctctcagggactatcctggcttcgctttccaaccggagcgggaacttgcccaaattcaacgctagctcattcctagggaataaggatctctacagttacccattgtcgccgcttaggaatagagggttgtccgttttggccattgttgggattggcttgggaagtggccttgctagcttggtgcttagcttcaccggggatttgagatctccctttgtagtcatgaacttaaggtgggcatgggttcagtag

SEQ ID NO: 9265 - DNA, 528 bp, Glycine max
  Peptide Sequence Number=SeqID_100950
atgtctccttcacctctagaaacctcacaatcactcaaactctcatccaattctctgcatgataacttcctctttaatctctattgtccctcaggatcttcacaccagaagttctctccgccactcagacgaatgcttccaagaacagaaaaaacgccaaaaattgagaactcccttccatttctgatttcaggctataaatacctggaggtgcaagcggtgcgcttagcaagtttgactctcgctcagcacacctgtataggtcatcatcttccaggttcttctatgcgctcagccagtcatgctgcgcctagcggatcatgcgctcagccagaggaggatggaatctcacaaaagtttgatatcactttcaacacttcgtcatctgcatacaacctcccaccatcaagcttttgttatcatccatcattatctactcaaatgtatggcatgggttatgatgatgaggaggaagatgatgataacaacaataccaacaataatgatgatggatggtcgtggtggtga

SEQ ID NO: 9266 - DNA, 447 bp, Glycine max
  Peptide Sequence Number=SeqID_100951
atggaagacatgaaagttggggctgtgaaatataaaggtatgggttatcagaaaaatatgaggattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatctggcccgaaaatactggacatataaatctgttatatctttaacagattattgtgcaatttttcaggataatgatagatctcatccagcacaagtagttgcagcccagatacgcacactgctttataaacatggaggctgcacgagttctgtaccaagtccgggattgaagagttattttgtgagttttgggacttga

SEQ ID NO: 9267 - DNA, 195 bp, Glycine max
  Peptide Sequence Number=SeqID_100952
atgaaaacagagatccaagaatcaatgaagctaagctacccaatatcccaacatatctgtatatttatatctttctgctattgggatgcttttgatgggaggagcattagcatgctatgtgttgagcaatgcacgaacaagggagcgaaattgcacaaaaggaatgaagttgatgacttcaatcaaccattttaa

SEQ ID NO: 9268 - DNA, 543 bp, Glycine max
  Peptide Sequence Number=SeqID_100953
atgggtgcactagattacctctccaacttttgcactgtaaccagcactaggaccaagcagaaagcaatgcagacaacagagataaaagtgagaatggactgcgatggttgcgaaagaagagtgagaaatgcagtgagttcaataaaaggagtgaaatctgtggaggtgaacagaaaggagagcagggtggtagtgagaggatatgtggatccaaagaaggtgctgaagagggggtactcactggcttcggcggtgccgccacaagacgagacgccggacgaggtgacgggggtgcgggcaaatgccacaggtcacagcgagatcaacgtcttcgaaattcaaaatttcaatgacggtgttttgaagtgcaccggcttaagttaccagcgcgccacctacaaagacgggcacccacggccaacgtcgttgaatgtgtcacgcgccatgcacgtggcacataaaatgctcacttatttacggaattgccaccgttactcctattacgacgtttttggcggaaacgatgtggaacgcgcgtcgtaa

SEQ ID NO: 9269 - DNA, 415 bp, Glycine max
  Peptide Sequence Number=SeqID_100954
atgggatccacacatgggatacagaaatcgaacggtatggatcaaaatatggggtttacccttatgtggtggaacgatgattgcttcaagaaaatagcagcagatttgtctggatcttttatcatgacatatgggataaatggggaagattatgagtattgccgttatggaggagttgtgttcatgttcaatgaaatcttgtgctgcagtggaaagggggagagcaaacttcttgaagggccggatttcaaaagatggcagaagaagatgcactttctcttgacaacattgaatgtggtgtatgtgctgagtacaccgatgccggtgtatatggaaggcgaaactctagatcaaacaaggaagcgttcgaaatgggagaacgacgattacatttgtcgtggacacattctgaacg

SEQ ID NO: 9270 - DNA, 249 bp, Glycine max
  Peptide Sequence Number=SeqID_100955
atgggtaaagaatcgtggtcattggtgcgcaaccatctgcataaagaactcataagttggtcggaagagtatatcaacctgcttggtggcatagggagatttgaggaattaaagcgttccctacttgctgacgaattatctatggtgcgtttttttacgagaccattgtcctttaccaccattggcgttgttgtggaatacacattgtcattattaggcaaagcagtggcccacctcatacataggtag

SEQ ID NO: 9271 - DNA, 666 bp, Glycine max
  Peptide Sequence Number=SeqID_100956
atgaaattaccaagtgtgaatttagaggcttcagaagcactacacgatttgccgttgaggaaccaggtgttccatagcttcgagcaacttcatgtcgatgacattgtcgatatgttggtggaattacttgagagtgggacgtacgcttggggcgctactacacttgtgcatatgtatgataatttgaatgaggcgtcaaagagcacgacgagacagcttgcaggatatattactctgttacagacctctggcaaggcactaccagtgttgacgtatcgtaggcggttagacagactgacccctgatgttgtgtgttggattccatatggtgaccaccgttcatttagagaatttgaagtcatctccttgtttaccaaccatctcagatgggttcccttggcagtcatttaccgaccgaagagggttgtacgaaagtttaggtacatccagaccattctgccacatcttaccgcgccttcgacttttgttgaagaaatggatgctagatggatgcagttcaatgactatattgcacctctagggaaaatttgtgtagtgcatgaccaatgttcgtcagattacatggagtggttctacatgattttgcatccgtttatgtctccggcacaactaggagatcctcctagagtttcgccagttcagtaa

SEQ ID NO: 9272 - DNA, 180 bp, Glycine max
  Peptide Sequence Number=SeqID_100957
atgatgcagagttgcagatcgcggcaaaatgaaggggacgagcgtcaagctaaggcgcgagagtcaggccacaacgcgaggctgaggcaagttgcaaaacacattggggacgagaggaaggaatttctgaatgagagtgagcacgacaggacaatgtcggaaagcgtactatatatttaa

SEQ ID NO: 9273 - DNA, 309 bp, Glycine max
  Peptide Sequence Number=SeqID_100958
atgttgattcttcgatcatctgagttggatgctctatcggactctactccatcagaatcccatagtctaaatccaagttcatctcttggtgaaccaagaatgtggacaaaagaaacttcaatcttcactttcctaactagagtggtaagtctcaaggtcaaagaaaccaatttcaagcccttggaaagtgctccacaacttcccatgaatgccttggaatgtgctcctcaatttcctatgaatttccaacatctagagaccaaggaaaggaagttagagaagggagaaataccaactaagaaattctaa

SEQ ID NO: 9274 - DNA, 294 bp, Glycine max
  Peptide Sequence Number=SeqID_100959
atggaattgataggaagtttggaaattattgataaggcagaaaaactaatgaatgttgtgattgcagagattctgcagactgatgctgggggttctccttcacttgtagctcgaagtctctcccctgttcaagctactgtgggatctgaacaaattcatatacatgttccaaatgaaaagttagcggtgttccagttgcaggggcatttggaattggagctggaaaagtgcgatgaggaatacccttatcatcagattttgcaatgttttgaggcaccaatggtctatgtgtag

SEQ ID NO: 9275 - DNA, 312 bp, Glycine max
  Peptide Sequence Number=SeqID_100960
atgtcagtgttgttttttaatgcatttgcattatcattactcagcaacatcaatattttaatgttccttgtattcaacaatgctttgaaaggacttaacgatactccacaacctaaatccaaggccggtgctaggtggattcttgttaaatgtaatagacaaaaaggaagcactgagtgtgactattacgtgatgcactggatgtccactataatcttaggaactttcaggaataattgggaaacgaccattggaagcacagagattgaaggcgcttcgcatccaatgggaacagtattatctcaaagttag

SEQ ID NO: 9276 - DNA, 414 bp, Glycine max
  Peptide Sequence Number=SeqID_100961
atggagagtttgagaaacttggaccttagcttaagtgggttcatgggattaatccctcatcaactaggaaaactctcaaacctgcaacaccttaatcttggatacaattatgctcttcagatagataaccttaattggatatcaaggctatcttccttagataataatacctttacttgtccaattccttcaccatttgcaaacttgtcatccttgagaactttaaacctggctcacatccgactgaatggaaccattcctaagagttttgagttcctcaaaaacctgcagggccaaaaggtatcactagatagagccgcgcaagttattgctgagtgcaaattaaagtcctcaccatatgatatatggcataataatagcactgtgtttgtgttgaaagtccattgcacctag

SEQ ID NO: 9277 - DNA, 507 bp, Glycine max
  Peptide Sequence Number=SeqID_100962
atgcaattcaggctcggcaggcgcgttgtaagggttgctaaatgggtcttcggtcgggtcaggatcaaaacccgacccgggtaccaccaccgtctcggttctggttcgtcccatttgagaaatcccataataaagcttctcacctgggggcaaaaattaaagagaggagcgaagaccctatgcgggaaaaaagggtcgggttatcttccaatcgggtcggatccggcttgcgacagggctccggcggtgccaaaggggcacttggcggtgtacgtgggggaggaggacggcgagttccggcgagtgttgattccggtgatttacttcaaccaccctttgttcagtgatttgctgagggaagcagaaaaaaagttcgggtttgaacaccccggtgggatcacgattccgtgtcgactcaccgagtttgaacgggtcaagacccggatcgcgtccgggtcgggtcagcgcgggaggacccggagattggggtggcggctacattattaa

SEQ ID NO: 9278 - DNA, 819 bp, Glycine max
  Peptide Sequence Number=SeqID_100963
atggcaaccgcaccggctcatgctccggtgaagtcgcagcctctgcacaacttcgccctccccttcttgaaatggggcgctagcagcaagaacaacaccaccaccgcttccgccgcccctccgaccccaactcccgcccccatcgcctcggatccagaaccgcgcgcaaccgattctcactccctctcaaaccaccgccaccaccacaattgcacgaagccgaacacgacaacgcagacgacgtcgtgcagaagccatggaaacagcgccctcgcaagcccgcacttctccccaaggccacaatcaagatcggcaccggaccttcccgaaaccaccaccacgccaccaacaacggagaattccactaaggcggcagcggcggcgacaacaacagccccgcaccgaagttgctgtggctccgcggtgcttgtcagctatgttgaggattcaagaaaggatttagactacgagaaactgtggaagcctccatcaaatcatgggtttataccctgtacaaagcctactcctaattactcaatcatggatgagcttaatgcaaaatggggttatatcgggtactatcaaattaggcatattttgtcttctaaggctgatgatgttaacattttcactaattcagaactgtgcaagctgatagattttgtgaataagatccatgttactggccagaatgggctactatcaggtgacaacaagagtaagaggcagtggagtccaacttgttcttgtcatatgctcaactctagagcttttcaagtaatgctattgcagagggatggattacttgaaaatagctaa

SEQ ID NO: 9279 - DNA, 210 bp, Glycine max
  Peptide Sequence Number=SeqID_100964
atgggaggctgggagtcaagaagcagaggagaagccagaacgacaaagcctcagcttcaagatagttttagtgtttgtatgcgaggtaacccttctgcaggtgatttagctccattggatttggagataaaagccccttgtaggaggaacaacgcagagagaagaagaaaaattttgcaggacaggacaacacaaccaggtcgggagtaa

SEQ ID NO: 9280 - DNA, 216 bp, Glycine max
  Peptide Sequence Number=SeqID_100965
atggggatgataaaaccaaagaataataagagagaagggagagctcaggcttggagtgctaagaatagtgctctgagacgagcgcgccctgtaggcttagcctgtgcttctgttggatcgcgcagtgggcacgtagccaggcttagcgcgcgtaacggtttctgctccttcgtgcttaacgccacgcttagcgcctgcatttggttgctcgcttag

SEQ ID NO: 9281 - DNA, 444 bp, Glycine max
  Peptide Sequence Number=SeqID_100966
atgcgacttaggactgcatctggagacattgtccctatcaacttagaaattgaagctacttgtcgacgtaataacgctgcaagaagaagaagggaacaagacacagaaggaagtaattacacctcacctcctctttctccacatcacgctgaaatagacggggaaccggcacgaagagtcaccctagaggacttctccaacaccgccactcctcaattcttcacgagcattgcaagatcggaggtgcaagccgccaatatctcatacccgcattcccttattcagctaatccaagggaacctctttcatggtcttccaagtgaagatccatatgctcaccttgcctcgtacatagaaatatgcaacagcgtaaaaatcgctggagtcccagaagatgcggagaggcaaaacgatggttgcactctttcaaaggcaacagcttaa

SEQ ID NO: 9282 - DNA, 228 bp, Glycine max
  Peptide Sequence Number=SeqID_100967
atggtgaaacttggatacttgagaccaaccatgagtgaaatggtgggtacgaaggtgtcgtacctaaaactcttaaggaatctaagtgtagttgttgtgagtaggcatatcttgtatttgacatacgtgagtagtagatggttgggaggtagtcccgcgtctttggaggcttcatggagatgtgtatctagatgtgaagacacattttacatttttttccctctttaa

SEQ ID NO: 9283 - DNA, 279 bp, Glycine max
  Peptide Sequence Number=SeqID_100968
atggtcttgttgcttccctttggctttctccgccttggccctttaagccttctcggcctaagccttctgaatcaactggaaagagagatccaacctgatgaggacatgaccaagagcaagggcaaggatccacttgaaggacttggaggacctatgacaagggctagagcaaggaaagccaaggaagcccttcaacaagtgttgtccatactatttgaatacaagcccaagtttcaaggagaaaagtccaaggttgtgacccaaatggaggaggactaa

SEQ ID NO: 9284 - DNA, 921 bp, Glycine max
  Peptide Sequence Number=SeqID_100969
atggctaaggccaaggcggagaaagccaaagggaagcaacaagaccatgttgttgatgaatggattctaccttctcctttgaccaacccgggtgccgctaagaggatgcatctggatccaaggggagggatcttccaagtggccaagagtggagatagggttgcttctctttggaagaaggacttcaatcttggggctctcatccagtcttccatgctcaaccagttggaccgtgacatgttgagggaaaatgccactaaggaatctaagaaggctcagactaaatgctccaaggttgaacaagctttggttgaagctaccaaggccaacgagacactgctacagtcggcaaaacttaagagtgatcttggagaagctatggtcgagatctttaaaactcacaaggttggcttcttcaaggccactcatcaagccaagtacttcttcaaggaagccaacctctcccttttcaatattgataaggatgtgaacccccaagggagttggttcctgaagctgagggcgagccctggtgcagcggtaaagttgtgccttggtgacttgttggtcatgggttcgaatccggaaacaacctctttgcatatgcaaggttgctctatgtttgatcaccaagctttcaaggaagtcctcaactcctttgtcaatgaactaggttccgttattagagatcaaattgttgggaatctcaaattggcatacaatgttcttccatatgaatttttgaacattggttgccaagatggtggctatgtgcccttaagatacttaatgatccttttaataacagttaatgatctaatcatacctctatatcatgactcatccactgatttacctttctcatctaagtcaaggaagattggactagggatacaggagaaggccctaggattctcatga

SEQ ID NO: 9285 - DNA, 546 bp, Glycine max
  Peptide Sequence Number=SeqID_100970
atgccatatgctgacttactcccttatctgcttgataatgcgatggcagtcataagcccaacaaagatttctcaacctatgtttcctagaggatacaaccccaatgtgacatgtgcttatcatgggggagttctagggcattccattgagcattgtatgatcctgaaacataaggtgcaaagtctgattgatgcaggctggctgagattcgaggaggagaatcactcgcgaattctaatgtcgtcaagcaatactatgtactatgcatggggcaatttgaaggttgttgttagatgttcccaaggactcattagggttttcagaaattgctcgttctacacgtttggtgggggtgtcgaaacttcatcagtaagcaaccaactcgcctgggcgagctgggcggcaaacttctcccctattttggctataaaaggggcgtgggaggctgagggaaggggttcaacaccctgggcaagcatacttcgcttaaaattagtgaaaagaaggagaaagaagaggaaaatcaaggtcgaggcgcttccgtaa

SEQ ID NO: 9286 - DNA, 189 bp, Glycine max
  Peptide Sequence Number=SeqID_100971
atggcgagtttaagggtgatgcaatcctaccccccaagggcattgaatagaagactccaagaagattgggccagagatgcaagagaaggccctagggttctcataagccttaggggcttcatagtgaagggagggtaccgtggtaatgtaggattttccagctcttgtattttagggcacctagactag

SEQ ID NO: 9287 - DNA, 806 bp, Glycine max
  Peptide Sequence Number=SeqID_100972
tagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatttggatcgggcggctcaaattaaagccatgaaacaagtagctgggaaattaaattgggaattagcacaattcgcagaattagaagctttgcccaattcgcttctgatctcgataaagctactcaaaaatcaattagcaagaggtcaacgattgcgcgagttgcttaaacaatcccaatcagctcctcttaccgtggaagaacagataataactatttatactggaacgaatggttatcttgattcattagaaattggacagacattcactggggaagcagaagtccttttgaaggaagctattcaagaacagatggaactctttttactacaggaacag

SEQ ID NO: 9288 - DNA, 159 bp, Glycine max
  Peptide Sequence Number=SeqID_100973
atgatgataacaaaagatgatgacaaaggagatgacaaaaagttcaaagatcaatcaaagaacaactcaagtgaatcaagaacaattcaagagttcaagataagaatcaagaagaattcaagactcaagaagaaaattgttgtaatcgattaccagtag

SEQ ID NO: 9289 - DNA, 503 bp, Glycine max
  Peptide Sequence Number=SeqID_100974
cggtggtaggcggtagtaacgtggcatggttcaaacagttgaacgcggctggtttgaactctagcaagcaaaccatgctgacgatctcagtgactgaagatgaagtattgggtatcggcggtgaaaacctggctggtttctactcagcaatgaaatacttccaatctcaagacaatcctgagaacaagaaatttgttgaggcattcaaaaaacgctggggtaaagatgctgtgattggcgacgtaacccaagcggcttacctgggcccatggttgtacaaagctgcggttgaacgtgcaggtagcttcgacgtagataaagtacaagcggcattgccaggctacaccttcaaagatgcgccagaaggtcctgtgactgtagaagccaaccaccacctgaccaccaagctgcgtattggtcaatggggtaaagatggtcaagcgaaagtggtttacacctctgactacatcaaacctgatccatttccaaaaggctaccaataa

SEQ ID NO: 9290 - DNA, 270 bp, Glycine max
  Peptide Sequence Number=SeqID_100975
ggactaccgaaacctgtagatatgccgaatcctgatgtcgaacccttatacatgatggcattgaccatcccgcagcttttcctcaagcttttgcagatgttgtgggatgctaccatgtttgagggattcaacgatagtcaaggaagtaaatccaaggttgcggctagatggattctagttaaacaaaaaggaagcattgagtacgagtactacgtaatgcattggatgtcaacgatagtcctaggagaattcaaggataattgggaaatg

SEQ ID NO: 9291 - DNA, 63 bp, Glycine max
  Peptide Sequence Number=SeqID_100976
atgaccatagatcgacctccactccttatggctcacatagacccgggtgccgcatgtgtgtag

SEQ ID NO: 9292 - DNA, 75 bp, Glycine max
  Peptide Sequence Number=SeqID_100977
atgggtgccaaatacctcgaaacggtcaagcaaaggttgcatgccatcaaaaaatggtccccaaatgaaattagg

SEQ ID NO: 9293 - DNA, 586 bp, Glycine max
  Peptide Sequence Number=SeqID_100978
atgactaccctgactcagacatggatgacgttgctgcttagcaacatcctacccagcgatcataattctgacctccccctaccgaagtgtcatctggtgtatgccattctgacacggatgagcgttcatgtggctcagttgatcgctgatgccatttatctctttgcaggtatgccgcctaccaggcaccctctggacccgaataagtccaacaaggccctaggatttccggctttgatcacaggactctgccagtcgttcggagtccccgtcgcacctagtaaggtgattcggccacccatcactcgagcttttattgagaagtattgcacgcagagacaggcacagggtggcgaccctcaggccctagatgcaccgcctccacctcctcaggctgacccagctgggtcatttgacacagagcagtatttacggcatttggttcgccagcaggcggccaaccacagggcgcacttcagggcagaggtatcatggctcggagattggcctgaggcccaggctgcagaggcatccgcagaggctcccggcgagccagatgaggcccgcgaggatgaggagatgtcag

SEQ ID NO: 9294 - DNA, 345 bp, Glycine max
  Peptide Sequence Number=SeqID_100979
atgtctgaaccgcctcagcaaacaaggatcatcccgatgttggatcaatttgcgccattcattcatggtttcattcgtgacattgtggatgtgaaagcgaacggtaactgtggatatcggtccattgctgctttattaggtatgggggaagattcatggccgttagtgcgtaatgaattgattaaagaacttggcaggtggtcgcatgagtacatgaacctcttcggtggcatagagagatttgaacaattaaagttgtccctacttgttgatgggttttcaaagtcccgagacatgtcggaaatcaaaaggaagcagacttacgcgatccgtaaaattccgtaa

SEQ ID NO: 9295 - DNA, 117 bp, Glycine max
  Peptide Sequence Number=SeqID_100980
atgggggccatgaggtgtttggaagacagtaggaaactcagccaacaattcggttatttctggggtctgggaggaagggtgatgttaggatcaatggattcaaaggataggaggtga

SEQ ID NO: 9296 - DNA, 198 bp, Glycine max
  Peptide Sequence Number=SeqID_100981
atgggttttcctttgccgacagtcacttatcttgccgaaaatttatctggagattccgctgtcctttgcttcgggggaaagaataaggattcttttgataggccaaggttcaaaaagtttaaggttgtgtttcaatggggtcctttatcgtgggaacccaatcttgatatctggggcaaaacaaatttgggtgtcaag

SEQ ID NO: 9297 - DNA, 189 bp, Glycine max
  Peptide Sequence Number=SeqID_100982
cttgatcctttgtctacagagtggactaaagatgaaagaagattagtgcagaacaatttgaaggctaaaaacatcattacttctgccttaagaatggatgaatattttagggtttcaaattgtaggagtgctaaggatatgtgggacactctacaagttacacatgagggcacaactgatgttaaatga

SEQ ID NO: 9298 - DNA, 195 bp, Glycine max
  Peptide Sequence Number=SeqID_100983
atgcgccttccaagaaaggaatgcacgcggagtcgccaccaacgtttattcgaggaaaacgtcggaaaaaccgaaaaagacgtgatctacgaacttttagtgaaaggttcgggagttgtatttatgcacggggaagggtgtttcccttgcccctacatattcctcaattgtgataaggaaatcagacctacgtag

SEQ ID NO: 9299 - DNA, 405 bp, Glycine max
  Peptide Sequence Number=SeqID_100984
atggttgtgggggagtgtaatgagcatttcctgctagaggacatactgaaggctgtggagccagaatttgattctactagtactactgtcttttacatgttgaaaataatggacttgggtgacttggatgatggcaattctggtggggttaaggttagtggagagatgatgctcccttatgatcaaatggtgatgagcaatgcaacagctcaatcagtgagtgtaatgaagcaagaaatgtgtagtggcaaagaacaaagtgaaaggagggtgttggggggtttcccatggcagattaatgcagacactaacattattggtgaactggattcaggaaaaccaattgcaagttggaacagtttcacaaattcttgccatgggcttcttcatagaactctaatgtag

SEQ ID NO: 9300 - DNA, 378 bp, Glycine max
  Peptide Sequence Number=SeqID_100985
atggttttcttgaccagacacgaagagtctataaaaagaattcaaaggactaaccgcttgagaattctttgtcctaacacattggagggtacatcctttgtggcacaagtagagggtacatctacttgggttgttatactgagaacaagggatgatacatctcttgtggatcagttcaagtggagggtacatccacttggttgttcaaagagaacaagggaggatacatcccttgtggatctttggcttgtaaaggattttacaaggttgaaagaaatctcaagaaccgatggttgcttggggactggatgtaggcatgggttgttgctgaaccagtataaatcttctgtttgtcttcttcttccctacactctttaa

SEQ ID NO: 9301 - DNA, 198 bp, Glycine max
  Peptide Sequence Number=SeqID_100986
atgtctgagcatctctgttatacaattgtggattctcatataactgagacaagtatgcaagcggggaatgcctctatgtatggattcctcaagccacaatccatacaaaaatttggacaattgcaatttgaatgtctccaatgcagtgcatattggcaattggccgttatatgtcctaagaacaatgttgtcatctga

SEQ ID NO: 9302 - DNA, 225 bp, Glycine max
  Peptide Sequence Number=SeqID_100987
atgacagtggaaggagaaggaagagataggagacgccacttcaaggagaagatgagtctagaagaagctcaccaccatatgaggtcatggataagagcttggaggaagaaggagatgaatgaagggagaggaagagaagagcacgaaattttgtgctctaaaagagctttgaaatctgaagttttaattttcaaatgttcaaagttgaaaaatgcacaaacatga

SEQ ID NO: 9303 - DNA, 273 bp, Glycine max
  Peptide Sequence Number=SeqID_100988
gcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 9304 - DNA, 723 bp, Glycine max
  Peptide Sequence Number=SeqID_100989
atgtgctgctctaaatcagttggaatatttgtctctttgctaaaagcatgtttgcattttagtggagaaaacaccgagactttttcaagtctcacaagttatccagaactacgtaggtctgaattcctcattggaggatacgtaggagcaagagcctcgcttttgtcgaccataccgccttttgttgccatgactcaagagctggtagcccgcggagacaccttacgaggcggcagacacaggtgtccgatgcacaagcagagaccaagtttggtcattctgcacccaagatacgcggagataccttacggttatctgcacccctttgctagcagacacagttgtgtccgatggcagcagagaccaagtttggtcattctgcacccaatgatacgcggagataccttacggttatccgcaccccttttgtcatgccagaggccggtcggtccgatggcacaagcagagaccaagtttggtcattctgcacccatgatacgcggagataccttacggttattgcaccctcttttgctatctgtaagacagaacgttgatagcatgcaggggctgacacagtcttctgcaccttttgttcctccgggaacaacaaagtcatttacatgcggaaatttcatggtcgcccgcgactctcgtcaaccgagaggagcgaaattagtgtcatacactgattttcggggacctttgcttgatgacatgtga

SEQ ID NO: 9305 - DNA, 1419 bp, Glycine max
  Peptide Sequence Number=SeqID_100990
atgaaaatatctacccggcttgcaacgggctttggcctgcttattgtgctttttattatctgtaccggcattgcgctcaacgccctgagtagtgcgaccaaaggcatggacgatgcggtcaacgtcaaaatgaaaaagtatcagctggtgctggatatgcgaggcagcatcagggatatgggcattgcggttcgtaacctggcgctcctgacggatgttcaggcaatgaagcctgaatgggagcgcgtccaaaaacaagaagcgcagtatatagccagccgcaacgctctggctgaggtgatgcaggaggattcaacaccgcaggggcgggaagtcatgagccgcattactgaagctgaggagcctgcactttcgtcgctgaagcaggctggccggctcgggcttgaaaatcgcgctgaggaagccactgcctatctgctgaacgtcacgcgcccggtgcagagtaccttgctcaaagcgcttaatgacatgacgctggttcagatgaaaaatacgcagtccgctgttgaaaccaacagtcaggcgacacgccgggcatcgctgatactgatgttgctcgcggccgcatcagcactgctggcagtgggaacgtgcgttatgaccattcgcgtactgatgcgccagctgggcggcgagcctgttcaggcgcagactcttgcggcgaccattgcttctggcgacctgacgacgcctgtaacgctgcgaaacaatgacagtaccagcctgatggcttctctggatggcatgcaggcaaacctgcgtggtctggtatcaaagataaaagactctgctgcttcagtggcgctggcggcggatgagatatcacagggcaatacagaattgtcatcccgcaccgaggagcaggctgcagcactgcaggaaactgcggccagtatggagcagcttaccgccaccgtgaaaagtaatacggccggcgcgcagcagaccgctggctctgcccgggatgcggcaacgctggcacgcgcaggtgaggccgacgtacagcgtatgtctgaaaccatgaatgagatctcattgagcgccacaaaggtacgggacatcacctccgtgatcgaaagcattgccttccagaccaacattctggcgctcaacgcagccgtggaagccgcccgggcaggtgaagaaggacgcggttttgccgtggttgccggtgaagtcagaacgcttgcacagcgcagcgcaaatgctgctcgcgacatcaaacagctgattgaacaggccgttgagcaggtcgaaagcggcgttgaggtggcagcaggtacagggcagagcatattgaagattgtcagcatggtgggcgaactggcagaggccatggataatatttcactggcttcttcagaacagatgcagggcatttctcaggttagcattgcg

SEQ ID NO: 9306 - DNA, 279 bp, Glycine max
  Peptide Sequence Number=SeqID_100991
atggttggttctggttctttaattgataatctttacatgcttgatgttgttagttcctataacgaaatactgcaaataagttcacatggccatatctctaaacagagaattcagagacttgtgttggatgaaattcttgaccctttggatttatccaattttgagactttcaaggctgaggttgaacttcaacttggaaagaaaattaaggctgtcaaatttgatcgaggtggtgagtactatggcagatatgatggatcaggagaacaacgtccatga

SEQ ID NO: 9307 - DNA, 307 bp, Glycine max
  Peptide Sequence Number=SeqID_100992
atgtgggaatctgaagcagctgactctgaaccaagggatgaagttgttgtagacaactctaacactgttgaaaatttggacactcgaaaagttgtggttccgggaaaggctccatcagctactatttcagctaatgatcaaaaggtgccagcacttcaggattccaaaacagaaccacctaggcggaagaggccaaaacatatggtagaggaggggaagaacaaggataactctcaaaatcataacaaagatactggcatgtcaagcattgaccaagacatttgctctacagctgattcttcatcat

SEQ ID NO: 9308 - DNA, 363 bp, Glycine max
  Peptide Sequence Number=SeqID_100993
atgtaccctcccttgttctctttgaacaacctagtggatgtaccctccactaaaactgatccacaagagatgtaccctctcttgttctcagtcacaacaacacaagcagatgtaccctctacttgtaccacaaaggatgtaccctccaatgtgttaagacaaagttctcaggcgggaaagggaagaatcaaaagaattctcagactgtgtcgttttgaattctttgacaagggagaagggagacacaaaagaattcaggcggttagtccttcgttcttttggataaggaagaagagagacacaaaaagaattcagacgattagtccttggcgaattctttttggcaaagggaaaagggaatga

SEQ ID NO: 9309 - DNA, 279 bp, Glycine max
  Peptide Sequence Number=SeqID_100994
atgcaaaagcacaagacgagaaaagtacaatgcaaaaatagtggggtcaccctaagggttgaatctcaacacttcgctagtttacatgatgacaatccatgtgtagcttccatcccttactttggtttcattgaagaaatttgggagcttaactatgtccatgttcatcctgcgactgggaaagccgacggtccccacaaaaagaagttaagaacatatttggggatcgtcgctcgtgataaggtggatgttgttggacaagtggcctcaataacttaa

SEQ ID NO: 9310 - DNA, 495 bp, Glycine max
  Peptide Sequence Number=SeqID_100995
atggaaattaaaagagtagggaagaagaaaacaaacacacaagagttttatactggttcggcaacaacccgtgcctacatccagtccccaagcgaccttcggtccttgagatttctttacaaccttgtaaaattcctttacaagcaaagatgcacaagggattggatgtaccctccactagaactgatccacaagagatgtaccctctcttgttctcagtcaacaacccaagtagatgtaccctctacttataccacaaaggatgtaccctccaatgtgttaagacaaagttctcaggcggttagtcctttgaaactttgtgaagggagaaacaaaataattcttaggtgggagaagggagacacaaaagaattcaggtggttagtcctttgttcttttagaaaagggagaagagagacacaaaaagaattcaggcggttagtccttggcgaattctttttggcaaagggagaagggaatgagaaagatgaatag

SEQ ID NO: 9311 - DNA, 453 bp, Glycine max
  Peptide Sequence Number=SeqID_100996
atggaggttgatgataattcagattcagaaggggaagatgttgtgagtgaggagttagctgtctcttcagctagtgaaccactaatatcagtaaatgctctaactggaactactagtttcaaaacaatgcgagtcactggttattacaggaaaaaaaaccctttcatatcctcattgacagtggcgatgactatggagtttgttacacaaggaaggagacatgtgctgagaggggcttctaatgctaagctgaaaacggtgaagaagcaacaattgtacaaggcactttcttctggtgtgcacttttttatgttgcagttgtgtaagggagaagaagacttattgttgaattcacttactactcatgcacctgcatcttccatgcctactagtgttgcagaattgctatgcagatttgatgatattttccaggaacctactgttagtcgatga

SEQ ID NO: 9312 - DNA, 135 bp, Glycine max
  Peptide Sequence Number=SeqID_100997
atggacggggattatgttttcaagccaactgaagaacaaacagtgaggttaaagattcaccatggagggatgtttatttataatccatccactgcgtatgtcaatggagaaatcgttgaagaggaatggggttag

SEQ ID NO: 9313 - DNA, 183 bp, Glycine max
  Peptide Sequence Number=SeqID_100998
atgacaaaagacaacaatagatacctcagagccctacactggggcaatgagggcaccatgcatgagcctcaagcgaacctaagggcagatcagaagttctcaccagcgggaccgacagacccttggcatcactctatggccttaaatcaagaaagtttcacttggtcatatgccaaagtgtaa

SEQ ID NO: 9314 - DNA, 372 bp, Glycine max
  Peptide Sequence Number=SeqID_100999
atgacccactacctcggccgggtcaatgactgggctgggtttcacaactatggctacaatacactaagttccctgaaagctggagttgctgcacatgatgtccaacgttatgtcaaggaatcagatcgggctgcacaatgcacaaggcaagataaaatgtcaaatgaagaattgaagctgcaggatccacgatgtcggatacgatgtcctgacatccggctcgaaaatactggacacataaatcttgcagattttcaggagaatgatagatctcatccaacgcaagctgttgcagcccagaaacgcacactgctatataaacatgaaggctgcacgagttctggaccaagtccgggattgaagagttattag

SEQ ID NO: 9315 - DNA, 216 bp, Glycine max
  Peptide Sequence Number=SeqID_101000
atgcggactagacatggcaagaaaatctgtacccgtgggtacccatccgaatttgtttcgattttgacgggactgtgtggaggatactcgatatccaacgggtacagagatgggataataaagtttaaccatcgggtattagatacgggtatgtggacattaggggtggaaatgagccgaacaacttgtcgagggccttcggctcggcctatctaa

SEQ ID NO: 9316 - DNA, 900 bp, Glycine max
  Peptide Sequence Number=SeqID_101001
atggggacaaatcaaaatggcaaaaggttttatcaagtcaaggttaaaagtctagatgtcactagcctcaaggaattgggacgattgatgggacctctccaaaggaaagccttccgcaaagtgtacgggaagattctagatgtgaccgcagcggaggtatttacggaagctgttgtatccctcgcccaatactatgaccagccgttgaggtgtttcacgtttggggacttccaaatggtaccaactatcgaagagtttgaggaaatattaggatgccctcttggggggagaaaaccgtatcttttctccggttttcttccttccttgagcaagattgcagctgtggttggagattcggcaaaagagttggatcgcatgaagcaaactcggaacggcgtagtgggcctgcctcggaaatacttggaaggcaaggcaagggatatggcgagccaagagaagtggggcccgtttgcggatatattagctttgctgatttttggggttgtcctctttccgaacgttgacggtttggtggacttagccgccattgacgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggctggtttcacacctattccaacaagacacaagacacccgtgtccgcttcaaagctatcgctcatgcaccgaaaaaggaagagtcaattgggaccaacatttggctggaataggaggcagcgcaatcaattggtttcctcgttggaaggaaggcaaggaaggagttcttttctcgtgtggagactaccctaattttccattgattagggactag

SEQ ID NO: 9317 - DNA, 309 bp, Glycine max
  Peptide Sequence Number=SeqID_101002
gatggagaattcatacttgttgaagtagatcattggggcaatcctattggttgggaagggaaaactctactgaatgtaattgggagcttggtaaggagacaccaatgtgctcctatcaattttcttagctggaaagacatgcttgaggactatattattgacatggttgaattaattcagaaaataagcaacattaacaacaaaaggaaccgctcaaaatatgaggacttgcattgcatgggaaccaagaatcttccaagatggattcatgagatgacaacaaaggctaaagggagtgccaccttctag

SEQ ID NO: 9318 - DNA, 315 bp, Glycine max
  Peptide Sequence Number=SeqID_101003
atgatgaagaacggtggaaaatcttcacgaaatcactcacgaaaacgtctcggaagcgttacggaagcgcctcggcttggattttcttcacggaaacaatttttctcactaattttaagtgaatctcagataccaggagggggaaaagagggaggtggttgtagaagcaaagcttcatggagaatcaaagatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 9319 - DNA, 411 bp, Glycine max
  Peptide Sequence Number=SeqID_101004
atgatgtttacctttacttctgctggtattaagtttgacaaatcaattaatcattcaagaggacctcctacaataagaattcaaggtcaaccatgtcatagaataggtagtatgttaccgatgcctgggaaagaaccaaaatttgcacaattgtatatctttgacacagaaaatgaagtgcagaataggattaatgcaataagtccacataatcaaattcaagaacacattgtttcacaacttagtgagatgctagatgaatacaacgtgcatgcaaaaactttcaggatggccagagatagattacaagatattcaagtgaataatatcaagttgaaactgattgctaatcgtgagaaagatggtcgtacatataatgtacccactgttcctgaagttgcagcactaata

SEQ ID NO: 9320 - DNA, 360 bp, Glycine max
  Peptide Sequence Number=SeqID_101005
tccttcttcttcactgtgcttcttcttcgtcatccttcactcaaccactgtgcttcttcttcgtcatccttcatcttcttcttctccctctccctctccctctctccccttcctaatgtcatctcttcatcttcttcccggtgccaccaccaccctcaactccgcattcctcctccacccccattctcccctcttcccctccaaaaccctaacccccaaaaaacccaaacccccctctgccctcctccagtggaattgcaaaccaaaaccccaacccaaacccttttgcagaacctattggtgtaccttgggcataaaaaagtcgcaggagtttgccttcataatttccctcaatcttga

SEQ ID NO: 9321 - DNA, 168 bp, Glycine max
  Peptide Sequence Number=SeqID_101006
atgtaccctccaatgtgttgggacaaagaattctcaggcggtcctttgaatctttgtaaggggaaacaaaagatatctcaggcgggagaagagaggcacaaaagaattcagacgattagtccttctattcttttggcaaagggagaagtgaatgaagaagatgaatag

SEQ ID NO: 9322 - DNA, 321 bp, Glycine max
  Peptide Sequence Number=SeqID_101007
atgtaccctcccttgttctctttgaacctagtggatgtaccctccactagaactgatctacaagagatgtaccctctcttgttctcagtcaacaacccaagtagatgtaccctctacttggaaagggaagaatcaaaagaattctcagacggtgtcgttttgaattctttgacaagggagaagggagacacaaaagaattcaagcggttagtcctttgttcttttggaaaagggagaagagagacacaaaaagaattcaggcggttagtccttggcgaattctttttggcaaagggagaagagaatgaaaaagatgaatag

SEQ ID NO: 9323 - DNA, 417 bp, Glycine max
  Peptide Sequence Number=SeqID_101008
atggaaggagctgaagattcagtttctgattacctgtttatgttgatggtgacgaaacgagacaactctaatgctgatgacaagggtcaatggaatttggaaatgaatcctgattccagaggaaagagacagagaaacttgcatatggagactttatgttcaggcataagcagtaatcttctaagtcttggtcagttacttcagaaaggctttaagataactatggaggacctgatgatgctggttggaacacaagcacttgagcacgaatgtcttagtgctgtaagtaacacggaagaatggctttggcactataggcttagacacctgaatttcagagatcttgctcaaatgcacaagttggcacaaggaattcctcaactacaacaaccacatgagaaatgcagggattgttag

SEQ ID NO: 9324 - DNA, 135 bp, Glycine max
  Peptide Sequence Number=SeqID_101009
atggtgtgctctggaatctgtgccaatcatctgcttaaaacacctgctacgcttagcgcactaatctcacgcttagcgcgcggccttgatgttgatgccctgctagattcttctgtcgcgctgaatctgcactag

SEQ ID NO: 9325 - DNA, 483 bp, Glycine max
  Peptide Sequence Number=SeqID_101010
atgtcctcaactaatgaccccgcaattaatagagaaggatattctgatcttggtgatcagctcatgcagtgtagtcactgtaatgcaaatatgtggtatgatgaaagagtcttaaaagataaaagaactacaaatccaagattcagtttatgttgtggaaatggcaaggttgaacttccattgttacagaatccacctaaatatctctaccaacttttgtatgatcatggtacatctgatagtaaaaattaccaacagaacataaggacatataacatgatgtttgcctttacttctgctggtattaagtttgacaaatcaattaatcattcaagaggacctcctacaataagaattcaaggtcaaccatgtcatagaataggtagtatgttaccgatgcctgggaaagaaccaaaatttgcacaattgtatatctttgacacagaaaatgaagtgcagaataggattaatgcaataaggtag

SEQ ID NO: 9326 - DNA, 300 bp, Glycine max
  Peptide Sequence Number=SeqID_101011
atgactctatttggcacacaattccctatcgaatcaaagatcaaacgtacgatcacagaccataggattttctcgaagggtggtgtttttggagagaaagctgggtgtttcggtcttttcctctttgttcacgtggggggaaagaatgaggattccttttttacaggccaaggttcaaaaaggtctaaggttatgtctcaatggggtcttttatcgtgggaacccaatcttgatatctggggcgaaacaaatttgggtgtcaaggtgtcgatctcgggccgaaaccctatcactccataa

SEQ ID NO: 9327 - DNA, 135 bp, Glycine max
  Peptide Sequence Number=SeqID_101012
atgactgaagttctttcagagttacggggtcttcgctcttatgttggaatgaatatccgtctcacacagcttgaagaagatgtgggatatattcgtcagagcttcattcttccaccaccaccaccaccttcttag

SEQ ID NO: 9328 - DNA, 540 bp, Glycine max
  Peptide Sequence Number=SeqID_101013
atgtcattaaaattgccatattatcctgaacttgtaaaggtcttctactgcaatttaaaaattcaggatggcattattatctctgaggtgcatggtattcctatggtcattgatcagtcattgttcttttctttaactaatttacccagtcaaggtgcaccttttgagggcaccattgttgatgactggaaatttgattattcgagtcatgatgctcgccgcatgcgttcctttgcaattggtgctggtgcagtgacttcctttgggtaccgtaaagatcggaatggtcaatggctgaagaaggatgcactccctcctcaagatgaacgtactccttcacctcctcctcagcgcgatgattcagcactcatgaatgaagtcctctccgaattacggggtcttcgttcttatgttggtgaccgcttcgactcattagatacacgctttgccggtatggacattcacctcacacaacttgaagaggatgtaggttgcattcgtcagagtttcgatcttccaccaccacctccgccttcttag

SEQ ID NO: 9329 - DNA, 270 bp, Glycine max
  Peptide Sequence Number=SeqID_101014
atggccagccaagcaacgaagtcgtttgagaatgtcatgagccatggaatgtggagggctatgcattgtattctggggatgctgtcattgtttcaagaggataatttgtggtctgagcagaagattattgaaaacgaaaagggaggcttccggttagagatgaaaccctttcattcgatgatgaagggaaagctgcttctactgccaagtgcttgtgtgtttatgaagggctttggttttgaaattgatgtccagaagtcttttgcctga

SEQ ID NO: 9330 - DNA, 1340 bp, Glycine max
  Peptide Sequence Number=SeqID_101015
atgtatccctgcatgcgtaatgtttctggtaccacctgtcctgacaatgcattaaagctcagttgtgctggtggtgggtctggcacgatttccagcaaggccagttgttactcgtgtggctcagtcgtcatgtcgttatcctccataatgagtaggaaaagggaagaagagcccttgtgtcctctcaaatatttttcgtcacattggaagcacagtcccttctctcatcgtatggctagttcctccggcgagaggtgtttgaaaggaacggtggatgaattcgtgcacgccggtgtaggtaacaaaggaggagtgcatgatggtgtaagaatggtggttgacgagagcttgaggaagctccagctaaaggccgaaatgtctttcgcgcgccattttgtttttcctcgtgcaacctggcataggccactgcttgactcatggaggctgcttcaaattcagagaggtagttgtttaccgtggttcactgctacagtttacatagcagtccagtgggatcctcgtatgtggttgatgcgaatcgcgaatggagagcatgaagaaatgccggccaagacgataattgaccattcctgtgcatccattgaaaccatgctaatgcctgaccttccatatagaatgatgcgatcaacatcaagcttcatccgatgcggcgctgtgtgtgatcctgatgccgaaaacgaagtcgcttctggttgtgcttgctgtggattatatctgttagctttgagatgtgctaaccgctccgataaggtctccatctttgcctcgactgttgctgcaaatttcgcaaacaattcctccattttttccgatgatagagcttttgatctagtgccttccgccatacgtctgagcttgtgctcaatgaaagcaccaatgatatcgagcttacgagggctagggaacctccgcgatatgcgcgacctttgggagctcgaaggaactcgcagggagaaagaaaacgcgagttcagagagaaaaactagaagaagaaaaggactcgagaggaaggaagaaaagcttctggatttttctatattccttcaaggtttgttacagcttatttatatgtgcgagggtccacaactaaccgcaagtgctacttcgttcttctcgaacgccattggtgcatggcttcgtcttatacgttcatatcaggctctatcggacatccgagtcaaaacattcgcccgacggaatatgcccgagtcttccttgtttatttctaagggtctcaataggtttccggccttatccagaggaaaggctatggccggtctcaataggttttcggccatatgcggagatccagaggaaag

SEQ ID NO: 9331 - DNA, 663 bp, Glycine max
  Peptide Sequence Number=SeqID_101016
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttacggctgtcactcttatccaaagaaagaccaaggtcaaggcatcttaggggtgacaccttctaagcccaaagatgatatggggaaggcaattcttggtggtgaagctccttcttccttggcttattccctagtggatggtgcctcccctctcctcttctcctttgccttccgctgcatctctatggtgaaaaatcaccattga

SEQ ID NO: 9332 - DNA, 253 bp, Glycine max
  Peptide Sequence Number=SeqID_101017
ggaccagtcactagagccatgagcaagaggctccaagaggattgggctagagctgctgaagaagaccctagggttctcatgaacctcaggactcatcttctccttgaagtggcgtctcctctctctctccctttctccattccgctgccattcatattccaagaagcaaaggaatccattgatgaagaagatcctaggcctacaagctccaatggagcttgcatcatgtggtatcaagagcatcttcatctag

SEQ ID NO: 9333 - DNA, 270 bp, Glycine max
  Peptide Sequence Number=SeqID_101018
atgtcaggtactaatcctaatgatggagtggggctttcgcaattccaaatgcaagctttgatgcaacatttggagaggttaatgaaaaacgagatgatgcactccatgagaggttggatcaaatggagaatagagatcataatgaagaagaaaggaggagaggagggaatgatgtgggagatgaaaatagagaatgttttctcatgcaacaactatgaggaggaccaaaaggtgaagcttgccgccacaaatttttccaactatgctctt

SEQ ID NO: 9334 - DNA, 258 bp, Glycine max
  Peptide Sequence Number=SeqID_101019
atgtctcctccacctctagaacctcacaatcactcacaaactcatctcaagctctcaggacgacttcctcttcaagctccattcactacaagtggccttgttggtgcttacgcgcttagcacaactctggaccgcttagcgcacattagtgaatttcggcttagcgcgcgttttcttgctcagcagatggactcaagcggtgtgcttagcgggatgagccctcgctcagcgaacacgtgcagctcatccatcttctag

SEQ ID NO: 9335 - DNA, 369 bp, Glycine max
  Peptide Sequence Number=SeqID_101020
atgatttgttgtcagcccagcctcattacaagcctagtaaaagtccttcggattcaagtttgtgtgttcttgactgtatgtggccgtgaggctttggttgatgatccttccttgatatctgtcatccctactaacttatctcagtcgtgtttcttaataatcatgttcatgtctttgaaaaactgcatgtcttgtgagaagttgttgatggaaacattgaatgccattcatgtcataagtgccaaaggagtcatcgcgctaagcgagctcaatgcgcttagcacgcatcaacagctaagcccagcaccagtgcacttagcgagtaaaggggaatctggaaaggcatctgctatgcaagcacgcgcttag

SEQ ID NO: 9336 - DNA, 471 bp, Glycine max
  Peptide Sequence Number=SeqID_101021
atgcagatgaagccaaagttgagacagtacagtgtcatgaggcatatacacgactatcatgactatgagacatttatcgtagcaaatatgcattacggtaaccaacgtccagttagagaatttgagctcatttcttgtttttttggacatatccgatggggtcctgctgttgtcatacaccgaccagagagggttgcacgacagtttgagcatgttcagacgatccctccacactctctaagttcaagattatacttagaagatattgatgacaaatggatgcacttctatgagaaccttgcaccggtgggtcagatttgtgttgtgcctggacaatgtgcatcagactacatggactggttctacatgattttgcatccattcatgaggccagcacatcccggggatccagtcagacatccacctgtcatgcaagatgacacatatgtcgaaccagatatgcctcagtaa

SEQ ID NO: 9337 - DNA, 261 bp, Glycine max
  Peptide Sequence Number=SeqID_101022
atggctgcaatatctggctctattccttcaaatctaccaattctcacaggaaagaactatgaaaattggaagattcagattagggtggtgatgcgattccaaggggtttgggagttcgtagaagaaggttatatacctgtgggagagagagcaacaaatgaacaaaagcaatggctcaaacctccaaagaagcatgggacattctgcagaaatctcatgatggagccacaaaaaccaagaagatcaagctgcaaactctga

SEQ ID NO: 9338 - DNA, 498 bp, Glycine max
  Peptide Sequence Number=SeqID_101023
atgaccggaaggcttcttcctagttcattggcttttgaaagctgcatccttcattatctcattgtgcgtatcttgcttccaagatcttcaaaccttgcacaagtttctaaagatgatcttattgtcatgtgggcttttcacacagtcactctcttccttcaacactttaacatccctcttgattctgaaccttatgttccaatcaagagatcctttctaataggcgctattgtgattgcatcctttggttaccgaaaagagcatgatggctcttgggtgaaaaagggtgctcaacccattgatgaagaaggacatttacaaggtggagaagattcctctattcttcaaaagattttggaaaggttcgatggtcttcaaacctttgttggtgaaatgtttgatactttggagttacaagttgacatgcgattcaatgagatggaatcaaagattaccaaggtcgaagaagatgtctcttacatcccgtacaagctttga

SEQ ID NO: 9339 - DNA, 294 bp, Glycine max
  Peptide Sequence Number=SeqID_101024
atgaattcattgcctagcgttgttcatgtgtcctccaccatcgagtctggagccccgcgaattgattgcctagcgctgttcgccaattctccattctccaatcttattcggagacccatgaattcattgcctagcgctgttcatgtgtcctccgttatcaagcgcggagcctctggtgactggaaaatatggttttttgttattttcccgatcggttccttcgccaaacatagaaagaagaaggagagacgagagtcgtcatggaataatcacggaaagggcaagacggaataa

SEQ ID NO: 9340 - DNA, 456 bp, Glycine max
  Peptide Sequence Number=SeqID_101025
atgactacgatcgaagcattagagcgggaaacgaagagggcccgaaaggaagaatggagcaggaacaagttccgaagggctctatggggcagtagcaacgagctcaagcttagaagggccgaaagggatgagtcaagggtggaaaacatgtataaggagaaggtaaacctagctgctattcatgggcagagactagaggatgagcatgcaaaggtatcgactctacaaattgaaagggtagcaagagagaggctgatagaatcattgcacacagaagctatgaaatggatggataggttcgctctcactctgaatgggggtcaagagcttccaaggttattagccagagccaaggcaatggcagatgtatactcgactcctgatgaagttcatgggcttttcgattactaccaacacatggtcgaactgatgtcccacataattaggaaccgctga

SEQ ID NO: 9341 - DNA, 220 bp, Glycine max
  Peptide Sequence Number=SeqID_101026
atgtcgccacacgggggcgacatggatgggggtgaaaaaaggaaagagagggatggggtttctcttgcttttggcatagcgggccccggcgggaggcccgcacgacgggctattagctcagtgggctcttcagccacatgggatagtttaatgtgctcatcggcgcctgaccctgagatgtggatcatccaaggcacatttagcatggcgtacttctcct

SEQ ID NO: 9342 - DNA, 267 bp, Glycine max
  Peptide Sequence Number=SeqID_101027
atggagtgggttatcattactgaaaaacccgaacacaaaatggaactgttgagattaaatcaacaccaaaaaaatgataagaaaaagaagggaattgctcttaaagcttcatcttcaatccaagaagaaagtgataaggaagacttaattgatttgaatgaagatgatgaacttagccattttgttaaaaagttcaataagttcctgagaatcagaggaaatcaaaggagactaaactttaaacctaaaagagggacagaagattaa

SEQ ID NO: 9343 - DNA, 2027 bp, Glycine max
  Peptide Sequence Number=SeqID_101028
tcttcgctgtacagcagctcacccgggctgcgcgcgccctgcagcagcacgatctgcacgccccgttcggccatcgccgtttccagcagcggcagcatcgagcgatacggggtaacgccggtaccggtcgcgatcagcaggtagcgggcgttgtggtcgccggggttcaggcagaaccggccatagggaccggacgcactgatctggccgccctgctccagcgcctcgaacagggccgtggcggcgccaccgggcacgaaactgaccgcgatatccaccgcctcgcccgggcccagcgcgtggtcgtggatggtcgccagcgagtagctgcgcttggtttcggtgccgtcggcgtagctgaaatggacctggatgaactggccgggctggaaatccagcggctgtccatcgtcacgcacgaactggtagtggccgacggtcggggccagcatgcggcagccgaccagcttgagggggaattgaacaggcacgacttttcgggacagtgtgtagccggggcaagccctcgggcccatgggcgcgaaggcttcgagcttggcatcccagaacgatatggcgcccgccctgcgcgtgcgcgacctgcgcaagacctacgacaatggcacccaggccctgaagggggtttccctggaagtggccccgggcgatttcttcgccctgctcggccccaacggcgccggcaagtcgaccctgatcggcatcatcagctccctggtcaacctcagcgagggccaggtggaagtgttcggcagcgacctggtgcgcaaccgcagcgccaccatgcgcctgatcgggctggtgccgcaggaaatcaacttcaacctgttcgagaagcccttcgacatcctggtgaactacgccggcttctacggcgtgccgcgcgaggaagcggaacagcgcgccgaagaggagctgaagcgcgcgcacctgtgggaaaaggcccaggtgatgagccgcacgctgtccggcggcatgaagcgccggctgatgatcgcccgcgcgatgatgacccgcccgcgcctgctgatcctggacgaaccgaccgccggcgtggacatcgagatccgccgcgacatgtggcgcgtgctgaaggagatcaatgccgccggcaccacgatcatcctcaccacgcactacctggaagaggccgagtacctgtgccggcacctggcgatcatcaaccacggccagatcgtcgagcagggcccgatgcgcgccctgctggccaagctggacgtggaaggcttcctgctggacatcgacggcgcgacgctgaccgcgccggacccgcacacgctggacatcgacatgccacgcgcaatggacctcaaccgcgtgttcgccacgctcaacgaggccggcatccgcgtgcgttcgatgcgtaccaagagcaaccgcctggaggagctgttcgtgcgcctcaccggcaacctggagaagcctgcatgagcaccaccgagctgaccgacggccagcgcaaccgcgtcgcactgatgaccatcgtgcgccgcgaagtcgcccgcatcatgcgcatctggggccagaccctggtgccgccggcgatcaccatgaccctgtacttcctgatcttcggcaacctgatcgggtcgcgcgtgggtgacatgggtggctacacctacatgcagttcatcgtgccgggcctggtgatgatgagcgtgatccagaacagctacggcaacatcagctcctcgttcttcggcgccaaaactgctggtcagcccgatgccgaactgggtgatcctgtggggctacgtggccggcgcggtgctgcgcggcctgatggtgggcgtgatcgtgctgatcatcgcgatgttcttcaccccggtgcgcatcccgcacccgctggtgatgctgaccacggtgatcctgggcgcgacgatcttctcgctggccggcttcatcaacgcggtgtatgcgaagaaattcgacgacgtggcgatcgtgccgaccttcatcctgaccccgctgacctggggatcctctag

SEQ ID NO: 9344 - DNA, 372 bp, Glycine max
  Peptide Sequence Number=SeqID_101029
atgtaccttctcttgttctcagttacaacaacccaagtagatgtaccctcttcttgtaccacaaaggatgtagcctccaatgtgttaagacaaagttctcaggcgggagaagggagacacaaaagaattcaggcggttagtcctttgttcttttggaaaagggagaagagagacacaaaaagaattcaggggcttttgaaaacaaactttgccactggtaatcgattaccagatgtcgcaacatgcccttcgcgagcgagcgaaggcgaggctcatgggtgcgctttccaagggaggaaagatgcgcggagtcgccaccaacgtttatttgtggaaaacgtcgagaaaaccgaaggaaaccggtcaaaatga

SEQ ID NO: 9345 - DNA, 429 bp, Glycine max
  Peptide Sequence Number=SeqID_101030
atggcacagaagaagagcactccaatcactcctaccacatccagatggagcaaagttgcaatcccttccaagaagaggaaagaaatttcctcatctgattctgatgatgatgtcgaactagatgttcccgacatcaagaggggccaagaaatcagggaaaaaggggaattcattgtcaacattccctctgacataacaaacagaaagagtgatgagtatcagaaagtgtttgtcagaggaaaatgtgttagattctcccctgctgtaatcaacaaatacctgggcagaccaacagatggagtggtggatattgctgtctctgagcatcaaattgccaaggaaatcactgccaaacaagtccagcattggccaaagaaagggaagcttttctgcagggaagctaagtgtgaagtatgcaatcctgcatag

SEQ ID NO: 9346 - DNA, 99 bp, Glycine max
  Peptide Sequence Number=SeqID_101031
atggaaaagaagaaggaaggaaagtctggtgaagcaatggccatttcaaggcgctcagtcagggaaattataagtcaatccttgagagatgaaatatga

SEQ ID NO: 9347 - DNA, 1044 bp, Glycine max
  Peptide Sequence Number=SeqID_101032
atggggacaaatcaaaatgacaaaaggttttatcaagtcaaggttaaaagtctagatgtcaccagcctcaaggaattgggacaattgatgggacccctccaaaggcaagccttctgcaaagtctacgggaagattctagatttaaccgcagcggaggtatttacggaagctgtcgtatccctcgcccaatactatgaccagccgttgaggtgtttcacgtttggggacttccaaatgctgtggttggagattcagcaaaaagagttggaccgcatgaagcaaattcggaacggcgtagtgggcctgcctcggaaatacttggaaagcaaggcaagggatatggcgagccaagagaagtggggcccgtttgcggatattttagcgttgctgatttttggggttgtcctctttccgaacgttgacagtttagtagacttagccaccattgatgctttcctcgcatatcaccatagcaaggaaagtccagtggtggctatcttggcagatttgtttgacacctttgaccggaggtgtgagaagaacagtgcacggattatctgttgtttacccgccctctgtgtgttgttgatttcacaactattccgacaagacacgagacacccgtgtccgcttcaaagctatcgctcatgtgccgaaaaaggaagagtcgattgggaccaacatttggctgggatagggggcagcgcgatcaattggtttcctcgttggaaggaaggcaaggaaggagttcttttctcgtgtggggactaccctaatgttccattgattgggactaggggttgtattaattataatcccgcactcgccataagacagctaggatatcccatgaggggagcgccaaccgaagaaagtctctcgcctttccttgtgagggatctaggcgcgcaaggtctcaaggttatacaaagaatccacaaggcgtggaggagtccgttgaggaaagacaaggagcttagaggcatccgaaacggcgtcatcggaggttatcatggatggctaagaattcacacgtggggctag

SEQ ID NO: 9348 - DNA, 366 bp, Glycine max
  Peptide Sequence Number=SeqID_101033
atgaccggtagattgctggctgggtcattgacatttgataatcgcatcatgcactatataattgttagaattttgcttccccggtcttcaaatttggcacaagcctctgaggaggatttgattctgatgtgggctttccttaccgtgacttcctttggataccgtaaggatcggaatggtcaatggctgaagaaagacacactccctcctcaagatgagcgtactccttctccttctcctcagcgagatgattcagccctcatgactgaagttttttccgagttacggggtcttcgttcttatgttggtgaacgttttgactcgttggatactcgctttgcaggaatggatatccgtctcacatag

SEQ ID NO: 9349 - DNA, 206 bp, Glycine max
  Peptide Sequence Number=SeqID_101034
atggctggagtcataccatacttagatgctcacaaagaatatgttgcaacttgtcacccaaacatgaatatgatgcgggtgttgcaggagcacaataggagtttcattaattggtttagaaaaacaatatttggtagcgacactgcttctaagacattggcattgttagctgttaggcataatctgaatgtcctcacttggaaggg

SEQ ID NO: 9350 - DNA, 840 bp, Glycine max
  Peptide Sequence Number=SeqID_101035
atggacttcttctcctatgagaattttgaatgcattcaggcatttcaaaattcaaatctcattccttttatgtctttgaaattgcttgtctattctgaattagttaaagccttctattctaacctcgaaattcaagaaagcactttgatttctgaggtttatgggataaaaatggtcattgaccaattcctattctatgacttgacccaattatctagtgagggtgtaccatttgaaggtacactgaatgatgattggaaatttgatttctctgtacatgatgtccgccggttggtttgcaccaaccaagcggatatgaccggaaggctgcttgccggttcattggcttttgaaagccgcatccttcattatctcattgtgcgtattttgcttccaagatcttcaaaccttgcacaggcattgcgattaaatgctctattgccatatccacacctagtcactatattccttcaacactttaacatccctcttgattctgaaccttatgttccaatcaagagatccttcttaatcggtgccgctgtgattgcatcttttggttaccgtaaagagcatgatggctcttgggtaaaaaagggtgctcaaccctttgatgaagaaggaaacttaccagttggagaggattactctcttcttcaaagaattttggacaggttcgatggtcttcaaacctttgttggtgaaaggtttgatgctttggagttacaagtggacatgcgattcgatgagatggattcaaggatcaccaaggttgaaggagatgtctcttacatctgcacatgctttgatctaccaccgccgccgccaccatcatcttag

SEQ ID NO: 9351 - DNA, 53 bp, Glycine max
  Peptide Sequence Number=SeqID_101036
acattgtaaaaggaatttacaaagatagtggaaatctcaagtgggttgcttga

SEQ ID NO: 9352 - DNA, 291 bp, Glycine max
  Peptide Sequence Number=SeqID_101037
atgtacatagactatgctataaggaaagaagaaccacttgcaatcactgacgaaagtagcccaactattgttgagctatatgagcggtgtgagcgatccaaccagctcagtgtgatgttcattaagaccaaaatctcgactgggatacatgtttttattgaccagcatgaaaaggtccaagacttgcttaaggctattgatggccagttcatcacttcagataaggctttagcaagcaccttggtcaagaagttttcctttctccggctcactagtgtgaaagatgtgtga

SEQ ID NO: 9353 - DNA, 2638 bp, Glycine max
  Peptide Sequence Number=SeqID_101038
gggccgcgatgatcgtggaggtggaatgatgagcttcgaaaacgcattgcatgaacagcgcgccaaaccgtcggcctttcagctgacgattcgccccgacaacatcggcgtgatcaccatcgacgtgccgggcgacaaggtgaacacgctcaaggccgagttcgtcgaacaggtcaacgacgtgctgatccgggcgcagcagcatagcgcgctggaagggctggtgatcgtttccggcaagccggactcgtttatcgccggcgccgacatcactatgattgccgcctgcaccagcgccaaagaggcggaaacgctggccaggaaagggcagagcacgctggcgcagatcgccgcgttcccggtgccggtagtggcggccattcacggcgcctgcctgggcggcggcctggagctggcgctggcctgccacggccgcgtctgttcattggatgacaaaaccgcgctcggactgccggaagtgcagctgggcctgctgccgggctccggcggcacgcagcgcctgccgcgcctggttggcgccgccaaggcgctggacatgatcctgaccggcaagcacattcgcgcccgccaggcgctgcgcatggggttggtggacgacgccgtgccgcagtcgattctgttgcagaccgccatcgagcgggtgaagcagggctggaagcatcagcgcgagctgccgtggcaggatcgcctgctcaacggcccgctgggcagaagtctgctgttcagcatcgtgcgcaagaaaacgttggcgaaaacccacggcaactacccggcggcggagcgcatcattcaggtggtgcgcaccgggctggatcacggcagcgccagcggctatgaggccgaagcgcgcgcctttggcgagctggcgatgacgccgcagtcggcggcgctgcgcagcctgttcttcgcttccaccgcgctgaaaaaggagcggggcggcaatgcccagccgcacgccctgcatcgcgtcggtattctcggcggcggcctgatgggcggcggcatcgcctgcgtcaccgccacccgcggcggattgccggttcgcatcaaagacatcaatgaaaccggtatcaaccatgcgctgaaatacagctgggacgtgctcggcaagcgggtgcgccgcaggcgcatgcgcccggcggaacggcaaaagcagatgatgctgatctccggctctaccgattacactggctttgaacaggtggatatcgtggtcgaggcggtgttcgaagatctggcgctgaagcagcagatggtagccgaggtagaagccaactgcgcgccgcataccgtgttcgcctccaatacttcctcgctgcctatcggccgcatcgccgaaaaggcccagcggccgcagcaggtgatcggcctgcactacttcagcccggtggacaagatgccgctggtggaagtgatcccgcacgccggcaccagcgaagagaccatcgccaccaccgtggcgctggcgcacaagcagggcaaaaccgccatcgtggtgggcgacagcgccggtttttatgtcaaccgcatcctggcgccgtacatcaacgaagcggcgcgctgcctgctggaaggcgagccgattgagtcgctggacaaggcgctggtggacttcggtttcccggtcggcccgatcaccctgctggacgaagtgggcatcgacgtcggcaccaagatcattcccgtgctggtcgaggcgctggggccgcgcttcgccgcgcctgccgcgttcgatgcggtgctgaaagacgggcgcaaagggcgcaagaacggccgcggcttctatctctacccgagcgaagggcagcagcggcagcggcgcaaacgtgcggatacctcattgtatacgctgctcggcgtcacgccgaaggcgcacatgctgccggcgagcgtcgctcaacgctgcgtgatgatgatgctgaacgaagcggcgcgctgcctggacgaaggcgtgatccgcagcgcgcgcgacggcgacattggcgcggtgttcggcatcggcttcccgccgttcctcggcggcccgttccgctatatggacgaactcggcgccgagaaagtgggcggcccgatttgcactatagttgcaacagggtcgcgttgtgatcgccatcactccttgcgacagcgtcagccggtgaggctgtacagcgaggctgcggcagcggcaaaatgcccggccgccataaagagacggcgcgttatcgttttaaagctttggctttgggttgtgggactcggcgaggcggcgctcgaggcagccagcgatgcggtaaggccccttaccctatgcggccgcgacgagtcccgtcagatggcggcctggttgaacaccaagtctgtggatattgaacgcgtgctggtcagcccctatctgcgggccgaacagacgctggcgacggtgcgtgaagccttgacgctgccggagggcgaagaagtactgcccgagctgacgccgggcggcaacgccgaacaggtcggcagctatctgcaggccctggcgatgcaaggggtgagctcggtgctgatcgtgtcgcacctgccgctggtggctatctggtggccgaactgtgcccgggcgagtgcccgccgatgtcgcgacctcgcgattgccaac

SEQ ID NO: 9354 - DNA, 147 bp, Glycine max
  Peptide Sequence Number=SeqID_101039
atgtgggtgcaagccattggtctgtttgctcaagcgacatgtgctcatgagtttaggcttccaagactgttcaatcagagattactcgtcttgcacgttggtggggctgccgtaaaacaacaaattaacaatgcacccttaacatga

SEQ ID NO: 9355 - DNA, 204 bp, Glycine max
  Peptide Sequence Number=SeqID_101040
atgaaattggccaaatacaggctaaaggcccaagtggagaaggacgaaggcccaagtggagaaggacaaagcccccgagcggagaagggtgaagcgtcatccaaaccttcgctaaaggcccaagtggagaagaacgaaggcccaagtggagaaggacaaagcccccgagtggagaaggatgaaggcccagttggagaaggatga

SEQ ID NO: 9356 - DNA, 460 bp, Glycine max
  Peptide Sequence Number=SeqID_101041
atgcgcgcgggccagcttccgcgcaccggtttcgacaatccccccggcctttacggcacagaggatggtttcgtggctctcaatcttctgccggcaggtgcgacgctgcgcgcgctcgatacctcggccgccggtgtcagcacgtcaagtgaagcgctgatcggcgaaaccgcgaaatcgctgcgtcccgccctcttcatcgctgccttcctgatgctgattgccgacagcctgatcgtgcttttcatgaacggtgcctttgcccgcctgccgaaagccagaagcgccacggccgcgagcatactcctcgccctcggcgcctttgccgcggtgtcgccaaccgatgctcgtgccgacgatcccaaacccggcgacgagcagatattcgagcggctggacaccacccatcttgcttatgtccgcaccggcgaagacgatgtcgaccgcatttcagaacagg

SEQ ID NO: 9357 - DNA, 243 bp, Glycine max
  Peptide Sequence Number=SeqID_101042
atgtaccctctcttgttctcaattacaacaacccaagtaaatgtaccctctacttgtaccacaaaggatgtaccctccaatgtgttaagacaaagttctcaggcagttagtcctttgaaactttgtgaaaagggaacaaaagatatctcaggcgtttggaaaccagaaaactcagaaagcttttggcaaaggaagaagaagaagaagttcaagaagatgttcaaagagattcaaaggttgtaa

SEQ ID NO: 9358 - DNA, 201 bp, Glycine max
  Peptide Sequence Number=SeqID_101043
atggtgggaagagtccctcctgctatggtggaaaggggaaaatttgatcatatagaggaaaggctgagggccattgaaggaggtggagattatgctttcgctgacttggtagagttgtgcctaacatcatcatccctccgaagttcaaggtgccagacttcaataagtacaaggggactacttgccccgagaatcacctaa

SEQ ID NO: 9359 - DNA, 159 bp, Glycine max
  Peptide Sequence Number=SeqID_101044
atgggtgccaaatacctcgaagtggtcaaacgagggtcgcatcccaacaacggatggtccccggacgaaattaggaatttccacttgcaaaaaaacaaagttctgaaacaaagtttagaaagcttttttggcaaagagaaagcaatgggcaatggttag

SEQ ID NO: 9360 - DNA, 232 bp, Glycine max
  Peptide Sequence Number=SeqID_101045
gttatgtcatgaagtgctaaaagtgacagttgagcttagttcacaatgggctaagcgcgcatccactgctaagcgcagcttcagcgcacttagcacaacagaagaatctggcagagcatcaatatcaaggtcgcgcgctaagcgcgagatcagtgcactaagcacagcagttgtcttcagacaggctcagcgtatgactggcgctaagctcaaatccacatactcgcactaa

SEQ ID NO: 9361 - DNA, 256 bp, Glycine max
  Peptide Sequence Number=SeqID_101046
agggtacatctacttgggttgttatactgagaacaagagagggtacatctcttgtggatcagttcaagtggagggtacatccagttggttgtttaaagagaacaagggagggtacatcccttgtggatctttagcttgtaaaggattttacaaggcgtatattgcttgggatgacaatgactcatccgatggttcggagaaggagatcaatcttctatccaaggactatgaaagtgatgagaacatctctcaagaa

SEQ ID NO: 9362 - DNA, 79 bp, Glycine max
  Peptide Sequence Number=SeqID_101047
atgacgggagatgcatcaaaatttacttatatatctcccaagaaaagtggacatgtgacatatggagacaacaacaaag

SEQ ID NO: 9363 - DNA, 447 bp, Glycine max
  Peptide Sequence Number=SeqID_101048
atgaagaagaaagaactcctaatcttgaaagtgtgtttgaagaattcatggcatatcatgctagctctaaagccaatcaaaattcagtgtgaaatcaggaaattcaatttggaaagagctatttcatggaaaattatctcgggggacagaagttacaaccctacaattaaaatgaagaagaaagagagagaaaaaacctttgtagaggttgaagctcaagaggaaagccctgtcaaagagcatgattcaagagaaaaagatgaagaggaaattaaggaggaagcacaacaatgggagaagtattcaacaatagaaaatcaacaagaaagtattctccaagtcaatacctctcctcatcaactgattgtaaaggaagaaaggcatgaagaacatgagaaacccttaaatgttattctttccttgatcacaacactcttcttgcaatga

SEQ ID NO: 9364 - DNA, 543 bp, Glycine max
  Peptide Sequence Number=SeqID_101049
atgggtgttaaacattttgaggtggctaggtatgatagatcaagatttgtatcccaaaatgcttacgactgctacgtagacaatgcccttggccaaaagatccttccgaaaaggaatgtgaagctgtacattacagaatttgatgaattcaggagagaaattgagaggaggaattggcacaaggagctcactaacttctctgaagggagcattaatgtggcattagtgaaggaattctatgccaacctttatgaccttgaagataaatcaccaaagcaggtgagggtgcgagggcacctaattaaatttgatgatgacgccctcaacacctttatgaagacaccagtggtcatcgaggaaggggacaacttgctctcttactccaggttctgcaggttgaggccagatcctcaagagcttgcaacccgtctatgtatccctaggaggggatttaagctgaatgcagatgggctgcctctaaagattttgaggaagaatcttactactctggtccagacctggagtgttctatcttttttctaa

SEQ ID NO: 9365 - DNA, 237 bp, Glycine max
  Peptide Sequence Number=SeqID_101050
atgatgacaaaggtaatgacaaaaagcacaaaggtcaatgaaagaatgagttcaaaatgttcaagatggaatcaagaacaattcaagactcaagaggaaaagttgaagaacacttcaagattcatgaggaaagttgaattcaagaatcaagattcaaggatcaagcttcaagaatcaagatcaagattcaagaatcaagatcaagattcaagattcaagaatcaagagaaggcttaa

SEQ ID NO: 9366 - DNA, 1203 bp, Glycine max
  Peptide Sequence Number=SeqID_101051
atgacaaacggtcatgaatacaaagggtggagagtgggtgttaatgtcttgagagagaactgttgtagaagagttatttctcgaggcatcaactctcaagaggttggatcgcttccaatgaaacaaccccctgatttcaatggaagatacaaccctgatgttctggatagtagtatagtgcatactgatttcattaccgattctatttctgagcctagttttagtgcttttgagtctgaaattagtgttgatacaattgctgacaacaatcaaactcttatggaattggctacacctgatgttgtgtatcaaccttggtgtgaagatccacacaagcatcttaaggagtttcatgtagtgtgttccaccatgcgaccacatgacattcaagaggattatgtgaagatgaaagcatttccattctctctggatgggttgatgttaatggacaagagtatgattgatgcagccagtgaaggcgctttaatggacaaaaatcttgttgttgcaagacaattgatttctaacatagcaaccaattatcagcaatatggtactaaaatggttgcaacatccaaggttgttgcaaatgaagcttttgtttttatggttgttgataagcaaagacacaacaacaacaacccctcagacaacaacaatatcaaccctccactagcaaataccaagctcccccattcaaacaacaacaacaattctagcttcgcagacatggtattcgccggggaaagaatcgaagtgggcttgaagagagggaagttcgattacgtctcctccacaagtaccaatgctaggaggatcggatcaactggggcaaaaaggaaggaaggagatacccatgccgtcacttcagcaccggcatggatcaagccaccgcagatctctcacggtacccatcagtacgagcaacatcacccgagcttctcagctcgtgccggggactcctccaactcagcacccatacaagctagggcgcctgcacccatccagagggagaccccccaagctacggctccaaccccgactctcccggccggtaatgcccactttggcgccggttccaatgcgataaggaactttcccccgaggacaacattcacaccaatcccaatgacgtgcgaagacctcttgccatccctcatcgccaaccagatggctgtgatatctcccgggaagatctactag

SEQ ID NO: 9367 - DNA, 228 bp, Glycine max
  Peptide Sequence Number=SeqID_101052
atgtattcgtacaaaaacaaatcaaagaaagcaaggttaccaatggcagagcactataacgcggccgtagcggccgtagcggccgctatagcggcggagcggcacccatctgcgacggacatgtgtgtagcggcgcggtttcgggtcacggctggagcagccgctatcgtggcggagcatggcggagcggtttttcgcgccgctacttcgaagcactggtggttataa

SEQ ID NO: 9368 - DNA, 165 bp, Glycine max
  Peptide Sequence Number=SeqID_101053
atgagccctcgtgtcgccctcccgccgaagggtggagctgatactgaggaaaaggaaccaacagatttgaggtcaaatcctcttcaagggggaggggatgatgcaatcctccgtaggaaggaaccagtcactagagccatgagcaagaggagaggattgggctag

SEQ ID NO: 9369 - DNA, 327 bp, Glycine max
  Peptide Sequence Number=SeqID_101054
atgtgggtggaaaaagggtgggagtggaaatttaaatggagaagacacttgtttgacaaagagcttgagatggcagattgtttccgtaatgatgttgctggcagctgtattcagattcacaaaaaagatgagtggatctggaaaatagaccctactggacaatattcgaatacttccattatggtgggaatctatgacatgggtcaacattcatggagcgagtctggcagaaaccgtggcagcacttttcccagcacgcgttctgtttgcctagtagaattcatcttaaccgatgaagaagttggtggctggccctcacatggatag

SEQ ID NO: 9370 - DNA, 149 bp, Glycine max
  Peptide Sequence Number=SeqID_101055
atgtaccctctacttgtaccacaaaggatgtaccctccaatgtgtcaagacaaagatctcagggaaagggaagaatcaaaagaattctcagacagtgtcattttgaattctttgacaagggagaagggagacacaaaagaattcagccg

SEQ ID NO: 9371 - DNA, 423 bp, Glycine max
  Peptide Sequence Number=SeqID_101056
atggacggagactcctcccgccgctcttccaccgccgaagacgacggcgaccctgcggtgtgggaagcgttcaacgaaagcctcagtgaagtgccgtcggtgttggaccgtaaccgacttctgatcgagcaggtgaacgagaaccaacactccaggctccgcgacaacatggtaacaaacgtgtccctcatcaggagctcagcggcaacatctccaaggttgtcgctctcaactccaatttctccgccgccttggaacaacaacaacactccaagaactccgccgccaacgccacatgtggcgaatcatgacacgtcacgtgactttaatggctctgcttcctctgtgtccattcatgaaaagggagcagaaattgctaatctactcggtcaaactgttcgaatgccatttgcacacaactaa

SEQ ID NO: 9372 - DNA, 99 bp, Glycine max
  Peptide Sequence Number=SeqID_101057
atgggcttacaggagcactcaagtcggatgacccccaaggcctacactctaaagtgtccgtcagggcctttccctcctgattcagtgcgcctcaagtga

SEQ ID NO: 9373 - DNA, 387 bp, Glycine max
  Peptide Sequence Number=SeqID_101058
atggtagccattaccccaaccaaggttcctcaacttccatttctccgaggatacgactcgaacgcaacatgtgcatatcatgcaggaattctgggacattccattgagcgctatatgacctcgaagcgtaagggcaaagattttcaagtttataccattattgtaaaccacagttacaatgctaaatacatggataaattggatatctttgtccctcatcctctcataaacgcatctttgcgtattcaactttcaccggaatgtgggtggaagccattggtctgtttgctcaagcgacctgcgctcctgagtttggacttccaagaccgttcaattagagattactcgtcttgcacgttggtgggggtgccaaaaaacaatgagtaa

SEQ ID NO: 9374 - DNA, 150 bp, Glycine max
  Peptide Sequence Number=SeqID_101059
atggggttccgaaaaaaagtggagaattgcgaattggcgaacagcgctacgcaatatcttcgcggggctccagactcgaagcgctacgcaataacttcacagggctctagactcgatggtggaggacacatgaacagcgctaggcaataa

SEQ ID NO: 9375 - DNA, 186 bp, Glycine max
  misc_feature (107)..(107): n is a, c, g, or t
  Peptide Sequence Number=SeqID_101060
atggtggaaccatcaaagaagcacaaaggttcttcaagtagaagccaacgacactccgaggctcaggatattccaattccttcctccatttcctcctccggcattgnttctcatcagaaaaacaacgtatacgctttttattctaatcttgaaattcaagaaagtaccttgatttcagaagtttaa

SEQ ID NO: 9376 - DNA, 126 bp, Glycine max
  Peptide Sequence Number=SeqID_101061
atggaggggggaaaactgccagggaaccacattataaacgaaacctcaaagagagttgggcttcgtcctcaaaaggaaacaacaccagaatatttagccttccatagatttaaacagaaaacgtaa

SEQ ID NO: 9377 - DNA, 153 bp, Glycine max
  Peptide Sequence Number=SeqID_101062
atgtctggttttcatggagtctctactttaatcaattaccaagtgttcctagaagtgatcaagaacactttaatcgattacatcaaaaatctaatcaattacattgttcttgaaagttttccagatgttgagaataacactttaatcgattga

SEQ ID NO: 9378 - DNA, 246 bp, Glycine max
  Peptide Sequence Number=SeqID_101063
atgaatgtcgggctacacacgggatctcgcttagagcggaaattaaagagtgtagggaagaagaagacaaacacaagagttttatactggttcggcaacaatccgtgcctacatccagtccccaagcgacctgcggtccttcagatttctttcaaccttgtaaaaacctttacaagcaaagatccacaagggatgtaccctcccttgttctctttgaacaaccaagtggatgtaccctccacttga

SEQ ID NO: 9379 - DNA, 247 bp, Glycine max
  Peptide Sequence Number=SeqID_101064
atgaagacaaaagctcatgatagaatcactaaaaatatagtaagtgaaactgagcaaaaggctccataccaagatgatgagcttgtagggcttcaagaagtgttggaagttgagtctgatgtcattaatgaatctcttgtggatgttgatggaggtggagaagagatagatgcatatttacttaaacaactagacttgtttgaatcagatgaggatgaatggatattaagtaagaatgagattgaga

SEQ ID NO: 9380 - DNA, 2823 bp, Glycine max
  Peptide Sequence Number=SeqID_101065
gatcacctcgctcatgccttcgtagtggatcttttccaggttggcgacgttgttgctgaccacgtgcgcctcgtaacccttgatgcgctggtagcggcgcttgtagaggaacaggcggctggattggccgccgttggcgttttccagccgcagggtgacgcccgccgggcagtaaagatagccgccggcggtcagcgggtagtcggtggcgtcggcggaagcggtgatggcgccgtcgatgacgtacacgaaggtttcgatctcttcgccgccaaagcctttggtgttgcggccgcagtcgtgcagcgttaccagataatcgacgaaggtggcgcccagtttcggcgtcgacaagatggtgacgtcgcagttttcaaaaccgggaatgacgttgcgcaccaggccggcgccgcggctgcgcccggtaaaaaagcgccgtcaggcctcggtggccgttcgggttggcgtagtgcgtttcatcaagacgttgacggtgaagaaaatggcggtgcccaccagcaggatggcggcggagatgtaaaaccccatcaccttggagccggtgctgtcggagatcacgccggtcaggaagggggcgatcaccgacgaggacatgccgaagaagttgaacacgccgaagctggtgccatagcctttcttcggcgcgttgtcggcgacgaaggagatcatgatcggatcgaccgccagcttgcccagcaacccgtacaggatcaggctgatcagcagcatggtggagtccggcgaaatgacggtgcaaaccagcatcaccgccgcgcacagctcgaggaaaatgatcagctgcaccttcttgttgcggaaacggtcggacatgcggctgaagaacagcgcgcccggcaccgaggcgaacgccaccagggcggaggagaagccgatggccaccccttcaaagccgcgctcttgctgcaggaacgagggcagccaggtgactatcatgtagtagccgtagcaggtggcgaagtacatcgcgtaggcggagatcatgcgcaggctgaacaggccgctgggctggccgtcctcctcgggctcggcagccgtcggcgcaacggtctggctgacggccgccgcggcgtgaggctgcgagcctttgatgaccacggcgaacaccagcgtcatcaccaccagcaggccggtgatgatgaacagcatgatctgccagttcatgttgaagcttttcaccagcaggctggaggcgatcaggccgatggccatgccgagcgccgagccgctgttgatcaccgcggttgccaggccacggcgttccagcgggatattctccgacgacagggagtaggccgagccgtagtaagagccgcagcccatgcccgccagcaggctgccggcatagaccatggtcaggctggtggcgttgccgatcagcagcgtggcgatgatgaacaggcagaagcccgggatcagcaccaccttcttgccgaatttgtccaccaggatgcccgccgggatctgcatcccggtgtaggcgaagaagtagaagctggcgatcagccccatttccgcattggagtgcgcgccgatggtttgttggatctcggggaagatcggcgtcaggacggtgcgatagatccagatcaccgcccagcccagacagagcacgacgacgatctttttccagattttcaccccttcgttcaaatcggcgacggcggttttttccgccgggttatggctgatgccggcgatgctcggcacgaacatcatcaccgtcggcacgcgcggggcgaagatttgcgagtcgtgtccggcgccgctgtgcatcatgcggtaattcagccgctgcgtttcgcacaggcggctgacgcaggccaccaactgttcgttcatcgggatcggcgcttcgtccatccacagatcgatctcggcctcgatgcccatctcggcgcagatgcgctggatatcctgctcgatctcctgcgtgaagcgcagcagcgcggcctgatcggtgtggcggcagtcgagggtgaagtgggtgaagcccggcaccacgttgacggtgttcggcttcggctccaccttgccgaaggtcagcaccagcgggtcgccctcggcgcgcgccttggcgatcgattcgcagcagatgcggctgaaggcgtgcacggtatcccggcggtagctcatcggggtggtgccggcgtggttggcttcgccctgcagccgcacgtcataacgccgttggccgacgatgctggtcaccacgccgatggttttgccttcggtttccagcaccttgccctgttcgatatggatctcgacgaaggccgcgatgtcgctgcgcagcggctgatgcggcggagggaaatcgaaaccggcgtcgcgcatggcgttgacgaagccgacgcccttggcgtccgtaatgtgctgcacgtcttcccgccgggccaggccgacgatgttcttgctgccccagaacacataagggaagcggctgccttcttcttccgccagcgcgatgacttccaggctgcgcagcggcggaccgtaggtgtctttgaggtgtttgatcgccatgaaggcggcttcgataccgaactggccgtcgaggttgccgccgttgaccaccgtgtcgatgtgcgaaccggagagaatcacctggtcggggtatttgctgccctccagccggccgaacaggttgccgaccgcatcaaaatgggtgcgcagtccggcggcctcgaaggtggttttcagcgcgtgctgcgcttcgatccattccggggtataaagcagacgcgtcatgccgccgctgggatcggcgccgattttcgataa

SEQ ID NO: 9381 - DNA, 333 bp, Glycine max
  Peptide Sequence Number=SeqID_101066
atgcagatattcattgaagccatagatctaaatatttgggaagcaatagaattaggaccacatatacccactatagtagatgtaagcacaagcactacaacccaaaaaccaagagataagtggacagaagaagataggagaaaaatccagtacgatctcaaagccaaaaacatcatcacttcagccctagggatagatgagtactttagagtgtcaaattgtactaatgccaaggatatgtgggatactctccaattaacccatgaaggaaccacagatggaatggcagtccaaggaacacgagatgaaacttcaacgcctcaatcagaatga

SEQ ID NO: 9382 - DNA, 609 bp, Glycine max
  Peptide Sequence Number=SeqID_101067
atgaggtcttgggtaaggggtcagtggatcccgtttgatgcagatgctatcggccagctcctgggatatcctttagtgctggaggagggtcaagagtgcgagtatggccagaggaggaaccggtccgatgggttcgatgagaaggccatcgcccagttgctatgtataccggggcaggattttgcccggactgctgccgggagacaggtgcggatcatgcgcaccaacatgaccaccctgactcagatctggatgactttgctgctcagcaacatccagcccagcgaccataattccgacctccccctgccgaagtgtcagctggtgtatgggcgcctaccaggcaccctctggacccggataagtccaacagggccctggggatttcccgctttgatcacaggactctgccagtcgttcggagtccccgtcgcacctagcaaggtgattcggccgcccatcacccgagcttttattgagaagtattgcacgcagagacaggcccagggggatgctccgcaggccgcagacgcgccgccacctcatcaggctagcccaactggatcatttgatatggagcagtatttacggcatttggttcgccagtag

SEQ ID NO: 9383 - DNA, 231 bp, Glycine max
  Peptide Sequence Number=SeqID_101068
atgaacaacaagactgacaatcttgtgttttggaacccacatcatcttctttctgctgatgatagcaaaagggcttttgacatacctgccacagaggtttctgaggggtttcctctgataaaatttcgaccgcaggtcaaatctggagaaatcatccacaacaacataggcatacctctttcctccaagactttcaacctgcataggccccatcaaatccatgtgaagtag

SEQ ID NO: 9384 - DNA, 396 bp, Glycine max
  Peptide Sequence Number=SeqID_101069
atggaactccaacgtcttaatcaaaatgaagaaactgacaaaaagaagaaaattatagcccttaaatccttatcatcaatgcaagaagaaaatgaagaagaagattcagatgatgaagaagacttttcattctttgtgaagaaatttcagaaatttatcaagaaaagaagaattgacagacgtcagaacttcaacaatggaagaaaatcacaagaagattctcaagtccttagatccaattgtccttcaaatgaagaatggcctgagaaaagtgataagaaaaggtatgatgaaagaaggaccaagaaggcctacattgcatgggatgacaatgattcatccgatggttcaaaaaaggagattaatcttctaaccaaggattatgaaagtgattag

SEQ ID NO: 9385 - DNA, 195 bp, Glycine max
  Peptide Sequence Number=SeqID_101070
atggtgaggtgtatgatgcatgcaaagagggaccacgaaaatccgatggtgaaaactaccatacactgccaaggtttgaatttacacaaaaactccttaccaagctttggaacatcaccaatggaagaagaatttaaattaacaaacaaaacatcacaggcaagtaatggcaggcaaacaattccagacaactag

SEQ ID NO: 9386 - DNA, 384 bp, Glycine max
  Peptide Sequence Number=SeqID_101071
atggttttgaaccggaaacgtctcggaagcgttatggaagattgcaggaattttacgaaagccctagaagccatttttcaacaaaaggagggaggtgtttgctgcccagctcacccaggttgcttagccaggaagaaagaaaaggtccagaatcctcaagatgggcccaattttgaaaactactatttaaacccttatgttgataagttcaccctctgtttttgtgttttttggttgttttccttccaaaatctcacgaaactttacggattccacgacgatgggtgttatgccttcctaagtgatgtaagctccattagagcttgtaggcctaggatcttcttcatcaatggattcctttgcttcttggaagatgaatggtag

SEQ ID NO: 9387 - DNA, 189 bp, Glycine max
  Peptide Sequence Number=SeqID_101072
atgtaccatctcttgttctcagttacagcaacccaagtaaatgtaccctctacttgtaccacaaaggatgtaccctccaatgtgttaagacaaagttctcaggcgcttagtcctctgaaactttgtgaaggggaaacaaaagatatctcaggcggaagaagggagacacaaaagaattcaggtggttag

SEQ ID NO: 9388 - DNA, 111 bp, Glycine max
  Peptide Sequence Number=SeqID_101073
atgatggccaaaggttggagctttgttggggttcaatggagaatggaggagaaagaaaaagcaactttctcgcgtttctctgcgtccatcggggccagttttcgaaagtaa

SEQ ID NO: 9389 - DNA, 348 bp, Glycine max
  Peptide Sequence Number=SeqID_101074
atggggatccaaaaaagggtagagaatggagaattgcgcaaagcaatcactacgcatggctccaaactcgagggcggaggatgcatgaacgttccaaactcgttgggtagagaatggagaattgcactaagcaatcactacgcatggctccaaactcgagggcggaggatgaatgaacgctccaaactcgtgggtggaggatacatgaacgaaaacgcaattcatggggattcgaaaaagggtagagaatggagaattgcactaagcaatcactacgcatggctccaaactcgtgggcggaggatgcatgaacgaatacgcaattcatggggctccgaaaaagggtag

SEQ ID NO: 9390 - DNA, 332 bp, Glycine max
  Peptide Sequence Number=SeqID_101075
gatttacacgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatagaggttgatgaaccttggctagggttatggctaccattgaattatcaagtagatatgggagcaagctttgtggttgatttagggatggcctttgtggataactgggtggtgggtaaggaggaggtttgttattggctgagtaatgacattgttgggttggtgggaaacttggccgtatag

SEQ ID NO: 9391 - DNA, 209 bp, Glycine max
  Peptide Sequence Number=SeqID_101076
gggaaaagagggaggtggttgccgcccagctcgcctggttgcttccaccagaaggcaccgccttctgttggaacaccctggaagattacgcaaccatcccctctttgacttctgaaatgttacggaactttacggattgcgcaacaatgcttcctttcgacttccggcatgtcgcggaacttcacggattgtctaatgataggtgttaa

SEQ ID NO: 9392 - DNA, 267 bp, Glycine max
  Peptide Sequence Number=SeqID_101077
atggttaagatataccacacagagtttcatgacttcaagacagagttggagagtgatgcaatcctccctaggaaaggaccagttaccagagccatgagcaagaggctccaagaggattgggctagggttaataaagaaggccttagggttctcatgaaccttaggcttctcaaggaagttttctcaaagaagcttctcaaggaagttttcttaagaaagcttctcaaggaagttttcttaagaaagcttctcaaggaagctacctag

SEQ ID NO: 9393 - DNA, 375 bp, Glycine max
  Peptide Sequence Number=SeqID_101078
atggtggtgaccaataatggcggatgcaatactgttgggaagggccggagaggtgttgacggcaaagaggagcaaaaccttgcggtgattaaattggtggatctggtggctcaacactcatgcttgcccatcgtggtctgtcgtagcactgactttggcgaagatgaacgtgcatttatcttagagaaattccgacaggtgacatcacgatggtaccaggcgactaacggtggagcaccaaatgaggatgagcgatctcatatgataattgtaactgacgcttgccttcctctctttgcttctggagaatttcctttgaacactcatcttctcattaactatgagttatcggcaaagaagaatgctggaccatga

SEQ ID NO: 9394 - DNA, 165 bp, Glycine max
  Peptide Sequence Number=SeqID_101079
atggcttgctttgaccagcaacattctggaaaggagggacatgttgttgttgttgttgtagaggacttgcctatctcagatttggatgattcctccaacctggattgtatctgttgcttgaaagatcataattattctgatcataagcttcagattgctcattga

SEQ ID NO: 9395 - DNA, 540 bp, Glycine max
  Peptide Sequence Number=SeqID_101080
cttgagaggattgatggggacccggcgttgagaggaacgaggataagggctacgtgggagtacgtgagctcagttggaggtgggcaacaggggatggtgggtttatacgtgatttgtggatgtggagaattgtcttgcaccatcgcccgactgccacctagtaccacatgtgatggagtggtacctagagatatgttgcgggggtcaggagaccttggggacgtcaggcgagctcctggcagtcaacagataaaaggaacaaagaccacaaagcaaggaggcttgtgtggtggctggccagctgtgaatcttgaggctaagatggtctctggtaatcgattaccaagggggaactggaagattgtggaggcctctggtaatcgattaccagtctgtgtaatcgattacacagaggaatgggtcactgcctctggtaatcgattaccaaggctgtgtaatcgatcaccagagatgaaaagccttaagataccccttttacttgcatgtagtggttatgagacgcattatgttgcgacgtag

SEQ ID NO: 9396 - DNA, 303 bp, Glycine max
  Peptide Sequence Number=SeqID_101081
atgaggcataaaattttgtgcttcttctctccctctccctccactcatcttctcctaccttcaagctcttatccatggcttcttatggtgtggaatctccaatcatctttcttccttttccattatgctgccattgatcttcaagaagccaaggattccattgatgaagaagatccaaggcctacaagctccacatggagctgcatcatatggggagtctccaagagaccacctaaacctctatttgtgtgtagactaagtgaagagccagttgggacctccaaagggtcatccaagccttga

SEQ ID NO: 9397 - DNA, 213 bp, Glycine max
  Peptide Sequence Number=SeqID_101082
atgcttactacctcaaaagattggaaagccgtttccaacgacttctccgcggcttccacatatggcataaaggaagggaaacttaccaagacgtcttcctcacctgatactatgaccaaatgcccctccactacgaacttcagcttttggtggagtgtagaggaaacgactcccactgagtggatccacgggcgccccaaaattcagttgtaa

SEQ ID NO: 9398 - DNA, 467 bp, Glycine max
  Peptide Sequence Number=SeqID_101083
ctaataacaatgttctagttcaaacacccacatcactacatgaaagtgctgagaacatttcgggttttacaaagggacatcatttggaaattccgaccatgccaataggaagcgtaaaacatgcaatgacggtttccaaactcagaaatgatgcaaagggttcctctcggtgtggggttttaacggagaacaacggcgctttgtggtggctaatggtggctgtggatgatggagaaaaagcttgtcacgttggaaatggttttggaagaaagaaaggagaagaaatggcatttttccaaagctacttggactacaaggctcaaaacgcacaagtgagcaatgctctcggaaatggaaacgtcgcgcacactccagacatcttctcaaagatcccaatgcttcatgtagcttccttaagaagcttcattaagaggcttcctcaagaagcttcctcgtggcttctttga

SEQ ID NO: 9399 - DNA, 210 bp, Glycine max
  Peptide Sequence Number=SeqID_101084
atggctgccattgaaatggctccaaaaaagctttccgcgaagagatctaggagggacgccgcagctgaagggaccagtgccacccctgagtttgagagccactgtttcaggagcgccgagcaccagcagcgcttcgaggccatcaaaggatggtcgttccacagagagagacgcgtccagctcagggacgatgagtacacagatttttag

SEQ ID NO: 9400 - DNA, 123 bp, Glycine max
  Peptide Sequence Number=SeqID_101085
gtttgtcccgtatggttctatacttgtagcaccactcattgagttggtgaggaactatgttctctcatgggaagatggtgttgaggaaacaatccctgagtttcaagaacctatggatttgag

SEQ ID NO: 9401 - DNA, 63 bp, Glycine max
  Peptide Sequence Number=SeqID_101086
ctgatagaagatgctgcagtaagagcatggagacagggggagcagaaagctgatgtcatatga

SEQ ID NO: 9402 - DNA, 372 bp, Glycine max
  Peptide Sequence Number=SeqID_101087
atgtcgggcactttgctaccccaagacgttatatctaagaaggagacaatttctcgggctcccgtattcataaatcgcatctgtgttatatgcatttcttcatgcattcatccattccacctgtcataccctaatttcattcggggaccattgtttgaccgcttcgagactgtttttcggagctgggttgcttccggaagcaacccagctcaccttggcgagctaggcggcaacctcctccccctttttcctataaataggctgaagggtgctgttcttaggatccctgatccccctaatgatgtatttcagctgttttgggtgaaaaaagttttttccgtgaagaaaatccaagccgagatgcttccgtaa

SEQ ID NO: 9403 - DNA, 339 bp, Glycine max
  Peptide Sequence Number=SeqID_101088
atgagacgctcatggttagatccatcccattggatcttggccgtcaaatcgaggaacttcgagctttatgtgaggccgagactgtcaggtcggatttggtgtttgtggagattttggggatgtgggggtggtggtgatgggtacgaggcggttgacggcttcttccaggaggttagtggtggtttttctgttgttttggttgggcatggtggttggggagtaaaagtagaggcagtccttgaggtggttaggcctcttagtgatccttatggctctgctagtggatatcgtggtgttgaagttgctatcaacttctctttatacactttctttctctag

SEQ ID NO: 9404 - DNA, 639 bp, Glycine max
  Peptide Sequence Number=SeqID_101089
atgccttactttggagtcattgaagaaatctgggaggttaattatgtaaaattcagtgtctgtgttttcaagtgcacatggctacaccaccctgaggtagcaacaccttcaccatctatgtcgaaaaagacaagaaaagcaacacaactcagatcattggctactagaccagttaaggcgaagggaccagtggttcatgttgttctagccactgggaaagctctggcacatggaaaggagggtgaggatgacaaagtatgtgaaaagtatgacataagcaaagagaagtggaaccaattttgtcagaatcgtagagatccttcatgggagaaggcacaggccattcaaaaacaaaacactgcccctcatgtgttgtctcatggaggttatgattttctggaacaaaagttgatggaagagaagaaaaagaaacgattggaggaagcaacccaatctaggagcactgacataatcgttgaccctccatctcccattagacgacacatgaagtggaagatggcttcacagttaagctttgtcgtcgatggacgtcaggatgtactgactgctaccattgggcgactagagtaccctagtcgtgtccttgctgctggagttgttgtcacgattaaacaataa

SEQ ID NO: 9405 - DNA, 216 bp, Glycine max
  Peptide Sequence Number=SeqID_101090
atgacgatgccaccttacagatggtacaatgggggaagtggttgcgagggagaaagggaagtggtccagtggggtaagtacgtggttgtgagggagaaggggaagtggtacgatggtggtgcgggaaagggattccttgggtgttcagaagttgtaaaaaggtttcttacaaagttagtgaaaatctcaagtgggttgcttgaggactggatgtag

SEQ ID NO: 9406 - DNA, 294 bp, Glycine max
  Peptide Sequence Number=SeqID_101091
atgtttgcacattcgattaaaggctgccgtcccttggggacggatgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacgcgcatcccgcgagtctcgcgtcgccctcccaccgaagggtaggttgcgacaggggtttagtaattcaggagacaccataagaacacatgagcattgttag

SEQ ID NO: 9407 - DNA, 177 bp, Glycine max
  Peptide Sequence Number=SeqID_101092
atgttggctgttgttttgtctattcaatccctgaataatatttggatgatgtcgattaggaaatgttcgatcggcgtcaccaggctaaaggcccaagtggagaaggacgaaggcccaagtggagaaggacaaagcccccgagtggagaaggatgaaggcccaagtggagaaggatga

SEQ ID NO: 9408 - DNA, 501 bp, Glycine max
  Peptide Sequence Number=SeqID_101093
atggcgcctaccaggcaccctttggacccagataagtccaacagggccctgggatttcccgcactgatcacaggactctgccagtcgttcggagtccccgttgcacctaccaaggtaattcggccgcccatcacccgggcttttattgagaagtactgtacccagagacaggctcagggtgatgctccacaggccgcaggcgcgcccccaccacctcatcaggctggccaggctgggtcatttgacatggagcagtatttacggcatttggttcgccagcagacggccaaccaccgggcacatgtacagacccagggcttcgcttctttttcatgccctactccagaccagttcagggcagaggtcgcatggcccggagattggcccgaggcccaagcaggagaggcgcccccagaagctcccggcgatggagaaaaggcccacgaggacgaggagatggccaatttgcttgacttcttgggagggagtggagctacatga

SEQ ID NO: 9409 - DNA, 216 bp, Glycine max
  Peptide Sequence Number=SeqID_101094
atgaagcaccctaaagataaaagggagtgctttagagtggatgtcttggatgaagtgatttatgactccaagaggttcattcaaagaaaagatggtttagaaaaagcattgactagagcatttgaggagatgagtgaatgtgattcgcagaaaccagttatcattaattcaagtctttctgaagaagaagaacagagactagtgaaaattttgtag

SEQ ID NO: 9410 - DNA, 201 bp, Glycine max
  Peptide Sequence Number=SeqID_101095
atgcatagatctcttgcaggagaggccaaaaggtggcttcattcatttaagggaaacaatatgaagacgtgggaggaagtggttgaaaagtttctaaaaaaatacttccccgagtcaaagactacagaagggaaggctgctatctcatcattccaccaattcccggatgaatccctgagtgaagcattggagagattttga

SEQ ID NO: 9411 - DNA, 185 bp, Glycine max
  Peptide Sequence Number=SeqID_101096
atgggagaaggtcaagaggttctgaatgtgagaaccaaaacaagagatttcccagagagcgggacctattgtcgccaaccgcaattctttacggccataactgaggttgataaagctaagtgccagtcatggcagctaagcgagattctttgcggcaatatgagtgctaagcaagaacctctcaa

SEQ ID NO: 9412 - DNA, 462 bp, Glycine max
  Peptide Sequence Number=SeqID_101097
gatgttcgaaaaaaagcacaagccatccaaaaacaaaacactgcccctcacatgatgtctcgttggggttatgaatatttagaaaagaaattgatcgatgagaagagaaagaaaaaactagagaaagctactcaatccgaaagcactgacaccgtcattgatcctccatctcccatcaaacgacacgtgaagtggaagctagcccgtaccaaggaaactggtgacatgacatctgaggcagcaaaagaaattgttgacaagattgatgcgcttgaggagcaggcctcacagggttactttgttacccatggacgtcatgatatactgactgatgccattgggagccggtataaccatcaagcaatactttggatcggctacaaggacctcctccattgctctcaaatacctgcaacagttgacgcaacaaatcaaggaccagctagaggattcgatcactga

SEQ ID NO: 9413 - DNA, 207 bp, Glycine max
  Peptide Sequence Number=SeqID_101098
atgatgcctcgtgaattcgctaagcgcaaccttcagtggctaagcgtgaggaagaatccaaaagaagataagttgtcaagttcgctaagcgcaccgctccaggtcatcaagcgcgctgcttcagctcatccactaagcgaaacaagcgtgctaagccaaaatccacttatgtgcgctaagcgatccaaatctgcactaagcgcatga

SEQ ID NO: 9414 - DNA, 539 bp, Glycine max
  Peptide Sequence Number=SeqID_101099
atgggggtgagcttagcttatagggggaatcttcttaaggaagcttctcaaggaggtgagcttagttatgagagggcatcctcttcaagcttcttatccaaggcaattcttggtggtgaagctccttcttccttggcttattccctagtggatgggttttataggtgtttgatcaaggattttagcaaagtggcccttccactatccaatatgcttcaaaaggaggtggagtttgattttgatgaccggtgcaaagaggcttttcattgcctcaagcgtgcggctgaatcaaagcctagattgatcaggtggatgttttggctccaagagtttgatttggagatctgtgatcagagcggtgaacagaacctcgtggcggaccacctgagtaggattgagtgtgcgtctgaggactcacccattcaggtgaccatgttattaggagatgcattccagaccatgagattgactcagtcctgcaattctatcatttttccgcaccaggtggtcatcttggcatacagaggacagctcgcaag

SEQ ID NO: 9415 - DNA, 384 bp, Glycine max
  Peptide Sequence Number=SeqID_101100
atgaataaaaaatctgcacctgtcgccagactctatggtttatgctcctctgccgaccaccacacaaacctttgcccttttgtgcagcaatctggagcaattgaacagcctaaagcatatgctgcaaacatctacaatagacctcctcaacctcagcagcaaaatcaaccacaacagaacaattatgacctctccagcaacagactatacgttcctccaccaatccagcagcaacaacaacaacaacagcaacaaccccagaaacagcaaacagttgaggctcctccgcaaccttcccttgaagaacttgtgaggcaaatgactatgcaaaacatgcagtttgaacaagagaccagagcctccattcagagattaactaattag

SEQ ID NO: 9416 - DNA, 207 bp, Glycine max
  Peptide Sequence Number=SeqID_101101
atgaaggttccacacaaccccttcacacttattttttctttatcattgtggggttccattgctcccagtaccagacgacgaagaactgacccacgagcattcagaggacactttcctccatgcagaggacacaatcacttcattcagaggacactttcctccatcaccaaactaggtggaaagttccattcgatgtccgcttcatga

SEQ ID NO: 9417 - DNA, 201 bp, Glycine max
  Peptide Sequence Number=SeqID_101102
atggatccaacctttgacccatgggctcaaaaaatctaccctaaggttcatgagaaccctagggccttctttagtagctctagcccaagcctcttggagtcttctatccaatacccttggggggtaggattgcatcatcccctccaccttggaaaggatcacatatgtattagtagtgttgggtatgttagagtagagtaa

SEQ ID NO: 9418 - DNA, 310 bp, Glycine max
  Peptide Sequence Number=SeqID_101103
cgacgaggcgggtcgttacactcagctcaccatttgggctcaatgcgcatccaacgctaagcgcaacttcagcgcgcttagcgcgacagaagaatctgcttcaatgaagtccttcaatggtgattttccaccatggagatgcagcgaaaggcaaaggagaagaggagaggggagacaccatccactagggaataagccatggaagaacgaacttcaccaccaagaatgtgccttggataagaagcttgaagaggatgctttaatggaggaaaagaaagagagaagggggagcatgaaattgaaggaataa

SEQ ID NO: 9419 - DNA, 309 bp, Glycine max
  Peptide Sequence Number=SeqID_101104
atgttggggaagcttgggaggattgatggggacccggtgttgagagaaacgaggatatgggctacgtgggagtacgtgagctcagttggaggtgggcaacaggggatggtgggtttatgcgtgatttgtggatgtggaaaaacttgttgtgcaccatcgcccgaccgccacctagtaccacatgtgatggagtggtacctagagatatgtcgcgggggtcaagagaccttggggatgtccagtggggtgctattgcccaaaaccaagtttgaccaattccggaccaacccgggcatagtcagtcagtga

SEQ ID NO: 9420 - DNA, 372 bp, Glycine max
  Peptide Sequence Number=SeqID_101105
atggggagcttcacagattcagcatgggaatggaacctttcttggagaaggcccctatttgacaatgaggtagcctcgactgtaggttttttggaagatatatctcacactgcactccaacaacatgcagcagacagctgggtatggaaacctgaatccaatggatactattcttctaggagtgcctacattctgctgcaagggaactcagaggagggaaacatggatgatatattcaaggacttatggaagctaaagatcccagctaaagcatcaatttttgctgggagtattaaggaggaaattgcatctcatcttttctttgactgcagcaaaacccaacattttggtgggaatccctatcatggatag

SEQ ID NO: 9421 - DNA, 408 bp, Glycine max
  Peptide Sequence Number=SeqID_101106
atgcgccctttatcattcaggaacaacaagttgggtggtaaacacgtagagacagattttgtgccctttatcattcaggagcagcgagtcgagtggaagcacgtagaggataaagcgaaggctttggctgatcgaggtcaatgggcttcattcattgatgtcctagcactattggttatcggagtcgtcctcttcccaaatgtggatgggctagtgaacctagcagggatcgacacatttgcctacgacacatttgaccagagatgcgagaagagctgcacaaggattgtttgttgcacaccagctctttatgtgtggctagtctctcacctctttcatcatgaaggtagacccgtttatcccctacaaggtcaccgcatgtgtgccgagaaagggaaggcaaattag

SEQ ID NO: 9422 - DNA, 129 bp, Glycine max
  Peptide Sequence Number=SeqID_101107
atggaagagaagagcttctatggaggctggatctttgagcttcaatggggtcctttaatggtgattttccaccttggagatgcagcggaagacaaaggaaaagaggtgagaggaggcgccatccattaa

SEQ ID NO: 9423 - DNA, 640 bp, Glycine max
  Peptide Sequence Number=SeqID_101108
atggagggtgaagctccggaagaagacgaagaggtacaggccctcaagacagagcttgagaaatcccaaatagtcaaagaaaagttcaagtcagcagctgttagggtccgaaaagagaacgctgaactgagagacgtcaatatagccaccaccaaggccttggagcaagagaccaagagggcccgtaaggaagaacatggccggaacaaattccgaggggctctgtggggcagtaacagcgagcttaagctccaaagagaagaaagggaccaatcgcgagtagatggcttgattctgaaggacgaattgaagacttgcctaaggtcaaaaaggagtttgtctcagcggttatgcaagaccgaaacaaacatgttagccatcatcaacaagtaccaagaagaattaaatttagccaccgcccacgagcacaaagtagcagacaaatacgcccgagtgtatgcggaaaaggaggctagaggaagggtgattgactcgttacatcaagaagcaacgatgtggatggaccggtttgctcttactttgaacgggagtcaagaacttccccgattgctggcaaaggccaaagcaatggcagacgcctactccgcccctgaggagatccacgggctcctcagctatt

SEQ ID NO: 9424 - DNA, 224 bp, Glycine max
  Peptide Sequence Number=SeqID_101109
gaaagctggagttgctgcacatgatgtccaacgttatgtcaaggaatcagattgggctgcacaatgcacaaggcaagataaaatgtcaaatgaagaattgaagctgcaggatccacgatttttgggacttgagtgttttgtgagccaccttgatgctaccctaacatcaagtgttggacctgagtgtgtagagttgatctctattgttcagagagcaatttctg

SEQ ID NO: 9425 - DNA, 161 bp, Glycine max
  Peptide Sequence Number=SeqID_101110
ggagaccagtcagggtcacgatgttttgcgagaatgttccaaccatatgggatcagcataggcttaaaggagcactcaaacccggtgacccccaagacactctgaagagtccgtcagggcctctccctcctgattcaggtccaacccagaaaacattttag

SEQ ID NO: 9426 - DNA, 333 bp, Glycine max
  Peptide Sequence Number=SeqID_101111
atggtatctaatcgagggggacaaggtggtcgtggaaaccgaggaggacgagctggaagaggccctcaatgttcttactgtgcttctgatcacattgctgataatagttcattattttcatccctctctcctaaaattcctcatttcattactttagtcgatggttctagagttgcagcaacaggaatcggccatgtatcacccacttcttctttatctttaaacactgtttttctgatacctagttgtcctttcaatataatatctcttagtcagcttactcgttctcataattgttcagtaacatttaatgctaactcctttgtcatatag

SEQ ID NO: 9427 - DNA, 162 bp, Glycine max
  Peptide Sequence Number=SeqID_101112
atgtcaaatgaagaattgaagttgcaggatccacgatgtcggatacaatgtcctgacatcctgcccgagaatactggaattgctgtacaatgcaagataaaaataaaagtcaagtgcagaagtgaagctgcaggatccacgatgtcggacacgatgtcctga

SEQ ID NO: 9428 - DNA, 459 bp, Glycine max
  Peptide Sequence Number=SeqID_101113
atgaggggttgtattaactataatcctgtccttatcataagacagcttggctaccccatgagaggagcgtcgtcggaggaaagcctcatgtctttcatcgcacggggtttcaatgaccccaacgtgagggtgcttcgaggaatccacaaggcatgggatgcattgcgaaggaaggacaaagagcttaggggaaacaacaatggaatcatcggcgtctatcataagtggctgagagtccgcgcacaaggtttgaattggctcccaaagctaagggctgcaagagaggaaaaggccaaagctccggaagagagcgagaaggagtatgatgaacagaaagacatcaacatggccactgccgaagccttggagcgagaaaccaagagggctcggaaggaagaactcgaccgaaacaagttccgaggagccttatggggtagcaacaacgagcttaaactctga

SEQ ID NO: 9429 - DNA, 198 bp, Glycine max
  Peptide Sequence Number=SeqID_101114
atggatgaatgcatgaagagatgcttatgtggtgcatggtataaatgtattttacggacacgagagcccggaaaaccgtctcttcttacttgcaacatttggcagcacagtgccccatggactaccagcaacatcatatcatcaaagagaaaaactctaaatgaggttccactgtcatcaagcaagtcagagacttag

SEQ ID NO: 9430 - DNA, 168 bp, Glycine max
  Peptide Sequence Number=SeqID_101115
atggaggatagggtcacgaccgatagatcgtcgtcccttcccggcgctggacaagcggaaaacgtcgctgcaaggcctatgttgtattctgaagcaatggggtatgccacattgcccccattctcttgctatttatgcctaaagatgcgcccaccaagtgctcggtga

SEQ ID NO: 9431 - DNA, 108 bp, Glycine max
  Peptide Sequence Number=SeqID_101116
atgaagatgctcttgataccacatgatgtaagctccattggagcttatgaatggcaacggaatggagaaggaagagagagaggagatgccatttcaaggagaagatga

SEQ ID NO: 9432 - DNA, 309 bp, Glycine max
  Peptide Sequence Number=SeqID_101117
atgtctcctttacctctaggatctcacaatcactcacaaactcatctcaagctctcaaacaggctcctgcttcgagctctggtctctgcaaatcttcacacagtgtcataccctaatttcgtccgggagtacttgtggtcggtccttgaaccttgtttgctcctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaa

SEQ ID NO: 9433 - DNA, 581 bp, Glycine max
  Peptide Sequence Number=SeqID_101118
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccg

SEQ ID NO: 9434 - DNA, 233 bp, Glycine max
  Peptide Sequence Number=SeqID_101119
ttttgggacttgagtgttttgtgagccaccttgatgttaccctaacatcaagtgttggacctgagtgtgtagagttgatctctattgttcagagagcaatctctgaggttgcatgggtagtgcccccagatgtaggtgacgttgcaccgaactggcgtgatgtcgtgacatccggtacgacatctgtcattggtatcagaatttcagaaggagataaactgtacaggctcaag

SEQ ID NO: 9435 - DNA, 183 bp, Glycine max
  Peptide Sequence Number=SeqID_101120
atgttgctggttgaggtccttgacactgctttcccgacctcaatgcaatggcactcacatttctgggattctggacagattgagaagattggtggaggaacgtatgggtctgcttgggccagcagcattctggaaataaggttggttgttgttgctgctgttgtgaaggactcgaccatctaa

SEQ ID NO: 9436 - DNA, 516 bp, Glycine max
  Peptide Sequence Number=SeqID_101121
atgcagattttcattgaagccatagatttaaacatctgggaagcaatagaaataggaccttacatacccactgtagtagatgtaagcactagcaccacaacacaaaaacctagagataagtggacagaagaagatataagaagaatccagtatgatcttaaagccaaaaacattattacttcaaccctaggaatagatgagtattttagagtgtcaaattgcacaaatgccaaagagatgtgggatactctccaacttacacatgaaggcaccactaatgaacatgaaatggaacttcaacgtcttaatcaaaatgaagaaaccgacaaaaagaaaagaagcatagcacttaaatcctcttcatcaatactagaagaaaatgaagaagatgaatcaggagatgaagaagacttctcactttttgtgaagaagtttcaaaaattcgtcaagaagaaaagaatcgagaggcgtcagaacttcaacaatggaagaaaatctcaagaagactctttgtag

SEQ ID NO: 9437 - DNA, 354 bp, Glycine max
  Peptide Sequence Number=SeqID_101122
atggcgtatttgatttgcctacctttagcccatctagatgtgatcttggggatggattggttatctactaaccatatctttctagactgcaaggagaagatgctagtgtttggtggggatgtagtcccaagtgaatctttgaaaggggatgcggccaacgaaggagcgggggatgttcgaacctacatgaattcccggaaaaaaagtggagaatggagaattgcactaggcaatcactacgagtggctccagacttattggtggaggatgtatgaacgacaatcaattcatggggcttcgaataaaagtggagaatggagatttgcactaggcaatcactacgcgtggctctag

SEQ ID NO: 9438 - DNA, 375 bp, Glycine max
  Peptide Sequence Number=SeqID_101123
atgatttttttaatcgaagcagtaaaatttgagctggatcagcttgctcaggcgagccaaatttcgcctgggcaagtgttgcaggctacaaatacgtctagcagcataaaagagccatttctttctccatcttttcccctaaaccctcccctaacaccctcaacctcctcctccatcaccactgaccaccacgagccgcctttgcttgctgtcagaccaccgcatggagaagaacaatttaatcagagcggaatcttcaaaactcaactcgaggattcggtagagaatagagcctccaatccttccttcgtggtttcttcgagagctctgcgtttgggacgaatggacggggaacctaagagatctaagaactaa

SEQ ID NO: 9439 - DNA, 666 bp, Glycine max
  Peptide Sequence Number=SeqID_101124
atgcccaccctgactcagatatggatgactttgctgctcagcaacatcctgcccacggatcataattccgacctccccctgccgaagtgtcagctggtgtacgccatcctgacgcggatgagcatccatggggctcagttaatcgctgatgccatctatatttttgcaggtatggcgcctaccaggcaccctttggatccagataagtccaacagggccctgggatttcccgcgctgatcacaagactctgccagtcgtttggagtccccgttgcacctaccaaggtgattcggccgcccatcacccgggcttttattgagaagtactgcatccagagacaggctcagggtgatgctccacaggccacaggcgcgccaccaccacctcatcaggctggcccggctgggtcatttgacattgagcagtatttacggcatttggttcgccagcaggcggccaaccaccgggcacatagccagggcttcgtttctttttcatgccctactccagaccagttcagggcagaggtcgcatggcccagggattggcccgaggcccaagcaggagaggcgcccccaaaggctcccggtgatggagaggaggcccacgaggacgaggagatggccgatttgcttgacttattgggagggagtggagctacatga

SEQ ID NO: 9440 - DNA, 300 bp, Glycine max
  misc_feature (21)..(21): n is a, c, g, or t
  Peptide Sequence Number=SeqID_101125
atgggggagaagcttgccacncaggtcgcccaggcgagcaaggacttagaggcagcagcaattccagaggaagaacctcaatcttctgagacatcttctagttttcctattgcagaacattctcatttagatcctagtgaagactacatcatggctgaagagccaagaagagttactctggaagattattcaagtaatagtcttaagacatgggatgaggttgtggagaaatttttgaagaaatatttccctgagtctaagactgcaaaaggcaaagctgccatctcttcttttcactaa

SEQ ID NO: 9441 - DNA, 665 bp, Glycine max
  Peptide Sequence Number=SeqID_101126
atgacgtctatagcccaagtctaacacttctagactttgggtttccggctctgatcaccgccttatgtagagccaaagggcttgtctctgacaacctgacttttgaacgcctgagcctgatcattaacttggcctactttaggaagaactgttggaatcccgaggatctaacagtttctatccaaagggctaagagggcgagggctaggccagctaagcttccttccacatctacagctcctactccagcatccacttcaacaggatctattccttcagttgagcagtttaaggagattgtagcccggcctgggactcaaccttctcttcacagggaagatgaaggtcccacatcccaggtaccacagcatgtggaggatgagtcatttgaggccaccattccagagccattcgttatagtggaggaggcaggtgagacacatgtgagacaggtagttgctaccactcctaagagatctcttgaggccacttcaaagcctcctgcaccagttgaggacctaccctcacctcagcatgcagcagacccctccactcctatcctagaggtacctgaggacctgaccacaccagtcctgactctggacacttctcctccagctactccagtacttcatctgaccgatgaggaggatgttcagacatag

SEQ ID NO: 9442 - DNA, 330 bp, Glycine max
  Peptide Sequence Number=SeqID_101127
gctggtccggccggatcatttaacacagagcagtatttgcggcatttggttcaccagcaggcggccaaccaccgggcacatgtacagactcatgattgtctttatcagttgagtctcagcctgcagagccagggctttacttctttttcgtgccctactccggaccagctcagggcagaggtcgcatggcctggagattggcctgaggcccaggcaggagaggcaccagcaggggcatcagcagaggctcccgacgaggcagatgaggcccgcgaggatgaagagatgaccgatttacttgatttcttaggagggagcggggccacatga

SEQ ID NO: 9443 - DNA, 263 bp, Glycine max
  Peptide Sequence Number=SeqID_101128
agcatgatggctcttgggtgaaaaagggtgcaaatcatgttggtgaagaaggacatgatggagaagattcatctcttctttcaaagattttggacaggttcgatggtcttcaaacctttgttggtgaaaggtttgatactttggagttacaagtggacatgcgcttcaatgagatggagtcaacaatcaccaaggtcgaagaagatgtctcttatattcgttcaagatttgatctaccaccatcgccgccaccatcattttag

SEQ ID NO: 9444 - DNA, 348 bp, Glycine max
  Peptide Sequence Number=SeqID_101129
atggggaattgcgatgaacgacccaaagttgcgctaagcccaattccaactgagaggaagtgcgctgagtgcccagaggactttgcctttgatgttttgatgatgccatatgatcgtgatgttttgatgccttatgaaaatgcacttctcaagtttaattcaagacaaaaatccaagaatacaagatacaacatcaagaagatctctagtgttttaggaagggaattccaaattgaaactgcaaaaggtttggccaagaaatttaagcaaaaatgtctttttcaaagagattcactctctggtaatcgattaccaaaggatgtagtcgattaccagtggccaaaatga

SEQ ID NO: 9445 - DNA, 399 bp, Glycine max
  Peptide Sequence Number=SeqID_101130
atgcataaggcattgcgattaaatgctcctttaccatatccacacttagtcactcttttccttcaacattttaacatccctcttgattctgaaccttatgttccaatcaagagatctttcttgatcggtgctgctgtggttgcgtcctttggttaccgcaaagagcgtgatggatcttgggttcgatggactccaacctatgttggtgaaaggattgtcatcatcaaaaagggggagattgtggaagcaatgacttccaaggttattttgatgatgccaaagaatcatgagctaagcaaattccacagattcaagaatcaagtttcaagaatcaagattcaagaattcaagattcaagaattcaagaatcaagtttcaagaatcaagattcaagaataa

SEQ ID NO: 9446 - DNA, 186 bp, Glycine max
  Peptide Sequence Number=SeqID_101131
atggaaaaagatctcaagaagactctcaaattcttagatgctacaaatgcaactaacttggtcacatcaaagcaaattgtccctcaaatgaggaaagtcctgagaagagtgataagaaaagagaaggagatcaaccttctaaccaaggactatgagagcgatgagaacatctttcaagaagattaa

SEQ ID NO: 9447 - DNA, 210 bp, Glycine max
  Peptide Sequence Number=SeqID_101132
atgggtaaagtagagaaggtgcaagagcagatgaaggccgacatggaggccatgaaagagaaaatggccacaatgatgaaggccataaagagcatgaagaagataatgaaaaccaatgcggttgcagttgccactaccagcactgttgctaaggtgaacccgatgcccctatctggcctcaaccaaatgaatcatccaacctcagatatg

SEQ ID NO: 9448 - DNA, 186 bp, Glycine max
  Peptide Sequence Number=SeqID_101133
atgtcaaatgaagaattgaagttgcaggatccacgatgtcggatacaatgtcctgacatcctgctcgagaatactggagttgttgtgcaatgcaagataaaagtcaagtgcagaaatttttcagaagaagatagatctcctccagcatcaaggagttgcagcccagaatcgtacacggctatataa

SEQ ID NO: 9449 - DNA, 1185 bp, Glycine max
  Peptide Sequence Number=SeqID_101134
atggtgctgggccatcttggcgtggcggtgacggtggtgggcattgccttcagcacccaatacagcgttgagcgtgacgtgcgcatgaaggccggcgacagcgtggatatccacaactatcactttattttccgcgacgtgcacaatctgcagggccctaactatagcggtggcgtggcgattatcgatgtcacacgcaacggtaagccagaagcggtgctgcatgcagagaagcgcttctataccgcagcgcgcaccatgatgacggaagcggcgatcagcggcggcttcacgcgcgatctctacgcggcgctgggcgaagagctggatgacggttcctgggcggtgcgtatttattacaaaccctttgtgcgctggatctggttcggcggcgtgtttatggcgctgacgcgcaacgccagcggtgacgatcctacgcgcctcgaatcggcgctgatcggtaaaccggtgccggtgtttaaactcgaagcgctggatcagccgggtaaaatctataaccagcaggtgctgaccgatggcaaaccgctgctgctgaacgtctgggccacctggtgcccgacctgccgcgccgagcatcaatatctcaacacgctggcggagcagggcattcgcgtggttggcctcaactacaaagacgaccgcagcaaagccgtcacctggcttaacacgctcggcaatccgtatgcgctgagcctgtatgacggcgacggcatgctcggtctggatctcggcgtctacggcgcgccggagaccttcctgattgatggccacggcattatccgctaccgccacgccggcgacatgaacgaccggggaggcgggcgtatgaaacagctgcttatgttgctcgcgggtctgctgctgagcaccagcctgtgggccgcgatcgatacttatcagttcgattcggtccagcaggaggagcagtatcgcgagctcaccgcatcgctgcgctgcccgaagtgccagaacaacagtattgccgactccaacgcgatgattgccgccgacatgcggctgaaagtgtatgagctgatgaagcagggccagagccgccagcagatcattgattacatggtggcgcgttatggcaacttcgtcacttatgaaccgccggtgacgccgtcgacgttgattctgtgggtcggaccggcactgtttgtg

SEQ ID NO: 9450 - DNA, 699 bp, Glycine max
  Peptide Sequence Number=SeqID_101135
atgggcccttcggtggctatctttgagaaccgcaaaagggaggaagttgaggcaccggaggaagacgaagaggtgcaggcccttaggacagaactcaagcaagctcaaacagtcaaagaaaggttcaaatcagcagctcttaaaatccgaaaggagaatgccgaactgagagatatgaatatagctaccaccaaagccttggaacaagaaaccaagagggctcgcagggaagagcacggccggaacaaattccgaggggctctgtggggtagcaatagcgagtttaagcttcggagagaggaaagggaccaatcacgactagacagtttgatcttgaaagatgagttgaaggtttgctcaaggtccaaaagaaacttgactcagcatttatgcgagacaaagaccaacatgttatccatcgtcagcaagtaccaagaagaattaaatctagccacgacccatgagaacaaagtggcagatgagtatgcccaagtgtacgcggaaaaggaggctagaggaagggtgatcgactcgttacatcaagaggcaacgatgtggatggaccggtttgctcttaccttgaatgggagtcaagcacttccccgattgctagccaaggccaaagcaatggcggacacctactccacccccgaggagatccacggacttctcagctattgtcagtatatgatagtctaa

SEQ ID NO: 9451 - DNA, 60 bp, Glycine max
  Peptide Sequence Number=SeqID_101136
atggtttcattgctttggttttcgccagttgccggtcagatagcaagatcgcttgaatga

SEQ ID NO: 9452 - DNA, 295 bp, Glycine max
  Peptide Sequence Number=SeqID_101137
atgataacaaaagatgatgacaatggtgatgacaaaaagctcaaagaatcaagattgaaagagatcaagattcaagactcaagattcaagaatcaagaaaaggcttcaagaatcaagaaaaagcttaatcaagataagtatgaaaaggggtacatctacttgggtttgactgagaacaagagagggtacatctcttgtggatcagttctagtggagggtacatccactaggttcaaagagaacaagggagggtacatcccttgtggatctttgcttgtaaaaggatttttacaag

SEQ ID NO: 9453 - DNA, 225 bp, Glycine max
  Peptide Sequence Number=SeqID_101138
atgacagaggactttgagtcctatgaaagcataaaggcgaggactttgagtcctatgaaagcgaggactttgagtcctatgaaggcgaggactttgagtcctatgaaggtgaggactttgagtcctatgaaggcaaggactttgagtcctctgaaggcgaggactgctgatcccgaggcaaaggccaccattggattcaaaggaatcctaaggagttttgcatga

SEQ ID NO: 9454 - DNA, 616 bp, Glycine max
  Peptide Sequence Number=SeqID_101139
tagagcatacatctacttgggctgtgatactgagaacaagagagggtacatctcttgtggatcagttcaagtggagcgtacatccacttggttgttcaaagagaacaagggagggtacatcccttgtggatctttgcttgtgaaggattttacaagggaatggaaactcaaggtaacttccatttctgaaagtaaagatctttcttctatgtctcttgccactctttttggcaaactacaggaacatgaaatggaacttcaacgtctcaaccaaaatgaagagaccgacaaaaggaaaagaaggatagcactcaaaacctcctcctcaatgcaagaagaagaagaagaagaagaatctgatgatgaagaggacttctcactctttgttccccaacacttaaatgctataagtgtaattgaccgtcacataaaggcacactgccccacaaatgcatcatggccagaaaagaatgagaagaaaagccatgaagaaaaaagatccaagaaggcgtatattgcttgggatgacaatgactcatccgatggttcaaagaaggagatcaaccttctatccaaggactatgaaagtgatgagaacatctctcaagaagattaa

SEQ ID NO: 9455 - DNA, 105 bp, Glycine max
  Peptide Sequence Number=SeqID_101140
atgtcttcatcagggaattctgggtgcataggttttgcaacctacccttcgacgggggtgcgaaaaaggcctcttcgagtgggccaagggtgtgtcttccattga

SEQ ID NO: 9456 - DNA, 1014 bp, Glycine max
  Peptide Sequence Number=SeqID_101141
atgcggatgaaatccctcaacatcgaaacaacatctgcacatgttgagcatgtggatcatgcaactgacgaggttcatgagcaatctcatgaggtagttactaatgatgcatgtgctgatgcccaaggttttccatgtggcagccactatttgcgtaggagagttgaagttgtcatctcatggaaggaaggagaggtcactatcaccctcgatgatgtgacatcgttgttacatctgcccattacaggcgcctttcatacctttgatgctcctcatgtagaccaagttgtggacctgttagttaagttgcttgaagtcagttcacaagaaacaagagatgagacatttcaatgccatggggcacattgttggatctacgagcttttccctactattgctttgtgtgtttctgatgaggattatcatgagaggaaaccaagtgtttgtcaatggaagtttgggaaggcattaccgggttcacctattgtgatactccgaccagagagggttgtacgacagcttggttatgcgcagcccattcctccacaccctattgccccatctttatctatagaggagattgataatagatggatgcagttctctgaataccttgcactggtaggtcagatttgtgttgctcctggacagtgtgcagcagactacatggagtggttttacatgatatctcaccccttcataagtccaacacggcctggggatcctcatagacatccacctgtggtgcacgatgatacatttattgaaccagatcctcctcatcagcttgttgccgcagcggctatgctagaaccacctgaaccttcacctgctgatgaggcttgccaacggataacagaaaggtcagaacacttgatcaacatgaggatggttactgctggaactgaagcatacaccgtgacagaggagtgcctgagaatcgccaggggtgtcactgagcaacaaaatgtttatgttcagtcgagacgaaggcggcgtacactagacacatga

SEQ ID NO: 9457 - DNA, 168 bp, Glycine max
  Peptide Sequence Number=SeqID_101142
atgaacgaacctatgaccaaggagaagaaggagcaggagtttgttcccaagctccttgggttgaaatttgaaacagaacaggatcaggagaagaagcagtggaggagatccaacaactcaaactgcctacgtttgtgctgctcccaccacgtgttgtcgtctctctga

SEQ ID NO: 9458 - DNA, 336 bp, Glycine max
  Peptide Sequence Number=SeqID_101143
atggagctaacaagaaacaagcatagaatcatggttaccttgaaagaaaacgaaagggttcctctcggtgtgggttttcaatggagaacaatgatgcaaaggctgaagtgcttaaataagaaatgctcttgggaacggaagcatcgagcacactccagatattgcgtcaaagatcccaacggtcatatcatggacaagtgtcgtgtgaaggtgcagaccaaatttggagaagatccaacggttaacaaaggctgggaagcgtttttaccgaggcagctttatgtagctttctctagaagcttcattaagagacttcctccagaagcttcctcatag

SEQ ID NO: 9459 - DNA, 228 bp, Glycine max
  Peptide Sequence Number=SeqID_101144
atggtgtacttcaaatgtacgagatggcctcgaggaaacttgcctcaaagagatccaggaaggataaagcggccgaaggaaccagttccgctcccgagtatgacagtcaccgttttaggagcgctgaacaccagtagcgcttcgaggccatcaagggatggtcaattctccgggagcgacgcgtccaactcagggaccatgagtataccgatttccaggaagagatag

SEQ ID NO: 9460 - DNA, 477 bp, Glycine max
  Peptide Sequence Number=SeqID_101145
atgaccactttagctcagacatggagtgttctttccacttggttgttcaaagagaacaagggaggggtacatcccttgtggatctttgcttgtaaaggcttttacaaggttgaaaagaaatctcaaggaccgcaggtcgcttggggactgaatgctactaagatctgtatcccagggaggggattcaagcaaaatgttgatgggcagccattgaagataccgaggaagaacatgaccactttagctcagacatggagtgttctttccttctctaacctgattcctacctcccatacatttgatgtgaccttggacaaagccaagttgatttatggcatcattatgaagatgaatatgaattttgggtacctcatctcccaccagatctctcttactgcacagcatgatacattcaaacttggattccctaccttgatcacacccctacgacggcgtgaagaaagaatcagattctag

SEQ ID NO: 9461 - DNA, 465 bp, Glycine max
  Peptide Sequence Number=SeqID_101146
atggctcttgggtcaaaaagggcgcttaacccgctgatgaagaaggcaacctaccagttgaagataattccactcttcttcgaaggcttatggacaagtttgatggacttcagacttttgttggtgacaagtttgatgccatggaattgcaagtcggcatgcggttcgatgccatggaatcaaggatcaccaaagttaaagaagatgtctccttcatccgtacttgctttgatccaccaccaccgcctccatcatcgtcttagcttaagtattgtgactaaggggagagaacttgagaggagaacttggggattgtcatcatcaaaaagggggagattgtggacaaaggatcaagctgaatgttttgatgatgccaaagtttcacatgtgtctcaaagtctcaaagctttattcaagacaaagaaattaaagatattcaagatggatgatcaagacagtctctag

SEQ ID NO: 9462 - DNA, 255 bp, Glycine max
  Peptide Sequence Number=SeqID_101147
atgggtgatcaatgttttaaaggctacttggacgtttcagcttttgaaggctcacttagcgagccaatcttgctaagcgagacgcgagaagggacaaatgactcgttgggcaagcttgcggcatgctgggcgcatacatctgtgactgatcctcttctagggtttcccaacatgctaagtgagctgcatgtctcgcttagcggatgtcactcgctaagcgcatatgcctcgcttagcgagacatcaactgcttga

SEQ ID NO: 9463 - DNA, 216 bp, Glycine max
  Peptide Sequence Number=SeqID_101148
atggttgagcttgagttgtcttttatagacttcagtgaagagatctgttacaggattagtgatgcaatcctccctaggaagggaccagtcaccagggccatgagcaggaggctcctagaggattgggctagagctgctgaagaaggccctaggcttctcatgaacctcaggctaagctctggcttctcaaggaagcttctcaaagaagcttcttaa

SEQ ID NO: 9464 - DNA, 406 bp, Glycine max
  Peptide Sequence Number=SeqID_101149
cctgagatctttgtctcaacacattggagggtacatcctttatggtacaagtagagggtacatctacttgggtttgactgagaacaagagagggtacatctcttgtggatcagttctagtggagggtacatccactaggttcaaagagaacaagggagggttattccaaaatcatgatgaagaccaagtcaacttgtgtctcatgacaaaatctgatgagaataacaaagaagattctgtaaggaagaaatggtacatcaacagtggatgttccaagcatatgacgggagatgtatccaaattcacaaccatttcccccaagaaaagtggacatggtacatacaatgacaacaatatcagtaaaatctcaaaagaggtaacatctaagccatcttctatgaattaa

SEQ ID NO: 9465 - DNA, 81 bp, Glycine max
  Peptide Sequence Number=SeqID_101150
atggtagaaatcaaccaagggatggaagcgaatggaggatgggatcgtgaccgaccaagcgtcaccccttctcggtgctaa

SEQ ID NO: 9466 - DNA, 159 bp, Glycine max
  Peptide Sequence Number=SeqID_101151
atgtctgcttacagtcatttcgctaagtgcgagcctcgcgctaagtgcatctttggtcatgcgctaagccacaaatctcaagcgcttagcgcccaacccttgcatctgaggctgatttggtccactaagctggccaaggatgaactaagccaactttaa

SEQ ID NO: 9467 - DNA, 157 bp, Glycine max
  Peptide Sequence Number=SeqID_101152
atggtgaccaacgtcaccggccttagtggcgtaacccacagtggccgggtgttcactcctcctcactcggcggaatttcccttcaaggggaaagcatccatgatccaagaacccgcagacacaaccacatcctcaaaagaagtggatcccccggctg

SEQ ID NO: 9468 - DNA, 330 bp, Glycine max
  Peptide Sequence Number=SeqID_101153
atggggaaaggaaaattagagctgagtgttgacaatcaaaatgttacttttgatttatttgacactatgaagcatctgagtgatcataaggcctattttaagatggataaggtggaacaagagattgatatggtagctaaagccatggttatgcaaactccacttgaaaaagtgctgaccaacacccttgagtgcttgactgcagaagaagaaaaagaagtgcagagttgcttaaaggaattagaaggtgagcaagagagtttccctgaaaggatgaaagttgaagagttaaagagagacagaccaccagagaagcaaaaatggaattga

SEQ ID NO: 9469 - DNA, 198 bp, Glycine max
  Peptide Sequence Number=SeqID_101154
atgggggagatgcttgccacccagctcgccaaggcgagcaaggtggcttcctccagaagcaaccgtcttctggagggcccaagtgggcctggtgttgagggaaggagcccagagtatgaagaacctcgggatttgaggtcaaatcctttccaaggtggagggaatgatgcaatcctatcccgcaagggcattgggtag

SEQ ID NO: 9470 - DNA, 782 bp, Glycine max
  Peptide Sequence Number=SeqID_101155
atggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacattgctcctcagcaacatcctgcccaccgatcataattccgacctccccatgcctaagtgccagctggtgtacgccatcctgacacggatgagcatccatgtggctcagttgatcgctgatgccatctatatttttgcaggtatgacgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaacccaccgagcacataccagttcaaggcagaggttgcatggcccggagattggcccgaggcccaagcaggagaagcacccccagaagctcccggcgatggagaagaagcccacgaggatgaggagatggctgatttgcttgacttcttgggagggagtggagacac

SEQ ID NO: 9471 - DNA, 297 bp, Glycine max
  Peptide Sequence Number=SeqID_101156
atggcggggcatggtgatcatgatggaggatggggaggtgcaagtgaggcagcaaagattgaagaagtaggacgatttccattgggaaatgttgacaatgataccaggaaaggagtggctaaaaggagttttaccaactttggttcttctagttggaaagacaaaagcaagaaagatggagctgctacttctagtagttccacacctaccccatcaaaaactcgttcaaagtcccaagaggaaccctctaaaaggagtagagatgtgaagtgtttcaaagtaccaaggcctaggaca

SEQ ID NO: 9472 - DNA, 318 bp, Glycine max
  Peptide Sequence Number=SeqID_101157
atgcaccgcaggccgcagacgcaccgccgccacctcatcaggctgatccagtcgggtcatttggcatggagcagtattaacagcacttggttcgccagcaagcggccaaccacagggggcaggtgcagatacatgagtgtctctaccagctcagcctcagttagcagagccagggtttcgctccttttgcgtgccctactccagatcagttcagggatgaggttgcatggcccggagattggcctgaggcccaggcaggggaggcgcccgcagaggctcccggcgatgcagaagaggcccgcattgacgaggagatga

SEQ ID NO: 9473 - DNA, 366 bp, Glycine max
  Peptide Sequence Number=SeqID_101158
cttggaggggttgatggggacccggtgctgagagcaacgaggataagggctacgtgggggtacgtgagctcagttgaagagttgattttcaccatcgcccgaccaccacctagtaccacatatgacagagtggtacctggagatatgtctccggggtcaggagaccttggggacgtcaggcgagctcctggcagtcaaccaataaaagaacaaagaccacaaagcaaggaggcttgtgtggtggctggccagctatggatcttgagtgatatctggaatatggcctctggtaatcgattaccaagggaagttgagatggcctctggtaatcgattaccaaggggtgtaatcaattacaaggcttag

SEQ ID NO: 9474 - DNA, 1386 bp, Glycine max
  Peptide Sequence Number=SeqID_101159
atgcacagcgcaagcgaggcgatgattcaggatgttggagaagcaagtgaaagagtgtgcaaggttatgatgacgtgtcctaccctcggacttgacactgctcttaatcaaaccggtgttagagtttcccctgatttagttgagaacgttctcaagaggttcgagaatgcgggcatgccagcatttcggttctttgagtgggcagagaagcagagaggttactcacatagcattagggcataccacttgatgattgaatctttggccaagattagacagtaccagatcgtgtgggaccttgttagtgcaatgaggaaaaagggtatgctaaatgttgaaactttttgcatcatgatgagaaagtatgctagggctaacaaggttgatgaggctgtttacacctttaatgttatggataagtatgacgtggttccgaatcttgctgcatttaatggtttgctgagtgctttgtgcaagtccaacaatgtaaggaaggctcaggagatttttgatgctatgaagggtcagtttgtgccggacgaaaaaagttacagcattttgcttgaggggtggggaaaggctcccaatcttccccgggctagggaggtttttagagagatggttgaggcggggtgcgaccctgatgtcgttacttatggtatcatggttgatgttctttgcaaagcggggagggttgatgaagctgttgaggttgtgaaggaaatggatgtgggcaattgcaggccaacgtcgttcatttatagtgtcttggttcatacttatggagtggagcaccggattgaagatgctattgatacgttccttgagatggcgaagaagggaatcaaggctgatgttgtggcatataatgccttgattggtgcattttgtaaagtaaataagtttaaaaatgtgcatagggtcttgaaggagatggagagcaatggtgtcgctcctaattcaaggacctgcaatgttattataagcagtatgattggccaaggacagactgatagagctttccgagtcttctgccggatgatcaagttgtgtgaaccggatgctgacacatatacaatgatgattaaaatgttctgtgagaaaaatgaactggagatggctctgaaaatatggaagtatatgaaatcaaaacagtttgttccaagcatgcacaccttttctgcccttatcaaggggttgtgtgaaaaggacaatgctgcaaaggcttgtgttgtgatggaagagatgatagagaagggaattcgaccatcacgtattacatttgggaggttaagacagttgcttataaaggaagggagagaggatgtgctcaaatttcttcacgagaaaatgaatcttctcgtcaaggagcctttatatgattaa

SEQ ID NO: 9475 - DNA, 1302 bp, Glycine max
  Peptide Sequence Number=SeqID_101160
atgaacaaaattttgaaaatttctcagctgactggaagagttgaagagaaaaggagatggtctgaggggattcaccaggctgtggaggcaaaggaaggtttgaagattcaggcagattctgttgtagtggcacagatcacataccagtcattattcaagctctatccaaagttgtcaggaatgactgggactgccaaaacagaagagaaagagttcttaaaaatgttccagatgccagtcattgaagtgcccacaaatcttcctaatattcgaaaagatttgcctattcaagcttttgctactgctcgtgggaaatgggagcaagttcgccgagaagttgaatatatgtttagacaaggtcgtcctgtcttagttggaacaactagtgtagaaaattcagaacttttgtctggtctgcttagggaatggaatattcctcataatgttctaaatgctagacccaagtatgcagcaaaagaagctgaaattgttgctcaagcaggacggaaacatgccattaccctctctacaaatatggcaggcaggggcacagatataatccttggcggaaatccaaaaatgcttgccagagaaattatagaggatagcttactttcatttttgacacgagaggatccaaatgttgaacttgcagatgaggctatttcacagaaggtgcttccaaaggtaaaggttggatcatcatcaatggccttactggctaagacaaccttaatggctaaatatgtatccaaaagtgagggtaaaagttggacatatcagaaggctaaatcttttatcttggaggctgttgaaatgagcctttcatatagtttggaggggctggagaagcttgctaatgaagaatctgagatctaccctcttggtccaactgtagcccttgcctatctgtcagttttgaaggattgtgaagaacactgtttgcatgaaggttctgaggtaaaaaggcttgggggtcttcatgtgattggtacatctttacatgagtcccggagaatagataaccagctacgtggcagagcaggaagacagggggatccaggatcaacacgatttatggtcagtttgcaggatgagatgtttcagaaattcaattttgatactgaatgggcagtgagacttatctcaaagattacaaatgacgaggatctgccaattgagggtgatgcaattgtaaagcagcttttggcactgcaaatcaatgcagaaaagttcttctttggcataagaaagaaccttgttgagtttgatgaagtattggagattgattcaactacgtaa

SEQ ID NO: 9476 - DNA, 1908 bp, Glycine max
  Peptide Sequence Number=SeqID_101161
atgggttcctccctcggcgacaacttcaaccttctctctcctcaacagcaagagctggttaaggtgctactggataacggccaagagcacctgtttcgcgattggccagctcccggcgtcgacgataaccacaagaaagctttctttgaccagttgactcggctcgattcgagttaccctggtggtctggaatcatacatcaaaaacgctaaacggctcttggctgattctaaggctggcagaaaccctttcgacggctttacaccttccgttccaacgggtgagactttggcatttggtgatgagagctacatcaaatttgaggaagcaggtgtacttgaagctcggaaagctgcgtttgttcttgttgccggtggtcttggcgagcgtttaggatacagtgggattaagatatatactcagttccagtatgtcaagggattaattcctgttcttaattgtagcttctgcctcttgcagcttgctcttcctgcagaaagcactactggaacatgttttgtacaacaatacattgaatctatattggctcttcaagaagccagctcacaaggtgaatcccagacacagattcctcttgttattatgacatctgatgacacccatggacgtactttagagttattagaatcaaattcttattttggtttgcaacccacgcaagtaacacttttaaagcaggaaaaagttgcatgcttagaagataacgatgccaggcttgcattggaaccacaaaacaagtacaaaattcagacaaaacctcatggacatggtgatgtgcatgcgcttcttttttcaagtggcattctgaaagtatggtatgaagctgggttgaaatgggttttattttttcaagatacaaatgggcttttattcaaggcaattccatcagcactgggcgtcagtgctgccaaacagtaccatgttaactctcttgcagtacctcggaaagcaaaagaagctattggtggaattaccagactcactcactctgatgacaatgatagttatgagggcaagatggactggtcagggaggtctatggtgataaatgtggaatacaatcagctagatcctcttctcagagcaagtggataccctaatggtgatgtaaattgtgagactggctactccccatttccaggaaatattaaccaattgattttagaacttggtccttacattgaagagctctcaaaaacaggaggtgccatacaggagtttgttaacccaaaatataaggatgccagcaaaacttcatttaagtcctcaactcgacttgaatgtatgatgcaagactatccaaaaacgttgcccctatctgccagggttgggttcacggtgatggaaacatggcttgcttatgcacccgtgaagaataatgctgaggatgctgctaaggtgccgaaaggaaatccataccatagtgcaacttctggagaaatggccatctatcgtgcaaatagcattattctcaaaaaggctggtgtccaagtagcagatccagtagtgcaggtcttcaatgggcaagaggttgaagtttggcctcgtatcacatggaagccaaaatggggtctgacttttaatcggatcaagggcaaagtcagtggaaattgctccatttccctaaggtctactctggctattaagggtccaaatatatttattgaaaatctgtccgtagatggggctctaatcattgacgctgtggatgatgcagaggtaaacgtgagtggctcagttcaaaacgatgggtggatccttgaaactattgactacaaagatgcctcggagcctgaggtgttgagaatcaggggttttaaatttaacaaaattgagcagctggaaacgaaatactccgagcctggcaaatttcacttgaaggcttga

SEQ ID NO: 9477 - DNA, 2922 bp, Glycine max
  Peptide Sequence Number=SeqID_101162
atggtctgtcattgcaagccatctcaagaaggaaagttgggctgtggggatgaatgtctaaatcggattcttaatattgaatgtgtgcaaggaacctgcccatgcggggaccgttgttccaaccagcagttccaaaaacacaagtatgctagcctgaagtggtttaaatgtgggaaaaagggttatggactgaaggcaattgagaatgtagctcaaggccagtttcttattgaatacgttggagaggtacttgatatgcaagcatacgaggcacggcaaagagagtatgctttgaagggtcatcggcatttctattttatgaccttgaatggcagtgaggtgatagatgcaagtgcaaaaggaaacttggggcgtttcattaatcatagttgtgatcctaattgtcggacagaaaagtggatggtgaatggggaaatctgtattggactgtttgcattgagggatattaagaaggtgtgccttcagccttcacttgctactttcatcaagtgtaagtgttattctgtgccaaaagctgaatttgtttatcaccaccctccccaggatgaagaattgaccttcgattacaactatgtgagggtttttggtgctgctgccaaaaaatgttattgtggttcacctaactgtcgaggttatataggtggtggtgatccacttaatgctgaactgatagttcaaagtgattcagaagaagaatttccagaacctgtcatgctcaccaaagatggtgaaattgaagattctgtacctacacccgagtattttaataatgttgatacacaatctgctaaacatatgttgaaagacagggatatattggacaattctacaactgctatagattcggatggttctctagagaaagagcgttctatgaaccctgcctctgctgtttctctgttgcacagctcagcagaaatggaggattcaaagggtaaattacaatcttctgttcaagttgaagaaatttctcaacaaatggaggatgtaacaagcaaacccatgcctgctgtacaccaaggatatgaaaaggaatcagaatttgcagacaaaacttcttccattcaaagattagacactacttctccccttacaactgtcagcaaaatgttaccgaattctgctggtagtaacagggagtcaaagtctgaaataattggaggcaggaagactcctaagttaaaaggttctgttaaaaagggaaaggttcatgctaatcctccaaatggccttaaaactgaggtgacagccaatcgattacaggtgccatcaataaaacacaaaaaagtagaaggttcttccaatggacggtttgaagcagttcaggagaaacttaatgagttgctggatggagatggtggaataagcaaaagaaaagatgccaccaaagggtacttgaagcttttgtttctcactgtggcatcaggagatagaattaatggtgaagcaattcaaagcaatcgagatctttccatgatccttgatgctcttctgaaaacaaaatctagagcagtgctgaatgatataattaacaaaaatggtttgcagatgttacataacattatgaagcagtacaggcatgacttcaaaaaaattccaatactacgaaagcttcttaaggtagtgtttggatacagaatttcagaattcttaaggaatttaaataaaatgcatgcaaaagaggtgcggaagaatgggagaggaacagatagaggtgcagaagggagagaggtcttggagttcctagaagcaggcaagattttgacatatgaacatattaatggtggtcctccttgtcgtggaatggagagctttagagagtcaatgctttctctgacagagcatgaagacaaacaggtccatcaaattgctcgaaacttccgagacagatggtttcccagacatgccagaaaacatggctatatggacagggatgataacagagtggaatctcacagaagtttcaagtgtaacagattttcagcatcacagagttataggcatgaacaggatttaaagactacagaagcaagtgattgtagtcagcagtcgatgcttgtgacaactccagtagatgctgaagcccgggaaggctttcctgtgcagtctctagatggggttgaaaccaaaacagctgaaaagcgtaagcgcaaaagccgatgggatcaaccagccgaaacaaactcgcattctgatgtcgttatgagctctattggtgaaagccagaacattcatgaggatgttccaccagggttttcgtgtccagtaggttcattaaatgcttccctaaactctggcaatcttgccttgcaaaatgcaagccgttctggatgtccctctgatataattattggtcatccaaaagagaaatttaactcttgcttggctgtctcatttggaatgccatggtctgttgcccagcaatatggaactcctcatgctgaatttccagagtgttgggtcactgcacctggcatgcctttcaacccatttcctccactacccccgtatccacgggacaacaaagattgtcaaccttctaatactaatgctatgataattgatcagcctgctgaagttgagcagggggataccagcggtatggttaattgtcgctctgatgatatgattcccagcacaactggtgttaaccctgaagactctaaccttctgtttgaggacaataaacacataagtaaacgattgaagggtgactcaaatgatttgggaacgaggtactttagacagcagaaaatacaccgaccatggttcaagaggaatgcatggaaatgtgatgagaacaactctagtggtgatatgtgcagtatagatgtaggagatgtaccaaaagagtcaaaagttacttgtgacgcggaggatgcaatctgtagagaggagtaa

SEQ ID NO: 9478 - DNA, 741 bp, Glycine max
  Peptide Sequence Number=SeqID_101163
atgttgaattcgtacaaggttgatgattcggggctgcgccagcactaccattcggagtttcgctctcctccgatttggttaggttccttgggaggcagagacaccaaggtggtggttgcagtagtgaaactgacgaatgaaaattcacgacgaccttattcaacttttgaggtcattgctgggtacttgtggcggtgtgtgagtaaagcacgctatgaaaaagggaaaagtgaccaacctacgaggttgtccgctttggttaattgtaggaaccgaatgagaccaccacttcctgatgggtatgcgggaagtgcagtattgcccacagtgacacccacatgttcctttgctgaaatcatgcaaaatccttcgagttatgctgttgggaacgttggagaggcaattgaaagggtgactggagagtttgtagagtcggcacttgatcacatagcaaaggagaaagacataaatttggtgaagtacaatatttattaccctgccccacctgtgcataagggacattacaaggggaacccgaacctttttgttgttagttggatgaatttttcgtttaagaatgcagattttggatgggggaagcctgtgtattttggccctggctacatgaattctgaagggaaaaggactttcctatttccaatatgtgatcgtaatggtggtgctaagatcttggctgagacatcttgctcgaacgctgatttctcaaatgaaacaaattga

SEQ ID NO: 9479 - DNA, 267 bp, Glycine max
  Peptide Sequence Number=SeqID_101164
atgagagggctggggttgtgttgcgaaggggtcgagtatgacataaacggggaagctgagccaaataaagagaaaattattgtccccgttagagtagagtcctttaacaaatccagggatcatgcaactgtgatccccgcaaagagaaagagtgttaagaaaatggtgtgtagttgttttatccaatgcttctctcaccagtgctccaaaaccaaaaccaaaaccaccaacaaggctgtctatggtacagccaattatggaaactaa

SEQ ID NO: 9480 - DNA, 582 bp, Glycine max
  Peptide Sequence Number=SeqID_101165
atgaagcagttgggaatgaaactgatagagctattggcaataagcttaggggtggatcggttgtgctataaggacttgtttgaagaaggttgctccatcatgagatgcaacaattacccatcttgccagcaaccgagccttacactggggacaggaccgcattgtgatccaacgtcgttaaccatacttcaccaagatcatgttggaggccttcatgtatttgcggacaacaggtggcaaacggttccacctcgccttgatgcatttgtaatcaacattggagacaccttcacggcattatcaaatgggagatacaaaagttgcctccatagggcagtggtaaacaagtacaaagagaggaagtccttggcgttctttctgtgccccaaagaagacaagttggtgagagccccagatgatattgtgagcatggatgggatcaaacactatcccgattttacatggtcagatttgcttcacttcacacaaaagcactacagagcagaccaagctacactgccaaacttcatcaagtggttgcaatcctccaaaaccacacaaactagccagcttttacgctaa

SEQ ID NO: 9481 - DNA, 1458 bp, Glycine max
  Peptide Sequence Number=SeqID_101166
atggaacagtcagcatttaccttattcctaaaatcatgttcaaaggtcaagagaaggagcatgcagaatcgtagattctgtagaaaacgaagaagctcgttgattggagaagttggtttaatggctaaagtttgttggccatattttgatcctgagtatgagaacttcagcaatagaatgaaccctccaagggtctctgtggacaatgctagttgccatgattgtacactgattaagattgatagtgttaacaaacctggaattctgctggaagttgtgcaaatcttgacagaccttgacttcgtaattaccaaagcttacatatcttctgatgggggttggtttatggatgtatttcatgtcacggaccagcaaggaaaaaagataacagatagcaaaaccatcgacctcattgaaaaggctctaggaccaaagagcaagagcacagaaggggtgaaaaattggccgagcaaacacgttggagtgcattctgttggtgattatacagccattgagctaattggcagagaccgcccaggtctcttgtctgagatttcggctgttcttgccaacctccattttaatgtttttgcagcagaagtttggactcataacaggcgaattgcttgcgttctttatgtcaatgatgcaacaaaccaagttgcggatgatccaaaaagattatctcttatggaggagcagctcaacaacatcttacgtggatgtgatggtgagaaagtagccaggaccagtttctccatgggttccacccatatggatcggcggcttcaccaaatgttgttcgctgatcgggattatgaaagttatgcagtagcaagagaagttgatagtcctccctctttaaggccaagaatcacaatagaacgttgtgaggaaaaagggtactcagtggtcagtgtcaagtgcaaagatagggcaaaactcatgtttgacattgtttgcactcttactgatatgcaatatgttgttttccatgccacagtatcatcagatggcccttatgcattgcaggagtattttattcgacatatggatggatgcacgcttgatacacaaggagagaaagaaagggtcatccaatgcattgaagctgctattcgaagaagagtaagcgagggtgtgagccttgagctgtgtgcaaaggatagagtggggttgctgtcagaagtaacaaggattctacgagagaatgggttgtcagtgtgtagggcaggtgtatcaacaagaggggagcaagcactgaatgtgttctacgtgagggatgcatcagggaaccctgtggacatgaaaactatggaagcactttgtaaagaaataggtaaaacaatgatggtggatgtcaagagagtgccaagcaataccaaagcacctgagactcgaggatgggctaaaactagtttcttctttggtaacttgttggaaaggttcttgacctaa

SEQ ID NO: 9482 - DNA, 108 bp, Glycine max
  Peptide Sequence Number=SeqID_101167
atgtatgcctacaactcatggaaaatgaacttaaaagtaaggaagagtcccttctgcacagcagtgcagcacagcagtgcagcacagcttcagaatgttgatggttaa

SEQ ID NO: 9483 - DNA, 1532 bp, Glycine max
  Peptide Sequence Number=SeqID_101168
atggaaattgaagttcctgttgtgattgtgggtgcaggccctgctggcctagcaaccgctgcatgccttaacaaatattccatccctaacgttgttttggaaagagatgattgccatgcatctctttggaggaaaagggcttatgaccgcttgaaacttcacttaggcaaagatttttgcaacctccctcacatgccatttccgcctgattttcccacctttgtccctagggttgactttttacgctacttggacaactatgtcacccgttttaaaatttccatccggtacaaccggaatgtggaatctgcttctatggatgaacaaaacaatgggaaatggagggttgttgtcaaggacacaacaacaaatgctgatgaggtttacgtggcaaactatctggtggttgcaactggggagaatagtgaagggtatgtgccccagattgaagggcttgaaggatttgaagggaaacacatgcattgcagcgagtacctgaatggaagagacttgtatggcaaacatgtccttgttgttggctgtggcaattctggcatggagatcgcttatgatctctcaaattggggtgcaaatacctctattgttgttagaggccctgttcattattttaccaaagaaatggtgtacgtgggaatgtccttgctgaaatacttcaaaatagagaaggtggacaagcttatgttgctcatgagcaaactgaagtatggagacatgtccaattacggcttgatcaggccaaaggatggacccttctttctgaagaaaaagggtggaactacccctaccatagatgtgggttgtgttagtaggattaagaaaggcgaagtgaaggttttcccagctatttcaagcattaaagaggacaagttgattgagtttgaggatggacaaaatggtcaatttgatgtcatcatctttgctactggatacaatagcactgtgctgaagtggcttaaggattacagagggctgttcaatgagaatggaatgccaaaaccagattttccaaatcactggaagggagagaatggtatctactgcgctggattttcaagaaggggattagatggcattgcttttgatgccaagcgtattgctgctgacataaaaaagacctcttctaacactgtcgtaacactcgctaatagccacaccacggtgagatacaccgaccctactaaatataatatcgctaagaccgataaaattgcaccaccaccatttcttacaccaattgaccttcttgaaggttacttctttgccggtgtagaaggaagcgacggtgtaaacgattgcggaggtggagaggagggagaagatgagaagggaaacgaagtaaaggagtttgaagagaaagaaagtggcccaatcggaagagaaggtgtcaaggagcttttggtgttggggtgtgccgggagatcggatacttggatgtggatgaggaagatgaaggagagaggaagaggtggaatgggtaaggatttagggacgagtgtctatgaagttccaag

SEQ ID NO: 9484 - DNA, 108 bp, Glycine max
  Peptide Sequence Number=SeqID_101169
atgggtgatgtgggcggtggtggcaagaaatacacatcgatattggatgagaaaatgaaagaaattagatcatactttatatggagagaaactggccggtggctataa

SEQ ID NO: 9485 - DNA, 603 bp, Glycine max
  Peptide Sequence Number=SeqID_101170
atgaaaccgagagcagacatgcacttccctctgccacagcatgtggcagacataacgtgcatggacccgaaccggccaccgctcgtggcggaaaaggtcttcaaaacggtgcgtttcataggcttcttcatacaaaacggcgtttcgaagagcaaggtggtggttcatgatatgcaggacgtgatgaagcgtgggaagaacatagggaaggcgctcaacgacgtcgtggctcgccaccaccaggcgctgacgtgtcgcccacgcgacgcgcacgtggccttcgtgtcgccgctggagtaccagttcagctgcagcgggagtccaccgcgcctttcttcgcatgccggtcggaggaatctctcacaggcctcccccgccgttcgccgctcgccagcgcaccgcgcggtgaggatgtgccgtggtggagacggcggcgccgacggcactatacacaggcgcgtgaagatcacgggctccgcggcttccatgttcaacgtcgaccgcgcggagaaggattttcacgtggacgaggcggcggaggagttcatagcgaggttttacagagatttgaggttgcagaaatggttggatcactattgctga

SEQ ID NO: 9486 - DNA, 1458 bp, Glycine max
  Peptide Sequence Number=SeqID_101171
atgagcgtttcacatttcgcggttctatcgtcgtgttgttgtccacgcttggccccttctctgtcgcgtgcttcaacccttcgttctcgcatccggtgttgtactactctcactgctacttcttcagagactcccactccaaccttcgtgaagaaacgagtagtgtcgggggttcagcccacgggctcaattcacctcggaaactattttggcgccatcaagaattgggttgcccttcagaatgtgtatgatacacttttcttcattgtggacctgcacgcggtcagagatgtacaggctatgaagcatggacactggaaatcacatggacacagacaatataacactgtcccaattacattaccatatgacacccaacaattatctaaggctacaaggtcaactgctgctatttacctagcatgtggagtggatccttcaaaggcttcagtatttgtacagtctcatgttcgggcacatgtagaattgatgtggctgctaagttccacaacaccaattggttggctgaacaaaatgatacaatttaaagagaaatctcgcaaggcgggagatgaagaagttggggttgcccttttgacttatcctgttctgatggcttctgatatacttctatatcagtctgattttgtccctgttggtgaagatcaaaagcagcacttggagttgactcgtgacttggctgaacgggttccagagccccttatacctccagccggagcccggataatgtccctaactgatggcctgtccaagatgtcaaagtctgcaccttctgatcaatccagaatcaatattcttgatcctaaagatttgaaagaaactttagaggttaaccagtacagtgacttgagatgcaaaggactgaggcagtatgctggctatgatgattggtggggttgtgcttggctcagtggagatgtgctcatagcaaacaagatcaaacgttgcaaaactgattcatttcctgggttagtacttgtaatattaccatatgatgatcttagtcctcagagttctcaaattacttgtgcactttatgacaattcgtacagcttggaatttgacaactctgagaggcctgaatgtaacaatcttgtttccatataccagcttatttcaggaaagacgaaagaggaagttgtgcaggaatgccaaaacatgaactggggcacattcaaacctcttttaacagatgccttgattgatcatttgcatcccattcaggttcgctatgaggaaatcatgtccgattcaggttatttagatggagttttagcacaaggtgctagaaatgcagcagatatagcagattctacacttaataatatttaccaagcaatgggattttttaagagacataatcttatggacatatacttgactactggaaatggaaagattattgatgcaaagcctaaaggtcccattagttcttga

SEQ ID NO: 9487 - DNA, 1066 bp, Glycine max
  Peptide Sequence Number=SeqID_101172
gcccgttttcattagaaccgacaaaccggttactgttgcagggaacgtgttcaccgctagcattcacatagtaacggtggtggtgggtgcaggagtgctggctctagcatgggccatggcccagcttggatggatacctggcttagccactatgatcatctttgcatgcatttccatttatacttacaatcttgtagctgattgctatagataccctgacccaatcaatggcaagaggaactacacttacatgcaagctgtcgatgcataccttggtaaaggagaaacaacccgtgtatttggaaacaaagtagggccaggactatctgaagcagataaaatgtggagggttttcagtgctttgggaaacattgcacttgcttgctcttatgctactgttgtgtatgatataatggacacgttgaagtcatatccaccagaatgcaagcagatgaaaaaggccaatgtgttaggaatcacaacaatgacaatacttttcctgctatgtggtagccttggctatgctgctttcggagatgacaccccgggaaacatcctcactggctttggattttacgagccattctggttggttgcccttgggaatgtgtgcattgtaatccacatgattggagcatatcaggtgcttgcccaaccactatttcgtataattgagatgggtgcaaacatggcatggccaggttcagatttcataaacaaggaatacccaaccaaaataggctccctaacattcagtttcaacttgtttaggctaatttggaggacaatatacgtggcagtggtcacaatcattgccatggtgatgccgtttttcaacgagtttcttgccctgcttggagcaattgggttttggcctctcatcgtctttttccctatacaaatgcacattgctcagaaacagatcaaaagattatcatttaaatggtgtctgctccagctattgagctttgtgtgcttccttgtttcggtagtcgccgcagttggttccattcgtggaattagcaagaatatcaaaaaatacaaacttttcatgtataaacaatag

SEQ ID NO: 9488 - DNA, 2187 bp, Glycine max
  Peptide Sequence Number=SeqID_101173
atggcggtttccgacagtcccagcggcggctccacgccacctcatcaggaacaacaagccaacagcaagtacggtttcaccaagcccctctctctcgcgggtcccaccgacgctgatctccagcgtaacaacgatttggacaagttcttgctcgattcgggtctctacgagagcaatgaagaatccgctgcgaggaaagaggttcttcaccgccttgatcagattgtgaaaagctgggtgaagcagttgacgcgccaacgtggctacacagatcagatggtagaggatgcaaatgctgtcatttttacttttggctcttaccgactaggggttcatggacctggagttgacatagacactttgtgcattggtccttcttatgtaaaccgagaggaagatttcttcatcattttgcataacatcctggccgaaatggaagaagtttctgaacttcaaccagttcctgatgcacatgttccagtaatgaaattcaaattccagggaatatctatagatttgctgtatgcaagtatatcacttttggttgtgccagaagacctagatatctcgcatggttcagtgctgtatgatgttgatgaaccaactgttcgaagtcttaatggctgccgtgtggcagatcaaattcttaaacttgttccaaatgttgaggttactggattccttggtggtgtaaattgggctattttagttgctcgaatttgccagctctaccccaatgcaatccctagtatgttggtttctcgattcttcagggtctatacacagtggcggtggccaaaccctgtaatgctatgctctatagaagagaatgaactgggattccctatatgggatcctcgtagaaacccccgggacagatttcacactatgccaataattactcctgcatacccttgcatgaattcaagctacaacgtttcggcaagtactcttcgtgttatggtggaccaattctgctatggcaataagatttgtgatgaaattgagcttaataaagcccagtggagcgcactttttcagccttatattttttttgaggcatacaaaaactatttacaagtggacataattgcatcagacacggatgatttactagcatggaggggatgggtagaatctcggttgagaatgcttaccctgaagatagagcgagatacaaatgggatgctgcagtgccatccttacccacatgagtatgtagacacatccaagccatgtgcacattctgcatttttcatgggcttgcaaaggaaagagggagtaagaggtcaagaggggcagcaatttgatatacgtggaacagttgatgaattcagacaagaaataaatatgtacatgtactggaagccagggatggatatttttgtttctcatgttcgtcgaaagcaactccctgcatttgtttttcctgatggttacaaacgcactcgaatgccaaggcatataagccatcaagctgaaataacaggtgatgatgccacaaactgctactctgggcctggattgtctgaaagatgcatcaagaggaaaaattactctgaaatggtggataagaagccagacaaaccagataagcgggcatctataagcccacaaaggttagaatgtgtttctcctgaaagttgtactggtaaatcaggtggtacagctcaaatgagtattgagtgtattaaaggggttaggttagctggttcaacaaccaaggatgctaacagcaattgtaaaattaagtcatctgatgcactccctggaagtggactaagaactgaggtagctgacatgcagattagtgaagcaggctttgttaacactacacatgatatgttgaaatcaaggagtgttgaagttccaaatgagaatgaagttgtcaatggggacaaagctcaggatctggctttagattgcttggaaagtgcagaaactgaatctactaacagcctgtcaaactatgaagagggtgatattgatatggatcagcgactagacaaagcatgtaatttcatcacaagggctgaatgttcagattatgtaccaaatgccagctcccagaacctcaattgcgaggaactgttgtggatggcagtgaaaaaactggaagtctgggagatagtgagtcagggatctttgcagggtgatgtttgtgtggctgatccagatcagttctga

SEQ ID NO: 9489 - DNA, 90 bp, Glycine max
  Peptide Sequence Number=SeqID_101174
atggggaaaaaacgaaggcaatacgctggcaatgctaacatttttggtaaaaacataaaaggtctccctaagcttattgtgtttggatga

SEQ ID NO: 9490 - DNA, 144 bp, Glycine max
  Peptide Sequence Number=SeqID_101175
atgccgtcatcatcaacaacgtgtaacaacggccactcgagcagcaattgtgacatgaatactctcaatggagcactttcaaagggcttggagaaaactacctctcatggcgggacttcagaaatgcttagtaacattagctaa

SEQ ID NO: 9491 - DNA, 5880 bp, Glycine max
  Peptide Sequence Number=SeqID_101176
atgtgcgacttcaaggcggaggatgaagggagtagtcttcgtgggaaagagatgtcgcaagtggattggggaagaatctacggcgaggaatttcatctttctcaaacttatcacgaagggcttctcaagttacaaacaaaagagtatgagatggctcgtgagctcttagaatctgtccttaaagatcctcttattgctaatgctcaggtggatagcagtgccagtgatggtcatctattgcaactcagacgtttctacagatttttggcattgaaaaaccttgccactgtttttctccagcaagactctacacattatgagaatgctctacgctgttaccttcaagctgtggagattgattctaaagattctgttgtctggaaccggctgggaacactgtcatgctcaatgggctcactgagtatttcacgttgggcatttgagcaaggcctcttgtgtagccctaataactggaattgcatggagaagcttttggaagttcttattgcaattggtgatgaggttgcttgcctttctgtcgctaaattgattttgaggcactggccatcacattctcgtgctttgcatgttagaaataccatcgaagaatcagaacctttgccatttgctccaagaggcatagacaaattggaacctcaacatgtgcggctcaaatttcctgacaagaggaaagctactaatgagaatgtagatgaggatgttgcattcaaaaagctgaaccagaataaagcactgcacctgacagaagtttcctgggtggctcttgccgacgcacttctggaaatcttatcaccacaaagttccgagatggatcctcaaaaagcattcagttctcctgatattaggctaagcataatcttacctaatagctcagaagctgttatggacactgtggaaatgaaagggtccaatggtgaaaatagtgtttctggtgatggtaacatacaacaattaagtgcttttaaagagaaagaagcaaatatccaagaagaacaactgcatgaaaggcgaagttctcgacttgaaaggctccggagtcgtaaaccagggaaagaggaatccaattcttcttgtggaaaggaccctaccaaggttgtcattcaatatctagagccatttatttctggtggattggggggtcaagatacaattgatagagataggacgacagtatcctgtttaggaaattctgaatattataatgtttctgcatttttaagagaaacttcaaacaattatggtgcttatcatatggggcacttgcttttagaagaagtcacaagacaaggtctcacatatcaggatgcttttgtcaaatttttggagttggaaaagttgacaaggcattggggaaaggagagaactgccgaatgtaatatttttcttgctgaactgtattatgactttggatcatgctcctccactggttctcaacaattagaatttatttctgagacgtcttatcatctttgtaagatcattgaatctgtagctttagattatccttttcacttgactcatgccttgaatgaaaattgtttttcgatagatagtatccaagagaccagtggaaaaacaataaatacctccactgagagcaattcaaatttagacatctcacttctgatgaaaaacagtcccctttggtctcgattcttctggctaagtgggagactgtctattgttgatggcaacagggcaaaagcatgtgaagaatattgtatcgctttgacacttttggcgaagagagaaaatgaagattctctatgttcagtcccccgcccacattgcaaggttgtaaaagagctaaactttgatagagttcttgatgaaattaatatattaaaggtcaatttcttgatggaaaagtctgtcattaagatgatggaacaagaaaagtttttggagtgtgtatccctgctttctccacttctattctccacacaggatgtctaccccaattcattctctttatccaagacagataaaagtgatgaaaagataacttccactgaactcatggctgtagatgttctaatggaagcatgtcaaaaggcgaatccaatggatgtagagatgtatttcaattgtcattatagaaagctgaaaatactaatgacaaagatgggtttaaatacatgtattacatcatttaaatcttctgatcaagcacctattttaagtgcgtctcctaattttgatattgattcaaaggaaagttctagcaagaactgtagtcacttggttgcggatgaagtgaaggcactctctgactgtatctcacaagtgaagaaaattatcgatcaacgtggagattctgatggcctttttgttccaacaagaagcatttgtcaaatgcaatctctgctgttgttaatcatgagccatgttgccaacatacttgccctcaacaaagcctcagcacaagtaatttctgatcaagctgaaagcagctgtttcgttgatgcagccattgttttctgcaaactccagcatctttgcccaacaacgcctatcaaaactcaagttgatttaattgttgcaacacatgacttgcttgctgaatatggcctttgctgtttgggtgaaggtggcaaaggtgaagaaggaacatttcttagatttgcaataaaacatctcttggccttggatacgaagcttaaatccagctttaaccataaagaatcaatgcaatgtgaggaagtgtccaaaaacagtcttgtcaatgtgtctgttgaagaatcaaaatcagacacattagacatccagatggattgcaccaaaattgatgaaattaattcagagaaaaaggatgtttatgaaggaataatatccaaaggcatttcatcttgcagagttcatgataaagactgtaaggaagtagagtgtgaaaatcatggaggtgctggcactggcagtaagttaattaagggtgaaagttcaatcaatcaattgattgaatgtgaagatgaactttctgaagatgaatgggaggaacttgagtctaaaattgactgtgccttagatcagtgctttttctgtttatatggattacatctaagatctgattcatcttatgaggatgatctagtggtgcacaaaaacacaagccgaggagattatcaaaccaaggaacaatgtgctgatgttttcaagtatgttcttccctatgcaaaggcatcttctaggactggactggtcaaacttcgtagagttttaagagctattaggaagcactttctgcagccaccagaggacctcttggcaggaaaccctattgataagttcctagatgatcctaatctatgtgaagataagctctcagaggaggctgggtctgatgggtttcttgaatctattactaagagaatgtttcctgatgtgggtggccttgctcagtataatgcaacattattgaggaggtctgagccatatttggaggtctactgtaacttgtattatttcttggctctgtctgaggaaatgagcgcaacagataagtggcctggatttgtgctgaccaaggaaggggaagaatttgttgaacaaaatgcaaagctcttcaaatatgatctcatgtacaatcctctgcgctttgaaagctggcagagacttggaaatatttatgatgaggaagtagatttgttactaaatgatggtagcaagcacgttaatgtagtagggtggaggaagaatgctactttatccgagagagtggaaacaagccgaaggaggagtagaaggtgtctactaatgagtttagctttggcaaagacatctgctcagcagtgtgagatacatgagttattggcattggtatactacgacagtcttcaaaatgtagtcccattttatgatcagagatctgctttgcccttaaaggatgcggcatggatgatgttttgtgagaactcaatgaaacattttaagaaagccttcacacttaagcaagattggttgcatgccttttacttgggtaaactcagcgaaaaacttggatattcacacgaaattgcattatcatattacaataaagctattgcttggaacacatcagctgttgatcctgtctacaggatgcatgcctcacgtttgaaattattatttaagtgtggaaaacagaatttggagattttgaaggttctctcagcaaattcctttaatcaatctgtaaaagaagctgtcacaagtatccttattggtattgatagctcatttttaaatacaaaggaaagatgtattgatgccaattttgtggaaacaaagcatgaagagttgctcaaattggatacagtatggtctatgcttttcaatgattgcctttctgctcttgaaacatgcgtagagggggatctcaaacatttccataaggccagatacatgctggctcaaggactgtacaaaagaggtgagagtggtgatatagagagggcaaaagatcatctatctttctgcttcaaatcttcacgctcatcatttacaataaatatgtgggaaattgatagcacggtaaaaaaaggaaggcgcaagacaccaggtactgctgggaacaaaaaatcccttgaggttaacttaccagaaagttctcgaaaatttattacgtgcattcggaagtatttgctgttttatctcaaactattggaagagactggagatagatgtattcttgaacgttcgtatgttgctcttcgtgcagataaacggttttcattatgtattgaagatcttatacccgtggctattggaaggtatctaaaggccctgattgcaactatgtgccattatcagactactgcctctggttcagtgagcagttctgacaatgtgctggagagaatgtttgcattgttcatggagcaagggagcttatggccagaaatatgcagcttgcctgaaattgaaggctcagatatgtcagagagtatcatatatggatatcttcatgaacatattgtattattggagaaaaatggaaaactggaaactcttgaagcaataaatgagaagattcggaagcgttctaagaacccaaagttctcagacagtaattatgccaaagttcgcaagcatgcttctgttgcttggtgtcgatctcttgtatacaatttggcacaaataactccattatcttgtgaattctcaaatgggattcaggtccttaatttgactgatggtgggatggataatagccagttgctctgtattgatttgcagccaaatgagttatggagtacagcttttgaagatccaactcatttagaaaagattgaaacaaaatggagcactattttatcaaaagtaaaagatattattatcaagaaagcttctgatgagaatttggaaactgcaaacactttgctcagagcttgctataatttttaccgggagagttcttctgtagtgcttacctctggactcaacttttatttgattccatctcaattagtaacacagacgccattcaacccaagtactgctggaattgaagcacttgatctgagcataccaaggaagcttctcttgtgggcctatgtgctatcccatggacgttgtgcaaatatctcaattgttgtaaagcattgtgaagaaatgtcgaagtcaaagatgaaaagaggaagtggaatgtcacctgcgttatcaaacacatctcctgcccctagttttccaggtagcggtagaaacggatcaaattctgccggaagcattgacgttgattctgcacatgccacaacagtggggtcggtttcacttgacattcagaaaaatctctttgcttctccccagttgcatcaatgcactagtaacgatgcagaacgaagcaatttgatagcacatgaaggagatccagagggagattga

SEQ ID NO: 9492 - DNA, 1134 bp, Glycine max
  Peptide Sequence Number=SeqID_101177
atgcccgaattatctcttcctcaggattcttactttctcggattcgacagttccacccaatcgttaaaggccacagtgttggactccaacctcaacatcgtagcctcagagcttgttcgtttcgattccgacttgccccattacaaaaccaaagatggggtatacagagacccttctggcaatggcagaatcgtttcacccactttgatgtggctggaagctcttgacctaatgcttcaaaagctttcaaaaccaaattttgattttgccaagtgtgtattggatcctaagaggccattgttggatcagcttgaaaatgctttttccattaaggaatccccaatttggatggattctagcaccactgctgagtgtagggctatagagaaggcttttgggggagccttggagttggttcatgtcacgggatctcatgcatatgagaggtttactggcccacagattaagaagatatttgatactcggccagaaatttatagcagcactgaaaggatctcgcttgttagttccttcatggcgcgtctcttctcgttggcgcttatgctgccattgatcattctgatggcaactgcccctggtttggagtcaaaacttggagagttagcccctgcttatgctgtagctggaaatattgctccatattttgtagagaggtatcactttaacaaggattgcttagttgttcaatggtcaggagacaatcccaatagtgtggcaggtttgaccctaaatattccaggagatcttgccatcagcctcggcaccagtgacactgtatttatgatcactaaagatcctaatccaggattagagggacatgtcttccctaatcaggttgatgcagaaggttacatggtaatgttggtatacaaaaatgggtcccttacccgagaaggtactgttgttgtgaatctgtctgatgtgcgcaactgctatgcagacaaatcttgggatgttttcaataaatttctgcagcaaacacaacctttaaatgttggtttccaccgctatattatagaaaatttctcaggcactcctgatggactgaaggaaaaagaagtggaggagtttgatcctgcatctgagattagaaatcacatgggaattccttga

SEQ ID NO: 9493 - DNA, 1329 bp, Glycine max
  Peptide Sequence Number=SeqID_101178
atgcctcatcattacataaacagtaagagtgaagagtcttcccatcgcggtgtacacagacgagtttccagtttgtggaagttacctgatgatcctcttcagacagcgactacacgtgctgaacttcatcgaaggagcattgaacaaatgcggattaacaaccgctcagttcaagacatgcagatatttggagatctcttgcatactccaattgtgattgttgaacatgtgatgaatgtaccccgtcattgtccaagtgcaaattcattactgaaacatattgggagtatagattcagatggcttaccaattggcctcagctctgatactataggcaagaaatttgcaccacaaagtaatgctcgtgtgttgaagattgttgtctttgtgcatgggtttcaggcatgtctcgggcatcatctagatctacgacttgtccggaatcaatggcttttgatagatcccaaagtagattttctgatgtcagaggctaatgaagataaaacatttggagacttcagagagatgggacataggctagctaaggaagttattgcttttcttaaaagcaaaatggacaaagcatcaagatatgggagtctgggagatattaggctaagttttgttggacattctattggtaatctcattataagaacagcgatagcagatagcataatggagccatttctatgtcacctatatacatatgtttcagtatctggtccacacttagggtatctttatagttcaaactcgttgtttaattctggattgtggtttctgaagaagctaaaaggcacacagtgcattcatcaactcactttcacagatgatccagatttccaaaatacatttctctataaactgtgtaagcctatcctaacaattgttgttggtcctattatgccacccgctagtaggccattatcaaaccatctgcaaatgtctagtcttgcaaacttcatgttcgagatgttcagtcatcagcaagaggatggttatgtgccttaccattctgctagaattgaatcatgccaggctgcttcacgtgacacttcaaagaagggtaagctgttcctagagatgttgaatgcttgtttggaccaaatccgcgccaactccatgcaacgtggagtcttcatgcgctgtgatgtcaactttgatgcatctacccaaggcaagaatctggactctataataggtcgggctgcacatattgaatttctggattctgacattttcgcaaggcataacctctcacccttcagagatcaagagtgctcagatttctgtgacaggatgttcaaagaaaaggttaacacttag

SEQ ID NO: 9494 - DNA, 204 bp, Glycine max
  Peptide Sequence Number=SeqID_101179
atgatgatgagtatgatggtagtgaagagggtgatgaaggggtggttcattttgagagagaaagaagggtgtggttgtgctgaatgtgaaaaaggttgcaaggaaggagaagggttggatcacttggggggaagcgaagcagtgacaagccttgatgatgaaaaacaggttcttgctgtcaagtactattgctgggagaagtga

SEQ ID NO: 9495 - DNA, 807 bp, Glycine max
  Peptide Sequence Number=SeqID_101180
atggccgctcctaccagggaccaagtcctctctctcctcgccgcggccaacaaccacggtgacctcgccgttaaaacctcatcgttaaaacaagccaaagaccttcttctctccatcgacccctccctcgctgccgacctcttcccttacttgctcgagcttcagtcttctcccgaaagcctcgttcgcaaattgctcattcagataattgaggagattggttttaaagcagctgagcaatctcctacgctgatatctgtactattaacgtttttacgggacaacgatgaaattgttgtaaaacagtctattgttagtggcacaaatatcttctgtagtatttttgaggagttgattgtgcagtttcaacaatatggtaaagttgagaggtggctagaagatatttgggtgtggatgcttaagttcaaggatgccgtttttgggattgctctggagtcatctgctgagattttaggttgcgcaccactgataatgcgtataactaatcaagttctaagtttctatcaatccacgcctggttctgttggaataaagttgctggcactgaaattcttggaaatgtttgtattactcttttcatctgacttcaatgatgctgagaaattagccgcaaaaggaattaggcaagctgttaatgtctcatggttggttggtcaccctcaccctgttcttgatccagtggtgctcatgtcagatgcaaataggactattggcattctattaaatttattgcagtctgttggcagtcttcctggttgcttgactattgcagttgtaaattggtga

SEQ ID NO: 9496 - DNA, 288 bp, Glycine max
  Peptide Sequence Number=SeqID_101181
atggatgacgttctaggaagtttcttagaaagcatgacaatcattgattttgagagcagtcaagcaatgttaaagatggttgtcgatgtctcggaaaggactagcttcggagggttagtggaggggtcaaagatacagcaggaaggaagaggaaacaagcagttctttgtgttggattcgtcggaggaagaagaggacaacgatgataaacaatttccagatccacatctacaaaaccctccacattatcctctcgccgctaactctgtcgtcgttagcaacacctag

SEQ ID NO: 9497 - DNA, 69 bp, Glycine max
  Peptide Sequence Number=SeqID_101182
atgtgtcatgtgtcacaacacaactcagaaggtggtgtgcatgggggcagcgtagagcaggcgttataa

SEQ ID NO: 9498 - DNA, 996 bp, Glycine max
  Peptide Sequence Number=SeqID_101183
atggagttctatgaccaagatttcttggaggaattaatgacactaagaagagaaacatgggacaccaatccaagcacagaagaaaatcagttcttctctaatgcttggagttttgactgttttgatcaaaactctctaccttacctcccaaactcttcttgtggtcaagaagttcctcaaagttacaataacgactaccccttcagtgaaatctatggctccttacttgatgaatcctcaccacagattatggattcatactatggcacccttgatataactccactcaatacccctccatttcttggtcaagaggattatccattgtccatgatggaagaagaggacccgggttttcttggggaagagcttaagaatttggagttgcaaaccacatgcaaagtggagaaaacacaatcctccgaaatgccggctttcaacatgggaacgggtctggaaagaaagaacaaccgatcaaagaagcttcaggggcaaccctccaagaatctaatggcggagaggagaagaagaaagagattgaacgaccggctctcaatgctaagagcaattgtccccaagattagtaagatggatagaacatcaatacttggagacactattgattacatgaaagaacttctggagaagatcaacaatctgcaacaagtagaagtagattcaagcatggctggcatttttaaagatgtaaagccaaatgaaatcatagtgagaaattcacccaagtttgaggtagagaggagtgtggacacccgggtggaaatttgctgtgcagggaaaccagggttgttactatccacagtaaacaccgtggaagcattaggcctagagattcaacaatgtgttattagctgtttcaatgatttcacaatgcaggcttcttgctcagaggaattggagcaaagggcaatgctgagttctgaagatataaagcaagcattgtttagaagtgcaggatatggaggaagatgtttgtga

SEQ ID NO: 9499 - DNA, 276 bp, Glycine max
  Peptide Sequence Number=SeqID_101184
atggaacgtgatattttagatatccatagagaggaaaattgtcctaaaaggatgatcacctgtgagttctgtgagtttcctttgccggctattgatctggctgagcatcaggaagtatgtgggaatcgaacagaactttgtcacctttgtaacaaatatgttagactgcgtgaactatacaaccatgaagatagttgcaatacaattcaagacaattctgcagggtcttcaaggtatgaaatgtcatcatttgattgtagtatgtgtttgaattag

SEQ ID NO: 9500 - DNA, 258 bp, Glycine max
  Peptide Sequence Number=SeqID_101185
atggatacccgcgtttttccagtagttgtacaactccaagaagttgttttgatggtctatccatgggaattgagaccttgctatttcatatgttatttattccatttttgcctggtgtattcacttggtatttatactcaggaaacaagctcgttaggaaagtccccagagttgagttccaggagggtaagagtgatggaaaatcttggcctcattgctccagctgggtcaccatttccaaaaagaagatgcacataa

SEQ ID NO: 9501 - DNA, 2688 bp, Glycine max
  Peptide Sequence Number=SeqID_101186
atgtgtggtggcgatagcagaagcttagggataaatgcgtgtcaccggggatctagggttttcgagcctggtccttgtggtggtttgtgttgtggtggcggtgatcgggccaggaaggaggagatcaagaggcttttcattttggccgcggaggaaactgccagggccgagaaagaggcgtcctatgagtacggcacggcggtttctgccgctccgaccaatctatgcgctgtgtgttattttcccgccaccgcgcgctgcgctcagtgcaaatccgttcgctactgttcttttgaatgccaaactgttcattggcgtcaaggtcacaagttagaatgccgtcctcccagcacaactcaccagagtgatggtgcaacgagtgatcttggcagcaaggtagtagagcaaggctattctggaatccatgttgggaagtctgaaagtgaaggcaaagaatgtaaaatagcctctgaaaggcccccaatttttgatatctgcttttctccaaaagtttcatctggaaaggatgcaaatattagagttgagtctcttgcagagggaaatataacagattctaattctgaattgtccagtaactcattttctggattctcagcttccacgggttctagtgattcatctgatggttcctctgtatgtgagagcatcatctcaaatgagcatgacggatcagagggacatacttttgttgatcccacccttgacattcctgataacactattgatgatagcatgggtgtaaccatgtcttcttcaccaaagtttgctactttggttgattcagtagatggtttttctacaatgcgtaaattaaatcatactggacctggttttagtaaagaagagagtaagcttgcatcaaatggtaattcaggttcaagtatgtggaaggggaaaacaattgagccttctacggtgttttcgggattctgggataaagctcttgattcaagagggattaaagatgatactaagaatgacacttacccatcctgttctgatgaatccacaggcaaaaagactgcttctgaatcttcatttcactttccattcagtaccatgcctcctttgcatgtacgagataccaagacaaatgattctgtatctgatgatgcttttccaaactgtattgggaacaatatggcaagttcaggatcagcatcgtctgagaatgacaacatgaattcttcgaaggggaggaatttctcgttcatcaacagcaaagtttccaatgttaggagttatgttactccaagtggttctgagtctgatcaattggaatctaaagaaagctctgggccacctttatcatctttctcccctcagccctccagtgttggcaaaaattcagtttgtgcggatgctttgagcttccataactctcaatcaactggctcatccaatcttgttgtggccaacggtgggagcaccttgaagtccactgaaattggttgcctgacttgtgaacttgctgattctaatttagcttctgtaactgaagaacatcattccagtacaaaacaagggaataatgacattgaatctggcactcgagctgtcacttcctctcaggttgctagctgttctgcaaattctaagagtggcttgaaaacatctgttttgaaagttgttgatcagtttagaggatcaaatctgtcaaagcactttccattagttgttgggagtgatcttgctggaagacgtaatgacaagagttttttcccttatgaattgtttgtcaagctttataactcgaacaaggtggagttatgcccatttggtcttgtaaattgtggaaacagttgttacgctaatgctgtacttcagtgcttagcatttacaccacctctgactgcttatttgcttcaaggattacatttgaaatcatgtgcaaataaaaaatggtgtttcacctgtgaatttgaaagattgatattgaagtcaaaggacacaaaatctgctgtgtctcctatgggcataatctcccatctacagaatattgggagtcagcttggtaatggaagagaagaagatgcacatgaatttcttaggcatgttattgacacaatgcaatctgtttgccttacggaagctggagttaatgcatcgggctcattagaagaggacactactttaatgggtcaaacatttggaggttaccttcgatcaaagataaaatgcatgagatgtggagggaagtctgagcatcaggaaaggatgatggatctgactgttgagatagaaggcgaaataacaaccctggtggaggcccttcgacgatttacaagcactgagactttggatggggaaaacaagtaccactgtgtcagatgtaaatcatatgagaaggccaagaagaagctgacagtttcagaggccccgaatgttcttacagttgcattaaagagatttcagtctgggaaatttgggaagctcaacaagcctattcaatttcctgaaatacttaacttggcacctttcatgagtgggactagtgataaatcacccatatacagattgtatggggtagttgttcacttagatgtcatgaatgcttccttttcgggtcactatgtgtgctatgtgaagaatatccaaaacaagtggtccaaggttgatgacagtgtgtccatggtccttccagtttcatcaactgaattcccataa

SEQ ID NO: 9502 - DNA, 852 bp, Glycine max
  Peptide Sequence Number=SeqID_101187
atgatgaaaacacgttatcgcttgccgcttttggcattcttcgcattcgcttccttcatattcataacgagatcatccctgcttgaaaaaatctcttccaccatgcctgaatattccttcaacaccgaccaggttctgtcaattctatttcgcgaattgaccaacaaccaagagaaaatggttttcctcggcaacaacgagccgaacctggtggtggctgcgccgaggaagctatgcggttacatgccggaggcgaagaaagtggcgttgcagaagctcgaggacgtgctactggagccgccaagagcgtcttcagggaagtcacgaaagtacttaaaacgcacgcggttcttgccggatttgatgaatgattctctggagaaataccctcgccgcgttttcatcgacgtgggggtgccggagaaggacggtgggagtggaatggagtggttttcgaagaattacccgacgaggaaccagaagtttgagatgtataacatagagacggtggcggaggagtcgtcatcgtcgtcgttgtcgccggggaaggagcaaatagagatgtcggattgggttcggaagaacgtgaaggaggaggagtacgtggtgatgaaagccgaggcggaagtggtagaggagatgatgaagagcaaatccattgggctggtggacgagcttttcttggagtgtaagccaaaacgcgagaacagaagctcagggaattccagccgaagggcctattgggagtgcttggctttgtatggcaagttaagggacgagggtgttgcagtgcaccagtggtgggatggagataaaagactcaaaagagacgaagagactggtgagagctga

SEQ ID NO: 9503 - DNA, 1896 bp, Glycine max
  Peptide Sequence Number=SeqID_101188
atgatgcaaactgtggcttcacgcaaagctgtgaatagaatgagctcctcagctgtggcagcttgcatggcgcctttacttcttcgcccccttctggctggagaatgtgaaattgaaaatgattttgatgtaggtggtgatggttctgttcaacttttacaagcagctgctgcggcaaaccatgctcaagcaatttgtataaccttattagaagaatatagcagcatatttgggggaggttctgtgtcccctgatatatacacggactcagaagaagagagtggatctgagagtgagggggcaactgatgatgatgatgatgatgatgatgatgatgattatgaagatgatgatgatgatgaacaagatgaatcaatacacgagtctgatgcagatgatgatcttgttagtgaatcgtacagtggaactgtagattctgaggccgatgatgaggaccatgatcatgctagttcaagttcgaaatcctctggtaagagtgaaaaattgaaagccactcggaagttatcatcaaagtcacttgaaggctcactgactcaacatgaagatttcaaaagctctgaactagtcactagttcaaagaagactggctatatagatcagtccaataagcctgctgatatagttggaggagtttccactaatcaagctacattgcataattcaaattctcctagccctgcttcgtgtatcaaaaaatccaataccatgtccaatggcccagcacctcggcatcgcaccacattggggcgcacctctgcaaggaagaatctttccatggaatccattgattttcctcttgaagatgaagatgaaattgaaaggcttgaagctgccaggacagaactacaaacccaaattgacgaggaggtgaaggcaaatgaaaagctgcaatctcatgtggacaaacaaaagaaagccttggaagagcgtcatctggctcttgagcaagatgtggctagactgcaggaactgttgcacaaggaaaagaattctcgggtggctcttgagaacaaagcagagcttgaggaattagctctggtagaagcagatcttgccaacttagagtggaaggttgatgagattggggtgaggcttaatgcacaaattgagcggaatcatggaagtacttcagattcctctaataaaccacgacagatatcaaatcaagaaagaaaattgaaacacaaggtagatgctgaagttgctgctacgccacaatttgacagatcaataagtaaggacactaatattggtggagcagaaaatgatattgagagaaagcctgaatcaacacctttaccaaacaaacacccaccaactagctccaagcgatctggtacaaagggtgagggagcaaattccactccttctgcactgacaaaactgacatccagactgaactttttgaaggtgggacgaagtcagactcaaaatgaactccaaagtatggataaaggccgagactcaagtcgctattcaatcaatgtggaaaaagggaaaggatatgaacgtccccaatcacttccatcccccaaactaccatctcctagacttccatctcctagacttccatctcccaaacatctatcccccaatagatttggagggtctgaagctcagtctgtgccaaacccagaaaagggtaaagggtcagaggcagttcagatttcagagaaaggactgagcaaaggtaaatcgcatcaaagttcagagaaactgaaaaaatcagatagccagccagcccatcactcagatggatggaatcaacaaccaaaacaattggagagaggaagatcagagggtcatcagacttataatgcggataaaggaaggtcagagggtcatcagacttataatgtggataaaggtcgatga

SEQ ID NO: 9504 - DNA, 918 bp, Glycine max
  Peptide Sequence Number=SeqID_101189
atggctgtggcatttaaatcggaatggtcaaaatttacccgtgttgaacttttgcatgaccatacatttttatggcaatcctttttattttttaagaatattcttttatcagagtctaagcatatcgtaattgaccttacccagattttcaagagtggaccacttttaatatcttctaaaggaattggatggacatcctggaagaaaaggtggtttattttaacacagacttcacttgttttcttcagaagtgatccaaatgctgtccctcagaagggaaatgaagtgaatttgacccttggtggcattgacctcaacaattcaggcagtgttgttatcaaagcagataagaaacttttgactgtacaatttcctgatgttcatgatggacgagctttcacacttaaggctgaaactacagaggatttatatgagtggaagactgcacttgagaatgctttggcactagcacctaatgctgccaatgtgacagagcaaaatgtgaaggatagagaaccagttaagtctactgtcgttggccggccaattttacttgctttggaggatgttgatggaactccatcatttttggagaaagccctaacattcatagaagagcatggtgctaacatagaaggaatcttgcgacaagcagctgatgttgatgaggttgaacgtcgagttcgggaatatgaacaaggaaaagttgagttttctccagacgaggatgcacatgttgttggtgactgtgttaagcatgtaattcgtgaattgccatcttctccggtccctgcatcttgttgtaaagcactgttagaagcttgccgaactgagcgtggtagtagggttgctgctatgcgtgcagcaataaatgacactttccctgaaccaaatcgccgcttactgcaaagggtttaa

SEQ ID NO: 9505 - DNA, 87 bp, Glycine max
  Peptide Sequence Number=SeqID_101190
atggagtctgcggaagaagttgacagtgacggaagaattcttccgtgggactccacgaaagaaccttcttctgctgggtgcccctaa

SEQ ID NO: 9506 - DNA, 327 bp, Glycine max
  Peptide Sequence Number=SeqID_101191
atggagatgaatccgataactgaaaggggtcaactaacccatgtgtgttgttcttcaccacactcttgggttcgaaccaaactacccccttgtctccgtttcactccacgaattcatatccccccatctgcgaaatcccatcatgcctcattcacatatttttcttcaaatgccactatagcctcatcgatcaccacaatgttattctcatttgacttctaccgtcgcagagttaacgcagaatattcacttcagggtccttccatttctggttttaaccaactcaacattggagtcaatcatccaggccaacacatatatcagtga

SEQ ID NO: 9507 - DNA, 702 bp, Glycine max
  Peptide Sequence Number=SeqID_101192
atgagtgctgacgccccaccccaaacccaagccaccaacaccaaaccggaagaatctcaatctcaatctcagtctcagcctcagcgtcactccggcgattatgctccataccctaaactggaccccaccgatgttgcgccaccacaacaaccactgaacactgaatctcgcgctcccatttccgaagatgctgccactactatgcccaaagactccaatccctatgtcactcctgctcccgtcactgcttcttctactaagactactttagattcggtgaaagacgttctcgggaaatgggggaagaaagccgccgaggccaccaagaaggccgaggatctcgccggcaacatgtggcagcacttgaaaacgggaccgagttttgctgatgctgccgtggggaggattgctcagggaactaaggttcttgcagaaggagggtatgaaaagatctttaggcaaacatttgagacagttccggaggagcagcttctcaaaacttatgcatgctacttgtctacctcggctggacctgtgatgggagtcttatatttgtcaacggctaagctggcattttgtagtgataacccactttcttaccaagtgggtgaccagactcaatggagctattataagagagttaaagtaaaatttccaacatacttttcaagcaagacaaagttagactcccatagagcttaa

SEQ ID NO: 9508 - DNA, 1452 bp, Glycine max
  Peptide Sequence Number=SeqID_101193
atgaaaaaattgaaagagggaggatttgagaaatggggcttaattcaacaagcgcaaaaattctttctggagggaaatgactccagtggtgcaagaaatatgggccttgattttgctgggaaggcagtatatactgctgtatgggttgctgctgtttcgttgttcatggagttgctaggtttctccacacagaagtgggtaactgctggtggtttgggcacagtattgctcactctggcaggtcgtgagatatttacaaactttctttcgagcataatgatccatgcaactcggccatttatagtaaacgagtggattcaaacgaagattgaaggatatgaggtttctggcacagttgagcatgtaggctggtggtcaccaaccatcatcagaggtgatgatcgtgaggcagttcatattcctaaccacaagtttacagtaaatgttgtgagaaatctgagccagaaatctcattggcgtatcaagagttacattgctatcagtcacttggatgttaacaaagttaataatattgtagctgatatgcgcaaggttttgtctaaaaatcctcaagtagagcagcaaaaattacacagaagggtctttttggagaatgtcaatcctgaaaatcaggctcttatgatattaatatcttgctttgtgaaaacttctcattttgaagagtacctctgtgttaaggaggcaatccttttggatcttctcagagtggtcagtcatcatcgagccaggctagccactcccatccgcactgttcagaaaatatacagtgaggctgactcggaaaatataccctttggggacaccattttcactcgatctagagcagcaaatcgtccatttctactgatagaaccaccgtataaagttaatggcgaagataaagttaaggcttcaacacgttcaactcgtgcaaatgaggaaaaagattccaaaattgatgaaaccatggcatctgacaccaaagaagatgagaattttacagcaacatcaacctcctcacctgatgtaatttccaaggataaatccaagtcattgtctgatgcccagcctaaaaaggaaaatgcagtagatgcaggaaagggaactacagttcctgtatctaaaaaccttgttcaaagtgctgttcctgaagcctctcttgctactacccaagagatcacttctgcaacttcttcacagtcaaagcaagatgaagagaaatcttctgtgtctttgccatcagttaggccttccttggaagagaacattcttctcggggttgccatagaaggctcaaaacgaactcttccaattgagggagaaatgactccatctcctatgcctgcagagtcacaagaatttgctgttcaacggaatgggggtggacctccggctagcaaggataagaaggatggtcagtcttcatttccaactggtaaacagaatgactag

SEQ ID NO: 9509 - DNA, 1410 bp, Glycine max
  Peptide Sequence Number=SeqID_101194
atgtctcctggtgcaagaaattctaggatttttgcccttcaaaacatgctttcgacttcttctgcaactctagtgtctatgttatcccagttgtcagaggcagaagagcagaaacgggttttcagtggtaaagagcgttggaaccaagtccggtcccttgctgatgccaagaatgtgatgaattatttgttcaatattgtatcttcgtccagagagaaggacatggaaataagagatctaaaagaaaaatttgtggggctaagctactcacttcgacagttggacatgataaaagctgaacttagtcacaagttgaagttgcagagtgatgctttgaaaagatactcagaatatgtgggagattcagaatattctgacttgaatgttggaggccacaagtattacttgtgcaagccggaataccgctggtctacccatctattggaggacatggatatatctgagacagagtcagatgatctgacagatgacgggtgggaagaatcaggaaagttaaaggtttggaaaaggaaatctaaaacaagacgctcagacattgaaaataatcaatccaacatcaacaatttagaagatttcaaagaaaattcaggagatatacttgtagatacccctggggaaactgcatcagatatttgctgctcttgtagcagaacctcattgtgcaagacagcaaaatgcaagtgcaaagctatgggcaatagttgtgggagttcttgcggttgcctagcaaccaagtgtgtcaacagagcatcaatatcaagtgaatcacaggagccaacacaatctgcaagtattgaagaaacaggccttcttgttactcaaggtgcagggttacttcagggagcactggttgataggcttgacgagacaaacagtggccgagggcacagaaaacctctctctgacataggaaatacacaggtcaaatcaaatgccaagaacgataatcccaaaaagaaaacagccaccgtaattattgttccaaatccgccaccttcttcgcaggcagagaattctgaagtccccatccccatccacaacctcaagttcagcttcaggaaagaaaagttcaacttcaggaaagaaaataataacaacacgaatgaaacaagtgtagctgtgaataaaccaagacataaaaggtccaaatccagacctgaaaacgctgcctcagccccaagggcagagggtaatttcgtggacccagatgcacccttgaaaatgccaagggctgttcgaagggaagcatcatccaatagtagtggcgttccattttgggacaggaatgctgctgctggtaataagtcagatgaacctgaagtttttgaaacaaggaatccactacggcacaaaagatcactagacgaaaaagagaacaacagacgctga

SEQ ID NO: 9510 - DNA, 1245 bp, Glycine max
  Peptide Sequence Number=SeqID_101195
atgagcaagtctccgcgcagagatctgcaagtcttcgatttcaacgaagaggatgaggtcgcctccgataaacaccacgatttcctcgctcgcgatgcgcaggtcaacaaggttggcatcaagagtgttgccagtatttctcatgttgatgttgatgaagctggtgctatgtttaatttggaaaagggtggttctgacacctctcctgactcagtggaagatatatatgatagtaaagagaatagttctgtgttggaagctgacaaacaatcaaatttgattagtcatgaaagtcgtcatcattttaaaatagatattcataaccataacaaactagagaaaatggatacaagtagcgaagtatcttcacctgaaacaagccagattgacccttcaggatcttcatttttttgcacagccccttcagggtcttcatacagtaatgaatcaattgatgtcaattcagaggctgatgagagcatgaatgagagtgctccaacaagtcctgcttctgatattccagagaatggtgtgtcattagatggttgtggattgaatggcacagacaattctgacatggatgacacaatggaagtcgttcttcatcctgattatgtcatataccaggataattattatctggggccaaagttaaccttttcaccttgttttgtcaagatcaatgtttcaactgcatgtataaagcaagaagcttttgatcttgaatgggcagttgatgatctcattgacattaattgtcagttgtttcaaagtagtggaactgtcattataaagcttcgagtaatatcacataatgcaagccaatcaaatcatgtaagcgatgcttcaggcattgaggaattggaaattgcggttgctgattacaattggtccctcagacatagacaaatcacatctcttaatctgaaatacttggcttcttggaacatggctcttcgtgtggatgtagaaggcaatggaactgattcacgtgggtcaagatgctacttccctaattttgaggagcattttgatgatgttatctatccgaaaggggatccggatgctgtttccctaagcaagagagatgtagatctcttgcaccagacacattcattaatgacacaattattgatttttacatccaatgatatatgtaggcacctatgggcagagaaatatcaacatatattgcgtttatataaagagaatactaaaaggattgatgattgtaggatattgtga

SEQ ID NO: 9511 - DNA, 1222 bp, Glycine max
  Peptide Sequence Number=SeqID_101196
atggaatcccgtgcctccaattccaattctccataccattaccaccaccaccaccctcgtttcaaaccaagccaacctatttcagaccgaatagttcgtgccctccgccaccgcctgcgcctcctccaccgttctggctccaccttcttcatattaggcgccaccggaaacgtgtacacggtgaccttatcctcctcaccctcatgcacctgccctgaccgcacaaccccatgcaagcacattctattcgttttcattcgagttttgggcgtgtcactcgatgatgtctgtctgaggaggaggacccttcgtccctgccagctccaacgcctcctcggagcgcctacattgccggaggtggtggcggggggcaccctgaggcagaggtttcaccagctgttctttggtggagggtcaacagcagggccaaagatagagatggaggagggtgccacttgcccggtttgccttgaggaaatggggaaggagcaaaacctggtggcatgtggaacatgccgtaaccctatccatgaagagtgcttgataaagtggaagagaaccaagggaagaagtgctagttgtgtgatttgtagagcaaggtggagggatagggtggagcaagatgagtatctgaacctgtctgcttatgttggcgaagatgatatggaagaacctgatgtcattcccccatctaattcttcaatctgtgtgttgaaagaagacggagctgtttggtgttggggttacaatttctgtatccttaatatgcttggagtccctcgcatctgcatccttgactactgtatggatggtcaacttggtattaatggagaggaatcacatgacaatgaatatgcaattggagaaaattctctggtgccctgcttacagaacaagtttcttgaattgcatccccctgattcttcttcaacgggtgggttagcacttgtaagcagtttcactccaagtccagtttgggattttcagggtcacactgttgtcaaggttgcatgtggaaatgaacatgttgtagctcgggttagtgctggagaggcatacaatggtgaagatttagtgtgctactcttggggttataacagccgtggccaattaggcttgggggatcgagagagcagactgcatccggaagttgttagaacatttgatgaggagtccccttatgcctttcacaatgctttgctcactcataaaaagaaatctt

SEQ ID NO: 9512 - DNA, 645 bp, Glycine max
  Peptide Sequence Number=SeqID_101197
atgttcccttccatcataaattctaatcaatctcgtgaccagcaacaacaaaagcaaaagggagaatggttagcaggaagtttcaaggcagagaacttcattccagggcttgttataggtttcatttttgggttgttgttggatttatcaaagcccggtagaaatcacttgtccaagaaaatttgctcatctgccagacctcaacaacagcaaatctcagtctcaagcaatgctgatcaagaacttaaaatgaaatattaccggcaggttctggtcgttaggcaagacctaaagatgaaatctggaaagattgcatcccaatgtgctcatgctgccactggcatgtacgctgaattaatgcaaagtgatcggtatcttttgagaagatgggaacagtgtggccagcccaaaattgttgtgacttgcaggaatcaacaagaaatgaataaactagcggaagcagccgagagtattggccttcctacttttgttgttgctgatgctggacgaacacaggtttcggcaggatcaaagaccgttcttgctgttggacctggtaagcttcctgttgcttgtatgttgaccaaaatcttctgtggattcagtgacagggagattgcccctgctttgacagcattaatatga

SEQ ID NO: 9513 - DNA, 3348 bp, Glycine max
  Peptide Sequence Number=SeqID_101198
atggcgttagggaaaagaaggaagaattcaattgagatggatctggaagatggagtctatttagggattctggggggatctgagtctattagattgttgagcttacagttcatagggaggcttttggttggccttcctgctgagaagaaggggtcaagattctttaatctcccaatgggaagatccagatctatttcagataaccaaaggaaaatcagaatgcaaccaattttcttagctttatctaatagactgttctgttttccacagacagacaatctgtgtgccactttatttgatgttcttcttggtggtgctagccccaaacaggttttacaaagacataaccacgtggagagggtgagaagcaagggtagtcattttttacttcctcaaatgttgcctctgattttcagatatctgtctggctgtaaggatgcacccgcaagaatgaaaataatcagagatttacttggccttcttgattcaaatgcttctaatattgaagcttttatggaatatgggtggaatgcgtggttaacatcatctctgaagctggatgtgttaaaagagtacaatgccaaattacctgataaaggtgactatgggatggatgagctgctcttggtgaggaatttgttttccctagttctctgtcactatttgcattctgtaaaaggtggctggcaacagatggaagagacagtcaatttcattcttatgcactttgaggaaggtggcaattcatatatagtttttcttcgtgatatatatgaggatttgattcagaatctggtagagctgtcagctgtggacaatattttcatttcacagccctgtcgagacaatacattatacctcctgagattgattgatgagatgctgatttctgaaattgataaagaactcccgtttcttggaagtgactttgattttcatgttgattttgaaatggaatgtcacaaggagtatagttcctccttaaaagaagtgttggtagaagaaactgacgtgcaagcatctagaaaatcacagaattctaagcagccaataccaaatgatgatacaatcgaggagaagtggtggaatctatacgacaaattgtgggttgttattagcaagatgaatggtaaaggacccggcaatatgttacccaagccatcctcatttgcaggaccgtctcttggtcaaagggctcgtggtttagttgagtcattaaacattcctgctgctgaagtggctgcagttgttgtagcaggagggattggcactgctttagctgcaaaacctaacaaaaatgttgataaagctatggttttacgaggagagaggtgtccaagaattatttatcgccttgttattctgtatttgtgtaaatcctctctagaaagagcatcacagtgtatccaccagttcatctcacttttaccttgccttttaaacgctgacgatgagcaaagcaagagcaggctacaacttattatctgggcactgctttttgttaggtcgcagtatggaatattggatgatggtgttcgttttcatcttttatcacatttgatacgggagactgtcaatattggaaaatcaatgcttgctactagcattgcaagccgagatgatgcctttgatcctagctacaattcaaaagatgcagggtccattcaaaatttaattcaaaaggatcgagttctgacagcagtcagtgatgaggctaaatacatgaagacatctaaaatggatcgcacccagcagatacaggagcttcattctagaatagatgaaaactccttggcagaatctagcagtaagaaaacttttgaagacgacatacaaagtagcttgaactctgttcttgcttcatatgatagcagcagagctgaattccatcttacttgtgaggaaaagcagcaaaatgttgctgaaaaatggatacacatgtttcgttctttaattgatgagaggggtccgtggtctactaatccttttccaaattgtattgtaacacactggaaacttgataagacagaagacacatggcggcgcaggccaaaactaaggcaaaattaccattttgatgaaaatctgtgtagtcctccttctgccattggtagtgggcttgctactcctgtcaatgaaagtaatcctggttttgtgggtaatatacctgaacaaatgaagcagatcttgctgaaagggatgagaaaaataactgatgagggaactttggacattagtgaaaccaatactgaaataagtggacaaaagactcaaattcccattgactattcagactgccaatcctcagacttactaaaggatgtcagtgacagaaaggatattgtgcaagaacgaaaagatacttcctcttctcctgaaacagaagctagtgaggtgcttgtatctgttccatgtgttctcgtgacccccaagagaaaattagctggtcatttggcagtgatgaaaaatgttttgcatttctttgctcagttcttggtagagggtactggtggatcatctgtgtttagaaactttgatgcctcaattaattctgatctgaccaagtctgatctaaaacaaagatcattgaagtggcctgtttctggtatggatcctcagaaggcaactgcagtcgggaacgtggagctaataaatggaaatggatctgttaaacttatgagatgtgttaaacgccaccgaagatggagtgtagccaagataaaagctgttcattggacgcgatatttgctcagatatactgcaatagagattttctttagtgattcagttgccccagtatttttaaactttgcatcgcagaaggatgcaaaagatataggaaacttgatagttactacaagaaatgaatattcatttcccaaaggaagtggaagggataagagtggatctattagttttgttgatcgacgagtggcacaggaaatggcagaaactgccagagaaagctggaggagaagggatataacaaactttgagtatttaatgattctcaatacacttgctggaagatcttataatgatctgacacaatatcccgtttttccttgggtcttggctgaccactcatcagaggttcttgattttaacaaatcatctacatttcgagatctctcaaagcctgttggagcacttgatactaaacgatttgaggtatttgaagatagataccgtaacttctgtgatcctgatatacccagtttctactatggatctcattactcaagtatgggtattgtgctttattaccttcttagattggagccctttacctctcttcaccgtaatctgcagatggtagatgtagtgttctatgtactattaatctag

SEQ ID NO: 9514 - DNA, 519 bp, Glycine max
  Peptide Sequence Number=SeqID_101199
atgccggagaagaagagcaagaaagtctccttcaccgaagaagatgctgtgacattcatacagaggtacgacgcaactacggtgctcactttacttcaggaagtggcgcattactctcaaccgaagattgattggttcgagttggtggagaaaagtgcgactgggatttctaacgccagggagtatcaaatgctatggcggcacttggcgtatcgccattctttgcctgaaaacttcgaagatggggctgaacctttgattagttttgcacaaactgctgtattgtcatttttttcactggattcttggattaacattgaatatgttcatacttatgtggagtctcatttccaggatgacgatagtgacctagagtgtgagctagaagcattaccccctgtaagtttggaatgtgcatcagaggctgctgcatgtgtgaagactcagcaacaacaagaagatataaggtgggttggatggttaagggagaagggaagagggaaaaggttgtgggtttga

SEQ ID NO: 9515 - DNA, 2226 bp, Glycine max
  Peptide Sequence Number=SeqID_101200
atgacgaactacgattacattctttggtgtaatcaacttcagccggtcatcgaagttcatggtttatcgcattttctggttgctccgatcattccgccgtggtttcaaggttgctcacaatcatcacatctgtttgcaaacaacatttcaaatatggggactacagtacacactgaacttggagagttaaatctccacttggctgatgaatatcaagaatgcttgaaagaaagtgtttttggtgtggaatcaaattgtggctccattatgcacattgcaaaggttaatttggattggggaaaaaaggatgtggaattatctgaagaagatggtcctaggtgtagactaggtttatcaattgatgttactggcatgggtgtatatataactttcaagcttgtagaatcacttgtatcaacagccatatcttttcaagctctattgaaaagcctatctgcttcaaagaaaaaatcgactcatagtcaggggcgtttaacaaaatcttctgggaaagggactcattttttgaaattcaatcttgaaaggtgttcagtacatgtatggggtgagacaggtttggaaaatacaattgttccagaccccaagcgagttaattacggctcacaggggggtagagttatgctaaatgtgtcagcagatggtaccccacgcaatgcaaatataatgtccactatttccgatgaataccagaagctgaagtactctgtctctcttgaaatatttcaatttagtttgtgtgtgaacaaagagaaacagtccacacagatggaacttgaaagagccagatctgtctatcaggaatatatggaggaaaataggccagtaacaaatgtagcattgtttgatatgcaaaatgctaaatttgtacagcgttcaggtgggcttaaagacattgctgtctgttctcttttcagtgctactgacattactgtaaggtgggagcctgatgtacatctatcactagttgaacttgttctccagctgaagttacttgtacacaacagcaagcttcaggagcatggtaatgaacacatggtagatgtgtctcatgtgcaagatgctaattggaaaaaagaagttaccattgaatcagggcaccttgaaaagccgaagaagaaagaatctatttttgccgttgatgtagaaatgttaagtatttcggctgggctaggtgatggagttgatgctatggttcaggttcagtcaattttctctgagaatgctcggataggagtgctccttgaaggacttatgcttagttttaatggagctagaatcttcaagagtagtcggatgcaaatttcacgaattcctagtgtttctgcaagtacatctgatacaaaaggacatgcagttacaacatgggattgggttgtccaaggtcttgattttcacatttgcatgccatacagattgcaattgcgcgccattgatgatgtcattgaggatatgttgcgaggtttgaagctcataattgctgccaagacaagtttgatttttcctgtgaagaaagagagctctaaagttaagaaacctagtacagtacaatttggatgcataaaattttgcatacgcaagctaactgctgatattgaagaggaaccaatccagggatggcttgatgaacattatcagctgctgaagaaggaggctgctgagttagctgcacggttgaactttctagatgaatttatatcgaaggcgaagcaaggttccaaatcaactgacactgttagttcttctcaagaaagaaaattttcttttaataatgttgaggttgatgtaaaagattcttctactattgaatccatgagagaagatatttataaacgatcatttcgatcatattaccaggcatgccagaatctagtgttgtctgaagggtctggtgcttgtgtagaagattttcaagctggtttcagacctagtacttcaaggacatctcttctttcaatatctgcattagatttagatgtaagcttgaaaaaaattgatggcggagattttgggatgattgaggttctgaagaagcttgatcctgtctgtcttgaaaatgatataccattttcccgactgtatgggtcaaatattctcttaaatacaggttctcttgtagtccagcttcgggattactcatttcctcttttctctggaagttctggtaaatgtgaaggctgtcttgtattggctcagcagcaaagataa

SEQ ID NO: 9516 - DNA, 2400 bp, Glycine max
  Peptide Sequence Number=SeqID_101201
atggagatatgtcatgaagttaagaaagactcttggcagaggaaatgccatgatcaaatgcaatttgtgtcaaaactcattcactgggtcttacacctaggcaaacagacacaagatggtgctcctccaaaagtcccagctcctttagaaaaagatatcaatttgcaagcaaggaatccttattatagggaggcattttcttatgctaccaatacttctaatctcagtggacataagcctccaagttacaataagttgagaactaccttgcttacaacagagagaagccatgtggagaacctcatgcaaccaataagaaattcatggaatcagaaaggtgtgactattgttagtgatgggcggagtgatccacaaagaagacctctcattaacttcatggttgtcactgagagtgaaccaatgttcttaaaggcagtaaattgctctggtgatataaaggacaaggatttcattgctcaacacatgaaagatgcaataatgaaggttgggtcatcaaatgtggagacaagccaatttggagttgcaaatttttttggtggaagagaagactttcatgatgttgactctttaagggatagaggtaaattggatgcaaaatcttggtggcttgttcatggtgctcatgcactaacacttcaaaagatttcccttaagctactaaggcaaccatcttcatcgtcttgcccaatcttcgcctcattccaagaaattcctcaaactacaatgaagaggaaactagaatgtgggatattgcaagagatagagcagcaagaatccgaagaggaagttgacaggagaagccgccatatccgagaggggaaagccactcgttcgcggaaaacggcagaattttcaatcgaagtctcgaaattccgcgagcaggaacacgaacacggttctgtcgcgagactccatcgcagagaatgcgacaagaatcacggagaaaaaggaagaaccctagaaaaaggaaaaaaggtagcgatgaatgtacttgaagaagaaaaagaagaagggtttggtgagaaagtgggggatgtcatcgggtgcaacgcgggtgcaggagaggcttgcgtggggaaacgtgcgcccagagtcactgtttgcgcaacaatttataacagcgagcctattacgtggctccgtagtaaaaccaaagggagattttttcaacgatacatggcggcgccgcacacaccggcacggcctccctccctcgcgagtctcaccgccatcgttaatcacggttgtcgtcggagctctcgtagttgctcctcacagtcccaggagccaggtcctgggctgaaatcacagtttgtcggcggttttggagcgtttgaggggtcggatccaagagaagatggaggagatgcggctgcgagtgcggggaggggtggcactcgcagtattggtggtggtggtggtggaccagggagggcagaagcgcctaagcttgcggcgttgttgaaagaaatgaaggaaggacttgatactgtaaggcgtaaaattcaatctttaactgccacggctaagggattatcaatagaagatcatcctgttgttcgaagtgttgtagagataagattgtttttggaaaagattcggccaattgacaagaaacaacaataccagatccagaaactaatacaagctagtgaaaatgcaaccagaagtgatattcaaaacaaggagccagttgcatccaataagagcgaggacgtgtcaaagtatcgtcccaatcctgacatgcttgttagcaaagtagacctaaccttgcaggatggcaatgagtattatcaacctgtaaaatttgcgcctacttctatggatctagagagatcttcaaagtatgaaagaaatgccttgcgaagagaaaaagaaattctgaaacaagctaagcagagtgattatattaggacattgatgaatgatatggaggaaaaacctgaagagataagagattttgagggagctagcagagaagttgatagatatattgccaagatggacgaacgtgctcggcaagaggaggagctgttcacgcgtgttcctcttacgaaacaggagaggaaacgagaaaagtacttgaagaaatcaagaaatgggttgcaaggtctaacagaaagtttctatgatgaaatcaaaacattaccctttggtgataaaactggagagcaaggaactaacaattttgacttctttgcagaggaaacattaaaggaagaaaaattgggttttgagctaaagggcggaaatgcatgctatctgcagaacagaccactgcatgctgttggaggaagtaatactagattcaacggaaaggaatgtaaaacctatagagttggtattggtgcattcctccgtgttgattgcagattttag

SEQ ID NO: 9517 - DNA, 11085 bp, Glycine max
  Peptide Sequence Number=SeqID_101202
atgacaaacgaaagatcgagttggccatcgaggctccgccaacttctctccagagagggttccattggcccttccgtcaaactcgactctgacccttttagcatcattcttatgtttccaagcattagtcagttgttggtatatgaattagagtgccgcatgtacaatagaagtgatggtcagcctcctaagatcaaagccttcattgagaaggtcattcaatgtccattacaagatatagctatacccctctttggctttcggtgggattacaataaggggaattttcatcactggaggccattatttcttcattttgatacgtatttcaagacatatttatcatgtcgaaatgacctgacattgtccgataatctagaagttggcattccattaccaaaacatgcaattctacaaatactacgggtgatgcaaataatcttagagaactgtccaaacaagagtacatttgatggcttagagcacttcaagcttttactagcatcaacagatcctgagattattatttcaacattggaaactctcgctgctcttgtaaaaataaatccttctaagcttcatggaagtgcaaaaatggttggctgtggttcagtaaatagctatctcctgtccctggcacaggggtggggaagcaaggaggagggcatgggtttgtactcttgtattatggcaaatgagaaagtccaggatgaagcactgtgtttgtttccttctgatgctgagaatagtagtgaccaatccaattactgcataggttctactctttattttgaattgcatggacccattgctcaaagcaaggaaccaattgtagatacagtttcctcccgtttgagagttatacacataccggatatgcatttacgcaaagaagatgatttgtcaatgttgaagcaatgcattgagcagtataatgttcctcccgagctccgattttcattgctcacaagaattagatatgctcgtgctttccggtctgcgagaataagcaggctttatagcaggatttgccttcttgctttcattgtgttggtccaatccagtgatgctcacgacgagcttgtgtccttttttgctaatgaaccagagtacacaaatgaattgattagagttgtgcgatctgaagaaacaatatctggatctatcagaacacttgtaatgcttgcattaggagcccagttagcagcatacacatcatctcatgaacgggcacggatacttagtggatctagtatgaacttcactggagggaaccggatgatactactgaatgtacttcagagagctattttgtcattgaaaacttctaatgatccaacttccttttcttttgttgaggcacttcttcaattctatctgctgcatgtagtgtcaacatcatcttctgggagtaatattagaggatctggcatggtacccacattcttgcctctgctggaggattctgatcttgcacatattcatcttgtttgtttagctgtgaaaacccttcagaagcttatggataatagtagttcagctgtatctttatttaaagagctggggggtgttgagcttttggctcaaagattacagatagaggttcatagggtcattggttttgttggagagaatgataatgtgacgctcactggtgaaagctcaagacatagtagtactcatcagctttactctcagaagaggctgataaaagtgtcccttaaggcccttggttctgcaacatacgcccctgcaaactctaccagatctcaacactcccatgaaagttcattacctgcaactctagtcatgatttttcagaatgtaaataagtttggaggtgacatttattactcagctgttactgttatgagtgaaataatccacaaagatcctacatgcttctcttctttgcatgaaatgggccttccaaacgcttttttatcttcagttgcatctggaattcttccttcatcaaaggctctgacatgcattccaaatggcattggggccatttgtcttaatgccaaaggcttagaggttgttcgagaaagttcatcactgcagttccttgttaatatctttacaagcaaaaagtatgtccttgccatgaatgaggctattgttccgctagcaaattctgtggaggaacttcttcgacacgtgtcttctttgagaagtactggtgttgacatcatcattgaaatcatccataagattgcatcctttggtgatggtattgatacaggatcttcttcaggaaaagctaatgaggatagtgcaattgaaaccaattctgaaaacaaaggaagtgaaagccattgttgccttgtgggcacagcagagtctgctgctgaagggattagtgatgagcaattcattcagctttgcatttttcatttgatggtattggttcaccggacaatggaaaattctgaaacatgtcggctatttgtagaaaaatcaggaattgaagctttattgaagctgttattacgacctactgtagcacaatcctcggatggcatgtctattgctctgcatagcaccatggtatttaaggggtttgctcaacatcattccactcctttggcacgcgccttttgttcctctcttaaagagcacttgaatgaagcattagctgggtttgttgcatcttcgggacctttgttgctggatccaaagatgacaacaaataacatcttttcttcacttttcctggttgagtttcttctctttcttgctgcgtcaaaagacaaccgttgggtgactgctttgcttacagaatttggaaatggtagtaaggatgttcttggaaacattggacgtgtccaccgtgaagttttgtggcaaattgctcttcttgaaaatatgaagcctgatattgaggatggtggttcttgttctacttctgattcacaacaggcagaagtggatgcaaatgaaactgcagagcaaaggtacaattctatcagacagtttctcgatccattactcagaaggaggacttcaggatggagtgtagaatcacagttttttgatcttattaacctgtatcgagatctgggtcgtgcccctggtgcccagcaccaatcaaattctattggtcctacaaacaggcggttaggacccattaatctgttgcatccatctgagtctgcaaatgtattgggggctgctgataagaaggaatgtgacaagcaaaaaacatattatacctcttgttgtgacatggtcagatcactttcatttcacattacgcatttgttccaagagttaggaaaagtaatgctgcaaccttctcgccgtcgtgatgatgttgcaagtgtaagtcctgcttcaaaatcagtggcttctacttttgcaagcattgctttagatcacatgaattttgggggccatgtagaagaaacatccatatcaagaaaatgtcgttatttcggtaaagtcattgattttgtggatgtcattctaatggaaagggctgattcttgcaatcccattttactgaattgcttgtatgggcatggagttattcaatctgtattgaccacatttgaagcaactagtcagttgttgtttgcagttaattggacccctgcatcaccaatggaaactgatgatgggaatgtgaagcaggttgacaaggaagatactgatcatttgtggatatatggttctttagctagttatggtaaatttatggaccatctagtaacctcctctttcatattatcttctttcacaaagcctttacttgcacagccccttagtggtgataccccaaatccccgggatgctgagatatttgtgaaagtcctccaatctatggtgttgaaggctgtgctcccagtttggactcatccccaatttgttgattgtagtcatgaatttatttctaatattatttctatcatcaggcatgtttattcaggggttgaagtaaaaaatgtaaatggaagcaacagtgctcgtattactgggcctcctctcgatgaaacaacaatttcaaccattgtagagatgggattttccaggtctagagcagaagaagctttgaggcatgttggatcaaatagtgtggagttggcgatggagtggctgttttcccatccagaggacacacaagaagatgatgaacttgctcgtgcacttgccatgtcccttgggaactctgaatcagacaccaaggatgctgctgctgcaattgacagtgttcaacagcttgaggaagaaatggtccatcttcctcctgttgatgaattattatcaacttgcactaaacttcttcaaaaggaacctcttgcttttcctgtccgtgacttgctcatgatgatatgctctcagaatgatggccaatatagatctaatgttgtcacttttattattgaccagatcaaggaatgtggattgatttctggtaatggaaataataccatgcttgctgctctatttcatgttcttgctttgattcttaatgaggatgctgttgtgcgagaagctgcttcgatgagtggtttgataaaaattgcctcagatctactctaccagtgggattctagtcttggtatcggggagaaagaacaggttccaaaatgggtcacagctgcttttcttgcattagacaggttgttgcaagtggatcaaaatttgaatgctgaaattgcagagctgttgaagaaggaagctttgaatgttcagcagacatcagtccgcattgatgaggacaagcaacacaaattgcagtctgcattgggactttccaccaagtatgcagatatacatgaacagaagagacttgttgagattgcttgtagttgcatgaagaaccaacttccctctgacacaatgcatgctattttgctactatgttccaatcttacaaagaatcattctgttgctcttaccttttttgatgctggtggtttaagtttacttctttctctgccaaccagtagcctctttcctgggtttgacaatgttgctgctggtattgtccgtcatgttatcgaagatccacaaactctccagcaagcaatggaatctgagataaaacacagtcttgtagctgcgtctaaccgccatccaaatgggagggtcaatccgcgaaatttcctgttaagtttagcttctgtaatttcccgggatccaataatatttatgcaggctgctcaatctgtttgccaagttgaaatggtgggtgaaagaccttacattgtcttgctgaaagatcgggataaagagaaatccaaggagaaggataagtcattggagaaagaaaaagcacataataatgatggaaaagttggtttggggagtacaaccacagcagcttcaggaaatgttcatggaaaacttcatgattcaaactcaaagaatgccaaaagttacaaaaagcctactcaaacttttgttaatgtgatagaacttcttcttgaatctatatgcacatttgttgccccccctttgaaggacgataatgcatcaaatgttgaccctggctccccaacatcaagtgacatggacattgatgtttctacagttagggggaaaggaaaagcagttgccactgtgtctgagggaaatgaaaccagcagcgaggaagcatctgcatcactagcaaagatagtatttattttgaagcttctgatggagatattgttgatgtattcatcgtctgttcatgttctgcttcgacgggatgctgaaatgagcagctctaggggcatttatcaaaagagtcatggtagttttgctgccggaggaatcttctaccatattcttcgtaattttcttcctcattctcgaaattccaaaaaagacaagaaagttgatggtgattggaggcagaaattagcaaccagggctaatcagtttatggtagctgcttgtgttcgttcttcagaggcaaggaggcggatttttactgagattagccatatcattaatgaatttgttgattcatgtaatggtggtaagccaaagccaccaggcaatgaaattcaggtttttgttgatctacttaatgatgttttggctgctcggacacctgctggctcaagcatctcagcagaggcctctgtcacttttatggatgctggtctagttagatcttttactcgtactctccaagttttggacttggaccatgctgactcgtctaaagttgctactagtattatcaaagctcttgaactagtaaccaaggagcatgttctttcagttgaatcaagtgcaggaaagggtgataatcaaactaagccttctgatcctagtcaatccagaagaacagataatattggtcacatgtctcagtccatggaaatgacatctcaggtcaatcacgattccattcaagttgaccatgtagggtcttacaatgtgattcattcttatggtgggtctgaagctgttattgatgatatggaacatgatcttgatgggggctttgctcctgctaacgaagatgagttcatgcatgaaactggtgaggatgccagaggccatgggaatggaattgaaaatgttgggctacaatttgaaattgaatcccatggacaagaaaatctcgacaatgacgatgatgagggtgatatgtctggagatgagggtgaagatgtagatgaagatgacgaagatgatgaggaacataatgatttggaagaagatgaagtccatcacttgccacatcctgacactgatcatgatgatcatgagatggatgatgatgattttgatgaagtgatggaggaggatgaggatgaggatgaggatgatgaagatggtgttatactgagacttgaggagggcatcaatggaattaatgtttttgaccatattgaggtttttggaagagacaatagttttccaaatgaatcccttcatgtcatgccagttgaagtttttggatctagacgtccagggcggaccacctctatttacagcctgctgggcagaagtggtgataatgctgccccttctcgccatccacttttagttggtccttcttcctcattccacctatctgctggtcaatcagatagtataacagagagctcaacaggcttggataatatctttcgatcattgaggagtggacgtcatggacaccgcttgaacttgtggagtgataataaccagcaaagcagtgggtcaaatactggcgctgtaccacagggccttgaggagttgcttgtctctcaattgaggcgacctactgctgagaagtcatctgataatattatagcagatgcaggtcctcataataaagttgaggtcagccaaatgcatagttctggaggttcaaggcttgaaattccagttgaaactaatgcaattcaggaaggtggtaatgtgcttcctacatcaattgataacactggcaacaatgctgatagcagacctgtaggaaatggtactctgcaagcggatgtatcaaacactcactctcaggcagttgagattcagtttgagaataatgatgcagctgtgcgggatgttgaagctgtgagccaggagagtggtggtagtggggcaacttttggtgaaagtcttcggagcctagatgttgagattggaagtgctgatggccatgatgatggtggagaaaggcaggtttctgcagataggatagcaggtgattcacaggctgcacgcacaagaagagtaactatgcctgttggtcattcttctcctgtaggtgggagagatgcttccctccatagtgttactgaagtttctgaaaattctagccgagatgcagatcaagatggtccagcagctgaggagcaagtgaacagtgattctggatcaggagcaattgatcctgcctttctggaagctcttcctgaggagctgcgtgctgaagtcctctcagctcagcagggtcaagtggctgaaccatcaaactctgagtctcaaaacaatggggatattgatccagaattccttgcagctcttcccccagatattcgagcagaagttctagctcagcagcaagcacagagactacatcaagctcaggagttggaagggcaacctgttgaaatggacaccgtctcaataattgcaacatttccttcagaattacgagaagaggcaagtttgtcagttctattaacatcctctgatgctatccttgccaaccttacgcctgcccttgttgctgaggcaaatatgttgcgggagaggtttgcacatcgatacagtcataccctctttggtatgtatcccagaagtcgtagaggagagacttctaggcgtgatggtattagttctggcctggatggtgcagggggaagcatcacttcacgcaggtctgctggcgctaaggttattgaagctgatggagcacctctagttgacactgaagctttgcatgccatgattcggttatttcgcgtagttcagccactatataaaggtcaattgcagaggcttcttttgaatctttgtgcccatagtgaaaccagaatttcccttgtgaaaattctgatggacttactaatgcttgatgtaagaaagcccgctagttattttagtgcagttgaacctccatacagactatatggttgtcagagcaatgtaatgtactcacgccctcaatcgtttgatggagttcctccgttactctctcggcgaatacttgaaactcttacctatcttgctcgccatcatccatttgtggcaaaaattttgcttcagtttaggctgcatcctcctgcattaagagaaccagataatgctggtgttgcacctggcaaagctgtgatggtggttgaagatgaaataaatgctggttacatatccattgcaatgcttttgggtctcttgaaacaacccctttatttgaggagcatagctcatcttgagcagttgctaaatttactggatgttatcattgatagtgctggaagcaagtctagttcatgtcataaatctcagatatctactgaggcagtagtgggtccacaaatttctgcaatggaggtagatgtgaatattgattcagttacatcttctgctcttgacgcatctcctcatgtccatgaatcctccaaacccacacctcccagtaataaggaatgcccggctcagcaagtattgtgtgatctgccgcaggctgaacttcagctcctctgctcactgcttgctcaagaaggtttgtccgataatgcatatggtcttgttgcggaggtaatgaaaaaactggtggtcattgctccaattcactgtcagctttttgtcactcatctggcagaagcagttcgaaacttgacttcatctgcaatggatgagttacgcacttttagtgaagcaatgaaagctcttatcagtacaacatcttctgatggcgctgcaattttaagagttttgcaggctttgagttccttggcaacctcattggctgagaaagagaatgatggattaactcctgcactttctgaagtttggggaattaattcagcattagagcccttgtggcatgagctgagctgttgtataagcaagatagaagtctactctgagtcagtatctgagtctattaccccttctagaacatctctgtcaaaaccatccagtgccatgcctccacttccagctggttctcaaaatatcttaccatacatagaatcttttttcgtggtctgtgagaagctacatcctgcacagtcagatgctagtaatgacacaagtgttcctgttatttctgatgtggaagatgctagcacatctggtactcggctgaaaacatctggacctgctatgaaagtagatgagaaaaatgctgcttttgccaagttttcagagaagcataggaaactattaaatgcttttatcaggcaaaatcctggtttgcttgagaagtctctttccctcatgctgaagactccaagatttattgattttgataacaagcgttcccacttccgatcaaaaattaaacatcagcatgaccatcaccacagcccattaagaatatcagtaagaagagcgtatgttctagaagattcatacaatcagcttcgcatgagatcaactcaagatttgaagggaaggttgactgttcatttccaaggggaagaaggtatcgatgcaggtgggctaacaagggaatggtatcaattgttgtctagagttatttttgacaaaggagcactgctcttcactacagtaggcaatgaatcaacatttcagccaaaccctaactctgtttaccaaacagaacatctatcttatttcaaatttgttggtagagtggttggaaaagctttatttgatggtcagctcttggatgtccattttactcggtcattctacaagcacgtcctaggggccaaagttacgtatcatgatattgaagccattgatcctgactatttcagaaatttgaaatggatgcttgaggcaagtaatgatatcagtgaaattttggatcttacttttagcattgatgctgatgaggaaaagttgattttgtatgagcggacagaggtgactgattatgagctgattcctggtggacggaatacgaaagttacggaggagaataagcaccaatatgttgatttggttgctgagcatcggttaaccactgccattcgacctcaaataaatgctttcttggaagggttcaatgaattaattcccagggagttaatatctatattcaatgacaaagagctggaattattgatcagtggacttcctgaaattgatttggatgacttgagagcaaatacagaatattctggatatagtggtgcgtcaccagttatccaatggttttgggaggttgttcaaggtttcagcaaagaagacaaagctagactgctgcagtttgtgactggcacatccaagctagcaacatttcaggttcctttggagggttttagtgctcttcaaggaatttcaggtgcccagaggtttcagatacataaggcatatgggagttctgatcacttgccttctgctcatacctgtttcaatcaattagatttgccagagtatccatctaaacaacatttggaagagaggttactgcttgccattcatgaagcaaatgaaggattcggatttggttga

SEQ ID NO: 9518 - DNA, 744 bp, Glycine max
  Peptide Sequence Number=SeqID_101203
atggatagggccaaagaggaaattcaaagagctttcaataacaatgaagggaagtataaggatatccttgcaatcattgataaaagatgggattgccaacttcatcgccctttgcatgcagcggttgaagttcacaaacaattgccagtgtatagaagggcgggagagaggtttggtatgactgtagcaatgaaagcaaggactgaaatatctcctgctaagtggtggaaattgtatggagggaaaacaccacacttgcaaaccattgttattaaaattcactcaaagaagagaagtaggcttgagcaccaaaagcttcaagacttggtttatgttaagtataaccaagatcttctagatcgctttgagtgtcatgatgtgattgatcctattgctttaaatgatattgatgataacaatgagtggttattgggagaattggaaggagaagaagctggtaatgatttggtttttgatgaagatgatgatttgaattggttagatgttgctgaggcaactggggctggtgaacctttaaaaaacacaaggagtcaaacacagataaacaaggcagcagctgcacctgcacctacaaatgaaaaaggaaaaaaagtgatggaaatggaagaagagaatgaagatgagggggaagaagagtacaattctaatgctagtgagagtgatggatttcaagaagataatgacttgaatcttgaagaggatgaagattctgattctaactag

SEQ ID NO: 9519 - DNA, 1491 bp, Glycine max
  Peptide Sequence Number=SeqID_101204
atggcgagccgcttcctctccgccggaatcagacgttttgtgttcggtgcacgaactctgtgtagctccgaagcttctcgcgcttctgcgttccctatgccgttcgcgcgaaaattcaaattctctaagcagagcccattgccggcgcttcaaaattgggtggaccaaggcaacgatgtttcacccttccagctaagaagcatcgccagaaccctcgtcaaatcgaaacgctaccaccacgccctcgaggtatttgaatggataaaaaaccagaagaatttccatatgatcccagctgatcatgctatgaaattggagttaatcattgaaaatcatggtctaatggaagctgaagaatattttatgaatctaccggactcagctgcaaagaaggctgcatgtctcatacttttacgtggctatgtaagagatagggacactagtaaagccgagactttcatgctgaagctctatgaactggggctagtggtgagccctcacccttttaatgagatgatgaaactatatctagtaacatgtgagtacaggaaggtaccccttgttatccagcaaatgaagcgaaataaaataccctgcaatgttctgtcctacaacctttggatgaatgcttgtagtgaggaagaaggatatgtggttgcagcagtggagacagttttcagacaaatgctaaatgacaggaatgttgaagtgggatggggcagtcttgctacattagccaatgcttataagaaagcaggacaatctaagaaggccattctggttctcaaagatgctgaaaagaaactatcaacttgtaaccgtcttggtcacttcttcctcataacactatatgcttctttgaaggataaggaaggagtcttgcggttatgggaagctagtaaggcagttcgtggaagaatcagttgtgccaactacatttgtatactaacatgcttggtgaagcttggggacattgtacaagccaagagaatcttcttagaatgggaatctaattgtcagaagtacgatatcagagtctctaatgttcttttgggtgcatatgtccggaatggattaatggaagaagctgaatcattacatcttcacacattgcagaagggtggttgtccaaactataagacgttggaaattcttatggaaggatatgtgaattggcaaaaaatggatgaggctattattaccatgaaaagagctttggctatgatgaaagattgccattggaggccgccgcatggaattgtgttagccattgcagagtatttggagaaagatgggaatcttgaatatgcagacaagtatattacagatatccataatttaggtcttgttagtttatcattgtataaagtattgcttagaatgcacctttctgccaacaaaccacctttccatatccttaaaatgatggatgaagataaagttgagattgataacgagacactttccattcttaaagctttcactgagtag

SEQ ID NO: 9520 - DNA, 111 bp, Glycine max
  Peptide Sequence Number=SeqID_101205
atggtggcgaaggaaaaaagagggtgggtgaaaggagtcgtcgccatggactttgcttcctttaggtatcttgcggctacattgggatggaaaattttcaaaagaggatga

SEQ ID NO: 9521 - DNA, 888 bp, Glycine max
  Peptide Sequence Number=SeqID_101206
atggataaaagctgtcatccctctagcaatactagtataagcacatcctctgctgccaaccccaacaacaatagcagggatcaatatcttcgccatctcaacaagctctctcaaaagatctccaaacccatcattaagaaacccgtctttgatcctcctcaggcccaagtcccaaacaatcaggtgcagcatcagccgccggtgtacaacatcaacaagaacgacttccgtgatgtggttcagaaactgacgggctcacctgcgcacgaccgcatctcaacgccgcctcccattcagccacccaagcccccgagctctcgccttcagaggattcgccctcctcccctgcctcaaattactaaccgcccacccccgctccttaaccccaccaccctcccccgccctcaacaactccctaacgccgttaccttcaacaacaacttctccgttttttcgagaccccccgcgccgttatctcctctgccgccgttccccaccgtccacgcccccgctgagtcacctatctccgcctacatgcgcgatctgcagaccctcgtcgatgcaaacgccaagcacttttcaggcttttctcccttgcctccaccgcctctggttcaacctcaacctcaacctcaacctcagcctcagcctcagcaagaacaacagccacagcagcagcagcaagggatggttccgtcgcaagcgccgtcgtcgtttcagatgccgtcttcgcctgtgccgtttgggtgtttgaattcgcagctggcgtcctaccctctgctgtcgccggggcttctgttttccccaacttctggtcagttagggtttccgcagcttccgctttcgcccactgtgccggtccctagccctcgctggaagggaatttga

SEQ ID NO: 9522 - DNA, 990 bp, Glycine max
  Peptide Sequence Number=SeqID_101207
atgaattcaaacgtgcactcaatttattacgtgcctaagctagcagactcgagttatatgacaaatggatatttggagactgccatcgattggttacctggcatcaaagaaattttgttgagagatttcccaagcttcttcagaaccatagacccacatgatattatgctgcaagttttgcaggaagagtgtgggagagctaagcatgcttctgcaatcattttgaacacatttgaggctttagagcatgatgttttggaggcactatcgtccatgttgcctcctgtgtaccccattggtcccttaactttactcttgaatcatgtcacggatgaggacttgaaaacaattgggtcgaacctttggaaggaagatagagagtgtctaaaatggcttgacaccaatgaacccaagtcagtaatttatgtgaactttgggagcatcacagtcatgactaatcatcaattgattgagtttgcttggggacttgctaacagtggcaaaacctttctgtgggtcattaggcctgatcttgtggacgaaaacacgattcttccttacgagtttgtgttggagactaaagatagaggtcaattgtcaggttggtgtccccaagaggaagtgctagcacaccctgcaattggagggttcttgacacacagtggttggaattcaacaattgagagtttgtgcaatggagtgccaatgatatgttggcctttctttgcggagcaaccgactaattgtcgattctgttgcaaggaatggggtgttgggatgcagatagaaggtgatgttacgagggatagagttgagaggcttgtgagggagttgatggaggggcagaaggggaaagagttgaccatgaaagccttggaatggaagaaactggcagaagatgccaccattctcaaagagggctcttcatttcttaattatgataatatggttcgtcaagttcttttgagtgacaacttgaaatcaacttaa

SEQ ID NO: 9523 - DNA, 1233 bp, Glycine max
  Peptide Sequence Number=SeqID_101208
gttagaaccatactggacattggctgtggttacggtagctttggagcacacctctttcagagtcagcttttaactatgtgcattgcaagctatgagccttctggcagtcaagttcagcttacacttgagaggggtcttcctgctatggttgcttctttcacttcaaaacaattgccttacccatctctctcctttgacatgttgcattgtgcaagatgtggcattgattgggaccgaaaagatggcattctcatgattgaagctgatagacttttacgaccggggggctactttgtctggacttcaccacttacaaatgctcgtgacaaagacagtcagaaaagatggaagatcatacaaagttttgctgaaaacctttgctgggatatgctgtctcagcaagatgaaactgttgtatggaagaaaactattaaaaggaattgctatagttcaagaaagaatagttctccccctcctttatgtggcaaaggctatgatgtggagtctccgtattatcgagaactgcaaaactgcataggaggaacacatagcagccgctggatttctgtcaaagagaggcaaacttggccttccagagatcacttgaacaagaaggagcttgcaatctttgggttgcaatctgatgaatttgctgaagactctgaaagctggaaagcagcagttcgtaattattggtctcttctgtcacctttaatattttctgatcatcctaagagacctggtgatgaggaccctccaccaccttataacatgctaagaaatgtactagacatgaatgctcatgtcggtggttttaattctgcattgttgcaagctggaaaatccttatgggtaatgaatgtggtccctctgagtggactcaactatcttcccttgatccaggaccgaggttatgttggcgttttgcacgattggtgtgaggccttcccaacgtatcctagaacctatgacttggtgcatgcagctggacttttatcccttgaatttgctcagcagcgcagatgtaccatgcttgacatgttcattgaaattgacaggttactccgtccagagggttggattataattcgtgacatagttcctttaatagagtcagccagagctctaacaacaaggctaaaatgggatgcgcgagttgtagaaatagaaagtgacagcgatcaaagactcctgatctgtcaaaaacctttatttaagagacaagcaaattaa

SEQ ID NO: 9524 - DNA, 1194 bp, Glycine max
  Peptide Sequence Number=SeqID_101209
atggcttggcgcttcttctccttcctctctaaaaccctaaaccttaacccctcttcctcctcagccccattctccacctccttccttgtcaccaaaacccccaaaatattcaagaaaaaactcaaacccaagcccagcccgcgcaccaccccggtccgaaccgaaccgaaccgcatcccccacttcgagcgcattctccaccgcgacgccctcctccgcttcgtgacccgctctaagcagttcctctccgcccagccggagcacgtcctgcgcctcgacgacgccggcaagctccaccgcgagctcggcttcccgcgcggccgcaaggtctcccgcttcatccagcgccaccccctcctcttccagacctaccgccacaccgacgccaaaacatggctagggttcaccgaccttatggacgacctcctcgcagaggaacgctccctcatggacactttagaactcaaccgagtcgagaaggttcggaagctgctcatgatgtcatcgcgcaaccgcatccccctcagcaagatccaccactgcagaaccctattcggcatccccgacgatttccgcgatagggtttccaaataccctaattttttcagaatcgtggtcgaaaacgacgggaggagggtgctcgagttggtgaactgggacccactcttggcagtgagtgccttggagaaagagttcgttgttgacgaggattccgcgaagaggaagtttaggtttccggtgaagtatgggaaggatttggatttagaattggatgatagtaggaagcttaatttgctcaacgcgcttcctttggtgtctccgtattcggatgggagtaagattgatgggtggacgttggaggcggagaagtatagagttggggtgattcatgagttcttgagcttgacgttggagaagagggcgtcgattcatcaccttgtggaatttaaggaggagtttagtttgactaagcatacttatcagatgctgcggaagcagccgcaagtgttttacttggctggaactgagatgaattggggtgtcttcttgaaggatgcttatgatgggaatggagatttgattgagaaggacccccaggctgtgtttaatgagaagctttataagtatgctcaggtggatcagatggaacccgggtgtgatgatgatggggtggaagtgcagcatttgacttga

SEQ ID NO: 9525 - DNA, 786 bp, Glycine max
  Peptide Sequence Number=SeqID_101210
atggtctcctttcacaaaccgcttaccgagagtactccaaggccagaaatccatgcagaattcgaagcatcatcgaagaagagaaagtgggaagagccatttgccgaagatttcttcaaggatcatcaaacaagtatagagaagaggaaatccgtctttgatatagagcctcgccctgagacccctttttcttcagataaatggcgtcaatacctcactattcagtcagggcagatacagttgtgtaacacaagaacaacaacagagaaccccggaagaagccccgaattagaaccaccttcttctcatcatcatatgagtttaaaccttgagctgaatttgacgtgtgaatcaccgaggaagaaagaagaaggctatggttatgacatgaatgagaaaaagagttctcgttcttcccctgggggtttgagagaattacgtgaggatctgtttactgatcaaccaagcaagtttaataagaaagattcagatggtaaaattctttctccttcatggttgtcattatctgaagatgattataaagagatggttgcaacagtttgcatgcgttgccacatgttggtaatgttatgcaagtcatctccttcatgtcctaactgtaaattcatgcacccaccagatcagaacccttcaaaattcttgaagagaagcattctcgatcatccaaaacccatccatgttgccagagcagaattgaatttcggtacatactttcaggatttggaaacaagacaacccattgttatggatgatggtggctcttaa

SEQ ID NO: 9526 - DNA, 925 bp, Glycine max
  Peptide Sequence Number=SeqID_101211
ggaaattactacacccccttctcctatgcaacagaagacaaaacctaaacccccatctctgatgtctaggatgacccaccctcacaaggtatatccgccgcgagccgccagaggtgatttccgggagcatcatgggaattcctacactggagtaaaagaaaaaaaccaaacaacaccacgtctccatcttcatctgcttcatcctcacgacgtcgtcaacgtgtttgcgttcactctccttcaacatcgtgttgcttcatctctaattatggatctggtttcgttgtggtttgcggtgagtttcatggtggtttcgttgtggtccgcgtgtgttcgcggtgatgggtgcgtgctggtggcttgcgtttgtttggggtgggctcgtgggggtggacggtggtgggtttcgtggtggcttacgatgttcgagatttcatggctcacccttggttttttttctccttccttcttctttatcaccaccgtgccgacaccggcaaccacagaaccaaactcaacactacgtggccacgatgtccgttcgacgagcgagcgcaggctttgccttgaacctcgacagaagcttcaacgggtccaggtctggagcttctttgattttgtccccattgccattaccgtcatttcttacggccctcgcttcggcgttatccgccaaaacaacgtcgtccaggctctaccgtgtctgggcagttttgactttgttgtcgttaccagttatgggttgaccgactgtagaacagtgggtgcgccttcattggctacaagtaatacgaaacattttgcatcatgtgggaaatggatttatgatgacagtgccgcaggtgcaatggaggtggcggttcagagcagagctggtgttcggagctgcggcgcaaggaatagagaagggaaggaggggcaatga

SEQ ID NO: 9527 - DNA, 1377 bp, Glycine max
  Peptide Sequence Number=SeqID_101212
atggtaccatttctggaaaaattctttccagctatattaagaaaggctgctagcactgaagtaaacatgtactgtgtgtatgacagtcaagtcttaacattgtttacatcttctctgtaccttgccggattagtgtcatctcttgccgctagtcgagtcacggcggtattgggtcggagaaacaccatcatcttgggtggtgtcatctttgttgttggtggtgcccttaatggaggtgctgaaaatattgctatgctcattttgggccgtatcctactcgggtttggagttggtttcactaatcaagctgcgccgttgtacctctctgaaatcgcaccaccaaaatggcgaggagctttcaacacaggcttccaattcttcctatcacttggagtgctggttgcaggttgcatcaacttcggaaccgcgaagaaaacttgggggtggcgtgtctctctcggccttgcagtggtgcctgcagcagttatgacaatcggtgccttcctcataaccgacactcccaacagcttggttgagcgtggcaaaatagagcaagccagaaaagccctacgcaaagcaagaggatcctccatcgatgttgaacccgaattggaagaactcattaagtggtcgcaaattgcaaaatccgtggagcaggaacccttcaagaccatatttgagaggcagtatcgaccccacttggtcatggcaattgctatcccattttttcagcaaatgacagggattaacatcgtcgcattctatgctcctaacctctttcaatcagtgggtttagggcacgatgccgctttactttccgccattatactcggagcagtcaaccttgtttctctcctcgtctccactgctattgttgatcgctttggtcgaaggttcttgttcgtaactggtggcatatgcatgtttatttgccagattgcggtgtcaattttgctagcagtggtgactggtgttcatggtacaaaggacatgtcgaagggtagtgcaattgtggtgttggtgctactctgttgctactcggcaggttttggttggtcgtgggggcctctgacgtggctaattccgagtgaaattttccccttaaaaatcagaaccactggacaaagcattgctgttggtgtgcagttcataatcgtatttatattatcccagacattcttgtcaatgctatgccacttcaagtttggagccttcttgttctatgcgggttggattgtagtgatgacaatcttcgttatatttttcgtgccagagacaaaaggaattcctttggagtcatgtacaccatatggggtaaacactgggttttggcggcggtttgttaaaggagaagttgcacaagaaaatcttccctga

SEQ ID NO: 9528 - DNA, 381 bp, Glycine max
  Peptide Sequence Number=SeqID_101213
atgaagggtttcttaaagccagtattgggtggaaatatcattgatgctagttgtgcaagaacttcatcttggttagagcagacatatctaggctcccctttgtttccagttctgttgatgctgtacatgcaggttgctgaaataagtcgtgttttacgacctggaggtgtatttgtcgtaaccacttacatgctcgatgggcctttttctgttatcccatttttaagtacactacggcagaatgcaaggcaagtgtctgggagctacatctttctctctgagcgtgaacttgaagatcactgcagggcatgtgggctggttggatttaaatgcattagaaatgggctttttgagatgatctctgctacaaagcccagttaa

SEQ ID NO: 9529 - DNA, 981 bp, Glycine max
  Peptide Sequence Number=SeqID_101214
atggaagcacaagagtttttccagaacaccttctgcccccaattcccctccggtaccaacatcacaccctccaacgccaatccctccgccgccaccgccgaccacttcctcgtcgaagacttcttcgacttctccaacgacgacaacgacgccaccgctgtcaccgacgccaccttcgactccctccccaccgacgtcgactcccccaacgttacccccctcgacagcaccaccaagaactccaatttgccctcctcctcctccgccgacgcccatttctccggtgacctctccgtcccgtatgatgatcttgcggaattggagtggctgtcgaaattcgcggaggaatcgttttcgagcgaggatttgcagaagctgcagctgatatcgggtgtgagagcgcaaaacgatgctgcatcgtctgaaacgcgtgacccgaacccggttatgttcaacccgcaagtgtcggttcgaggcaaggctaggagcaagcggacacgtgggcccccatgcaactggacctctcgcctcgttgtcctctctcccaacaccacgtcgtcgtcttctaactccgacgccggtaagaagccggcgacgccgcggaggagagaggctgccttcgccgaaggcggcagcgaggggcggaagtgcctgcattgcgccacggacaagaccccgcagtggcggactgggcccatgggcccaaaaacgctctgcaatgcgtgcggcgtgaggtacaagtcgggccggctcgtcccagagtacaggcccgcggcgagcccaacgtttgttctgacgaagcactcgaattcgcaccgcaaggtgctggaactgcggcggcaaaaggaaatggtgaaggtccagcagcatcagtttctccaactgcatcaacagaacatgatgttcgatgtgccatcatccaacggtgaggattacttgatccatcagcacgtgggccccgattacacgcacctcatctag

SEQ ID NO: 9530 - DNA, 423 bp, Glycine max
  Peptide Sequence Number=SeqID_101215
atggaccccttattttggaagataaatattgggagtggtacttggaataggtattttagaatgcttgttttggaaagggcattccaaactagcaaacccccgtcaacaccaaaacacaagcgctcagaacccacccccaaccccaactccacaccagaaagaagagttcaacttaccttcaatgatgatgatgaaggggggaaggagaatttgcggcatcacgtcgggaagagggtcgaagggggaaaaaagagatgtgtgagttgtaggagggagacaagccgtcgtagggaaagctgtgggtctcaagagggagtcttcgcggaagggagggtgttgcggggaagggggtcatcatggaggcaatcgtcgtgggaaaggagggagtttgggaaggggtgcaagggtagtctagtaaattga

SEQ ID NO: 9531 - DNA, 162 bp, Glycine max
  Peptide Sequence Number=SeqID_101216
atggcctacggattctacccttcgtttgcaaggttggcagccaaaaagggagatgatctgaaattacctttccctacacatgcaattgggcctcagtccacccttaagcaggatgatcgagggcttgtccgtgacattatcccagaagccgccaacgcttag

SEQ ID NO: 9532 - DNA, 1161 bp, Glycine max
  Peptide Sequence Number=SeqID_101217
atgacgaaccaaaatgtggtgactcatgaggttattaacacgctgattgccatggcagcttccatttcaaactcaaccgtgttgccaagtgcaacagtaccagaatccatggctgtgcttggtgggttttgggggctgccccataataaaaatcttgtgaaaagattggaaggagccaaagttagtgcatggattgattcaatgagagcttcttccccaactcgtgccaaatcagaaagccaagaaaaaagatcttggattctttatcacccttcagctctgaacacctttgaacagatagtatatagtgccaaaggaaagcaaattgtagtttttcttgactacgatggaactctctctccaattgttgcagatccgaataaggctttcatgactagaaagatgagagcaacactaaagggtatagcaagacattttcccacagcaatcgtgactggaaggtgcagagacaaggtatataactttgtaaaattggcagaactttactatgcgggaagccatggcatggacatcactggtccaacaaaaagtccaaagcaaggtaataataataataaagcagtgctgttccaacccgcgagtcaattcctgccaatgatcgatgaggtgtacaagatcttgttagaaaaaacgaagactgtcccaggggctaaggttgagaacaataagttttgcttgtccgtgcactttcgttgtgttgacgaaaagagttgggcagcgttggcggagaaagttagattggtgctcattgagtatccacaacttaggctaacccaagggagaaaagtgctagagatccgtccaaccatcaaatgggacaagggcaaggctcttgaatttttgttagaatcattagggtacgagaattcgaatgatgtatttccaatctatattggtgatgatcgaactgatgaggatgcttttagggttttgcgcagtaggggtcaaggaattgggattcttgtttctagagttgcaaaagaaacagatgcttcctattccttgcaagatccatcagaggcaagtgctatatattcaatatccaccacaatttattataataatttaaatgttgagcaattcttgcggcgtttggtggagtggaaaagatcgagtactgtgactcccgcaagtgtatag

SEQ ID NO: 9533 - DNA, 939 bp, Glycine max
  Peptide Sequence Number=SeqID_101218
atgggtgattcaaggcaggcgcacaatgcgagggcatattccattgcagccaccggaagcgatgtgggagggttggtgggagagactgcctttgtcaagtttggtcttcaaagaactgcttcgcaaacatcagtggttgatccagtgttgtccccttcaagaagcaacattggtgacactcacaagaaatcaagtggttgcaacattcaggcagttcaagttgtcggttgggtgttatctaactgttgttcaatatgttctgactcagatgaagctgctttaatccttattcgccatggtgagtcgttatggaatgagaagaacttattcacagggtgtgttgatgtccctctcagcaagaagggtatagatgaggcaattgaagctggacaaagaattagcagcattcctgttgatgtcatatttacatcggctttgattcgtgcacaaatgacagccatgcttgccatgacccagcaccgtcgtgggaagggtctcaataagcaagaaacagcagacagatatgggaaagaacaagtccatgagtggcgacgaagttatgacatacctcctccaaatggtgaaagtttggaaatgtgtgctgaaagagcagttgcctatttcagagatcaatcatcatataacgctgataaaggactgatgctattgacatcaattctgcagattgaacctcaacttttatctggaaagaatgttatgatttcagcccatgggaattcattgagatccattatcatgtaccttgataaattaacttcccaagaggtcattagtttggaactgtcaactggaattcccatgctttacattttcaaagagggaagattcattaggagggggagtcccataggaccttccgaagctggagtttatgcctatactaggactgcaatggcacttttagtcctctaccaatag

SEQ ID NO: 9534 - DNA, 93 bp, Glycine max
  Peptide Sequence Number=SeqID_101219
atggatgctacacagcaaagacgttatgaaccatcacgctgtggtcgtccccagaaacgtccggtagaggagtcatcttctcaacatcaaaag

SEQ ID NO: 9535 - DNA, 1116 bp, Glycine max
  Peptide Sequence Number=SeqID_101220
atgcctcgccaaccgccgccgtcaccgccgtcgcagccgggcgttctggaccccgaaatctggcgagtctgctctggaaccactgtggagatccccacgctgcattctagggtttactacttcccgcagggacacttcgacgtgtatctttccgccgctgaacttcccggcggacccgccggtgcagaacctcctcgtcaccgacgtgcacggcttcgtctgggagttccgccacatctaccgcgggacgccgcggcggcacctgctgaccaccggctggagcacgttcgtgaacaacaagaagctcgtcgccggcgacgccgtggttttcatgaagaactccaggggaggggtggcgatgtcggaacgaggatcaaggtggatgaggaggaggaagaggaagaggaggtgagagaggttttctcgagggacgggagggggaagctgtcggcgaaggtggttgcggaggcggcggaactggcggcgaggagcatgccgttcgaggttgtttattatccgaaaggtgggtggtcggagtttgtggtgaagactgaggctgtgaatgaagcaatgagtgttgagtggagccacggaatgaaagtgaagatcgctacggagacagatgattcgtccagggtgtcgtggtgtcagggtacggagatgaatgccaatgtcaaagaggctccacagatgaggattcttacttgtgaaagtagctgtacagacaaagctgcttccaagaagagttatcttcgtttacaagctgattttgataattttaggaaaaggactgacaaagagagacttaacatccaatccgatgcccagcaacaagtcattgaaaagcttttgttgatggtcgacaattttgagagaacccaacagcaaattaaagcagcaacagagaaagagaagaaaattggtgttagctatcaaggtatttacaaacaatttgtagaggttctgaggaatcataatgtttcagtggtagcaacagtgggcaagccgtttaatcccttggccaaaatttcgccatataaacgtgccactgtggcttatggctccgtcacaacaggcctcccttcacaacacaaattgcctatgggggagggctaa

SEQ ID NO: 9536 - DNA, 141 bp, Glycine max
  Peptide Sequence Number=SeqID_101221
atgggaaaggtgaaagtttgcgttttgacgggaattgaggaaatgggtaagtgcagcaacaacaagaggaaaaggggaacagagaaacagagagaacaggggaatgatgaagaaggaccacctggatggaatgaggtctag

SEQ ID NO: 9537 - DNA, 5877 bp, Glycine max
  Peptide Sequence Number=SeqID_101222
atgattccacagtcaggatgggataaactgtttatctctttcatccccgctgactctgtgaaggctacatcaaagacaaccaaagcaaatgtgagaaatggaacctgcaagtgggcagatccaatctacgaaactacaagactcctccaagacattaaaactagacaatatgaggaaaagttttataaatttgttgtggggatgggttcgtcaagatctagcatccttggcgaggccaacatcaatctagctgattttgttgatgccttgaagccaacagctgttgctttgcctcttaatggaagtgagcctggagtcacactacatgtcacagtgcagcttctgacttccaaaactggtttcagagaatttgagcagcagagggaactcagagagaggggtctacagacaacctctgacaaaggaactcatgatgaatctgctgacagcaaagagtcatctcctgaccagaatgtcaataatcatataaataaggttcattcaagagtgaaattgaaaagagaatctaaagatctcccccgcatttcttcacttgaagaagaatcaggggtaaatgaagattatgctgactctgctgctggctttgatggctcgtctagtacttctgaaagcatatatacagagaagcatgatatctccagtacacatgaagtggacagtcttaaaagtgcagtctcttgtgatttaggtggcctatccctcagtcaaagttctcagccagagaaaggagaggcacctgataatcagtttcctgcacagggtagtgatcgggttcatggttggagcatagactattcagctgccaataatttggctgctgcttctgaagataggaacagtagcagacttatgggaaatttggaagcagttaagtcgtctatttttgatctaaaactgaaggtaagttctttgcaaaatcatgctgatgaaataggtgttgaaacgcataagttttctgagcaacttgctgctgagatttcatcaggagaagagttagtaaaggaggttgcagtactcaaatcagagtgttcgaaattcagagatgagtttgagcagcttaaaagttctaacttgagcttagcattccctcagaaagaacctactggtacagatccggatagattatttcaaaatttacagcttaaatggcttaaggggcttttgctcatggaagggaagataagagatattcagaaggtgtctatgggatttccagaaagggattgtaggttccttaacttggagttagaagcactggctgagattttgcagaatctcaaacaagaatctggagagccaatttcaggggccaaagttgtcaatgaaagagagaacaagaaaatggatttacataaaagtgaacaatttttaacagatattgggtctgatgcaggtttatttcaacctgaaagcatgactcattatcttaccatacctggccctgtgtctcacgagtctgattctgttgatcctacccttcctatgaaagaaaaagtttttgcacttctaagagagctagatgagtccaaaaccgaaagggaaagccttgtacggaaaatggaccagatggagtgctactatgaagctcttattcaggaacttgagcagaatcaaaggcagatgatggctgagttgcagaacctcaggaatgaacattctacttgtctgtacacaatttctgctggtaagactgagatggagagaatgcaccaaaatatgaatgagcagataatgaagttttctgaagacaagcgcattttggaatctctgaacagtgagtttgaaagaagggctgtttcagctgaagcagcccttaaaagggccagattgaactattctattgctgttggtcaattgcaaaaagatcttgaactgctttcttgccaggttctttctatgcatgaaacaaatgagaatctcataaaacagaccctttctgattcttcacttccaaatactgatggtagcccagagccagtgacatatcctaaactttcagaaggtcatacttccaatcgattgctatgccgaaatcacagttcttccttacaaaaacaacatttgggtgaagacattttactcagcgatttgaaaagatctcttcagttgcaagaggggttgtacagacaggttgaagaagaaatcagccaaatgcattttgcaaatatatactcagatgtgttttctaaggctctgcaagaaacattgcttgaagcaagtcttgacattcaactcatgaaagagaaaattgttcaactctctcagcagctggagcttacaaatgaatccaatgagctactagtgttgaggttgcagaatgctatgaatgatatcctctcgctaaatgagtacaaggagatttgcactgcaaatagcaatgatattgctctccagaaccaaattttagaggcaaatttaaaagatcttgctcatgaaaacaatctccttaccgagaaaattaacgagctggaagttcttctaacacagtatagaagttatgagggcaagtacatggcatgcagtacagaaaactcagagttgaagagtttattgaaaaaagagagcctagaaaagaataatcttcatgatgaactatccattttgcaggaagagttaaaatctatcagagctaaatatgacgagcaagtttcgatgaaggataatctgcagaataatgtcatctttttgtctaataagttacagaaattgcttacatcatatgaagaaagacacagtgaactttctctttgtagtagatctgcttgtttggattcagaatgtgaagacttagaaggcctcttattgcaactagaagagctgcaacaaagtgcatttcgtagaatcctgctactcattgaagagaaggagaatctagtgcatgaaaaacttatggctcaagtatctttaaataccacagaatcagatgttctagtcatgaaacagaagtttgagcatgatttgcaagagatgttacataagataactgtgtcaggtgcccttttgcagaaacttcagttagattttgaggtgatcattagcaggattggttttgaagctgaagaattcttttctcagcatcacaaagaatttttgtctggtctggatcatttggaagctgagctacaacaacttaattccagaaatcaggaccttgctcaagaaattataaagctagatacttcatctagtgaccttgaaatgtataagctgaccttagcaacaatcaaagagcaaaagaatgatttggacttgtctttacaaaaaacagaagaatctgccaagatttcatctgagcttgattttttgaagaagaacttggattctctgcataatgagttgtatgctgagaaaaatgtcagagaaaagttagaaaacatttcagatcttaccacagaattgaatgagaagcaaagtcagctgcagggaaagaaagaatttggagtgtctttagaggaaaaagcagaagaatctgccaagatttcatctgaactcaattttttggagaagagcttgcattctctgcataacgagttgcatgctgagaaaactgtcagagaaaagttggagaaaacagtttcagatcttaccacagaattgaatgagaagcaaagtcagctgcagggaaagaaagaattggagttgtctttagaggaaaaagcagaagaatctgccaagatttcatctgaacttaattttttggagaagagcttgcattctctgcataacgagttgcatgctgagaaaactgtcagagaaaagttggagaaaacagtttcagatcttaccacagaattgaatgagaagcaatgccagctgcaggattctgatctaaacagacaagaacttgtccatctaaagcaaatggtgacagacctagaatttgaaaaatcaagaatctcagatctgctagagaaatctgagaaacatcttacagatgctttaaaagaatcttcttcaattagttgtctggaaactcggttatctgaaatgcatgaattttccatagctacagatgttgttatgacttttaccggtgctcagtttgaggatcatatggaggagctagctgagaaacttcattccacttgcaggcaacttgatgtgctccacaagaagaatcttgatgtagaatctgaattggatggctgtctttcaagagaacggatttgcattgaagaaaacacaagattgttggcgagtcttgacttcttgaaatatgagttagaggacttgactgctcagaatagagcactaattgatcaaaacagtgaactgaagtcagagcttaaggagcataagagtaggaaagagaaggtcagcgatacttcttatgtgtgtgaaagacagagtgtcctcgaggttgcaaggctggagcaattgctggcaagttgttgtagagatgctgaagaactctttttgtccaaggaggaaactgaactcgagtgtatagttctccggggcaaattggatgaactggaaagtgcattcacttcattaaaacaatcagatgatgagctgctaaggctgcagaaccaatgtaatgaacttaccaagaggcttgctgaacaggttttgaagacagaggagtttaagaatttgtctattcatttgaaggaactgaaagacaaagctgaggctgagtgtgttaatgcccatgacagaagaggacatgaaggaccaccggttgctatgcaggagtccttgagaattgcatttatcaaggaacaatatgaatcaaagttacaagaactaagacaacagctgtctttgtcaaaaaagcatagtgaggaaatgctgtggaaactacaagatgcagttgatgaaactgagaatagaaaaaagtctgaagcttctcaaataaaaattaatgaagagctgggaatgaagatcttggaattggaggctgaattgcaggctgtactttctgataaacgcaatttgttaaatgcttatgacctcctacaggctgaaaaggagtgttcagcgataagccttgactgttgtaagcaagaaaagcaagaacttgaagcttctcttgtaaaatgcaatgaggagaagtccaaaattgaagtagagcttacattggcaaaggaattggttgagacttcccgatctcatgtgaattctctgaatgagggcaatggtgcattctcttcatttaatcctcaagaaaattctacttgtgctgcttgcagtcatgagccagagagtgcaagcatcaatatgcaatccgaggatcctcttgcatttagtgttatgaatggatgccaaactcttggaactgaaaaggacttgcaactagaagaagtaatgaagcatgtggcatcaactgaaagtttgaaatctagcatcgatcacttgaataaggagttggaaaggatgaaaaatgagaatatgcttccttcagtagatggtcaaagccacgagtcaagttttccaggtctgcaaagagaactgatgcaattacacgaggccaatcaagagttaggaaacatattccctgtttttgataaattctctatcagcggtaatgcattagaaagggtgctcgctttggagattgagcttgctgaagcattgcggaccaagaagtcctcaaacatccaatttcagagttctttcttgaaacaacacagtgatgaagaagcagtattcagaagcttcagggacatcaatgagctaattaaagacatgttggaactaaagacaagacattctgctgtagagacagaactgaaagagatgcatgaccgttactctcagttaagccttcaatttgcagaggttgaaggtgaaagacaaaaactcatgatgactattaagaatacaagagcatctaagaaggcttcaaattaa

SEQ ID NO: 9538 - DNA, 1338 bp, Glycine max
  Peptide Sequence Number=SeqID_101223
atgggcttatattttcaagacccggctgagttggacaaagcgggttttggagtgtgtgttcgggtcttggccgccaccgacgaagatgttcacttcaggattgtctccatctctcctattccccgcatttcatcacaaactttattcatttctcttctctattcgcaatcatcgctgttaactggtgcattctggaacactggctggttaatgattcatagtgttctaaaagcaagtaggtttcaaaatccacgtagagaagcccttgttttgaccattgctatcagtggttgtgtttgtcgtttagcatttagctcaatgaaagaaatcaattgtaaagtggattctagttcatgtactcttgcccccaatagggaaccctgcatcacagagtccttatcagttagtgggaatggtactactacttcatctatgagtgtaaaatccacccctgaaattgaaaagaagtttgttcatcatgtatatgatgctattgcgccgcatttcagtgccacccggtttgccaagtggccgaaggttgcagcatttttgtcatctttgcctttgggatctcttgtcctcgatgccggatgtgggaatgggaaatacttaggtttgaatcaggattgtttttttataggatgtgatataagtccttccttgattaagatctgctcggacagagagcatgaagttctggtcgcggatgctgtgaatctcccttacaggactggtttcggtgatgcagcgatatctatagctgtgttacatcatttaagcactgaaaatagaaggagaaaggcaatagaagaattggtcagagttgttaaaaagggtggccgtgttctgattacagtttgggctgtagagcaagaggatagtaagctgattaccaaatggactccactgaatgagaagtatgttgatgagtgggtaggaccaggtagtcctcatactcgggcaccttcatcctcgtcattggaaagtatccccgaaagtgaggtgagtacctctggtgagcacatggaagtttgccatgaggcacatgcatcaagatatttggaggaagaaaaaaatataaagaatcaacaggaatactttgttccctggcatttaccttatcatcgtgctgaaatcagtggcgcttctgccgaagctcttgctgctggtctggcaacgaaagatgacaaaaaaggtgctgtggtgtataatcgatattatcatgtttttagtgaaggcgagcttgaaagtttgacaactgaaataaacaatgctataattgttgatcagttttttgataaatccaactggtgcattattctagagaagacagtatga

SEQ ID NO: 9539 - DNA, 1128 bp, Glycine max
  Peptide Sequence Number=SeqID_101224
atggctgaaagttcggaatgcattgaggtgaaggtctctcctgcacatgaccaaaggattccgttgatgagatcaagaagaggaggacggcggcggcgcggcgacacgtgggtggtgtcggtgttcgtgataatccagatcggggttttcatcgccaccatgctcgtcaacgattgctggaacaattctcacggcgattgcgttcttcaagccctcggaaggttctcgttccagcctctccccgagaatcctctcttaggtccttctcagtccaacttggttgattcaattgatcgatttgcgataagaggaatctggttggatgaaatgggagctcttcgacgtagccttttgacagagcatcatcaaacatggcgtcttttcacatttccatttttgcatgctggggtcttccacctgctgctcaatctctccagtgtcatctatgtcggagttagcctagaacaccactttggaccaataaggattggtataatctatgcattgtctgcttttgtgggttccttggtggcttctctttttctccaaaacatgcccgctgttggtgcttccggtgctttatatggattattgggaacattgctttcggaacttgtttggaactggaaatttcattccaataagatttcagcaatagcatcattagtctttgtctttgtgtgcaacttcgtccttggttttctgccttatgtagacaattttgcaagcattggaggtttcatatcaggattccttcttggatctgtttttttactcagccctcagctccaaccagtagctccaaataaaggaggtctgattgattatggtgtcaaaagttgcatcaagctaaagttgaagcaaaagctggacagaccagttctcaggattgtttctcttatcctcttcagccttttattggctggttgtcttgtggcagttcttcatggaatcaacatcaacagttattgcacatggtgtccatatgtcgactgtatcccttttacaagctggcactgcaaagacacagaaacctcttgtgagtatgccctcgccgccgccgccgccgccaccaccgcatttacagttaaaggccatcaagccacaagtgagtgcactgacacttaa

SEQ ID NO: 9540 - DNA, 114 bp, Glycine max
  Peptide Sequence Number=SeqID_101225
atggagaagaagcaaaggctcttttttgggttgaaagacaaggtggttcacggtggggcacgattgacgactagggtttgcttgggttctcttgggagaggtagggttctatag

SEQ ID NO: 9541 - DNA, 2154 bp, Glycine max
  Peptide Sequence Number=SeqID_101226
atgccccaagcactcctacttcgtcaccacactgaaagagacacttacaaggcaaccggttggaaccggtcacaaggcggaacccgaagagtcacccccagcgtagaagaagatagcagcctggagaggcggttgccgaacggtgacgtgtacatgggaagcttctcggggaacgcgcccagcggatcggggaagtacctgtggagagacgggtgtgtgtacgaaggtgagtggaagaaaggcaaggcgtgcgggaaaggaaaattctcgtggccttctggagccacctacgagggcgaattcaaatcgggtcgaatggacggcttcggaaccttcaccggatccgacggcgacacctaccgcgggtcctggagctccgacaagaagcacgggtacggtcagaagcgttacgcgaacggggacttgtacgaggggtcgtggaagcggaacgtgcaggagggggaggggcgctacgtctggaagaacgggaacgagtactacggggagtggaagagcggcgtcatttgcggccgtgggacgctcatttgggctaacgggaaccgttacgagggccaatgggagaacggtgttcccagggggcaaggggttttcacctggtccgatgggagctgctatgttgggtgctggaacaaggaccttaagctgcaccagctcaacggaactttttaccccgggagcggcgataatctcaccgtctcaatgaggaagcgttcttccgttgacagtgctagagggagtggtgttaagagttttcccaggatttgtatctgggaatccgagggtgaagccggggatataacctgtgatataatcgataatgtttcgttgttgtatcgggattcgagtggaaccgggtcagatcgaggagatgttaacccgtttcgccggaacccttgttgcttttccggtgaggcgaagagaccggggcagactatatccaaggggcataagaattatgatctcatgcttaatctgcaattgggtataaggtactcagttgggaaggaagcttccatttcgcgagagcttaaaccgagtgattttgatccgaaggagaagttctggacaaggtttccggctgaaggatctaagattacgccgccgcatcaatcagtggagttccgctggaaggactactgccctatggtttttagacaattgaggaagctatttcaggtggatcctgcggattacatgttagctatatgtgggaatgatgccctcagggagctttcctctccagggaaaagtggaagcttcttctacttgacccaggacgacagatttatgatcaagacggtgaagaaatccgaagttaaggtgcttcttcggatgcttcgaagctactaccaacatgtttcgaaatatgagaattctcttgtgacaaaattttatggagtacactgtgtcaaaccaattggaggccaaaagacgcgctttattgtgatgggcaatcttttctgctcagaatatcaaatccatagacgatttgacttgaagggatcttcacatggccggacaacagataagaccaaggagattgatgaaactaccaccctcaaggacctggatctcaactttgtgtttcgtctacaaaataattggttccaggatttcatcaaacaaattgagcgggattgtgagttcttggaggctgagggaattatggattacagtcttttagttggccttcatttccgtgatgataatacatatgaaaaaatgggattgtcaccatttcttttgcgcacaggaaagtgggattcttatcagagtgaaaagttcatgcgtggttatcgctttcttgaagcagagctgcaggatagggatcgagttaaatctggccggaaatcattgattaggttaggagccaatatgcctgcgagagctgagcgcatggctcggaggagtgattttgatcaatacaccccttgttgcagtggggaaacctacgatgttgttttatattgtgggattattgacattttgcaagattacgatatcagcaagaaactggagcatgcttacaagtctttacaggttgacccttcatcaatctcagctgttgatccaaagctttactcaaaaaggttccgggattttgtgggcagaatattcattgaagactggtaa

SEQ ID NO: 9542 - DNA, 678 bp, Glycine max
  Peptide Sequence Number=SeqID_101227
atgcggttatgcttgtcccctagcaccactactcaccaagattctctactctgccagctcagccactattgctccctcacacgtagtcccttagttggatacttcgacctcgtcgttaaggtttacttcaaagggttgcaccctatgttccccaacggtgggatcatgtctcaatatttggactctctccccattggttctgtcttggacgtgaagggcccacttggccacattgaatacactggaagaggaaacttcctcgttcatgggaagccaaggtttgccaagagactagccatgttggctggtggcaccggaatcacacccatttaccaagtggttcaagccattctaaaggacccagaggactgcaccgagatacatgtggtttatgcgaaccgaacccaggatgatatattgctgagggaagagcttgatgagtgggctaagaagcatgacaggttgaaggtgtggtacgtggtacgagaaagcataagagaagggtgggaatacagtgtggggtacatcacggaaagtatcatgaaggagcatattccaaacgcatctcctgataccttggcgttgacttgtggaccaccccccatgattcagttcacggtgcagccgaatttggaaaagatgggctacgacatccagaacaacttgctcgtgttttag

SEQ ID NO: 9543 - DNA, 84 bp, Glycine max
  Peptide Sequence Number=SeqID_101228
atggactcaaaggggaaaggaattagcggaagactctactcttcatctttcaatttcatgatgcttgataaggacgctgtgtaa

SEQ ID NO: 9544 - DNA, 489 bp, Glycine max
  Peptide Sequence Number=SeqID_101229
atgaaggtagtgattgctttgagtaacaaggatggctacagtgcgataaatactagcatccaaaaactactggttagagctttgatactgtttcgagttgttgggatgcaaaactgggatcaaaatgttgatcagagccaagcatatcagacagcactgctggacaaggcacacatgcgcggaattcgctctctcccaagtcacaattaccgaagtgccaacctaaatttgatatcttttttctatgagaggaagctagttcatattcagctcatcaagaatgttgcaggagagatacacataggcggtttcaaggcccggctaccctgggcaattgcccaggctctggcccaaattcatttggtaacagaaacaaaagaagtaaagctgcagcaacactgtagaaaccttaaagcttccgccatcgacacctactggttcttttccgactaccgccttccccttttttttcggttagtaattgtttaa

SEQ ID NO: 9545 - DNA, 1401 bp, Glycine max
  Peptide Sequence Number=SeqID_101230
atggagaaaataaacagtgggggttcttccatcagaaggcgttcattgagcatatcaagtcacataagccatcatacagacaatgatgatgatgctgaatgtgagagtgtttcagaggctggagacattggagatcgtgttactattcgaagctgcagcttccgcttgtcttttgacaacaggtcagaaaatgaagctgttgttgtttccaattcagaggaacacagattgcatcccaactctgttaggcctttgcctcctgcactcacatctgaagacaccaaacatgatcctcataaacgtttgccagtgttgctggactatgcttcatttatgattcctttagcagtttttggaattcttggggtcttcacaagatatttgctgcagaagttatttggccctggggttgcccatgtgacaagcgaccaaagtattctttatgttgatcttccttctaatatgattggttcatttcttatgggatggtttggggtggtattcaaaggagacataattaatgtgtcagagcatctagctgtagcaataacaactggttacttagggagcctcacaaccttcagtggttggaatcaaaaaatgctagaactcagtgtttccgggcattggctcttcgcttcacttggctttctagtaggtatatttctcgttggctattccatcatatttgggattgaaactgccaagagtttcagggggtttctcaacaggctgaatattagttcaggcaaagaaggctctaagatctttatcaactgcaaagtagacagctaccgctgtcagttgatagttatggcgatatccgtggttgcgttgggcatattatggggtgtcagtggtgcattagttaaggctgagttcaagaatggtggcaatgttgctcagttatggtttgcttgcatggttggacctataggtgtgtggattagatggttcttagccaggctcaacggacgtggattgggaaaggcagggttgtttaaatggattccatttggaaccttaattgccaatgtatcagctgcttgtattatggctgcactttccactgtgaagaatgcagtaatttccacaccttctatgcctaactgcattatccaatctctaagtgcatgtttggatttcaagttcaaaagtatttttgagacaaaagtaaacaccagggattgtgatactgctgtagcgggaatacaatttggtctgatggggtgtctgagtactgtctctacattcgctgcagagtttaatgcgatgagagaaagcagtcgccctatgagagcatatgcatatgctatcattacagtttttttgtcattctctttaggaatcttgatatactgcatacctgtttggacaaaggggttagatattgacacatag

SEQ ID NO: 9546 - DNA, 1605 bp, Glycine max
  Peptide Sequence Number=SeqID_101231
atgggtttctcaaaggaacagcttcttgcgcggttaaaggagcttcaggttccattttcccagtatgagcatcctgttgttttgaccgtcgacgctcaggctcaatatgttggacatttggggggtggcctcagcaagaatttgtttctcaaggacaagaaaagcaggttgtatattgtttctgctttagctggtaccaaagtagatctcaaagtgttatctcagcggcttggtttgggaaaaggtggtctcagaatggcacctgaggaggctttaggtgaagtacttcaggtacccttgggttgtgtcactccatttgcacttgtgaatgaatcagcacgagatgtttcactgctattggatcaagggttcaagtctcagaagcactgcttcttccatccactgtcgaatgacatgtctatatctctaaatgcatgtgatcttgacaagtttcttaaatcaattggaagaaatccatcatacgttgatttggaggttagtaaatttaagaccaatcctacagtggggaaagatcaaccccctgatctagctgcactagttccatctggttccatagttttacccgatcaaccccaaaaacaatcttcttcacaggttcctaaggatgcaaaccatgtttctgtggataatggagccaatacagtttcagctaaagttgtcaagccatcctctggtgggaaaaatacaaaggggacaccagcaaaaaatgttaattcatcaggctcctttgcagatgctgggcaattcgttgaagagatattgcaaaaaacatcacaattattgctttcagaggtcaaggacgaaaatataaagttacacggggagcagctcggtactgtgttatctgacaaattacagaaaaacctcaatgcagagttcaagagccttgctatgatatttaagaacacagcatatacggaagggttccatgctgtgtatgagcaaatatattcaactgcgacaagagggctgccacggaacaatgcaatcggagtgatatatgtgcttgcattgaagctccctcgcttctccacccacttcgagttcctcctgacaaaccggacactgagaattctccttcagatgcgcgctctcgattttcaccgtcggaatcgtctcgatcgccctctccggccccggcgccggacactgccggtcgttttccgttatttgttcgatgagttcgttgagccctggcccgaagaaataatctcgcgcgtcgaatccgcgcgggattgggcttgggccgtgtcggtttgggatgttaatgggctcgaagggttgatggataggtccatgggctggaaagcgatccagacccgggaagcggcggatgggtgggtctatcatgagggaaagtgcttcgagcaaacgcgcttctggggagggatctggtgtggtgaagtccaccacgagtcttggacgcggcatgttgaattcgcagatgaattggccgaaacagcgcgggcacgtgatttgggtggggttgttgtaatcgggtgcggcgcggacggtgcggttgcactggaaggactcaatgacattgttaaagttgattatgggtttggaattaatgaagggtga

SEQ ID NO: 9547 - DNA, 84 bp, Glycine max
  Peptide Sequence Number=SeqID_101232
atggagatagacgggaggcttagcccagctttcgagctaagtgctcatatgaaagcagcacttgttcaagtgattgcgcgctga

SEQ ID NO: 9548 - DNA, 555 bp, Glycine max
  Peptide Sequence Number=SeqID_101233
atgttggtgtggccagtgattgaccaagggttcactttcttgggaatgcaatatacgtcggcttcctttgcctctgctgtagtaaatgccgtgccctctgtcacttttgtgctagccctaattctaaggttggagcgtgtgaatgtgaaggaggtacgtagcctagcgaaggtgattggaactttggtaacctttggaggcgctttgttgatgacactatataaaggccctcaaattaaccttttttattctccaaacacaacccaccaacaagatggggttcactcccctcagggtctcaaacactgggtctcagggacactctttcttctcctgggttgtgtcgcttggtcatctttcatcattttacagtcgataacattgaaaaggtatccggcagaattgtcactctcttcattggtatgcttatcgggtgctttgcaagctggcgtggtgacacttgtggctactcatcaatctgggcttgggccatgggccttaggttgggatttcagactctatggtcctctctacacggtcagtactcctttataa

SEQ ID NO: 9549 - DNA, 222 bp, Glycine max
  Peptide Sequence Number=SeqID_101234
atgggaatgttcatatttgccatggatgctataaagaagggtatgagtcattacgtgttcattgtctaccgtaatgccatcgcctctataactcttgctcccttcgcatttgttcttgaaaggtctctttcaccttacttctcatactcattcatgaaggttaggcccaagatgactgtccggatattttctgagattatggcgctggctttcttcgagtaa

SEQ ID NO: 9550 - DNA, 1137 bp, Glycine max
  Peptide Sequence Number=SeqID_101235
atggaggaccaaaatggtagtggtaagttgagccaagggcttcgcaaggtgaagccttaccttgctatattgtcccttcagtttggctactcagggatgtatatcatcactatggtttctttcaagcatggcatgagtcattggatactctcagtgtaccgtcatgtagttgctgctattataatagtcccttttgcacttgtccttgaaaggccagtgctagatcagaacttgtacaacatggggatgaagatgacctcaacaacgtttgcatctgccactgttaatgtcctcccggccattacttttgtaatggcactcattttcaggctagagaaggtgaacttgagaaaatttcacagtgtagccaaagtcattggaacccttataacagtttcaggagctatggttatgactctgtacaaaggccctgccttccaaatcataaagggtggaggagccatcagcaaccatagcaactctagcagtactagtaccaccgaaccctctgaccagcactggatagttggaactgtttatctcatatcaagttgtgctagttgggctggcttcttcattttgcaatcattcactttgaagaagtacccggcagagctctcactgacagcttggatttgtgtgatgggtattattgagggttcaatcgcatcccttatatttgaacgagacttcagtgtatgggccataggctgggactcaagacttcttgcttgtgtttactctggggtgatttgttctggaatggcatactatgtacaaggggttgtaaccagggaacgtggaccagtgtttgtgacttctttcagccctctatgtatgattatcaccgcagcattgggttcccttgtcttagccgaacaagttcatctaggaagtatatttggggccattctcattgtgtgcggactttacactgtggtgtggggcaaaagcaaagaccgtaagagcacaacagaaatagagaaaggcgaaagccaagaattgccaataaagaacggtacaaaatcagcgtcagacatatttgatggcattgaaatcaatgttccttctgaggtgttgaagaaaggaggagggaaaaatgtcccaccagcaacaacaacaacaacaacatcatga

SEQ ID NO: 9551 - DNA, 847 bp, Glycine max
  Peptide Sequence Number=SeqID_101236
catgcctctttaaatgtgaaggtattagcatcgtctgaagttcccaaaccttcaaataatgctaagaaaattgttaagaaaaaacctgataccaaagtaactaaaaaggtcagcagtgaagagaactctgatacttcagataaggagactgatgaggaagagagtgaggaagatgaagttaaacctaggaaaaaaattgttccaaaaggcaaggtgaagacttctgtccaacccaaaaagcgtaaaggagaggagactgatctatccagtaagaaaagggtcaaacctgctaaagcaacctcagaagacaatagtgatgcagaagatgatgggaagaactctgaagatgatcagtcctcttcatcacctgagaaaccttccaagaagaaagaagtttcaactcctgtgtatggtaaacatgtggagcacttaaagtctgttattaaagcatgtggaatgagtgttcctcctgtaatttacaaaaaagtcaagcaagtgcctgaaaacaaacgagaagagcagctaattaaggagttggaggaaatactgtctagagaagggctgtcttcaaatccatctgaaaaggaaatcaaggaagtaaaaaggaagaaggcgagagccaaagaacttgagggtattgatctaagcaatattgtgtcaagttcacgtagaagatcaacaagtagttatacatctcctccacctccaaagccgaaggttccagttgaaactagtggcaatggggctgaatgtagtgataatgatgatgaagacaatgataatgaagaggatgaggaagaggatagtggtgacgatgatggaagtcagagtgaagaatttaatgatg

SEQ ID NO: 9552 - DNA, 414 bp, Glycine max
  Peptide Sequence Number=SeqID_101237
atggccccaaaccagcactttactaatggttttcaaagcactactacggtatctgatataaccttaattgaacgcaacaaagaagtggccctagaagaaacacatgatgacgagtacttaccaatcgtgtccgaggtagagaatgcgaaatgcgagtgttgtggaatgtgtgaggagtgcacccgcgagtacataaggcgggtgcgtgacatgttctcggggaggttaatatgcgggttgtgtgctgaagctgtgagtgtggagatggagaagaatggtggaaagcgagagaaagctgtgaaagagcacatgagcgattgtgtgaagttcaataggcttggtaggtcatatcctgctctgtatcttgctgaagacgtcaaagagatcttgaagaagactcagaaaaaaggccat

SEQ ID NO: 9553 - DNA, 748 bp, Glycine max
  Peptide Sequence Number=SeqID_101238
cgcgtcgcagagacctcgcccaagaatggtagttggaaccatcgaggagtggtgtgaccttgacggaggagggaccgtcgctaggatgaacaaagaacggactagtaggatcagtagagggatccgccggcagttaagtgcaaaaaaggaggcttggaaagagagaagatataatagtagtggtggtgattggggagtgagctttggagggtgtgagacaagtgtgaatctaatggaagggtttaacatgatgcaggggaatgtggggaggaagagggtgatggtggtggttgatgacacttcgcattccaagcatgcaatgttatgggcactcactcatgttgctaacaagggtgattccttgactctgcttcacgttgtgcctcctcacaaggctcctgaatcttcttgctccacttatcttgttaattatcttgggtctctttgcaaagattgcaagccaggggtggaagtggaagcgctcgtaatccaagggccaaaactggcaactgtaatgagccaagtaaagaagctggaggtctctgtcctggtactgggccaaaagaagccatcttctctttttagctgtctttgtggaagcaacggaagcagtagtacagaggagtttgtggagttctgcatcaataaagcagagtgcttgacaattggagtgaggaagagaagccagggcacgaatggataccttatcagcactaggtggcagaagaacttctggcttttggcttag

SEQ ID NO: 9554 - DNA, 1617 bp, Glycine max
  Peptide Sequence Number=SeqID_101239
atggagaagttacgaaggggatgcattggcaaaactaacttgcaaaatctgtgccagacagaggttacaactgtgatttgtgggcgcaaagaattgaaatcactagtaaatattagtggtcaacttgactcagtgaaacgtgtgatatgcatggacgatgatatcccatctgatgcctcgtctgctcagcatggctggaaaatcactacgttttctaatgttgagaggcttggtagagaaaatcctgttgaggctgatttacctctttcagcagatgttgcagttataatgtacacaagtggaagtacaggattacctaagggtgtgatgatgacacatggcaatgtcttggcaacagtctcttctgtaatgataatagttcctaaccttggaccaaaggatgtctatctagcatacttaccgatggctcatatccttgaattagtagctgagaatttgattgcagctgttggaggttgtataggatatggatctcctttgactttaactgatacatcaaacaaaataaaaaaggggaaacagggggattccactgcactgatgccaactgtgatggcagctgtaccagcaattcttgatcgtgtacgtgacggagtgctcaagaaggtaaattcaaagggaggattgtcaaagaagttgtttcatttagcctattcacgaagattacaagcaattaatggttgctggtttggtgcctggggcttggaaaaagctctatggaattttctcgtgttcaaaaaggttcaagcaattttgggtggtcgcattcggtttatactgtgtggtggtgctcccctttctggtgatacccaaagattcatcaatatttgtcttggtgctccaataggtcaaggatatggtctaacagagacttgtgctggtgggtcattctctgattttgacgatacatctgttggacgtgttgggccacctgttccgtgctcatatattaagctaattgactggcccgaaggtggatattcaaccagtgactcaccaatggcgcgaggtgaaattgtaattggtggtccaaatgtcactcttggatacttcaaaaatgaagaaaaaacaaaagaatcttacaaggttgatgaaagaggaatgaggtggttctacactggtgacatagggagattccataaagatggttgccttgagatcattgataggaaaaaggacatagttaaactacagcatggagaatatgtgtccttgggaaaggttgaggcagctgtttctgccagtcccttcgtagacaatatcatgttgcatgctgatccttttcatagctactgtgtggcactcgttgtagtttctcattctgctttggagcaatgggcttcaaagcaagggattgcttattctgatctttcagaattgtgcagcaaagaagaaactgtgaaggaggtgcatgcatcacttgtaaaggaagcaaagacggctcgtctggagaaatttgagattcctgcaaaagttaagttgctttctgaaccatggactcctgaatctggcctagtcactgcagctcttaagctcaagagagagatacttagaaagacttttcaagcagatctctcagagttatatgcctcgtag

SEQ ID NO: 9555 - DNA, 2082 bp, Glycine max
  Peptide Sequence Number=SeqID_101240
atgaacgccattgcaactgctgcacttctctctctccctttctccttctccaaatcatccaagcttgacaccaaaaagggtttgaaaggaaggtttagagtgtttgctgtatatggagaagagatagataagaagagtacatggagtgcgctctttgatgtggaggatccaagatccaaagtgccgcagtataaagggaagtttttggatgtatatcaagcccttgaatttgcaagatatgatattcaatactgtgattggcgagctcgccaagacttgcttgccatcatgcttctccatgaaaaggttcttaatcctttagctcgtgattataagtccattggcaccatgaaaaaggagctagcagggttgcaggaagaattggcactagcacaccaacaggcaagggtgtccactgctttagataaactagcttacatggaagaattagtaaacgataagttgttgcaagaaagaaccacaaccgaagtttcccagacatcctcttctcccagtacttcttttaaacctgtagatgtagaaaagagaagaccgccacgaaaaagcttggacatatcaggtccagttcagtcataccatacccacttgaagaatttctggtaccctgtagctttctctactgacttgaaggatgatacaatgatcccaatagaatgttttgaggaaccatgggtcatttttcgagggaaagatgggaagcctggatgtgttcaaaatacctgcgcacacagagcatgccctctgcaccttggttctgtgaaggagggtcgtatccaatgtccttaccatggctgggaatatactactgatggaaaatgtgagaaaatgccatctactcgactgctaaatgtgaagataaagtcattgccatgttttgaaaaagagggaatgatctgggtttggcctggcaatgaccccccaacagctacccttccatctttgctacctccgtctgggtttgaagtgcatgctgagattgtcatggagcttcccatcgaacatgggttacttttggacaaccttttggatcttgcacatgccccttttactcacacttcaacttttgctaagggatggagtgttcccagcttggtgaaattcttgacacctgcatctggcctacaaggatactgggacccctatccaattgatatggagtttcgaccaccttgcatggttctatcaaccattggaatttcaaagcctggtaaactggaaggacaaagcaccagtcagtgtgccacacacctgcaccaacttcatgtctgcttaccatcttcaaaacaaaaaacaagattgctatacagaatgtcactggattttgctcctgtgcttaagcatattccttttatgcaacatctatggagatattttgcagagcaggttttaaacgaggatctacggctagtgttaggccagcaagagcggatgaacaacggtgcaaatgtgtggaatttcccagtatcctatgacaagcttgggcgaaagaaagatgtcgatcttcgagtacaacgggagtgccctagtggctatggtggggaagaactgcttcgccatcgcgagcgatcggagactcggtgttcagccccagaccaccgccaccgatttccagaggatttccaaaatccacgacaagctgttcatcggcctctcggcctcgccaccgacgcccagaccctctaccagcgcctccttttcggccacaaattgtatcagctccgcgaagagagggacatgaagccccaaacttttgccagcctcgtctccgctattctctacgagaataggtttggtccatacttttgccagcctgtaattgctggactaggagatgatgacaagccattcatttgcacaatggatgccattggagcaaaggaacttgcaaaagattttgcagtggctggcactgcatccgagtctctttatggtgcttgtgagtcaatgtttaagcctgacatggaaccagaggaattgtttgagatgatttcccaagcactgctatcatctgtagatcgtgattgtttaagtggctggggtggacacatttatgttgtgtaa

SEQ ID NO: 9556 - DNA, 249 bp, Glycine max
  Peptide Sequence Number=SeqID_101241
atgggcaacgtcattgaaacgtttgcttcgggcttaggaaatgctattggcaaactcttcaattctccaattgaatatctttccggaaagtcttgcagctcagtgtgtggaccaacatgggatctcatttgctatatcgagaatttttgtgttgccaatctcctcaagctagccatgttctcttgttcctctatctggtgcataaattgggcatatgtggatgtctttgccggtcttcttgcaaaatga

SEQ ID NO: 9557 - DNA, 537 bp, Glycine max
  Peptide Sequence Number=SeqID_101242
atggatggtgaggggaaacagtcttccaaaaaaaacccttacgttgaactagaagaggttgactttgattttattctagcaaagggcatgcaagaacaagagagagagttcacaatgctttcaactattgaaagtgaaaagtttgaaaccgaccttcgatttcttgaaggtgaaagaagtaatgacgatggcgatgaagacatggaaatggaagaagatgagattgatctagatgaattatcttatgaagaattgatggagttggaagagtttataggagaagaaacaagagggttatcagcaaatgaaatctctttgtgcttgtacccttatacttgccaatgtgctgaaagcaaaagtggcattgatcgttgtgtgatttgtcaggttgaatatgaagaaggtgaagcgctggtggcacttcaatgtgagcacccttatcattcagattgcataagcaagtggcttcaaattaagaaggtttgtccaatttgtagcaatgaagtgtcaactcccaacatgacttcgaatccttag

SEQ ID NO: 9558 - DNA, 1476 bp, Glycine max
  Peptide Sequence Number=SeqID_101243
atgtcggttgaggagatgcagtcacagaagaggaatgtgtttgacgcagaaacggcgtcgtccttggtgaaggagctgagggacaacttcggttcgggaaggactcggagttatgaatggagagtgtcacaagtgaaggctctgttgaaggcggtggttgataacgaggaacagatcgtcgacgctcttcgttccgacctagccaagcctccactcgaaaccatcgtctacgaggttggtatgtttaaaaactcatgtgaagtcatactgaaggaattgaaacaatggatgaagccagaaaaggtcaaaacatcaatcagaacttttccttcgtcagctgaaatagtacctgaaccactgggtgttgtgttggtcatctctgcatggaactatccaattttgttgtctcttgatccagtcgttggagctatagctgctgggaatgctgtggttctaaaaccatcagaaattgctcctgcctcatcatcattattattaaaattgatagagaagtattgtgataactcatttataagagttgtggagggggcagttgatgaaacaaccgcactattgcagcaaaagtgggacaagattttctacacaggcaatggaaaagtgggaagaatagtgatgactgctgctgcaaaacaccttacaccagttgtgctggagcttggaggaaaatctcctgttgttgttgattccaatgtcgatttgcagatagcagctaggcgaataatttctggcaagtggggattgaataatggacaagcctgcatttctccagattatgttataacaacaaaagattgtgctcccaagttggtggatgccctaaagactgaattggagaaatgttatggaaagaacccgttggaatcagaagatttgtctcggattgtgacttccaaccactttgctcgattgtcaaagctattggatgatgataaggttgctggcaagattgtttatggaggtgaaaaggatgaaaagaaattaaggattgctcccactcttttattggatgttccgcgagattctctgataatgggtgaggagatatttggtccattacttcctattatcacggtgaataaagtggaagaaagtattgatttgatcaactcaggaacaaagcccctggctgcatatatatttacaaccaacaagaagttaaaggagcagttcgtaatgaatgttcctgcagggggtttgcttgtcaatgacactgtcttacatcttgtcgttgatactttgccatttgggggagttggggagagtggaatgggtgcataccatgggaagttctcttttgatgcttttacacacaaaaaggcagttctttatcgcagttttgctggtgattcatcattaaggtacccaccatacacggatacaaagctgagattgatgaaggctctcatcggtggtcgtttcctcggaataattcgtgctcttttcggatggtcctaa

SEQ ID NO: 9559 - DNA, 132 bp, Glycine max
  Peptide Sequence Number=SeqID_101244
atgttttcattccagtccaataagaactccgcaattcgtgcaaaattacgcacactcatggaccttgagtctcgtgctaccgtgcaaatgcgaatgggcggcgcgcgtggattttatgtgacatggttttaa

SEQ ID NO: 9560 - DNA, 972 bp, Glycine max
  Peptide Sequence Number=SeqID_101245
atggcttcttcaatccctaatggacctccctctgcgttgaattcccagttctacgatgatctcagaccgccacagaggaccttcaacttttcttttcttcaacctgtcaaatttcctcgttctcaacgccttttcgtcgtcagagccagcgatttggagttcgaagccaccgttgtcgccggcaaggtgccgcccaaaccggcggctcctgtcggaactccggtggtcccttcacttccacttcaccggcgtcctcgccggaaccggaagtcgcctgcgcttcggtcggcttttcaggaaacgagcatttcgccggcgaatttcgtgtatccgcttttcattcacgaaggtgaagaggatactccaatcggggctatgcctggatgctacaggcttgggtggaggcatggacttgtagaagaggttgcaaaagcacgggatgttggtgttaatagtgtcgtgctcttccctaaaattccagatgctttgaagtctcccacaggagatgaagcatacagtgaaaatggtttagtgcctcggacaatacgtttgctcaaggataagtacccagaccttgttatctatacagatgttgcattagatccttattcgtcagatgggcatgatggcatagttagagaagatgatgttgtcagtcctagtgatatgatggatggtcgggtaggagcactgcgtgcagctcttgatgctgaaggctttcagcatgtgaagcctggtcttccttacttggatatcataagtctgctcagggataattctcctttgccaattgcagcataccaggtttctggtgaatacgcaatgataaaggccgccggtgctctcaaaatgatagacgaagaaaaggttatgatggagtcactgatgtgcctccgaagggccggtgctgatatcatcctcacatattctgctctgcaagctgccagatgtttgtgtggagagaagaggtga

SEQ ID NO: 9561 - DNA, 1686 bp, Glycine max
  Peptide Sequence Number=SeqID_101246
atgaagccaggaatgttggtattgagcagttgtgtgcttgaagggatgtggcctaatttaattgccaaagctaaggaaggtggattagatgtcatacaaacttatgtattttggaaccttcacgaacctcaacaaggccagtatgactttagaggaatgcgtaatatagtgagattcattaaggaaattcaagcacaaggtttatatgtaaccctccgaattggaccatacattgagagtgaatgcacttatgggggtctaccgttatggttacatgatattccgggtattgtattcagatctgacaatgagcaattcaagattgagaacgaatatgggaacgttgaaggggcgtttcacgagaaaggattgtcctatattcgttgggctgcccaaatggccgtgggactccaaactggtgtgccttgggtaatgtgcaagcaagataatgctcctgatccggtgatcaacacatgcaatggcatgcagtgcggaaaaactttcaaggggcctaactcgcctaacaagccttcactatggacagagaattggacaatgccgtacataagatctgctgaagacattgcatataatgttgccttgttcattgcaaagagaggaagctatgtcaattactatatgtaccatggaggaaccaattttgacagaatagcctctgctttcgtaataacggcatattatgacgaagctccactggatgaatatggtttggttagggaaccaaaatggggccatcttaaggagcttcatgcagcaatcaagtcatgttcaaattctatacttcatggaactcaaactagcttcagcttgggcacacaacaaaacgcttatgttttcaaaaggagctcaatagaatgtgctgccttcctggaaaatactgaagatcagagtgtcacaatccaatttcaaaatattccatatcaattacctcccaattcaatcagtattctaccagactgcaagaatgtagccttcaacacagccaaggtaagcattcaaaatgccagagcaatgaaatcgcagttagagttcaattcagctgaaacatggaaagtgtacaaagaagccatccccagctttggcgatacttcattaagagcaaatacactattagatcaaatcagcacaacaaaagatacatctgactatttgtggtacacattcaggctttatgacaactctcccaatgctcaatccattcttagtgcatacagccacggacataacaaactcaatcttataaacgggatgaacaatatttctttccttagtgcaacagttggattgccgaactcgggagcatatctagagcgcagagttgctggtttgcgtagtctgaaagttcaaggcagagatttcactaatcaagcatggggataccagattgggttgttaggagaaaaattgcaaatctacacagctagtggatcaagtaaagttcagtgggaaagtttccaaagctccactaagccactcacatggtataagaccacatttgatgcaccagtgggcaacgatcctgtagtgcttaaccttggttctatgggaaagggatatacttggattaatggtcaaggtatcggtcgatattgggtatctttccacacaccacagggaactccatcacagaaatggtatttgcctctaccatattcaattaaatag

SEQ ID NO: 9562 - DNA, 1330 bp, Glycine max
  Peptide Sequence Number=SeqID_101247
atgagccagtggatacacgtggcggtggcagcatccgccgtgggatgcgtctcgacccttttgttggtctttctctggcgttggtgccataaaagaaatcatcgcagaaatttcgttgagccggctagtttgaccagagtggagagtgtccagggagggatttctgtttccaggcttcatcaacaacaacaaccttttcaattggatcagggaaacaagaacaacaacaagggcaattacaattactatgtttttcgcggtggtggcgtgtcggggaaaagaagtttgttcaattggggtgatcatccatctatggccgctgatgctgttgaaaatggatggtcacgatttgctttcacagggtacaagagttacacgccatctccttcgaaaagatcagcacttttaggagtttgcgctgcacctggtggaggaagtgattttggaagagaatcagaggttgagataagctgggaagtggcccgtggatctgctgagtttatgcagaaggtgaggttgaatcccgggatcaaaaaatctcatcatcacaacaacaataacaacgctttttctctgagtgttgcttctatcattagaggggctttgcctttgcctggtcctcctttggggaactgtgcgttcccacaagaggcatattttgagattaccattttgtactcacgtggggatgagtatgagtttgttgggaagagtgtggaaggtgaaaagaccaagcttttggttcaaggtaactccaatgttaaagggaattcggaggctttggttcatgttactagtggcaatggtagtaataaaatcaacaatgttgaaggagaaggtgggaagggtgaatctgtgatgttctcttttgggttaactgctgggggttctgttcctttgagagttccaggtagctacactgggagcattggcttcaactccaacggttctctctatcttgatggaatgaaacttgtaagcgaatcagagaaggcagaatgggtaggaaccgatagagtgattggttgtggatttgatcctaggcagaagaaggttttcttcacattagactcagagctaatgcatgtcattcactgtcagacagaggaatttggtacaccactctttccaatcttggctgcaaacatagacattctggtgttagttaattttggacaaagtgcatttaaatatgcacctgcaaatgcccagagaacaccaaatccatgcttcatagccccacttgtaaattcccctgctgctaccataggctatgatgacagcaaggagctattctcaattggaaggattgatctcagtggctcaatcg

SEQ ID NO: 9563 - DNA, 51 bp, Glycine max
  Peptide Sequence Number=SeqID_101248
atgacgttgaccaaattgtacctgattaagaaaattaagggtaaaatatga

SEQ ID NO: 9564 - DNA, 2187 bp, Glycine max
  Peptide Sequence Number=SeqID_101249
ggaagagaatcaatggaagacggtgagattgaagagggatcaattggcggtgtagaggaagaggagcaatctccagaaccgcacaagtcggaggaatctccctacgaaatgttgcgcaacagcaaggcttccgtggagagcatcgtcgccgatatgctctccattaaaaaagagggtaaacccaagcaactccttcgagatctcgttactcaaatgttcctacatttcatcaccctccgtcaggctaatcgcagtattttgctggaggaagaccgcgtgaaaaccgaaacggagcgtgccaaggcgccggtggatttcaccacgctgcagcttcacaacctcatgtacgagaaaagccactacgttaaggcgatcaaggcctgcaatgacttcaagtccaaatatcctgacattgaccttgttcctgaggaggactttttccgcgacgctcctcaagatatccaggactccgtcttgtcgaacgatgccgcgcacaatctcatgctcagaaggctcaatttcgagctattccagcgcaaagaactctgtaaacttcatgagaaattggaacagcaaaagaaaatccttttggagactattgcaaacagaaagaaattcctgaccagtctcccttcacatctgaagtctcttaagaaagcctctttgcctgtacaaaaccagctaggacttcatcatacaaagaaattaaagcagcatcattcagcagagttgcttcctccaggtctttatgtgatttactcacagctgttggctcaaaaggaggcctttggggaacccattgatctggagattataggaagcctgaaggatgctcaagcttttgctcgtcaacaagctcacaaggacactgacatttccactaccatggagagttccaaattggaagatgatgctcctgatgaagaagaagatggtcagaggcggagaaaaaggccaaggagggttcaaaccaaggagagccttgaccaggggggattatatcaagttcacccactaaaaatcgttatccatgtgtatgaagatgaggcttctggccctaaatctgcaaaactcattactctaaggtttgagtacttggtgaagttgaatgttgtatgtgttggaatagaaggatctaatgatggtccagagaatgacatcttatgcaatttattccctaatgatacgggacttgagcttcctcaccagtcagccaaactctttgttcaagatgctataacattcaatactcaaagaacttcacgtccttacaaatgggctcagcacctggcagggattgatttcttgcctgaggtgtctcgtttgcttcttaccgacaacagtggagcagtcaagaatgaaaatgttatatctggtctttcactatatcgccagcagaaccgagtaccaacagttctgcagagaattcgtgcaagaagaaaagctcaattggcccttctggaacagctagaatctctcactaagcttgagtggcctcgtctgccctgcaaaagtgttccatgggctttacacactcctttgtgcaatttgggcagttggtcacctgtaagacttccacctgtacttagagagtcctcatctcctgctgtcatagataaagaggagcatattcaggagccaatggatgctgatgtaatcgaacgatctggtgccacaaaagcagaaccacagagtataacagaagatggggagcttccaactttgcttcctaaagtgtctaagcttgacctttccgcacaactgaacttaatttcaaaaagtatcattcccccgctcaataaaatcaggtcacaaagtttcaaaaagattgatgatagttctgatttcttgctggatattgaaagtgatattgatgagccagctcagattgaacaagaacatgaaaaatccaattaccatgccagaaagtctggttcatggatgaattacgggctcaaggaatttcgcttagttctttgcagaaaaatcagtgcagatgagagcaaattgaatttagaagccaagatcaagatcagtatggaatatcctctaaggcctcctctttttgcattgagcattagttgtatatcttctggggaaaaccatgatgagacaggtttggagtggtacaatgaacttcgtgcaatggaagcagctgtgagtaaactcaagatgttattgcagtaa

SEQ ID NO: 9565 - DNA, 3072 bp, Glycine max
  Peptide Sequence Number=SeqID_101250
atggaccaaaagcccaagaagaaaactatatctactgaacaaagttctggtattatttatcagctaaaccaagcaagagagactgaggatggaacggaatttgatagaggaatgatatttggacattccattattttaaatgatagagcaatgataccaccaagagaatttggctctgcaaacatgtccaaattggaactcccactcctgagcaataagtctttgaatgatggagcagttcgaacggtgcgaaatgcgaaaagaaccaatgaatctgaaaagcgggccccacatcgagccacgtatgacataaatctttcttcttcttcgtcgtcgtcgttggtcttcaccgccaacaacctctcctcctcgttttcagggccgtttcatccgtttggtggcgccgttgatattgtggtggtggaacagaaagatggtactttcaagtcctctccttggtacgttcgattcggcaaattccaaggggttttgaaggcaagggaaaaggttgttgatatctgtgtcaatggggttcaagctgacttccaaatgcatcttgatcatacaggggaagccttttttctcagggaaatcgatgcacaaggacaagaagaagaagatgctattttgatgtttccgtcttcttccgctgatgatgaggcagatgatcactctcgctctcactctctcaggtccaagagtttgaattatgatgctgcagctgctgctgaggttgtgggaaggactactagttctcgccgctcccggatacttggccttgtctttgggagaaggtctttgaagagggaagatggtggggctgttggtgatggtgatggaactgagaacagggttggttccttggagcgggcccagattgcggctaacttgttagacatcaagtggtccaccaatctctccgcggaacaagggcaagatgctcttgctaacccgtctggggatggtgaggtggttgtggagaatggtgaattgaatgaggaatcttgttttgatggtgagtgtgacttgaatgggaaggaagtcatgtatgatactgcagggtctgatgtgcaagttgcatgtgtggagatggaggttgaggcatgcgtagaaaagggattgaatggagaagagctttctattgatgcgccgggtaaaaatagtaatgaaacatcatcagagacttccaagttgggcgtggattgttctagtgaacaagctcacggggaagttaatgtccatgtccacgatgatgaagtcttgcatggttctgcaactgtactgctagctgaggatacagaagctgaggaagttattgagaatgctgctcttgagttttattctcgggttcagcaaacagctagttcagattctgatgatgttaggtacaatgaggtggttgttgaagagcaaccaacatctccaaaacctcaaactgtcaaaatgagcctaggacattattcaaatgagaaaaaagttgagccaaattgtgttatcaaaaatgtctctagcacactatcatctccaagtaaagcatcaaggagatcatcatcaccaagttcagaggacgaaaatttcctttttagtgaccttgacaaaagtgtaatcaatgatcgattcgagagatcattctcccctgaacatgtagataaagaagatcatgtttcttatgggaatgacactgaaaagttaacagcaatatccaatcccatagtcattcccagaaccatagctgcggtggaggaagttgtgcagctttcgggatccttgccaaatatttcttctggtagtgacatcatggtcgaatacgatgttcattatcctttgagtcaatcactggactcaaattccacatccttgccatgggcatttcctggaaaagatgacttggaatgtctaaaatcagatgaagacaaaagaaaccagttaccacatgaggagcaaggtgctaaggattacaatgattctggggaattcaaagggatgggagctgactgtaattcaaaagcattcaatgctgaatatctggttggcatggtgtcttttgaaagtccatatatatttaaactgaaaggcatgataccagctgaccaagttgagaaaaatcatacaggagatccatcaacacacaacccttcccctggtggaagttggagaatttggcctttctccttgaggagagcaggatctagcaagtctatgttgccgccttctccaagtaatgccaacaacgctacttttgttaattctccagagaatacgactagtactgatatgaacaaaaatgagctcaaacccaatttaatgaaaaagaaggttaaggaaatgactccaacctctgaacagctagcctcattgaatctgaaggatgggatgaatactgtaaccttcaccttctctacagctgtgctggggaagcagcaggttgactgtcgaatctatttgtggaaatggaacactcgtatagtgatctcagatgtggatggtacaattacaaggtcagatgttcttggtcagttcatgcctttggttggtattgactggtcacagacaggtgttgcacatttattctccgcaatcaaggaaaatggttaccaactgctttttctcagtgctcgttcaatttctcaggcctatattacacggcaattcttagttaaccttaaacaggatggaaaagttttaccagatggtcctgttgttatttcccctgatggactttttccctctctatatcgagaagttattaggagggttcctcatgaattcaaaattgcatgcttagaggacatcaaggcactttttccttctgatagcagtccattctatgctggttttggtaatagggatactgatgaaatcagctaccttaaggttggaattcccctaggaaaaatcttcattattaatcccaggggagaggtggttgtaaaccgtcgtgttgacacaaaatcatatacttctctgcatgctctcgtgaatggaatgttcccccctactagctcttctgagcaggaggactttaactcatggaatttctggaaactaccccctcctgccatggatatttga

SEQ ID NO: 9566 - DNA, 651 bp, Glycine max
  Peptide Sequence Number=SeqID_101251
atggtttccaacctcccttcttcgtcccctccctttcccggcatctccctctgccatgcggccctcatcgacgcctaccgcaccaacctcaaggccacccactggcaagaggtggtcaatgctgtcacggtgcagtgtcccaacgcctcccccatggggaaaatcgtcgtgcagtgtcgccatgtcgacgagcacgttggagtggcaatggagcacgacgaatgcagagggcttgagaagctcacggttgatggtgttgaggattcttgcgtagagctcgcacttgacagtcttttgctcgtccttctgctcacgcttgaagccaccgccattcctctcgtcgaccaacttgactttgagaaggcgctcggccccgatgcgcgtccaccgcttctacagctggctcctgaccccatgcgcgtcgcccgcgagttcgccattgtcctcggatccacacgcacaacatcattcgtcacccgctcgcgcgccggaacaaagtcgccgccgtgtgcaggagcggtggctccggtttcatggaagctgttgtattggcaagacaacatcattcttcaggacgctgttgaatatgccagggtttccttaatgttgggttttcctacgcctcttcaattccccatgcttcgatattaa

SEQ ID NO: 9567 - DNA, 717 bp, Glycine max
  Peptide Sequence Number=SeqID_101252
atggcccatttttctctctcccctctctcctgtgcaccttctcctctaccaccacgccgccgaatctttctctctcctcctcgagccgccgcatcttccgccaccgacgtcgtttccacttccacttccacttcatcttctgcttcgaatttcgcgcccaaagtcgttgtcaccagagagcgcggcaagaacgccaagcttatcgctgctctgatcactataggttgttcaagtgtagatgagtttatggctagtggacatcaggctaaacatgaaatcaattgtttggagcttccactcattgagcacatgcaaggacctgatttagataggcttccttctgtattaggtgacaatgcatttgattgggttgtgataacgtctcctgaggcaggctcagtctttctagaggcatggagggcgagccctggtgcagcggtaaagttgtgccttggtgacttgttggtcatgggttcgaatccggaaacagcctctttgcatatgcaaggagcttctgggatgcctcatgtcaaaataggtgttgttggggctggcactgcaagcattttcaaggaagctttgcagtcttccaaccgatcccttgatattgcctttgtgccatcaaaagttttagtctctactcctgcttttttgttaaagattgacctctacagctctactgttacatctttgttaacatcgtcaatctgtggctga

SEQ ID NO: 9568 - DNA, 1719 bp, Glycine max
  Peptide Sequence Number=SeqID_101253
atgggaatctgcagaaatatgggtacccaaccaagggtacaaagaaggctaggaggaaacagagctgcactttttgtatatgctatggaaggactagagaacatggcttttgttgctaatgctgtgagcctagtaacttacttctttgggtacatgaacttcagcttaacaaaatctgccacaaccctgaccaactttttgggaactgcatttttactagcactggttggtggattaatcagtgacacctatctttctaggttcaagacttgtgttctgtttgcatgcatggaattgctgggatatggtatcctcacagttcaagcacgcttccaccaattaagacccatcccctgcaaagatctggcaccaacccaaatgagtcaatgtgaggctgctacaggtggccatgctgcaatactttatactggcctataccttgttgctttaggaaccggtggtattaaggcagctttaccagccttaggggctgatcaatttgatgaaaaagatcccaaggaggcagctcaactgtcaagcttcttcaactggttcttgttcagccttaccataggagcaataattggtgttactttcattgtttggattggtgtcaacctaggatgggattggagttttattgtatgcacattaacaattctattcgcaattgtcttcatatgcatgggcaactcattgtaccgaaacaatgttccaaagggaagccctctaattcgaatcatccaggtgtttgtggcagcctttagaaacagaaaacttccgattccagataatacagacaaactacatgagattcatgaaaagcgaggaggggacaattttgaaatccttaaaagaacagatcaattcagattctttgaccgggcagcaattgctagaagcagcacaggtgcagcaacaaactcaggaccctggagactttgcacagtgacacaagtggaagaaacaaaaatcctaatccgcatgctaccaataatagtcagcaccatatttatgaacacgtgtttagctcaacttcagactttcactatacaacaaagcaccaccatgaacaccaacctaggggggtttaaagtgccaggaccctctgtcccagtcatccctttgatgttcatgtttgtcctaatccctttatacgaccgtgttttcgtcccgctggctcgaagaatcacggggattcccaccggaattcgacaccttcagaggattggaattggtttggttctgtctgctgtttccatggcagtggctggttttgtggaaacacaccgcaagtccgtggccataaagcacaacatggtggatagcagagagcctttgccaataagtgtgttctggctgggtttccaatatgctatttttggagctgcagacatgtttaccctgatagggcttttggagtttttctatgcagaaagttcagctggaatgaagtcacttggcactgcaatctcgtggtgttccgtcgcattcggttacttcacgagcacggtggtcgttgaggtggttaacaaagtgagtggagggtggctggctaataacaacttgaatagagacaacctcaactacttctactggttgttgtctgtgttaagtgttgtaaactttggattttacttggtttgtgcttcttggtatagatataaaacggtggaaaacgagcaagatgattcaaaagataatgttgacatggcctag

SEQ ID NO: 9569 - DNA, 195 bp, Glycine max
  Peptide Sequence Number=SeqID_101254
atgtataaggagagagggaggggtagcgtgaccccgaggggagagggagggaggaagcaaaaggaagatgaaggtgaatgggaggagaagaagaaatgtcggggggaaaaagaaggaggagaagaagaaaaaagaaagaaaaaggaagtgtattgggaaggaagtacattggagtggggaggaaaaaaaaattaa

SEQ ID NO: 9570 - DNA, 2640 bp, Glycine max
  Peptide Sequence Number=SeqID_101255
atgtcatggctggctcgttccttcgcaagctctctccgactcgatgacgacgaaaacgacatcgtactggatccacctaccacgtcatcgagagaacccccgcaacagcaacacgaggcacgagaaaatgcattcggatcagaagaagctgaagaagaagaagacgacgacgaagagacgcaagagcgtggtggagtcaaagaggacctcgacgaaatcaaggaaaccctaactcgtcaattttggggaatggcctccttcctcgctccaccgccatcagattctcattctccatccgatccctcttcgttcgtttccgatcaatccaatcatcgcgctgtttctccgaacgaagtaccgcaattggatgacgctgcgatttccaatcactctaattcggtttcggtgggatccgattcggatggggattgtggtctcgcgcaacgcgcggttggaattaccgaagaggtgctggtcttcgcgatgaacattgctatgcatcccgagacgtggttggattttcctattgatgaggaagacgacaccgatgattttgacatgtctggtgcacaacaagagcatgctgcggttgttgaaagattgactcccagattagctgcgcttagaattgaactgtgcccttgtcatatgagtgaaagttacttctggaaagtgtattttgttcttttgcattcaaggcttaataaggaagatgcagggattttgtctacaccccaggtcatggcagcaagagcaatgtggatgcaggaattgcataaacaaacaaagcctgaatttgaaatttccggaagaagtgtttcctactcaagagacaatgcagcacaacacaatgatttttctcccgacttattagatgacacttattctgatgacatgcctagtcagacatatggatatagaacaacctctttgtccatgttgtcagattgtgagactgataagcacatggttgaaagttctggaacacatttcactgataagtctgttattgagaaaaattccattattaaaactgaaaacaaggatctaaaatgtggtcagccctctcaaattattattcaggattatgatgatgatgatggtgatgaatggccagaggaagattctgatttagggggatatggtggaacaactcatcccatggtgaatgaagaagacatatctttcagtgatctggaggatgatgattatggcattaaacccgttagttccagtacaggttcaaaggtggtgaattgtgctatcttagctgcaacaaaggacgaggagttcaacaaccctgtatttggcgcgagtctccaattctctcgaagaaacaaaaagtaccttctcctaattgctttattcggcgcctccggttacggtgcctacagggcctacaattcaccctatgtcgctcagaaacgatgccgtatcgccaagctcctcagagccttcgtttccgtcgccgagttaatttccaactccgcggacaccgttaccgttatctctaacgacttgaaccgtttcctcgcttccgaatccgacgaaatcccaaacagtttgaagcagttagccaaaatagcaaaatccaacgagttctccatgtcgttggctagggtttccgaggctgtgacgcttgggattttgctagggtataaatcacagcctggtaacgataaaaaagatacgaaaatcaccgcggaagcttctggattctcggatagggtgttggagaggtttttctccaaggctggaacgggttttgtgtctgttgtggttggaagctttgcgaggaacttggttttgggtttctacgacgccgaaccggtcggtgcgagattccaatcggatgttcctggatgggtgaatgtgatttgtgatgagaggtgtgggaagcttataggggattgtgtgcagacttttgtgagtaccgctgttgctgtttttcttgataagacaatggatgtcaatacctatgacgaaatgtttgccgggttgtcaaatccgaagcaccaggaaaatgtgaaggggattttggtttccatgtgtaatggtgctatggaaacctttgttagaacctctcaccaggttctgactaacggaactgcgaggccgaatacgggtttgtctgtggctcctgttgttgttccggtgagtgaagatgggtgcctgaaaccggaggtgtttcagctcaaaattggaagcttgattaatggtgttcaggatgttgggtggcttgaacagatcaagtcagtgctgtcggtgcctgcaaaccggaggttcgtgcttgatgtcacagggagagtgacgtttgaaactgtgaggtcgttcgtggcgtttttggtttggagaatatcagatggattcaagaggagtgttagtaaggttcatgaagaggttatgggcaaaggactggaggtggttagatatgttggagctaagtcatcggttattcttaccttgtgccttgctttgtatttgcatattatgggtgatttcatagcagatttgactctctgcactgctaactggaactggctgccaggtatgtggctgccaggaattgaacacggtaccagaaagtttacaacactcacatgtcctgctcaatcaactgagctagaccgccttccctag

SEQ ID NO: 9571 - DNA, 747 bp, Glycine max
  Peptide Sequence Number=SeqID_101256
atgacggtctttcatttcttcaattgcgcgattctcaccttcggcccccacgccgtctactattctgccacgcccttatctgagtatgatacactcggcacctctatcaaagccgctgttgtttatcttgcaacggcattagtgaagcttatttgtctagctacttttctcaaggtatcagagagcgatagctttgatccgtatcaggttacagttgcatatattgataaagaaagagaatggtatgcaaaaatgagaactgggcaggagtttttgaaggcgttaataggttttatagatgttgctgggctttattttgccttgacccagttgactcacaggaacatctctcagaatcataaatttcaagcagttggacttggctgggcatttgctgactctgtgctgcatcggttggctccactttgggttggtgccagaggattagaatttacttgggattacattcttcagggccttgaggctaatgcaaatttggtgttgagcatatcccttgctgcacttggatctttgatgtggcttcgaaaaaataaacccaagaccctcatccctattatatatttgagtgcagggattgtagcaaccatgccatctatcacaagctatctgaggcgtggattggggtggcactttcccaaagtggtcggttttgagctcttcacatccctggtgatggcttttataagctggcaactgttttctgtatgtcagagaccttcagtgtga

SEQ ID NO: 9572 - DNA, 2796 bp, Glycine max
  Peptide Sequence Number=SeqID_101257
atggttaaaaaaggaagttgttctccacccactccttcacccaatctatttgatttcttcttcttcttcttccgttcactgtcagtgtcctctctctgttcgcccattccagagatcagaaagaggaaccagcctatcgcatatccaccgcaacgccaacgacttcaaagctcctcttgctctctctcagcctcgccacgcgccaacaccacactctctctctacaaaaatcagagtcctcgcttctcacttcgaacattgcttattcatctctctcgaatcgaaatctctgttcgtcactcctttctccgcatcgtcgaacgtccaaaatgcatctcagccagagattctcgcgcgttccgaagccgatcgaaaattcgccggcgaattgatggaatcggagagattatattgatattggcatgggtggaggcccacaatgcgaagtcccatgaacaccaacttcaattgggaggcttggagaggaataccgagaacattgcctcacactcttgcatacatgaccagattcttgaacagaggaagcgacctggtcgcaaggtgtattcaattaccccacaggtttatgagcctggtcgcttgaaaccccctcagcataaaggtaggacattacttgatgtgtcaacatcatcaaggcctcaagaggatgcaaagaagcctattaggatatatctaaattatgatgctgttggccactcccctgacagggattgtcgagcaattggcgatattgtcaaacttggggagcctcccatgacttctcctggttttccttcttgcaatcctcatgctattcctccaatctttggtgattgttggtataactgcacttctgaagatatctcagaagatgacaaaaaatgtcgccttcgtaaggcattaggtcagacagctgactggtttaggagagcattggctgttgagcctgtcaaggggaacctgcggttgagtggatattctgcgtgtggacaagatggaggtgtgcagcttcctcgtggatatattgaggagggtgtatctgatgccgacttggttcttttggtgactacaagacctacaactggaaatacacttgcctgggcagtggcatgtgaacgagatcaatggggtcgtgctatagctggacatgttaatgttgcgcctcgccatttgactgccgaggcagagactttgctttcagctactctgatacatgaggttatgcatgttcttggttttgatccacatgcctttgctcattttagagatgaaaggaaaagacggcgtaatcaggttactgaacaagttatggatgaaaaacttggacgaatggcaacacgtgtggtgcttcctcgtgttgtcatgcattctcgatatcattatgcggctttctcaggaaatttttctggtttagagctggaagatggtggaggacgtggcacatcaggatctcactgggaaaaaaggcttcttatgaatgagattatgactggttctgtggatacaagatctgttgtttcaaaaatgacattagctctattagaagatagtgggtggtacaaggccaattatagtatggcagaccatcttgattggggtcgcaaccaaggtactgagtttgttacctctccttgcaatctatgggagggagcctatcgttgcaacacaacacagttttctggctgtacgtataacagggaggcagagggatactgccccatcctaacttatagtggagatctccctcggtgggctcggtattttcctcaagctaataagggtggacaatcctcgttggctgattattgcacttattttgttgcttactctgatggatcatgtacagacactaacagtgcacgagcacctgacagaatgctaggtgaagtcagaggaagtaactctaggtgtatggcttcatcactagtacgcacaggctttgtacgaggttctatgacccagggaaatggttgctatcagcacagacattcatcggatggagattttactgttaaatcaacctatcatcaagcgacacatcctcaaggatgggtgccaccaatctctagtgaaatcccgagagatatgtggaagatgttttggaaaattaaatcaattctgaaatgtttgaatttgtcttggagagcatgtaaaagtgttctccctgtcatgaaaaatctgtcttcaaggggattggaagttgatataagatgcccttgttgtggtgaaagagaggaaactgttatgcatgctctccttctttgtgaagaagtcaaccagatctggtttgcatcacatcttggaggtagagttttaatcaatgatgatgttccttttgttgtttggttctatgattgggatcatttgggtcaagtattggcagcagcttcaatgttagtccctagtgtctatcagcctcatattggtgaagcagttgcttttagatgggccttggagacagctagacacctttctttttccagaattctttttgaaactgattgtcttagaatagtacctcaatggaaaaacaggcatactcagaacaatagctattttgctggtcttatacaggactgtgctattctggcaggtccaaattttgttgaaaatataacttatagatctacaaatagagtagctcatgaactagctagattagcttttactgtaaaggattttgtttggatagaggaggccccttgttgtgtggagcccctcattgatgctgatgtaaggcctttggcccttgttgaatgcaaaggtctcatttcaaaaaaagaatatttgttgtag

SEQ ID NO: 9573 - DNA, 576 bp, Glycine max
  Peptide Sequence Number=SeqID_101258
atgtgggaatggggcctgttgggtactataatgcccatacctgcacctatccccattgaattttgcgggtttttcattgccttcagtttcatctcttttgagcggttatttactctacatgtggttcttacaaatggtattgaagtgaagctacaaaggaatgctcttagcgtgattgaagcacccaccggtaacgaggaagatgatgaccttgagtttgaaaatatgccgtggaatggatcagatttggcatcggacgatacacagaagttccacaagccgaggcatagaatgcatagaacattgggatcatctcacaagaccatgagtaggtcattctctggcgattcacagtcaaagggctccgtttctatgcctcatgggtccacgaaggtagacttgagcaaacttgaaatggctgcattgtggagatattggcgacattttaatctagtggatgcggtcccaaacccatcaaaagagcagctagtagatgttgttcagaggcatttcatgtcgcaggtgattgtgggattcgtccaagctgcaaagaggcttaagactgtgtgcaaatga

SEQ ID NO: 9574 - DNA, 225 bp, Glycine max
  Peptide Sequence Number=SeqID_101259
atggaaagttcggtcaatggtgggttcacccatttgcagagctgtggagatagcagcgaagaagagttatcggtgcttcctcgtcacaccaaagtggtcgtaacaggaaataaccgcaccaaatcggtgctcgtcggtcttcaaggtgttgttaagaaggccgttggactaggtggatggcattggctgaatttcaaatgcttggtactttctgttgcggattga

SEQ ID NO: 9575 - DNA, 2154 bp, Glycine max
  Peptide Sequence Number=SeqID_101260
atggagagcgacgacgacttcgaccttttgcctccctcccccatccaagaacgaaagctgaagcgattgaagcaagcagatagggttcccgaaccttctcaccttcctatctctcctcccaatttttccgaatcaggaaacggcgaagaacacttgacgcagtcaaacggcagatctgggcctgaaattgaaactttagccacaagcccgagcccgagcccgagctctcaatctgacactccgaaaggtgtaactgtcgacgacgatggtttggtcgcgaaaagggctctggattttgattctttgagtgaggaacacgggaagattgccgaggagagtgaagaagttagggatctgaagaccaacgaagaaatcggtgatttgaataccggcgaagtagagaggaaacgacgtagtttagatgacttaccagagaagaacggaaagaagaagaagagaatcgaccacgacggtgatggtagtgagaagaagcctaacgaatctgccaccaataagagaaagaccgagaaggaacgacgagatactctgaaacagcttcgagcggagtctcataggcttcttcgagaaactagagatgcagcttttaaacctgctcctctggttcagaagccaatttcttcgatcttggagaaaattcggcagaggaaattggagattttacagaaatctgctgataatgtagaaaaggctgggccagaagaaacaccagctacttgccctgcagccactaggactaatttggacacgtcacatattggtgaagaatctaatgatgctgcagctagttctaactctcggagcattccttctcccatgaccaaggattcagaatctgagcatgcatttcgagctcctattggtgatactcaggaactctacactgactctgaaagaaacgatactaaagatgaggctgtaaatgagaagtctaacaacccttccgaagaagtgtttgccccattgatgcttgcaatgaacttgaagcttgattctgctcctcctgatgattatgtctcttccgatgaggaggaggaagacaatgacaaggagaatatagagccatgtgtacatgtatcagttgactcgactttaccaccaaatggtgaccctgttagggcttttgttgatgaagaagcagaagaggaagatgacagtgataatgaactacaacttttccaagatgatgaaggtgaagaagatgatgatgatattgaggaagatgatatgattgccactcaatatgaagaaaagccagatgatagagaaaagcatgaccaactccaccagcagtggcttgagcaacaggatgcagctggaatggataatctacatcagaaattcaattgtggttcaaaattgaatgaaacaccatcaactgaagaggaagatgaggaaagcagagaaactgtaaatgatgatgaagctgaagaatacactgcaccatcaaaaagtctgagggtcactctgaaaaaggtgaagcagatgatcccgcagatgttttcagataaagatgataaatatgtatcatctgatgatgaagaaactgaggacaagctagccagacaatccctctattataaaactgaggaaaaagctaaattcttttcaccaggtgaggacgaaaatagcagggaagttttcagtctaataaagaaatttaatgtgcccgatatcaagagaaaaggaaaaactacttccatctttgctatgccgagcattggacagaacataaatatatcatcaaagtcatcttttgttggccgggcttcagatcattttatgcccacttctcgaaagcagggatcatgtaaggtccgatcatatatatttgggcgagatgacagcaacagcaggagttcaatattgatgtcagaggattcttcagatacgattcaaacggagagtcaaccaccaaaagcggcttctgccaagtttcaaagaaatatgcagaacaaaaacaccaccttgaattctgcatctaaagagtctagtgtgtcacttttggatatattaaggaagtctttacatcatgcagatcacagttttcagaatgtcaacgttcaaccaaagacatcaatatttgatgcattcaagttagtgaagaagccaaccaaggcggaggcaagagtttga

SEQ ID NO: 9576 - DNA, 213 bp, Glycine max
  Peptide Sequence Number=SeqID_101261
atgggttcgaatccggaaacagcctctttgcatatacaagggaatattgttcacaagggatttcatcaggaggactgggagcaagcacaatatgcagcagcttttgagtgggaaggtttcaggaaattaaagccttcgtcactataccctccaacaacactctcgcgcgccgccgtagctagcctcgaacaagcttctcgcgcgccgccatag

SEQ ID NO: 9577 - DNA, 873 bp, Glycine max
  Peptide Sequence Number=SeqID_101262
atgggacctgttggtgttggagccttccctgatggagaatgggattgctttggcaaaatgttggctaatgaatcccattattgctcaccacaattactcggggaagatgatgggagtgttggaatgcaatccatgtttttcgccactcttgatgttgggggaaataagagtatgttttactcttttgactctcacaactctaatttgcagtatatttctcaagaaagcagtcacaataatagcacttgtagtgaccatagtgtcttcatgatcaatccggaggatcatacaaactaccattttggttatgttgatcatgtgctagcaaatagtacatccatggatttttgcatgatggatgagaaaaaccctggctcttgtgtccaatctgacattgtcatgaaagacaatcctgatgtgtccaaactcaaagtgcatgtagaagataaaataaactcacatgggaatggtaacaaaaaacctcgtgattcaaaagatgtgcaacattgcatgaagaaccagaaacttgagaaaaatgggaatcaggcagaagagattaatgccggttcagatcatggatgtagttctagtagtaacactctagaggatgataatgcttctcaagcaaacagtggaggagccacttctgctctcaacttaaaagggaaattaaacaaaaatagaagcagtatgcttgaagaagcagtccaatacatgaaatttttgcagctccagatcaaggtaataccagacaaatcgcgtaaaattgacaactctgatgatttgtggatgtacgctccgatagcttataatggacttgacctcgtactcaatctcaatcaccaagagttccccacctttgtgaccttataa

SEQ ID NO: 9578 - DNA, 987 bp, Glycine max
  Peptide Sequence Number=SeqID_101263
atggaccctagaatatggagcaaactacctcctgatgttgtagaacacatacttttgttacttcctctcaaaacactcttgaatctcagacccacttgcaaggccttcacctgtctcctcttttcaccttcatttgtttccaaacactcttcttctttatcttcttcctctttatcacccttctcttcctttctcttactctcccatcctcaattccctcactatttccgtctctacgattccaacctttgctcttggcgaaccctctctctctccctctccaactctctacccttctcttcttccttcactcttgtttcctcctctggtggcctcttttgtctcttcaaccccacctcttctacctttcttgtgtacaacctctttgtcaagtccttcagaaaaatcgaatccccaacaagtctttctctttatttgggacatgtcacttttgttaccacccctcttggctactacatagtacttcttcgttcaaagtcaacttccaacactagtgtctttgtttatgattctaacgaactctcttgtcggtcttttgagggtttcaatgctgttctcagcggcagtattcaccagcagggtactttcttcgatgggggcttgtatttcacaaccccggaaccattttcagtggtgcctattgatttggatagtggaagatgggagagacacgttgctgagttgccacaacaagtcactttcatgaggctggtgagtgatggagaagggaagttgtacttgcttagtggtattgggaacgatggaatcttgaggagcatcaagttgtgggaattaacaaagggtgaaagggtttgggtggaagtggtggtgttgcctgagattaggtgtaggaaatttgtgtggaggacttgggattggcttccaaggtgcccctatttgcctctcaaatctagctgtggtttcaagtggttttcttttgttccaaagctctatgcttcggtgtga

SEQ ID NO: 9579 - DNA, 1149 bp, Glycine max
  Peptide Sequence Number=SeqID_101264
atggtagaagctgcaatttccacgcccaaaaaagtcacgtctcgttacacctcatcatcatcatctcctcgctcaccttcgcctttcacgtccaaacggtcacagtcgctcgagcggagacgacccggaacgacagcgtcgtcgtctgggaaaatgcttctgacttcgacaacaacgaggagcttatccgtgtcgtttcagggcgagtcgttccggatcaccgtcaacaaagccaaaccaacaaccacaaacgttgctgtccctgctcccaaactcctcgcgccgagaaagtcagtgttgaatggtgcatcgtctccactaggagttgtgaatagcagaggccaagtttcttatattcgtcccgcttcacccaacaaggtaccttcatcttcccgaggtgtgagtcccttgaggctcagaaacggagcttcccctaatggtttcagcagcatcaacgagtcttctattttgacctttgccattgatgttaagagagggagggtcggagaaaaccgaattttcgaggcgcattcgctgaggcttctctataaccgcctcttgcaatggcgttttgtcaacgcccgagcagattctgacctctctgtgcagaaatccaatgctcagaattgtctctatgatgcttgggcatctaccactaaactacgagaatctgtgagtgctaaaaggagagagttacaattgctgaagcataagttgaagctaattttcatcctcaaggaccaaatgatgtatttggaagattgggctaatttggatcgagtttacacaaattcactttcgggagctattgaagcactaaaggctagtactctccgccttcctgttgttgatggggccaaggcagatgtactgaaagtgaaggatgctgtttgttcagcggtggatgtaatgaaggctatggcatcctccatatgcctattgtttccaaaggttggacatgtaaactcgttggtagttgaaattgctaacttgagtacaaaggagcatgttttgcttgatgaatgcagagaccttttatcaatgattacagccatgcaggcgtggaacccacttctagtggaggaaactcatgccttagacatggcaacagggcggggtcgggttttgtttatcccaccccgtccctga

SEQ ID NO: 9580 - DNA, 1290 bp, Glycine max
  Peptide Sequence Number=SeqID_101265
atggtgtttgggcaaatagtggttggtcctcctggctctggcaaaacaacttactgcaatggcatgtctcagtttcttagtcttattggaaggaaggttgctgttatcaatttggatcctgctaatgattcgttaccgtatccttccctttacctctttcagacatcatttttctcaaaggatcttgtgaaactaagtgatgtaatggtggaacattcgcttggaccaaatgggggtcttgtgtattgtatggattatcttgagaaaaatattgactggttggaagcaaaattggaacctcttctgaaagtgcatttgattgatgcccatctttgcagtgaccctgggaagtatattagtgcattgcttttatccttgtccacaatgctacatctagaactccctcacataaatgtcttgtcaaaaattgatttaattgagagctatggaaagctagcctttaaccttgatttctatacagacgtgcaagacttgtcatatttacaataccatcttgatcaggatcctcgctctgctaagtacagtttccatcaccaagaagaagatgtaccatgttcaagccccaagaagtactccaggagaaaagaaagtaggaatattaacaaaaacccatactccaatcgaggcttagacaagttttctgcacttttggctgatcttgacgagagaaggcaaaaggtttactcacagatgagtcctcaggacatatcttttgttcggtttgcgtattccagcaatgatgatttcgttcccatagtggtcaaagtgaaaaaaaataataaggatcagaagaagcacaagagtgaagaactcaaagcaagacacataacatctttctcggagcaattggagaaatcttctgaagaaacaaccttggaagaaaggaagcaaaaactcaataagttggaagctcataagaagaagaatttgagcttttcttggaacgtgttgaagagaccatctttctatgtgccagcggttgtgatgttgattttggtttttttggttgttcttgggagatcggttgctacactttgcacttgtgttgtgtggtatgtggtccccacattgagtgaatattatgatagttcaaaaccaagaaacaaatcgatgatgatgaattctaagaagagagattatgttagggggtggctgaatgatgtgaagatggtgaatcctgaagatttagcttctccaagaagtggtgattccaaggcttattcaaatgacaataattcagggaaacatggccaccagaaaagtttgtga

SEQ ID NO: 9581 - DNA, 366 bp, Glycine max
  Peptide Sequence Number=SeqID_101266
atggttattacaaccttcaacggaaccggcgttggatttggtacgctggtttgggtttcacgatttctgcatattcggaatctcgattccctctcacacgctaaattttctttttcaggtttcggcgtaggttgcggtttcggtataggatggggtttcggaggtatgccattgaacttattgggtcttggtgcaggtggaggttgtggcgttggagtagggcttggttgggggtttggtactgcctttggtagcaagtatcgttcctcacgggtcacatttcaaggagtggattttgatagcaaggagaaagttaacagcacggagttgtcaaaacccaggaccgaagttggaggtgcacggtag

SEQ ID NO: 9582 - DNA, 492 bp, Glycine max
  Peptide Sequence Number=SeqID_101267
atggtgtcgctgttcaagggctgtgactaccatcattggctcgtcgtcatccatgagtccgccggcaaaggctgcaccaagccacaaatgattgattgctacattcaaaccctcgccaaggttcttggaagttcaagtagaagaataggaaaagaatgtgttgatgtcgcggtgggttcttacatggtgttgtcaaaggagtctacagggtgttgtgaattggggcatgatgcaggaagtcttataacaagatgggaagggcttgagtattatgatcagagatgggtagaggtgaacttgcaaggagcttctaatgtatatggcggctgctatgactgggaaggggggattgttttgccatttgaagatgtggtccctcaccttggcttagtaagtagtaacttaggtgctcatttctcttcagctattaaatcttatttagcaagttgggaattgtgggctaatgttatgatcctagagttcgaggattga

SEQ ID NO: 9583 - DNA, 861 bp, Glycine max
  Peptide Sequence Number=SeqID_101268
atggcgtcgagttttgatcgatgggaaaaagatcctttctttaacgcggccgaagaagttcaggaatctgcagacaggatggaatctacatatagaacatggattcatgcaaggagagatgcgtccagcccatggaactgtgatgaactccgccgagatctagaaactactcttggcactgctaaatggcagcacgtggttgcatttggatggacaatgcagttagaggaatttgaacgggcagctaggtcaagttatagcagagtttcaagtgaggatgcgagaaatagacaccgggattttattcatgccattggtgacaagattcagaaagttgaacattcgttacaagaatctgttcattcaggtagcaaggcatctctgccttggacgcgtctggatgaaggagaacgagatgagcttgcgtcgtttctttcgggaataccggttctcattaaatgtgttggcagagacaatgaaagtctgcaagctaattgttcaagcaatttacatgtttcatctgggtggggttcgtccgaagcagcgctggagaaatcacgtgggcatcgcagggcagctagtgctgatgctgatattggtacttggaaaatcactgtttctgacgatgtgcaacaatctagttcctccaatggttcttctggtcctactcctatgcataaggtagccagtctctctggattttttggttctatggaaaccatctctaagttcaagtggcctaagaatggttatagaaagctcaaagcggttaatccttgtgaagaagaggacaaggcactgctaccaccagctggattgaatgggagacttggttgtgtacttttaatgcttttgctttag

SEQ ID NO: 9584 - DNA, 2832 bp, Glycine max
  Peptide Sequence Number=SeqID_101269
atgggaaaacgtaattctcaacgtaaaagtgctgcgatgttcgatagtgatgacgatagtagcgtgacttcgtcgtcaactgctcgttctgatttgatgtcggtgtctggggctgaagatgttcaatttgttcaagattccttgctcgaccaagctctcgacgcattagatgagaaaaggggttccacgagggagaaagctttgtcatcgatcattgacgctttcaatagcaacatgcagcatgagtttgtggagaagaaatttgctaccttactacatcaatgtcttgcttcaataaaaaagggatccaaaaaggcatctgctaaggagatagctttggcatctcatgccattggttgtttggccttgactgtcggatgcggtgacaatgcccgtgagatatttgaagaatccattcgtcctttggatgaatctctcacatctaggatagatgtttcaaagacaccatcattactggagtgtttggctataatcacttttgttggagggaatgatcaagaagaaacagaacgatcaatggacataatgtggcgagtgattaatcccaaattaggttctaatgtagttgctgtcaaacctcctgcttcattaattgccaatgtggtgtctgcatggtcttttctcctctctactgtgagcaatttgaagctaaattcaaaaaactggcagaattcaatatcctatttatctagtcttctagacaaggaagataggtctgtacgaattgctgctggtgaagcactagctctaatttttgaaattggagttatagataaattttctgctgagttagacagtgcaagtgatacaacgcaagggagtaaaccacttgaaagctacatatttttacaaggattgaaaggaaaggtgataaatcaatgcaaaaatctttctacagaggctggtggaaaaggttctgcaaagaaagatcttaatagtcagaggaacttgtttcgagatatcttggatttttttgagtatggttactccccggatatttcaatgaagattggtggtgattccctgcaggcatcatcatggtctgaaatgatgcagttgaattttatcaagcattttcttgggggaggattcatcaagcatatgcaggaaaatgagttcctacatgaagtctttggtttctcaccgaagagaaagtatcttaataccaacgaacacagaatgtctggtggtgaaaagagaatgtttaagtctccaaattcgtttttgaacaaggctaggacgcaatcacttaataagcagcggatattatctgagggaaaatgggcctccaaaagtgagaccttgattgggccggcgaatgatggagttgcagatgttgagaagtgtaagacagagcggatcagagacagggaagctgggaaactgcatgcaagccatttcgccaaccgcataaaatggaatcgcatttcgcaactccaattatccaatcacaaagacatcgtctcacctcacaaaggcgccatcaactcccttcagattgattccacggagggaagatatttgctatccgccgcctccgatgcctcggtagcagtctacgacgtccaacgacccaccgtttacgaagccggcggcgtcatttcgaaacacagctctatatttgtcgttgacaagcagcaccagcaagcccataaatatgcggtttcctcagctatatggtatcccattgacaccggcttgttcgtcactggctcatacgatcaccacattaatgtttgggataccaataccacccaggtggtggtaaatttcaaaatgcctggaaaggttcatagggctgcaatgtccaatttatcaacatctcacatgcttattgctgctgccactgaggatgtccaagttcgcctttgtgatattgcttccggagcctttgctcacactttgtccggtcaccgtgatggagtaatgactgttgaatggtctaattcaagtgaatgggtcttggttactgggggatgtgatggtgcaatacgattttgggacatcagacgcgctggctgtttccaagttttagatcaatctcggactcagcttggaagacgcccaaccatactcaatcactccatgataactaaggattcaagtacaaaattgagtgctgcgcagaagaaacatgctaatggaagtggtagcagacaacaactaattggcagagttccatccaagggaccaatgaagcagaaattacatccaggaatgttgtctactcaggatcgtgcgactgctcattatggtgctgtgacagggttaaaagccacagaggatggcatgtatctactaagtgcagggtctgattcaagattgaggttgtgggatgttgaatctggctgtgacacacttgtgaacttcgaaacagttcgcctgcaagtaaacaaacctcttcaactagccaccactcaagattcaacccttgtttttgttccatgcatgagatctgtgaaagcatttgacatgtggtctgggaacacatacacgatattacgtggtcactatgaatgtgtgaactcttgctggtttaatcaacaagatcagaagccaactgacaaaacacaaggtgaatcaaggagtcatcccggattcctggtattgattacactgaaaatattcatcgctgcttctttgaaagccatgacttgtctggactggagtcagtgttctgttggcaagaattgcaaggaactgtacactggtggaaatgatagacaaattcttgtctggtcacctgctaggtcaatggctgatgaaatggacgaaggacctgctgaggatcaggataactggagtagctga

SEQ ID NO: 9585 - DNA, 1149 bp, Glycine max
  Peptide Sequence Number=SeqID_101270
atgaggaagttgtgtcctaattttgacaatgaagatgggttggataccgtccttgaggttccaattcccgaggagatgttgtccggcatgggcagcaatggatccagtcgttggcagaacatgcgaactctcatgaatgctcgattcgttgataagtcttccggtctctcaacaccatcaaacaatgaattcatggtgttgcttaagcttgtgggtgctccccttattcctcttcaggttccatcagaccataatttgactcgccccctcaaagattgttccattagagattcgactgccaagtacatagttcagcagtacgtggcagcgacgggaggagtagctgcattgaattcactggaaagcatgtatgctatgggacaagtgagaatatgtggatcggaggtgcgtcgtcaaggtgatggatacgaagaaagcgttcaatcaagaggcaaaactgaagtgggaggctttgtattatggcagaagaaccctgatttatggtgtttggaattggtcgtttccggtttcaaggtcagtgctggcagtaatggtaagctagcttggaaccattcttcttctcaacctttccatgctaacaaaggtcctcccagacccctccgccgcttctttcagggactggacccaaggtgcacggctaacttgttcctagacgcagaatgtgtaggagagaacaacattaacaacgaggtttgcttcatgctcaggttacaaacggatcaacacattctgcaagcacaaagcatgtccaatactgaaatcgtaatgcacacaatgctgggttacttcagccaacgcacggggctactggtgaagtttgaggacacaaagttggtgaaaatgaaggccgttaaaggaaaagagacagtgttttgggaaacaagcatcgagtccatgattgatgattatagatacatagatggcattaacatagcgcatggtgggaggacaattgccacgctttataggtacggtgcggcgcataatcacaaacatatgattgaggaaacatggacgattgaagaggttgattttaacattgttgggttgtctatggattgctttctgcctccctctgatggtgagagagagcacgaaggtgcagagcaagcagtgggaatgggatag

SEQ ID NO: 9586 - DNA, 384 bp, Glycine max
  Peptide Sequence Number=SeqID_101271
catgagagagggagccatgaatatgatggtgattctggaaataccaacttcaagaggcacttcttgttatgggtcttagctgcggttattctcattgctctttggtccatgctcgctggctccgtcaccctcaaatggtcctcgagcaacaacgatgacttcgattctaccattcatgatgtgggagagagagagaaggtggtgaggcacatgtgggatgcgtacagccgcactcacacgaagtccgttggattacccaagttttggtgggaagcttttgaagctgcttacgagcaattgatgagtgatgttcctgccgtttcagaaattgccaagatgtctctgcggtctcttcctcttcaaattcaatcacactcggtataa

SEQ ID NO: 9587 - DNA, 654 bp, Glycine max
  Peptide Sequence Number=SeqID_101272
atggcatcctccgctctcatctccgacacccagccatggaaggacctcaaggcacacgtggatgacgtaaaaaaagcgcatcttcgcgatctattgagcgacgataagcggtgccagtccatgctcgttgaattcgatgacattctgctggactatgcaaggcaacaagccactcccgaaactatccagaagctatttgagttagcggaggctgcatcgctcaaagaaaagattaatcgcatgtacagcggggaacatataaatagcacagaaaataggtcagtgcttcatgtcgctcttcatgcttctagagatgttgtcattgagagtgatgggaagaatgttgtccctgaagtttggaaagttcttgacaagatccaggatttctctgagcgggttggtgctacagggaaggctttgaaggacgctgttgcagttggtattgggggaaacttcttaggtccactgtttgtacacactgcacttcaaacaggttgggtgattattgctagtctctttagtagcaattccaccataattggccttttatttgtgttgacacttaatgtaaaaattcttaagggatttcctagactatcaatgataggaaacaacaggatcttgaaatctatggttctcacaaacaatcaataa

SEQ ID NO: 9588 - DNA, 1896 bp, Glycine max
  Peptide Sequence Number=SeqID_101273
atgccatacaagtacgagaattatgacccctcattccccgaccaacccgtggttgacttatacctcccagtttgggccaggttacctgccttcaagtccaagccagctttcatttgggcacaagacttgcacaccttcactgctctcacctaccaacaacttaacgccacagttgatgtcatctcctctcgactactcgctccgttacaacgaggtgacactgttcttcttctttgctctcctggacttgacctagttgagctcatctttgcgtgtcaaagagctggtcttttgagcgttcccatcatccctcctcacccttcttttgctaaagaaaactatcaccatctcataagagccatttcgcagaccaaacccaaagctgccctagctcaccctcactacatatcaagcattagacaatacgtgtcttccccccacaacaacaagaaacttgctcacatgttacatagcatccactggatttccgtagacgaactcaaacatcatcatggtgttgttactttaaataatcttgattcactgacatacagtggttgcaaagcgaatgaagtttacttggttcagtacacgtctggtgccactggggttccaaaacccgtgcttgtcacagcgggctcagctgctcacaacgttagaacagcgagaaaagcttacgatcttcatcccaacagcacaatcgtttcgtggctgcctcagtatcatgattgtggtctcatgttcttgttgctgacccttgtatcaggagccacgtgtgttctcacttccccaacggcgttcatcaaacgccccagactctggcttgaactcttgtcgaaattcaaggccacgtgcactcccgttccctcgttcacattgccactcgtggtcaaacgaggaggaattcaccaaggagcttctacttcatccatcaacctttcaactttgaagaatctcataatcatcaacgagcccgtctatagagactcagtggaagaatttgttcacactttttctccatttgggttaagcccttcttctatctctccttcctacgggttagcagagaattgcacctttgtgtccactgcgtggaggagcgttaatagtgatcataatgatagtgttggtgcctattattcttcaagcttcccagattttcccactcacaacaagctcttaccagttgcaaggctcgaaaacgtggaagaggaagacgtggagattatggttgttgatgaagaaacgttggagccagctgaggatggtgttgaaggagaaatttgggttgcttcaccaagcaacgcttctgggtaccttggccaccctagtttaacaagagaagtgtttcatggaagactaagaaacatgattagcaagtgctttcttcgaactggggacagaggcatagtgaaaggagaaaaaagatatctttttgtcactggtcgctgtcaagacgttatggaactccgaaatggtcgaaaggttcatccacattacatagaaactgcggcttataacagttgccccaagttactgagaggaggttgtcttgcagcgtttaaagtttcatcaacggtggtggttgtggcagagatgcagaggatcgaaaagggtatagaaaaaggtgtgttgaagaggatttgcgagggagttaaagaagctgtttggaagaaagagaaggtggaggttggatgggtggttttggttgagagtgagtgtgttccgaaaaccacttctgggaaattgataagagggaaggctaaggagaagcttcttgcaggggaaatggtgattctgatgaagatgcggtttggaaaagatgttactgtttttaagagagcaaagaaggtaactggttcaattttatttgcagaagctcgtagctcattataa

SEQ ID NO: 9589 - DNA, 285 bp, Glycine max
  Peptide Sequence Number=SeqID_101274
atgggattagctatcaggcactgggtgttcgtgaagggtgaccatactaactttgagattgagccttcttttgggattgaggcttcggcgttgtacccggatgtcaagtacaccaccgtgaagaataccttgacacgttcgtttgagaatttagaaagcaaggattcacgagtaactctattagtactagttccagatgatgaggttggtaatggttctggggctggtgccgaggccagttcctcttcagacttggctagcggtgatgctgtttttatgctataa

SEQ ID NO: 9590 - DNA, 1590 bp, Glycine max
  Peptide Sequence Number=SeqID_101275
atggtgaatgaagaaaaagataaaaccaacaacgaaaaaaaagaacttaacagaagtagtgttggacatttaataaaattgttgggtgtaagaggaaatctacacctaagaaaatcccaaaagataatgaaactgttggaaaacgacaaggcccaacattcacccaaaaaaatatacaacaaggtccaacaaacccaagcagatgaaggatctgagccgcaattactggaactggacacagtagtattttttcagtgcattttagctgttaggcaaaaaagttgtcgaatggagatgattttaagggagaaggacgcaaatgagtgggtttaccgaggcgaaggagctgccaatcttgttctcgcatacaccggatcatctcctacgtttattgggaaagtgatgcgcattcgtaagtgtccaaggaatggcgcagagggtatgtgtatgaggagcccctctgctttgactgcgctcgaacgcctcctctggaaagacgttgatgaactcatttcatcttcggacaatgaaattgcatgccaattatttgcccaccacgttatgaagccattgcttggtcccaaatatgttgatgctgggatgcttgttgaggtgccaagggaatttctcgaattggttgaaaagaatgttattcgtcaacgtcctgcttggagagttgataatgctcgggtcgacatgcatcgtggttctgtgcttctcatgtctgatcattcagtcttcactcatggtaatctaggatctagcccctgcatatctgttgagataaagcccaaatgtggatttattcctctttcaagattcatatctgaaggaactgctatcaaaaggaggataactcgctttcaaatgcaccaagctctgaaattgcatcaaggagagatatcattgctaagtaaatacaatccacttgatctgttctctggatcaaaggaaagaatttataaagctatcaaggatctcttcactacacctcaaaacaattttcgtgtatttatgaatggctctctcatatttggtggtctgggaggtggtgcagaagatacaaactttggtattgctaaagcatttgaaaatgcacttaagtctgtcattcaagctgataatggtctgtgtacagagaacttgcttactcttgttgctgaggctgtaaaaaaatcgggagtccttgatcggctcctggatgttcagaagcttgataatgttgacatagaaggagccatccatgcttattatgacattacccgtcaacagtgcataatatgtagagaattgagtgaagagcaactgaaaagatatacctctttgcattcagcttcgttggatgaaagcttgagaattgtaaaggactacttaatagcagcaactgcaaaagactgcagttttatgatatgttttagacaaaggaaagcaggggattctggatctggatctatttgcagtaacatatatcttgagtcaactaagcaaacctttgacttcaaggtagacagtgcattgcatgattcatttggttcagcttctgctggtgctgttaaaaagctactgcaaaaggtcattcaggaatgttag

SEQ ID NO: 9591 - DNA, 1293 bp, Glycine max
  Peptide Sequence Number=SeqID_101276
atgatactgcagttcttcgtgctttcacagagaggcgataacatcgtctaccgcgactctcaaaagggaagcgctgagacatttttccgaaaagtcaagttctggaaagagaatgctgagggagatgctccacctgtttttgtagatggtgtgaactacttccacgtgaaggctgctggattgctatttgttgctactactagagtcaatgtctccccttctcttgttttggaactcttacaaagaattgcacgtgtcatcaaagattaccttggtgttctcaatgaagattcctttagaaagaacttcgtgctcgtttatgaattgctggatgaagtcatagattttggttatgtgcaaacaacatccactgaggttttgaagtcatatgttttcaatgagccaattgtgattgatgctgcacggatgcctccacttggccctgcttccatttttatgcaagggaccaaacgaatgccaggtacagctattacaaagtctgtggttactaatgaacctggtggaaggaagagggatgagatctttgttgatggatatatacttactagtgagatagatggaaccattcaaatgaagagttatcttactggtaacccggagattcgacttgctctcaatgaggacctgagtataggaacaagtgattatagaggttcaggtgctgtcattttagatgattgtaacttccatgagtctgtacaccttgatagttttgatgttgatagaactttgtcattggtacaaccagaaggtgaatttccagtcatgaattatcatatgactcaaccatttaagccaccctttcgtattaatgcattgattgaagaaacaggatccctaaatgctgaagtgaccattaaagtgcgagctgaattcaactcaagtatcaatgctaacactgttcttgtagagatgcctctgccatcatttacagctcggctaatacgagtcatattaatagataacaataatggctgctccatcctcttacaggttggtggtggatctgaacatactttacgagcaaagctaaccacaggaaatatcatgaaagaagcagggcctgttagcatggctttcaccatacctatgtacaatgcttcaaggcttcagctcaaaaacacgtttcctgtattttacaaagcaatgagaccgtgctttaaggaggcaaatgcgttaaggattaaggaaggtgttggtggatgctactgcgttaatggagtggtcgtggaaggcgtaatgaatttacccttttcgacaaaggatgagtga

SEQ ID NO: 9592 - DNA, 1212 bp, Glycine max
  Peptide Sequence Number=SeqID_101277
atgttgattcgacgattgccttggacggcgatttcttttgccgcaccacttcccttctgtttcggcgctaccaatggacttcccattcgcaagcaacttaactcttctctcttctccttcttctgctccagctccggcgtcaatctccctctacaacctggtcacgaaacggatactcgtcactcgcagtctctgaaacccggtctttacctcgttggaacgccaatcggaaatctcgaagatatcacactgagggctattcgcgtgctgaactcggctgacgtcatactctcagaggacactaggcactctgggaagttgcttcatcactacaacatcaaaacaccccttatgagttatcacaagttcaatgaatcgcatagggaacagcttgtgctgaggaggttgaagcagggtgagattgtggctctcataagtgatgctggaatgccaggtataagtgatcctggtacggagttggccaaattgtgtgttagtgagaatatcctggttgttccaatccctggtccctgtgctttggtgtcggctctttctgcctcgggtttacctactgacgaatttacatttggtaataagctggctaaactgaattttgtacattatggtattttggagcctaagatgggtgttgtgacgtataattttgtagttggttttcttcctaagcattcgggatcgagaagaaaaaggctcatggtttcagctgatcaaacaacaacacaaatattttacgttcctcctcacaagctttctcagttccttgatgagagttcttcaatttttggtgatgcaaggcaatgtgttattgctcgggaaatgactaagttacatgaagaggttgtgagagctattgatcgaagagaaatgaggaattttagcagaaaaatcccatatctagaaaagaaagaggaagctttgataggaagagaacaatctagaaaagaaagagaggtagggggaactttttggcatggtactcttggtgaagccaaggaagtattttctattcgtcaagtgaagggagaacttaccatattgatcgaagggaaagcaaattctaaagttgaacctccgtcagacactgagcttgagagtgaactaagagaactgattgctggtggcgagagtctttccacggtaatagcttccttatatctgtatgcattcaattttagttcaatagaagcttga

SEQ ID NO: 9593 - DNA, 1971 bp, Glycine max
  Peptide Sequence Number=SeqID_101278
atggcgaagcattcggtggcaatggcgaagaagcggtggccgataatgttggcggcattcttgtccgtctcaacagtgacggtgctcttaatgagatccaacaactccgattcctgcaacaccaaccattttactgttgcacaagataatcagattcgttcccctgtccaactcacaaatgcggcttccagtcccctaattttcatgaagtccaagctagttctcatggtttcgcacgagctttctctttcaggcgggcctttgctgctgatggagttggcgtttctgctgagaggcgttggttctgacgttgtttggatttctaatcagaaaccttcggaacatgatcgggtcgtttacagcttggaaagtaagatgttggacagaggagtgcaggtcctgtctgccaaaggtgaaaatgctatagatacagctcttaaagcagatatggtcattctaaatactgccgtagctgggaagtggctggatgccattctcaaggaaaaagttgcccatgttcttccaaaggttttatggtggattcatgaaatgcgagggcattatttcaaagtggaatatgttaagcacctcccttttgttgcaggtgccatgattgattctcatacaactgcagagtactggaagaataggactagggagcgtttagggattgaaatgcctgaaacatatgttgtacatcttggaaatagcaaggagcttatggaagttgcagaagatagtgtagcaaagagagttcttcgtgagcatgttcgggaatctcttggaggatatgttggtgtcttctgcaccctcttgggcctactctccctttggactgtattgctatcattacccaccgctggaaaaccaaccttgtcctcaagggttatcaacaacatgaaaggtgaaagggttgggtctgtgacctacgccgcagagcagccaaggagaacagtgaatgttggaatgaacaaccaggagctggacggccgtaacaccactgtccccgaagcgcagactcgtgccggtcgtgttggtggtggagatggtggcgggggcgacgacgcgaacaatggcgagaacggtaggtgcaagaaggagcctaatagagacggagtggaggcggcatgctcgagcatgtgtgacttcattacggagcttccatgggaagccgccatggcaagtgatgctgacttgggtgcaggactaggtggcatgatcatgcgtgacttcattacggagcttccatgggaagctgccatggggagtgatgctgacttaggtgcggggcatggaatcggagtcggcataagaaggggagtcagcattgtggcatctgtcgatggtggctgcaccgaagaagaaaacggggaacgttggctggatatcatgcctcgaggcggtcctagcttgatgaggaaaggtcggcttccgccattggaggacggcaaagaaggggaaggtgtttctcgtggtaaagggcaggatctatttcttcgctccttttatgaaagtttgcaactcattcaggagaagaaactccagttgccatttttgcatgctgtgatagtagggagtgatatgaatgctcagacaaagtttgaaatggaacttcgcaaatttgttgttgagaaaaagattcagaatcgtgttcactttgttaacaaaaccctggctgtggctccttacctggctgctattgatgttcttgttcaaaattctcagggaactgcagctggaggcacgatggagattgtggtgaatgggacaaccggtttgctgcatcctgtcgggaaagaaggcgtgacacctctcgccaagaacattgtgaaattggcaagtcatgttgagaagaggctaacaatgggaaagaaagggtatgaaagagtgaaggagagattcctggagcaccatatgtcgcagagaattgcattggttctgaaggaagttttacagaaggctaagcaatag

SEQ ID NO: 9594 - DNA, 1398 bp, Glycine max
  Peptide Sequence Number=SeqID_101279
atgtcgtcgcaacgatcatcatcatctgtgttcgacaacgatcagtctccgacgttgttgacgtcgtctcagcaacccttggccatgccccggttcttgtcgcaaacccaaaaccctggtcaaaccctagaagacgttttttctcgtctctctgtctccgcgtctcccttcaactacccaccttctgatttctccgccggtagctcttacggcgtcaaaaccccctcaaagattcttccttgtaacggttggggtcatggggttaccactcttcaaagttccaatctttggcaccccgcattcacctccaacaattattcttattatgatgatggttttgtcgattccaaacctttggtgaggcaaagagaaaaaacccccacatttggtggaggtgcttttcccgtttttccactctccaatgggatgcaacagaaaacccctgatgatgctggtttcttgtacgggtttttgggtggtaataacgggtccaataatctggggtttagtggcaacgaaaggcgcctccgatggttcaatgatttgcgggggagggttctgttgttggctacggatcaacatgagtgtaggactttgcaggagacaatgagaaaattgactagagaagagttttatatcatcttcttggagctgatcaatcacgtgaccgatttgatggttgatccctttgggaactatgttgttcaaagaatggtggaaatctgcactgaagagcagctgagtcagatcgttttgagcttggctcagtgtaattttcagttggtcagaatttgtctaagtgcgcatggaatccggggtgttgagaaactattggagcgtgttacaacccaagagcaacgagatcttgttttgtcagctctttgccccggtgctgctatattggccaaggatgtgaatggtcatcgggtgcttctgcattgtctaaaacaattctctggagaagacaatgagcaatgcattaaccatgcacagggagaaacaaaacagaagctgcttgatgctatcatattacatgtttcactcttagcagaagactgttacggcaactatgttgtgcaacatttgttgtcgctgaaagtaccaggagttgcagaatctctactcatacagcttaaaggaagatttttctatcttgcctgcaacaaatatgggagtaatgtagtggagaggttcctccaagactcgggtgaaaagcattcgacatctattgttttggagttgctccacaatccaaatgttgcaatgcttcttgtggatccctatggaaattatgtcatcaaatcagcactatcagcatctaaggggcttaggcgtgtttgcggattggattttgaagagcgcccttcaattatgacggcaccatggaatttaccataa

SEQ ID NO: 9595 - DNA, 1392 bp, Glycine max
  Peptide Sequence Number=SeqID_101280
atggatgaggatttttcatttctacaacctctggatcttatcacaaagggcccaagtgaactacacaatatagtgaaagccagaaaggaaaatctacgtcagcataaatttgaatcaaataaaataataaatgacttgagtcaggatgacccaaggagggaggaaactgagaaagagaggaaagaaaaggaaaatgaacacacattggaaaaaattaggttagagaaagataaggagccgccaaagcctgagtataaagaaatacagcacaccgatcaaaaccatacagagaaacctgaagataagattactgtcgaaaatctagaaaatagagcacaaggaggggctgagccaatggagatctcccagagccccatgtcgtcgcctgatgatactccatgtggttatgtaaaacttttgaaaggtcatacatcagaggtttttgcttgtgcatggaatccatcagctccacttcttgcatctgggtctggagattcaacagctcgaatttggaaaattgctgatggagcttgtgactctagtgtgcaaaatgaaccagtaaatgttgtggtgctgcagcacttcaaagaaagcaccaatgaaaaaagcaaggatgtgacaacacttgactggaatctgatatcttttgctatgatttttattacaaagggggatggaacactattggcaactggttcctatgatggccaagcaagaatatggagtagagatggggagttgaattgtacactaaacaagcacagaggtccaatcttttctctaaagtggaacaagaagggggattatcttcttagtggaagtgtggataagactgctattgtatggaatataaagactgtggaatggaaacaactatttgaatttcacaccggcccaactcttgatgttgattggcgaaacaatgtttcatttgctacatgctccactgataaaatgatacatgtttgcaaaattggagagaatagaccaatcaaaactttctcagggcatcaggatgaagttaatgccattaaatgggacccatcaggttctttgctggcttcctgctccgacgatcacactgcaaaaatatggagtctaaagcaggacaactttttgcatgatttgaaggaacatgtcaaggggatatatacaatccgatggagccctacaggccctggtaccaacagtcccaatcagcagctagtactagcaagtgcctcattcgactcaacaataaagctctgggatgtggaactagggaatgtactctacagcttaaatggccacagggcaacttctcagtccacatctgctagtgcagataactttagggaagaactggcttggagaaggaaacctggtggagtgaagcaggaagacgaagaatga

SEQ ID NO: 9596 - DNA, 936 bp, Glycine max
  Peptide Sequence Number=SeqID_101281
atgagcaaggttggacaaagaggtgttctatctgagaatatgccttgcttgttgttgttgttgctatttctgattcaagcatggccagtgaagccacaacaagcctacgataggaacatattcatattagcgggtcagagcaacatggcgggtcggggcggcgtagtgaacaacaccgccacgtgggacggcgtcgtttcaccccagtcccgtcccaacccttcagtcttgaagctcgacgcgcaccttacgtgggtggcggcgcgtgaacctctcgacgcggacatcgattctgcgaagacaaatggtgtcggaccaggaatggcatttgcaaactgggtgttggagaagcacccagagtttggtctgattggtttggtcccttgcgcgattggaggcagcaacataagcgagtgggaacgaggaaaagagctttacaatcagatgataaagagggccaaggcatcgctgcgtgacggtggcaccattcgggctttgctatggtaccaaggagaaaccgatacagtgaatttacacgatgcgcagttgtaccaaacaagagttcacaagttcttcttggacgttcgtgatgatctacggtctccgttgcttcctataatccaggtagctttggcatccggatcaggcccatacatagagatggtaagacaagctcagctgggcattgacctcctaaacctgagaactgtggacgctcatgggttgccccttcagcccgatgggctgcatctttcgaccccggcccaggtgcatcttgggcagatgatggccgatgcattccttcagttcgtaccttcttcaaatccaaattacaatgttagcccaattcttaatgaggcaatcaggctgtataattatgccttttatgttaatatgcttcccttgttctcaactatgtacccaacattcttatag

SEQ ID NO: 9597 - DNA, 384 bp, Glycine max
  Peptide Sequence Number=SeqID_101282
atgtggccaaagtgggctcctgggcttcacacgtcaactttgagagtgacctttgtcaagaggacaggagggggagcttgcaaaacaaaggactttgacgctcaaataattaactacctgccaatagataaagagattcaaatatattcaaatattgatcgattagagataacctgtcagtgctatgtagggtgtgatgaggacaaggcaatgactaagggcaaaaaacctttagaaggacttggaggacctatgacaatggctagaacaaagaaggccaaggaagctcttcaacaagtgttaaccatgctatttgaatttaggcccaagttacaagtggagaagtttcggattgtcaattgcatcatgttccaagaagagtag

SEQ ID NO: 9598 - DNA, 433 bp, Glycine max
  Peptide Sequence Number=SeqID_101283
gccggccttggatccactcggttggggtggtcccgtcaacgctgcaccagaaattaaagtttgtagtggaagggcaactggttatagtatcgggggaggaagacatattgaggagtcattggaaacatcattccaagcactggaaattgtgagtagtgcttatgtggaatctcctctggttgaaacggggatggcacgacaagcttggtggagttcgttgagaatcatggaaggttcgggttgggctatgagccttcacattccaaaaagaggagggttgccttcgaaaggaaggagagaagcctggcctatctacaaggacatggactacaagtggaaagggatggatgcgcaaggattaggttgcggtgatagacgaaggaacccctcaagactgaccaaattgggtgcagccatgtcctcctggctttga

SEQ ID NO: 9599 - DNA, 297 bp, Glycine max
  Peptide Sequence Number=SeqID_101284
atggcccgagttatgttggggaacggttacgaacccggaatgggtttaggcaaagacaacggcggcataactagcctgataaattgccaaaagaaatcgtgggaactgggaaattggcgaatggaggaacgccccgacatttacgcaacgagcataatatccgatgacgagttccccgaaggtactaatacctgggacccgcctatcaacttcgagcaagaaacgaatcaaatggaagatgaagggaacgaggatgtgggacttccccccagaattagaaaggatggtcgcccatga

SEQ ID NO: 9600 - DNA, 168 bp, Glycine max
  Peptide Sequence Number=SeqID_101285
atggcagcccaagaagaagaagaagaagaagaagaagaagaagaagaagaagaagaagaatctgatgatgaagaagacttctcactctttgtgaagaagtttcataaattcgtcaaaaatagaagaatggagagaagccataacttcaaaaatgggaaaagatcctaa

SEQ ID NO: 9601 - DNA, 300 bp, Glycine max
  Peptide Sequence Number=SeqID_101286
atgtcagccagtgatcatgccattccgagggatagaacccatcaacccacaaagaagagcctattggagctaacatcacacgatgctttgttggcacataacaagttgctatctaagcaacttgagatcctaacagaaacacttggttgtaccatgtgtggtgaagctcatgagacaggccaatgcatccctattgaagaaaacactcaagaaattcatttcatggggaatcaacaaaggaaagtgatggaagcttgcttgtggagcttctatggaggatggatctttgagcttcaatga

SEQ ID NO: 9602 - DNA, 435 bp, Glycine max
  Peptide Sequence Number=SeqID_101287
atgtgggatactctccaattaacccatgaaggaaccacagatgtaaaaaggaacacgagatggaacttcaacgccttaatcagaatgaagaaaatgacaaaaaagaagagaagtatagcccttaaagcctcatcatcaaaattcatcaagaaaagaagaattgacaggcgtcagaatttcaataatggaagaaaattacaagatgattctcaagttcttaggtgttacaaatgcaaccaaattggtcacatcaaggccaattgtccttcaaatgaagaatggtcagagaaaagtgagaagaaaagatttgatgaaagaagaactaagaaagcctacattgcatgggatgacaatgattcatccgattgtttagaaaaggagattaatcttctaaccaaagattatgaaaatgatgagaacatctctcaagaatga

SEQ ID NO: 9603 - DNA, 243 bp, Glycine max
  Peptide Sequence Number=SeqID_101288
atgcctaaatcatctcccaacatgcatgtgaagcaagaagtatcaacaagagtcaagccaaggctattgtgcaagcaatcaatggggcaaaacacaccaaataaaatagatgatgatggctcaaattctcaccaagggaagggaccagtcactagagccatgagcaagaggctccaagaggattgggctagagctgttgaagatggccctagggttattatgaaccttagggtagatttctga

SEQ ID NO: 9604 - DNA, 711 bp, Glycine max
  Peptide Sequence Number=SeqID_101289
atggacatgaacctggggtacctcatctcccaccagatctctctgattgcacagcatgacacatccaaactaggattccctgccttgatcataactttatgtaagggtaggggagttcagtcagattcgaggtatttagagagcctgagtcctgccattaatttggcatatattaagaagaactgttggaatcttgatgatccaacagtaaacttcggaggacccaggaaggccaaggaggcaccagcaccttcttcttcttcagtacccccctcttcatccactcagattctagttattcctcctacaccgatacagatgccacttctacctcctctatctgcaggaccatcagatttcatttttacaccacagatgcttcactccatgcttcagagtatccatagggggcagtccattattatgcagagccttcaaggcttaggcttgccctccattatcagcatggaggagtttgatgctcaggaggcctggataggagaccagccttcttcttctagagggggtggggcctctacatcccaagagcctaatattgaggagccactagcactagcaccagcaccagcaaagggggaggatgagctcacccctcctgagcctttttactttgacactgatgtgcacatggctcaggaagagggtacctccacaaatcagatacctgagccatcctctgcacctccttag

SEQ ID NO: 9605 - DNA, 381 bp, Glycine max
  Peptide Sequence Number=SeqID_101290
atgggggcattgcatgatgtggagacgtgtccaatggaggaagagttgctagagggaatgatgaacaggggccaaattgaagtttgcaatgcgaagaaaggggatggggatccctttacagttaagaagcctgcgcccttcccttataaaagtgataaggcggtgccatggaagtacgccgcacaagggccagacgaaaggaaggacgtgtctgtcatacatgttaaggatgatctgctgtcgcaacctacccttcggcgggagggcgacgcggggctcgcaggtgggtcttccatgggaggaaaatgcgcggagtcgccaccaacgtttattcgaggaaaacatcggaaaaaccggaaaggtgtggtctacgaactttaa

SEQ ID NO: 9606 - DNA, 684 bp, Glycine max
  Peptide Sequence Number=SeqID_101291
atgtggcgtcttaacaaacataatggtcgacaatccattgagatggtgttgatggaccatacgggtacaaagattggggcaactctatggcaagaattgttccctgaatttgaacccaagttgcgttgtggtggtgcatatgttattcagaacatgaaggttgttgatactcattctgactacaaagtgaatgcaattaaatatttggtttattttgtgaagacaacgtctgtcaaagaggtggacagacctgagattcctcctaatgttcatgccattacttcatttgctgatataatttcaggcgttgcaaaacctgatactttagttgtgattgaacgcaaaacagttaattcagcatatagagtgactgtcaagttgagagacaacagtcatgttgagatcatcatgactgtgtgggaggaatatgctcttcagctggatgatgctattgagcaaaaccattttgtgcaaaagctattggttgttatgctaactcttgctaagattaaagaacccaaggacaagtatcccctcagtgtacagaatataaagcatggttcgaagttgtatgtgaatggtgacattgtagaaatccaacaattccatgatagtttacgtgtgccattttatattggcggtctagatgatgagggcggtgtttctcagtcacagtctacctag

SEQ ID NO: 9607 - DNA, 477 bp, Glycine max
  Peptide Sequence Number=SeqID_101292
atggaagatgcagaagaaccagctcatgtagtcactggaacacgcccctggcacaacgcacacctcacctgttggaacgatatgatcctcatagtgcatccacatgtcatgtatatcatcatacgagacccacgaatcgacaggaggagcaggaatgatctgcgtgtatcgaaattgtcacacgaccctctctggttggtaataaacagcaacaggcccccagcgcgagagaccggaatagcacgatctgatgtggaagtttcggacctcccggtgctccccataagggatccaacaaacatccgaaatccggagtcggtccaggcgctccctgtacgccgatgtacgaatgctcttcacggtctttttggtcgcaatccacctacacgcacgcggagaatcctcttcgtacttctgatcaacaatggagtccgcgaccgacggaaagtgcttgtaaatctagcactacaaatgtaa

SEQ ID NO: 9608 - DNA, 512 bp, Glycine max
  Peptide Sequence Number=SeqID_101293
atgactagaggcaatccaggtgacttccaaccctttgatcctgatatagataggacatttcatatattagttaggcatagtgtgcatcttgattatcctgaacattttgtaccttttgagcatcctgagcattctgttattggtgagtctgagcattctgtggttggtgattttgaacatcctgattttgagcattctaaaaatatggctcaacctccacctcgtgagtggcctctaagggaaatggctgcacttgatttcacttatgaaagcttgtgcattcaataccctgatgaggatatcccatatgtccttaaaactggactgatccacttgttgcccaagtttcatggtcttgcaggtgaagaccctcataaacatctgaaagaattccatattgtctgctccaccatgaaacctccaaatgtccaagaagatcacatctttctgaaggcctttcctcattctttagagggagtggcaaaggactggctatattaccttgctccaag

SEQ ID NO: 9609 - DNA, 368 bp, Glycine max
  Peptide Sequence Number=SeqID_101294
ataatgtattggggagaaacatcttgacagagaggaaggtggagatctaccacactgagtttgatgattttaaggctgagttggagaggcatagtctccataaacacctcaccaatttggttgatgggagcatagatgtgtcttcggtgaaagagttctacgcaaacctatacaactctgaaggtccttcaccaaagcaagccagggtcagaggccatctagtgaagatcgacgctgacaacctcaacacattcctagagacacctatggtgttggcagagggtgagactttgcccacatactccagatactgcaggctgccttcagatcctagggagattgaggctaccctatgcagaccaggctga

SEQ ID NO: 9610 - DNA, 120 bp, Glycine max
  Peptide Sequence Number=SeqID_101295
atgccacttcaagtagaagatgagtctagaacaagctcaccaccaaaggaagccatggataggagcttgaagcccactaatccaagatcaagtccaagattctcccctaagtgtgcttag

SEQ ID NO: 9611 - DNA, 237 bp, Glycine max
  Peptide Sequence Number=SeqID_101296
atgaaaactaggttgcctcccaggaagcacttctttaacgtcattagcttgacgcatttacctcaatgggtgatctcatgttttggatcttacctgcagaacctcttgatccacctccattacctgttaattaggcaagctttgaaaagttttgtttttcaccttctcgctaagccaatctactggcttagcgagcatccgctaagccaatctgctggcttagcgagcatccgctaa

SEQ ID NO: 9612 - DNA, 324 bp, Glycine max
  Peptide Sequence Number=SeqID_101297
atgaggaacagggccgacgggttcgacgaggaggccattgcccagctgttatgcacactggggcaggattttgctcggaccactgcaaggaggttggtgcggatcatgcgcaccaacatgaccactttgacccagacgtggatgacactgctgcttaccaatgtcttgcctagcgatcataactccgatctcccactgcctaagtgccaattggtgcatgccatcctgacacggatgagcgtccatgtggcccaggtatgccacccaccaggcaccctctggacccggataagtctaacagggccctgtggtttttggctctga

SEQ ID NO: 9613 - DNA, 429 bp, Glycine max
  Peptide Sequence Number=SeqID_101298
atgaagaatattttagattcgggagttgtatttacgtttgaggaaggaggtccttttaaggcaagaacaaatgaaggccgatatggtggccttgaaagaccaaatggcttccaagatggaagccatgctaagcatggaaagactaatagaaagcaacgcaaccacggctaccgccgccaaggcagacactactcacccctctaccacgaatcaagcgcatcaacccgcccggacatggggggacgaggaggagagatactggggagcaccgacggcccgcatctggggtataacagaaatgcctatccctacggcttaccccccgatttcacactacccaccatgcacgagaacatggatcatgccattcccataaccttcaaaggtcagcttccccagcccatagggggcgcccgcgaagagtcataa

SEQ ID NO: 9614 - DNA, 185 bp, Glycine max
  Peptide Sequence Number=SeqID_101299
gaaatggtgctgaaaaagcttccagccaagaggtccaagaaagatgccactggagagggttccagtgcggccccaaaaggaagatgtggactttgatagacataggtttcggagtgaggaacaccaccggcgatttgaggccattaaaggccggtcattcctcaaggagagatgagtccagctga

SEQ ID NO: 9615 - DNA, 414 bp, Glycine max
  Peptide Sequence Number=SeqID_101300
atggagttctatgcaaacgcttggcccactgaagaaggagtcatggataagcgttcctgggtgcggggccaatggatcccatatgatgatgatgctatcaaccaattcctggggcatctgttgatcttagaagagggacaatgttgtgaatacactgaaagaagaatccaagtctcaggttttgatgaagaggccataggccagctactatgctccctaggacatgattttgcatggagcgtgatagggaggtgcatggggatcatgcgcactagcatgaccactttgacccagatctggatgacacttctgcttagcaacatccttcccagtgaccataattctgatctcccgctgcctaaatgccaattggtctacgctatcctgacccagaacagtgttcatgtagcataa

SEQ ID NO: 9616 - DNA, 180 bp, Glycine max
  Peptide Sequence Number=SeqID_101301
atggaagcggaatggataaggaagaaagatgattggagatgtcacttcatggagaagatgaggcaagaacaagctcaccaccataggaagccatggctatggttcagcccactaatccaagatcaagtcaaagattctccacaaagtgtgcttaggtgtcatgaggcatataaagcatga

SEQ ID NO: 9617 - DNA, 243 bp, Glycine max
  Peptide Sequence Number=SeqID_101302
atggcctcctcgaatcccttgtttcctgaaggaaattctattcacagaccacccattttcaatggtgagggttaccattattggaaaacccgcatgcaaatattcattgaagccatagatctaaatatatgggaagcaatagaattaggaccacatatacccactatagtagatgtaagcacaagtacttcaacccaaaaacctagagaccagtgtacagaagaagataggagaaaaatctag

SEQ ID NO: 9618 - DNA, 603 bp, Glycine max
  misc_feature (19)..(19): n is a, c, g, or t
  Peptide Sequence Number=SeqID_101303
atggtgacattgttatttntgagagatagagcccacattcctactacaaaatgtttattggagctaacctcccaagatgcattgttggcacaaaacaagttgctatctaagcaacttgaggcattgactgaaacactaagatgtaccatctgtgagggagctcatgaatctagatgttgtatccctattaaagaacaaaccactcatgaagtcaattacatgggaaatcaatccataaaaaaatttaatgtaggaggattttctggattcccacatggccagcaatacaatcaacagcagggacaatggaggaaccaccctggaaatcaattcaatagagatcaaggtggaccatctataaggccacaacaacaagggcctagtctctatgatcacacaacgaagctggaagagactctaactcagttcatgcaggtttctatgtccaaccagaagagcacagagtctgccataaagaatctagaggtccaagtgggacagcttgcaaagcaattggtggatagatcatcaagcagttttacagctaatacaaagaaaaatccaaaggaagaatgtaaagatgtgattactgtcataccctaa

SEQ ID NO: 9619 - DNA, 600 bp, Glycine max
  Peptide Sequence Number=SeqID_101304
atggcaagagtatcgaaagtagtcaaaatcttggtgcaagaattggaccgagtgaagcaaaacaaaaatggggtggttaggataccaaggaagtgcttggaggagaaggcaaaagttttggcagatcaaggagaatggactttatttgtcctctttccaaatgtagatggactagtggatctagcgacgatcgatgcttttcttgcttattaccaaagcaaggaaagcctggtcattgctgttttggccgatgcctatgacacgtttgaccagagatgcgagaagagcagtgtgagaattgtttgttgcacacccactctttatgtatggctggtctcccaccttttttgtcatgaaagtaggcccgtctgtcccctacaaggtcatcgcatgtgtgtcgagaaagggaaagcaaattgggaagaactcttggcagggttccaaaacttccccttgatgggaacaaggggttgtattaattataatcctatactggccataagacaactaggttaccctatgagaggggtgccatcgaaagagattatcgcgccttttatcgcatggggtttcagtgaaggcaatgcaaaaatgctttaa

SEQ ID NO: 9620 - DNA, 246 bp, Glycine max
  Peptide Sequence Number=SeqID_101305
agtccggtagcatgcgaagacaacttacggttatctgcacctcgtcattcggagaccccaagtccgattgacaagcagaggccaatgtggtcatctgcaccctttccagagaggtcagcatcttccgctctagcttctcatctcaaggaggtgagcttagctattagagagcttctcaaggaagttttctcaaagaagcttctcaaggaagttttctcaagaaagcttctcaaggaagctacctag

SEQ ID NO: 9621 - DNA, 324 bp, Glycine max
  misc_feature (308)..(308): n is a, c, g, or t
  Peptide Sequence Number=SeqID_101306
atgaccaagaatagggtgttgaaagagcataataagactatcctaaattggtttaaagatacaatctttggtaacgataatgcttcagaaacgtcaagaaagttagcagatgggcctaaaagaaatatccttatgatgaaaggtggtcagtggttctacacagaaaaaataattgatgttaatgttgaagatgatgattcaactgttgatacttgtcttcatcctttctccacacaaatgttgcctaacatcaacagagaagaagaagttgatgacgtccatgcaaattgtaataatcatgatgaagngaaggggatcctctag

SEQ ID NO: 9622 - DNA, 279 bp, Glycine max
  Peptide Sequence Number=SeqID_101307
atgtcattgcctagtgctattcatgtgttctccattatcaagtgcgaagcttctggtgactgggaagcatgttattctgttgttttccagatcggttccttcgccaaaagaaaaaagaaggagtggagacgagagtcgtcatcacagaaagggcaggacggacgaaatcaatgtcctatctgtcgcaacctacccttcggcgggagggcgaagcgtgactcgcgggatgcgtgttccacaaaaggaatacgcgcggagtcgccaccaacgtttatttga

SEQ ID NO: 9623 - DNA, 502 bp, Glycine max
  Peptide Sequence Number=SeqID_101308
atgtatgaatatcctaggagaacccgaacattaacgcgtaagcattcctttcaaaattcatatggatattcatgctttgttggaaaaagggaaatgggtcccaagattctctccacgaacagacatagaagagacgccacaggagaagggtctagtgccacccccaagtttggtagtcatcgtttccggagtgccgagcaccaacagcgcttcgaggccatcagaggatggtcattccacagggaaaggcatgttcagctcagggaggatgagtatacggactttcaggaggagacagctcgcagacgttggacgccgctggtgactcctatggccaagtttgaccctgagatagtcctagagttctatgttaatgcttggcccacagaggaaggagtgcaagacatgcgttcgtgggtgaggggtcagtggattccctttgacgcagatgcccttatccagttcctttgtgactcgctagttttggaggaagggcagcagt

SEQ ID NO: 9624 - DNA, 216 bp, Glycine max
  Peptide Sequence Number=SeqID_101309
atggaaaattctgacaagatgaatttcaaagagaagaaagaaaagaaaggatacatcacttgggaagataatgtcataaattattcaagtgattcagagaagaaaatcataagtccagacaacaaacgaaggccacatttctccccaagaaaagtgaatatgcgatttatggagacaacaaacaaaggccacttgatcaacaaccccaacaagtaa

SEQ ID NO: 9625 - DNA, 466 bp, Glycine max
  Peptide Sequence Number=SeqID_101310
gccactcagtcgagtagtgcttcgccttgaagaacaaggtccagagtttgatagaagccggatggttgacgtcgcaggggcccaaacttttgaaggacgtaacgacctccagaaggtttatctacaaagccttgcaaaaggcgggcgtgattccctacgggacacagctccccaaagacctcaacacccctcggcagtatcaggtgctaggcctatgtcgtttccttacgagaatagccacgcagtgccgtggaggtatgcccctccgggcggaaggaaggaagaagctaccaatattagtttactatcggccaaagtgaccaatatcactgggctaagtggcataacccgcagcggtcgtgtattcgcaccccctagcctgccgatacagtccgtgaactttaaagggaaagcaaagatgaccgaaggacaaaatgtcaaggtgatccccgcgccgaacgaggat

SEQ ID NO: 9626 - DNA, 219 bp, Glycine max
  Peptide Sequence Number=SeqID_101311
atggataaacctcctgcaaactgtatgagatcctctttgagtgagtttcaggtcatcaaagcttttaacatcaatattcatgcacccaaggctgctgaactggagggagttgttttggctatttctatagctcattccaaaggttggggcaagctttggctagaggtggattctcttttagtcctcaaggctttcaatgttatcagtgtggctccttag

SEQ ID NO: 9627 - DNA, 361 bp, Glycine max
  Peptide Sequence Number=SeqID_101312
atgtatgaataccttgaagaggaaagagcccctgatcttgagagtattttggcagacttcatgacataccaagctagctctaaagggtcatgttatggaatgcaacagcagggaactcagtttcaaaggaaccagttttctacaggctatcaatgggagtcattctggcaaccaaattatcacgataaaacagaaggagttcttaatctggatgatctgttaatgcaattcaaagatacagtagagtcaatgcaacaagcctttagaagaattgcaactaagattagtaagttggtggatgacatggctagtgctgcggccaaacaagaggaagagcgtgcaaagattgaaactgataaag

SEQ ID NO: 9628 - DNA, 126 bp, Glycine max
  Peptide Sequence Number=SeqID_101313
atggataagagcttgaaggtaggagaagatgagtggagggaggagagaaggagcacaaaattttatgcctcaaaagagcctactaatccaagatcaggtccaagattctccactaagtgtgcttag

SEQ ID NO: 9629 - DNA, 114 bp, Glycine max
  Peptide Sequence Number=SeqID_101314
atggtagaggcctctggtaatcgattaccagcctgtgtaatcgattacacagaggaatgggtcactggtaatcgattaccagtggttatgagacgcatttgtgcggcggcatag

SEQ ID NO: 9630 - DNA, 377 bp, Glycine max
  Peptide Sequence Number=SeqID_101315
gccagttcctgggataccctttagtgctggaagagggccaggagtgcgagtacggccagaggaggaaccggtccgatgggttcgatgaggaggccatcgcccagttgctatgtataccggggcaggattttgcccagattgctgtcgggagacgggtgcagatcatgcgcaccaacatgaccaccctgactcagatctggatgactttgctgctcagcaacatccagcccagcgaccataattccgacctccccctgccgaagtgtatggcgcctaccaggcaccctctggacccagataagtccaacagggccctgggttttcccgccttgatcacaggactctgccagtcgttcggagtcccctgtcgcacctag

SEQ ID NO: 9631 - DNA, 147 bp, Glycine max
  Peptide Sequence Number=SeqID_101316
atgcttgggttgtgggtgtgggtgtttgacgcagtgcttgtggttgtgtgggtgtgggtgtttgacgcggtgcttgtggttgtgtgggtgtgggtgtttgacgcggtgcttgtggttggtggtgtttggtgtgggcttggccgctag

SEQ ID NO: 9632 - DNA, 180 bp, Glycine max
  misc_feature (16)..(16): n is a, c, g, or t
  Peptide Sequence Number=SeqID_101317
atgaatgtgagtttcnttgagagagctctggaggagttggacaaaaatgaatctaaaattgttgataaacttgtatacaaagaacaagaggtttcagttttagtaaagcttggtcacctagaagaaggagaagctttgtaccgggcattactttccatgaatcctgataattataggtga

SEQ ID NO: 9633 - DNA, 353 bp, Glycine max
  Peptide Sequence Number=SeqID_101318
gatgtcatctattgtttgcaaggatcacgctcgtaagacacccagtggacccgaagaagtccaacagggtcctggggtttccagctttgattacgggcctctatcagttctacggagtgcccatttcccccagcaaggtcatcaggcttcctactaaccaagctttcatcaagaagtactgcgcccccaggcaggcaaagggtgagacaccacagcagcctggggatggccagcagcgggcaacagacgcaccgtcgccacctccagagcctttcagctcatctacaaaggctggagcgttgcctatgacccatggccgaccagcaggcgaccaagtccaaagccaaaggtag

SEQ ID NO: 9634 - DNA, 777 bp, Glycine max
  Peptide Sequence Number=SeqID_101319
atggtagaggtctccacggaggccattgcctccctcgcccaatattatgaccagcctttgaggtgcttcacctttggggacttccagttaacacccacggtggaagagtttgaagagatcctgggatgctctctaggaggaaggaaaccatacctcttctcgggattttatccctccttagctagaatttctaagatagtcaaaatctcgacacaagaattagaccgcggaaagaaagtcgaaaatggggtggttggggtaccaaggaaatgtttggaagcaaaggcgagagtcttggcaactcaaggcgaatgggccccgttcatggacatcctggcacttttgatcttcggggtggtcctctttcccaatgtggatgggttggtggatcgggcagcgattgatgcttttctcgccttttatgaccgcaaagacagcccggttgccgctatcttagccgatctatatgacacattcgaccaaagatatgagaagaacaatgcaaggatcgtttgctcaaacaaagaaggagtgtctgtcaattggttcccccgatggaaagaaggaagaaccgggattcttatttcgtgtgggaaatttccaaatgtttccttgatggggacgaagggttgcatcaattacaatcccgtcctcgctataagacaacttggttaccctatgagaggggcgccatcagaggaaggcctcataccttttattacacgaggtttcaatagaaccaatgcgggggtgcttcagagggtccacaaggcatag

SEQ ID NO: 9635 - DNA, 519 bp, Glycine max
  Peptide Sequence Number=SeqID_101320
atgccatatgtggaagccgcggaggagtcattggaaacggccttccaatcctttgagatagtaagaattgcctccgtagattccctctctgggcatccttgcctgtccgatacaacaatgatggtggcccgggtaatgttggggtatggctatgagcccgaaatgggtttaggcaagaacaacggcggcagaaccagcctggtaagcaccagaggaaaccgcgggaagtttggattaggctataaacccatgcaagcggacataaggaaaagtgtcgcgaaaaggaagagcagaggccaaagttcgcagttgggtcaacaagtcgaaggggtcctgccctgctacatcagtaggagctttataggtgcgggtctaggacacgaaggccaagtcatcgcgatatgcgaggatgactctccgagtaggtcggatttggtactatcatgccctcctggtttccgactaggaaattggcgagtggaggagcgcccgggcatttatgcgacaagcataatgtaa

SEQ ID NO: 9636 - DNA, 849 bp, Glycine max
  Peptide Sequence Number=SeqID_101321
ctcttcctcgttgcctcctgaagaattgcagcagttgacccagcaaatcagggaccagctagaggagtcgatcacagaaaaagtgactcggcagctcatggcatcgttcagccagatgcaatctcagggacttgcactacctccggagcctctagttggtccctcaggtcctcgagtaagaacaaaggggagttgtgttgatcccttaggaaacgatcctaagacgggtgactcagataggcgcggcttgtacatcgaagcaaatcctacccgcctggttgtcttggggagagtttatgagggatccattgttgttcataacactcctttgttgcctggccaagtaaaggtgggtgtgaaggaggttaaagatccagatgctccagttcctgtacccactaatgaggtttccttagtggggcagacaattcacaccttccttgcttctgtgtctccggcaaaaccacctcaaaagccggatccggaggtcgatgatctgctttatctgatgacattgaccatctcagagcctttcttgaggccttaccaggttacatgggatgccaccatgttcggggtctttaatccagacttcccgctctacataaagctcaaagacctctcggaaatcgcacacggtggtcaatgtctcagcatatcagtgttacagttgtggattctgcatataactgaaacaagtatgcgagtggagaattctgatatctatggattcctcgagccacagtccattcagaggtttaggcaatcacagtttgagactgaaagttacataaagagtttgatgcagagttcaaaacgcgatgtctaccttggagcctacctgaatgg

SEQ ID NO: 9637 - DNA, 147 bp, Glycine max
  Peptide Sequence Number=SeqID_101322
atggtaaaataccgcgccaaatccaagacaggaatgaatcgaggtgctcggggacgggtacgaatggacgctaggcctgtgatcaacagatcgatgtcccgcgtttggcttcggacgatcaagaagcgctactgggaggcagcctag

SEQ ID NO: 9638 - DNA, 108 bp, Glycine max
  Peptide Sequence Number=SeqID_101323
atggaggttgaggaaccttggatggggttatggctaccattgcattatcgagtagatatgggagtggtgtttggtattggatgtgcagcaggtgggctttgtggctga

SEQ ID NO: 9639 - DNA, 546 bp, Glycine max
  Peptide Sequence Number=SeqID_101324
atggataagctccaacgtcaagctttccgcaagacctatgggaaggtttgggatctagctatgatagaagtctttattgaagccattttatccctcactcagtattacgatcagccactaagatgttttacgtttagggactttcagttagtaccaaccgtggaggagtttgaagagatcttgggatgcctgctaggaggaagaaaactatatcttttttctgggttctatccctccatggcgagaatagccaaggtagtcaaaatctcggtgcaagaattggaccgagtaaagcaaaatagaaatggggtggtcagaataccgaggaagcacttagaggagaaggcaaaggctttggtggatcgaggtgaatgggcttcattcattgatgtcttggcgctattggtatttgaggtcatcctctttccaaatatggatgggctagtggacctagcggcgatcgatgccttccttgcttatcaccatagcaaggaaagttcggttgttgctgttttggctgatgcctatgacacatttgaccaatga

SEQ ID NO: 9640 - DNA, 414 bp, Glycine max
  Peptide Sequence Number=SeqID_101325
atggccaataaagagggagtgcaagaacagatgaaggccgacatgtcggccttaaaagatcagatggcttctatcacggaagccatgctaaaaattcaaaaatcaatagaagacaatgctacaacgactgcttccaatacagctagggaagcggaaccagtgctacaacccgcaataaacttgggccgagatagaaacacgacgggtttcaatcggaggtatagtcctcaagcctacccttatggtttgcctccagacttcactccccgtaccgctccagacgatttgagccaagcccctaccttcgaggggcaactccctcctcatgccgactatcctctacaggaagatgatgaaggagatgcccatctaggccctcttcttcccctcaaggaaccgcccccccccccatga

SEQ ID NO: 9641 - DNA, 1238 bp, Glycine max
  Peptide Sequence Number=SeqID_101326
gtgtgccagaagatgcagtgaggcttagcttgttctcattttctttggctggagaagccaagatgcgtcaagctaatgacgttaaagaagcgcttactgggaggcaacccaactctttttcctcttcatgcgctgagcgagtaaccgctcatgctaagcacgccaacccctacccattggctgaagggcaagtcagctcgctaagcacaacccagagtctcgctaagcacatctatgcgctaagcgcaaataactctctgcttggaaccccattttatgaggcttttggtattctggttgcggctaagcgagccatacttgctaagccaccatgcctctattgcttagcgagcctactcgctaagccaattaatgtccagcgatcaagcttagcgagccatgcttgcttagccattgtgctaggtcagctaagcgagggtgtcttgcttagccagggtctctattttcctatagtcgcgctaagcatggcctctaggaagagaaaggcaactgcctttcgacctcagaagccctacgacacaaccagatttatttctgagggcgcctgggaaagatatgagcagaacgttcattcccggaacatccttccagagaggaacattaatttatatgtcacggagtatgatgagttctgccgtgaactcgagaggaggcggtggcataaagccttgacctggcagcctgatggtcacattgatgtggccttggccaaggagcaggttcgagtacgggggaagctgataaagttttatggggacacgctcaacacatttctggagacccccatggttttggagccaggggagcgatacactgcctacaccaggagtgccctggaggctcttaaggaaggatttgactactctggtgtagacctggagcgtcttacgtgggctcgtttatctctggacagatatcacagatggcccagtccaaatcctcccggcttccctgctttgatcatcgctatatgcgttgccagaggagttgttccagactcgttgaccttccagtcccttagccctgccattaatttggcatacatcaggaagcactgttggaacccggatgatcccatgatcacctctccggggacccgtaagactaaggatggggaacctgacacttctactcctactgctccagctcctacacccgcacctacaccagcaccagttcctcctacatcacccaccaccatggcttatgcctggtga

SEQ ID NO: 9642 - DNA, 177 bp, Glycine max
  Peptide Sequence Number=SeqID_101327
atggctacagccaggtgggcactcaagcatcctgtttatggcattgtgatactacggttgggaatttacacagacagatccaacgtttccaagacgacgttcctaaatgaaaaactctacacggttccggaatttcaacaaacactattgacaacaatgaaacaagtaccgatgtaa

SEQ ID NO: 9643 - DNA, 111 bp, Glycine max
  Peptide Sequence Number=SeqID_101328
atggctgcggcaagatacaaaacgttgggtcatgcctctaccgcctcggtttacataaatgctccgtacatgagagtgcccggcaacgctatatggttccctctccatgcg
